United States Patent 8,067,671 (METHODS FOR GENETIC CONTROL OF PLANT PEST INFESTATION AND COMPOSITIONS THEREOF) - sequence listing, part 32

SEQ ID NO: 53750 - DNA, 1596 bp, Heterodera glycines
  Genomic contig location: Contig_ID=SeqID_4247; Location=2127..3722; Strand=-
  SCN-specific regions: Sequence locations=1-225,251-268,290-398,421 -765,794-916,948-1327,1362-1512,1534-1596
atggacacgctggagacggagcaccgtaacattctgttgcaactcggcaatcggaaagtgaacgccattttcctgcgcaatttgccaaatgccgaggaaaatgccaaaatgggcatcagtcggcacacgaacaggtgaaggaaaaagcatggcaaagtgacatttaatagcccaccaatgagaaatctaatgttttccagagaaagccgtgaacagtggatcgtcgccaaatacgtggagaagaaattcgcatcgcagccattgtatcaaatgggtgagtgtgtcaaatgcacatacaatgaaatgaaatgatcatttggatgctacaattatttatttaagtggcttaacaatgagacactcagaaatcagtaatttgtcttaaaatatcccactcaaaaaatccttaaaatttcaaatatatagcctagaaaagtgacaatgacagaacctaaagtggatgatcgtattactgttgtaccccgaactgatcagacattggataagtgttgatatggttttgaagaatcacctttgggacttacactatcgccctttccgcccattgtcatgatttgattggctaattaaaaatcgcatcactcacaatcagtgaacctccccccgataaaactgtcttcatttctccccctttttcagcttattctcgctcggtcactgcactgaataaaaatgaaagggaaggcggcggcagtgatggaggacaaacgggtgcaacagcacaacactcaacagaaacgaacccatcatcagcagcagcaacaacaagcactacggtcaaactgaggcataccgtactgcttgacgacgccgccgttaccgatgcgttgtcggttgacgacaacttttatggtaaaactcagaaatgcaaacagtttattcattctcgtattacaaataaatgaataaattaattttatatttttcaaatctcacttttccaattctttgatcgtgtttcatccttttttggatcgggatcagtcagattgtttttcaaattactaatgatcaattaaatcctacagcggaaaatcgcctctcccgtgcctcctccttcggctcggactccaatttggtgcaaagcgctcgcgcggcgattgcccaacgggcgtccgcctgttttgcccgcggcgttgttgggcagcagcaccgccgccttgtgaacgcgttgcgcaccgggtgcttggaggaggtggttttctttttgaaatgggccaaaaggctttaccccttttaatttaggtgcttagggcgatgatccaggatggtctcaacctcaacgaggaattgcaactgcacgcaaacacacaacaacagcagcagcagaagcaacaacacgaagatggtggagaggagaggggaagcaactccaaaggaagcggaaacgatgctacagcaacaacaaatgccaacattgaacagtgccatcagcaaaatagaccaaagcagcaacatggtggagcagtaattgcagcaataaggacgacgacaatgacaacaacaataacattaccactgcacattgctgttgaaaatgttcgttttgtttacaacgggaacaaatttacgtga

SEQ ID NO: 53751 - DNA, 1105 bp, Heterodera glycines
  Genomic contig location: Contig_ID=SeqID_23047; Location=98..1202; Strand=+
  SCN-specific regions: Sequence locations=1-173,201-507,529-581,604 -622,644-743,831-867,938-1081,1103-1105
atgcattggatgaattttttggatcgaaaaatgatcagttttataaaaaggggattgaaatgttgcccgaacgatgggggaagatcattgattaaaatggtgagtacatcattgattgaacatttgttttttgtgaaataaaaaattgtttaatgttgaagtgcttaaagggtcagaactttttcatcaacccaatattttaggaccgacgatttttaataaaacatcaaaaaattgacaaattgtcaccagtgccgaagttgcagttcatttttatgtgtgttcgtttcgttgttcattttgtcgtttttccgatgccgtccattccaaaattaaattttggtgctcggcaactcagcgtacttataaaagatttgggaagaaaattgcaaaaattgatcaatgattcaaattatgttgaagaatatgatccgaaaaagagagcagaactgaaatggaagcttgaagaagatctatttttagacggtaaatcgaatataatttacaatttttaactaaattgtattaatattggccgaatggaaattaaatatgccaaaagttcttagtattttcggtggataattttaaaattaaatttttcaaaaaagaaaacctctttcttcctgaaaatttgccaaaatttttgataaaaatttggtgctaaaacaatttaatttaagatactgatgaggataaactgctaagaattttggacgagcttgataaaatgaaaaatgaggaagaaaagaaaaaacatgaattgaaacacaattcggctgaaacaaaaacaaagcaaaaaacaaaaatggaaaagaacagaaaagaaagtgagaaaatgggagcaaaattgaacattttacagagtaattaataataaataaataattttaaataaatgcattattttaaatatatttcattttaattttttttaggacatgcaattcaactaaaaatattagaatttctattgacaagcgatgaattgttccgaataaatcatcgttttgatgaaagggtgacaaagggaaatactttacaacattcataatagcttatgacattttgaattatgggcaaaaagttaatttaaaaactttta

SEQ ID NO: 53752 - DNA, 831 bp, Heterodera glycines
  Genomic contig location: Contig_ID=SeqID_23047; Location=1284..2114; Strand=+
  SCN-specific regions: Sequence locations=1-49,81-104,242-507,548 -577,600-618,665-831
atgctaacaaaagtgtttctgctattccctggcaatgtttctgtgccatttttgttagaaaattttttcctaatttattcaatttggtaatttgaaaagatcggttaaaatataattaattaaataatattttatgaataatttttttaaataaattattaaaatatttctaatggtttatttaaaacttttgatttatttgccatttttaaatttgaatatatttatatttattaattttctatgaatatgaaatgatattttcaaaaaaatgcaggaattggcctttaccattgcaattgactgacattaaacataaaatggcagaccaatttttgagttggtcaacaacgacaatttctgctgaattgactaaaaaatatattaatttggaccaaaaaaattctgtggaaatgccaatcattgcaccgatatttcctgaacaaaatgttatgaatctgatcaatgcgagtgatgcgagaaaaattaaaaacgaattttgaatggtaaaatatttaagaaatcaattttttattatttaaataatgcaaaatttttagcatttaaaacaattaggtcaatgaaagaaaatgaagattttgttgcatttttggagggaaaataattgttttttttatgaaaatattttatttataatttaattcgatgctctttttatgaaattgtctaaaatgaaaattttctgaatgagattaaatttcaatgctctgataaaatgtgataagacaatttattcattaaatcccaaaagcaaaaatgtaaaaaaaaaattgaatgattaatattttgaatgtcatacacacaaaaaaa

SEQ ID NO: 53753 - DNA, 982 bp, Heterodera glycines
  Genomic contig location: Contig_ID=SeqID_23048; Location=331..1312; Strand=+
  SCN-specific regions: Sequence locations=1-651,673-836,913-959
atggttataacaatgactactaaaatttatatgattgagtaaacatttccgtctttagggtggcattggctgtgccgtgctcgcctcgcttggccttgtgccaaccggtttcggcgctccgcttctgaactcgtcgcttttacttccgttggacggcggaggctccgccacaagcgcaacaatcacaccacgaaatgccaattcggacagaagaagcaatgagaatatgagcgacattttgccaacatttcaaatggtcagtgccaacaatggacaatttcctaatgcaaaaacaaatgacaatttgccatcagttggaaatgcatccgactcagcctttgtaccgtttggtttggatgtcaatgaagcgcaagttgcgcaagccggactatctgccaggtattgggggtgatcaatgattagaatgtctgatcaacagaaatgataaaaatgccatgtggtgaccagaatgcctgatcaggagaaattatagaattccatgttgatccatgcctgatcagcagaaatttaaaaaatgccaccatcagcaaataatgccatcagtgatttttagcagcttttgaataaataccatctcattttgacgtgacttatcagttgatcactctcggacccttttaagcattcccgcccccctatttttctcctttaatttttaatttggctaatttcccaattttcagctcgcatcgattggtacgcccgcgtttggatgcccattggttttgcggtgttcaatgtgtgctattggagcgtttgtctgaccatggcttccaaccaaatatccgacaaaagaaattgatgacaacacagaattaattctttttttattttaaatattgccaatttattttattttccaattattatattttatgttttatttttattagtcgtaggatttatcaaagaaatgtatgtaaaaacggtttaatacatatcatatgtacatatttataaa

SEQ ID NO: 53754 - DNA, 877 bp, Heterodera glycines
  Genomic contig location: Contig_ID=SeqID_23051; Location=50..926; Strand=+
  SCN-specific regions: Sequence locations=1-190,212-227,249-495,521 -523,545-658,680-848,873-877
atgaaattaactgaatatgcattatcggacgcattgaataacaatgaagtgaagaaaatttattttggcgaagaaattctcgaagctttggcaagtttcgatgctgacaaacgccgggcatacattttgatggaaaaattacggccgatgtctgtgaaggtaaagtcgggaaaatgcatcaattgtgagcttaaaaagtctcagtttcaattttcaaattcttaaaataattttataaattcatttatgcaaattcagaatcacattatttgggcagaggacggagaagaaagcagtggagaagactttttagaagacgtgaccccggaattgggaatttttggcactttgctcggcaacattgtcaacggtgaagtattgtacaatgcgcaatttggccatcagctgaagaccaaattggccagcgaaaatgcgcgtggcataacaactggaaattgtgcttttgatacggcatatttggtggactgattttttgaagggaaaaaggagaaaggaaggatgaagaaattaggataaatataaagcattcattgtttgatatataatcaaaatgtttcactttgataaaccaaataagctctttcttctttggactttataaaaagtcagaaaattattaattttaagtttgttatgaaatatttcttgttacttcttttctaaattatcaaaattgtttacaaacaatttttgatttagcgagattttagcacctaaaaacatctaaaacgggggttagcatctgttttggcattttcaaattttagaacctattttggtattttccagatgattttttttgacgcaatgaaatttttagcgacgtgtttaaaataattacaaaaattttagacaa

SEQ ID NO: 53755 - DNA, 1878 bp, Heterodera glycines
  Genomic contig location: Contig_ID=SeqID_23053; Location=30..1907; Strand=-
  SCN-specific regions: Sequence locations=1-252,276-555,578-579,601 -611,642-815,852-861,895-909,932-976,1012-1532,1554-1634,1656-1878
atggccactgtcgccttgaaaattcgacatctttccgacgaaatgggcttacagcggtaagggcaactcatcgtccacatcataattaatttgttaaaataaaaaaaagaaaatgcaaaaaattatgcatttaataatcattaaaagagtaattattatacaaaattggtatgccatgcactgtaaatgttcatttcgttttttgattattatattgtatgtttctttccccaactcttagcttaataattatttgtaaatttttgttttattaagatacagcaatcgggtgttaatcgttgaggacatcgaactcgatggtggcaggtggtcatttatcgaaaattgttcggaagcaaactgtgtggtatgtgtaatgattaggtccgggaccgaaaaatggtcaattttgcatttttagggcccttttttaggcccaatttttttaattaggaggtggtttgtgatttgttaacaaattttgcaacaaaaattgccatttttatgcgcgtgatttttgattttttagaaacgaacggaaggatgggggttcttaattttttagttaaaatgttaagttaaaatttttggaaatagaaactctgtccttcaaaaaaaatatatttttaagatttttaaatcagcaattaattaaaacagaaaaatattataggtctcatgacgaagaacagaatctgagagattttgtgtgttggaggagcgcgagcgtgatacgcgattcgcgtcatttttttccgcgattcgcgactgcggcaatttgaatccacgatccgcggaatttgggactccgcggcaatttttgataaaatttcaaaaataaattttttattgaagcgattgttttatatatttaaattatttaaaagtaaatttctgtttatgaaaatcaaagagatttgcaaaatgcaaatatccttcaaaattccaatttccccagtcggcgccgaccaaaatctttaattttcttttaaaaataacaaaaaaaaaattggaaattttgagtttttaatgcgcgaccgcgatgcgcgactgccggatttatttttgtgcgatccgcgaccacggcaaattgtatttttaggttttacctatttttctgagctccccatggccaaaaaaagtgttttttcgtcgaattaaagccgcagaaaaactaagtaaaaaccaaaaacacgatccctaataaatacaaatttaaatgtttgggtaatttaaggtgttacgagccgtccgtggtgtgcatgttgtgatcacgcgatttgattttgaacaagataccaaccgtgcccagcgttcaaacgaatggtttagtcgaaacaagggcgaaatcagcaatgcaattatgtaaggcaagggagggataaaaagtgcaaatcggaccgatggctaaaaatgcaaattttgcgatgaaaaaaagcaaaatttagcaaatttgcactttttccatcgccaaatttgcactttttgttcatttgcgaaactgggttttatcagacctttcgcgcattcgaactcaaaaagttaattttctgccaaattctcagcaattggcacgcaagcaacaaagacctgcccacggttttcagcgaagttaattgggctttgcacaaccaactgagcaatttttccctttatcgaaactttgttttgattcgccgagaaaaatggctttcgagtagttgcttaatcgacacggcaaattccacagtgcccattcgcggaacgcatccgactgaaaacatggccaccgcactcattaacccatttcttttcgacgcgtactgctatgccctgtttttgttcttatgaagaatggattggtgtgaggagcgagacgaagaaggattattgaataaa

SEQ ID NO: 53756 - DNA, 296 bp, Heterodera glycines
  Genomic contig location: Contig_ID=SeqID_4248; Location=207..502; Strand=+
  SCN-specific regions: Sequence locations=1-275
gtccatggtcgcgtgtggagggttcgcccacttctccgaatccgaatattccctttgctaaattggacaataaaccgttattcaatgttgacggccgactaaacccttctctgactatcctcggttccgatgttaatgtgcccagggaaacagtgatactgaacacggtaaattaataataattagcccaacaaattttaagattaaatcgttggaaaattaagtcagctaattttaaggttgtgctgccgtataaggaattgtcggctaattacaagaatcaaattattctctga

SEQ ID NO: 53757 - DNA, 308 bp, Heterodera glycines
  Genomic contig location: Contig_ID=SeqID_4249; Location=607..914; Strand=+
  SCN-specific regions: Sequence locations=1-308
atgccgggcgaacatgccaccggcacattggtgttcttgaacaacgtactgataagtaagtgcgcttttgaggccatggtttaacataaattcacctttcttctagcaatttttcttttttctcccaatttttagaaaaaggtgccaaattcactcttcgagagtctcgtcagcggacggttggctacggcattgtgtccgaattgtacaagccagttttcatcgacactttcaagaagaaagttttcaactttgagaagataatggaaagagcggaagtgatgacagagggaaatgtaacgccatga

SEQ ID NO: 53758 - DNA, 423 bp, Heterodera glycines
  Genomic contig location: Contig_ID=SeqID_4249; Location=1..423; Strand=+
  SCN-specific regions: Sequence locations=1-423
gacattcacgtggttcggcaaaagcacagcgcaggtggacatggaagacaaaactttcaaataaaaaaacggcttaaaaccccaaaaatggcattttgaaaatcttaacaattcacacccaaaacttcaaatttttcccggcgcgcttatcggcaccgccggcttcctgttcccgaaaaatttttcgaaaaagcgcgttgcaaaaaaaagcatgaaaagcaaaaaatattttgtcaggggcgggcccgtgcccttggccctccgcccaaggcaacttaaattatggtcaacatttcctcctttctcatcgattgtcagagttcggccggtgaacacgtcggtctgctgtgtaagaatctatactatgatccaatttcgcgtggtttttggttgacaaagccgggaacagtgacgccaacgaac

SEQ ID NO: 53759 - DNA, 800 bp, Heterodera glycines
  Genomic contig location: Contig_ID=SeqID_4249; Location=2130..2929; Strand=-
  SCN-specific regions: Sequence locations=1-490,527-531,554-800
atgaacagattaattagaatgttctaccaacttgctccactacaattgtgtctctgcgttcgtcctgctcaaacgtttggtcgacaaatgtggtaagatttttgaatgattggctcagaatgctcgtcttcaacggattgagtgcgtctctgaatgaaataaacgattgatcgtttctgatgtagatggcatatgccggtcaatcaatgttcgttcgtgccctttctttccctcatcgtcttccgtccggttggccaaccatctccgcccccccacccgatgccttcacctaatcactgtggcgactgaatcagtgtgtgcttggacacatttgtagacggtctgaacaagtcgcattgcgtacggagcattgggtggcacctttgaagtcaatccattgggaaccccaaaaacattgtattaccctcgaagtgatcacttttcccacatgtcgtgcaaattgctgcgcgttttcaattccttaacaagcaaaaataaataaagtaaatttaaaattaataaatttcagctcaataattcaaaatattcacccaacaattgaaactgttccaattgcgtgtgcaatttgttgcccaactgcggcaacagtttggctgtcttctccggtgccgagtgagcgtccaactgaaggaacagcgcgtccaactccgagacggactcgtccatcacagcattcagttccttctgacacgcgtggacaccgtctggcgaaaagttttttgtttgaaacaacgcacaaaatggtacaaattcattcaattcgtttactaataaagtaa

SEQ ID NO: 53760 - DNA, 803 bp, Heterodera glycines
  Genomic contig location: Contig_ID=SeqID_4250; Location=213..1015; Strand=-
  SCN-specific regions: Sequence locations=1-493,530-534,557-803
atgaacagattaattagaatgttctaccaacttgctccactacaattgtgtctctgcgttcgtcctgctcaaacgtttggtcaacaaatgtggtaagatttttgaatgattggctcagaatgctcgtcttcaacggattgagtgcatctctgaatgaaataaacgattgatcgtttctgatgtagatggcatatgccggtcaatcaatgttcgttcgtgccctttctttccctcatcgtcttccgtccggttggccaaccatcttcgccccccccccactcgatgccttcacctaatcactgtggcgaccgaatcagtgtgtgcttggacacatttgtagacggtctgaacaagtcgcattgcgtacggagcattaggtggcacctttgaagtcaatccattgggaaccccaaaaacattgtattaccctcgaagtgatcacttttcccacatgtcgtgcaaattgctgcgcgttttcaattccttaacaagcaaaaataaataaagtaaatttaaaattaataaatttcagctcaataattcaaaatattcacccaacaattgaaactgttccaattgcgtgtgcaatttgttgcccaactgcggcaacagtttggctgtcttctccggtgccgagtgagcgtccaactgaaggaacaacgcgtccaactccgagacggactcgtccatcacagcattcagttccttctgacacgcgtggacaccgtctggcgaaaagttttttgtttgaaacaacgcacaaaatagtacaaattcattcaattcgtttactaataaagtaa

SEQ ID NO: 53761 - DNA, 83 bp, Heterodera glycines
  Genomic contig location: Contig_ID=SeqID_4250; Location=39..121; Strand=-
  SCN-specific regions: Sequence locations=1-83
gcggaacgcaactgaacgaccaaatcctgacgagtgcgcgagtacatctcggaaagactgaacagacaacggtactggagcca

SEQ ID NO: 53762 - DNA, 887 bp, Heterodera glycines
  Genomic contig location: Contig_ID=SeqID_4250; Location=656..1542; Strand=+
  SCN-specific regions: Sequence locations=1-733,755-887
atgcgacttgttcagaccgtctacaaatgtgtccaagcacacactgattcggtcgccacagtgattaggtgaaggcatcgagtggggggggggcgaagatggttggccaaccggacggaagacgatgagggaaagaaagggcacgaacgaacattgattgaccggcatatgccatctacatcagaaacgatcaatcgtttatttcattcagagatgcactcaatccgttgaagacgagcattctgagccaatcattcaaaaatcttaccacatttgttgaccaaacgtttgagcaggacgaacgcagagacacaattgtagtggagcaagttggtagaacattctaattaatctgttcattgttgaaatttctttctcccctggtttctctttggatgcgtaatcccctcaccttttttacagcttaacgccactttccgtgccgagttggccagcgtggcttgggacatggcattgcagcgcgaaatggagggcaacgtctccaaggcgttgcaatacgtcggggtgaagttggaacagcaaatgacttttggcgacgacgccctccgtttcaccggtcgcatttcacgtgctcaaactcacaattaccagctgctgaacattgcacacgaactggcgaagtacgtgcatcaaaccaaattggacactcaaatttatcatttgaattcttctatttttagatattggcccggcctttgtggccctcttttttcactcatccaaacggccgtcaacacaattttggagcgaatgcgcaccaccgtttcgcttgttttagactcaatgcatgacgagaatttggcggtcgctttggcacccagtgccacctcatcggaatatgtgaaggagctgtgcggacatctcaa

SEQ ID NO: 53763 - DNA, 2897 bp, Heterodera glycines
  Genomic contig location: Contig_ID=SeqID_4251; Location=1100..3996; Strand=-
  SCN-specific regions: Sequence locations=1-408,435-683,709-999,1022 -1212,1235-1507,1550-2167,2192-2897
  Gene Ontology: Cellular component=kinesin II complex; Biological process=signal transduction
gtcccttccgaccgaatttcggaattggaacggctcgtcttttacctgcaaaaacggcacaaccctaacgaaagttatgccctgtgacaaaacttaataattgcttttttggtagattccgattccctggccagcatggaaattcatgcaaaaatggacgatttggaggtagtcgataggctaggcccatacgtccgctttcgcttccaattttgctgtgttcagagttacatggaattgctttacgaggagggggagcccaagcagcgcggggtggcaatgcttgcggaattggtacgccatgtcgaggcatcgcaattggcacaaattgtggagaatgagcagctgatgggagcactgactcgaatttggcgcgaggtgatggcacaattggctcgttgtcctttttgcctttttgttgtcctttttcctctccccgtcaccgaaattcaccaaaccatttaaaggactcgcgcaaaaacttcgaattggcaattcatttggcccaacttttccgtcggctgtcccaatttgcgccttttcatcccacactttcgcatttaaaagtgaattttctgtttcaattttctactatttctccgtttcgtcagattgggctgctcagtgtacaaacggtcgattttgagttgggccgttgggaattatggcgagagcaaacgcacgaaaaggaggagaaagagcgactcaaatgggaatatgcgatgagaaagcaggaccaactgatcgcgggtaaactgggaaaaattgagcaattccggactaatcgacgcaaaattccatttttgagcgtcgctacaaagaatggaatgtcaatttaaattaatgccgattgtgtttagtggtccttaacatactgttgaatttggccgacgatttgcggacggagcacaaaatgttgcgcaagggccttttgccgacccttttcaaatgcctcgaccaccgttcgtcgccccaactgctgacagtggccgtgaagtttctgtggaagctgagccaattttcagagaatcagcagcaaatcgcagtaaatttaattcatttttcgttgtttttctattgcttagaacaccgccggttccatcgaccgtttggtttcacttttggcaccgtctctgaaaagtgccgtatccgaatgttgtggtggcgtcggcagccctttgccactgtcctcctcctcgccctccgattttctgggcccccttttctcccttttgttcaactgttccttcgagccgtcttctcgccgctgtatggtcgccgcggggctcgtctctctgttggccccgcacatttcgggtgagaagcaaatgcaaatgcgcggattggacaagccaattaaaatcgccattgcttaatttcagaaaatgatgttgccttggccctgatgtatcagctcagcattgtggacgatgccaaagcgatgatcgcttttacggattgcattcccaccgtatgttttttggactgttcgtttcccggatgtttcttcctttggctgttcttcttcagctcctccgtttgctcttctccgacagtcgccccccttccgacggcgacggacgcccaaaaaaagaaacggcggatggacagcggcggaagcgctctctgctggtcaaatcgctgttggtgaacattgtgctggagaagcggaatgcccaactgttgtgcgggtcggagggccaaggattggactcgctgatggcattcgcattggaaaacgaagggggcgacgttttggcgatgaaagtgataaaaacacacaattttagatggaataataattctttttcatatttttttgggtcgcacgaaacatcgcctcccacgagggccccacccgggaaatgttcaccaaatgggtgccccaactgttggagaacgccgtcgagaaggcccaaggagacgacagcaataacaacaacagtcctctcaaaccctcatcttttgcgtcgtccatttttgcgctcgaatgtttggccatttgtgcactgcttccgaacgcaaattgggcccaattggaggacagtcacagtgtagtcgcatttttagcccaaattttgaagcgatcgcagcaaagcgaaagggacgaaacgaaaaagtcaatgcacaacactttggacagaaggaaagggcgagaacaccacgaaagaggagcagaggaggagaagggcaaagagcgaaagaagggaacgatcaccgacgaagtgctgcttcaggtgacagtcgaagcgatcgaactttggacgatagaaacgaaacacacactcattatcattttattcactacaaaaccatccagcaggatgaaacaatttaaggtcgtccaattgtgtggcacggtcgccggacattcccttgaaatggcagaacgggtggagaagcatctgttgccactgatcatttcgacactgaacagtgagtgatttgaacccccaatattcctaggtagcctccgtcccatgtctaaattagaccgccaagacgacgacgaaattgtgttgcaatgcgttttcgtttttctttctcttctcgcgcatggcggcgaaatggccaagcgaatttgtcaacagaaagaggaaattaatctacgcaaaagcaaaagggagaaagcggtggaaacagcggcggttgttccgctgcttttgctcaatttgatgcacgacaaaaacacgcaaattcgcgcgttgtgtgagcaaacgttggagagagtggcggtgtgtagggatacaatcatattttgttgtttaatgagtaaactaaggacccaatgtttgtatgtttcaggaagtgaatgcacattggcgagaacgtatacgcgaggcgcggttccgctggcacaacgcccagtggttagaaatggtcgaaacgaccaccga

SEQ ID NO: 53764 - DNA, 608 bp, Heterodera glycines
  Genomic contig location: Contig_ID=SeqID_23058; Location=1410..2017; Strand=+
  SCN-specific regions: Sequence locations=1-158,180-608
atggcagaggatggtgttctaaaatcggtgatcggacttcgcattgaacgggtggcagagctggacggggttgcaaagttttccccagacaaacgcatcgccaaattgccatggtaaaaagcaaagggaaattcgggcaaaaggcccgcccgatgaggaaattcatttaacctcgaaacaggcgtcttgaagtacggaaaagtgcgggcggaggacagcactcgccgcccactttggctgtttatgtttggtgcaattgggccaacaaatcgcagtgttggcgctgcaaggccatcgtcaaatttgtcatcaaatcacgcgaggtatccacatttgtgaagcctttactcagtgccattgagaattcaagccgtgccaatgttttcggattaaatcgaatggcattcgatttctttaatttcgatgaatttggtttttcccatttagttggattttgtccgcaactttgagcacattttctgcgctcgtcagccatttgtgaattggacacgtctgttggagtccaccgcagcgaacagtctgagacgggccgaggacacactcgaaatcgaggcacagatcagtgtcaccgaaatcgtcggatacgg

SEQ ID NO: 53765 - DNA, 299 bp, Heterodera glycines
  Genomic contig location: Contig_ID=SeqID_23061; Location=39..337; Strand=-
  SCN-specific regions: Sequence locations=1-144,184-299
atgacaaattccaacctgggtgagcacacatttcagataagcttcctatcattatttcttagaaacaactaataatctgttgaacagttatttcaaaataaattcgaatatattagcttattatgcatcttcagtgtgcattctaaaataaaatcattttttgttctaattttatgatttatttgttttctgttgactaaatagtcagttattatagcaaatattaatttatatttgcgtagcttcaaatgagcattctgccttcaatttcgaagggaagtgaatttttttataataaa

SEQ ID NO: 53766 - DNA, 928 bp, Heterodera glycines
  Genomic contig location: Contig_ID=SeqID_4252; Location=2451..3378; Strand=+
  SCN-specific regions: Sequence locations=1-279,301-928
atgtccgctcatttccgagcccaactgaaattggcgtacaatgactccgaagaattcctcaccgatcaagagtcctttcctgttccccagcaaaatggtcaacccgacatactgtatgccaaatcaattcgttcccaactccaatccctggatgatcataattccgatgtcaaatctgtcttaacgcaactcgaagataattccgatcggtggatgaccctcaggactaatatgactggggctgaaaggacccaagacaatccattatacgatgcatttgtgttagataccccttttcccaaagcaatttctgaccttaaaaaataccttcgtaccctacgtaccgaacggcgagccctggaagctgcactccccgtagctaatgtccaaaatgcatctgccccttccttagtccatttacccaaaacatccctcccaaccttttctggcgattgtaccaattatacgagtttttggaacacatttaaggcaggtgttcatgacctgaacattcccaattccctcaaatttacctatctaaagcaatgtctctctggtcctccccttactttaattaattctctcccgatttccgacgactcttatgattctgctgtttcccttttgtctcaacattatgaaaatcccgaggaggtagcccgagccctccacaattccttgcgcaaacttccccgaattcgacccggtgattatttttgtgaagacctccgggctctccttgaccagttggagtgtatctgtattcaaatgtcccaacaaaatcattcatatgatactgttgctgtccaaatggaggtcgaggaacgactccctcgttttgttctcgatgaaatatttatgtcaaaagaaaatgacgataattggtcatccgacaaattgaaatcacgactttgggccatactcaaac

SEQ ID NO: 53767 - DNA, 1572 bp, Heterodera glycines
  misc_feature (1539)..(1539): n is a, c, g, or t
  Genomic contig location: Contig_ID=SeqID_4253; Location=676..2247; Strand=+
  SCN-specific regions: Sequence locations=1-199,222-336,358-650,674 -1194,1217-1401,1426-1572
tacaaatcattaatttctcatcccaaaatacggataccgaatcaatggccccaccctcagactttttcactctggaagggataggaattagagacgacctacaacccatttccgttgatgaaattgttcttaaacaattcgatcaatcgatcgaatttgtcaaaaatcgctaccaagttaagttgccctttcgttccgaccccaaaacccttcccctcccttgaaattttggactttgttttggccgattgcgttctgtttttaacacactttcagctaaacccgacctcctccaaaagtacgactctattatacaggaacagaaaaaaatgggtattgttgaaattgtcaaaaatcccttcgaattttcgcctccattacattatttggcacatcacccggttatttcaccccttaaaagcaaagtgcgtattgtctacgacggttccgcacacgtcggaaaagaactatccctaaatgagtgtctttttcccggtcccataatcctgcctgatcttatcggtctcttattacgttttcggattcccccaattgtcattacaactgacattgaaaaagccttcctccaagtcaatgtgcacccggcacatcgtgattgtacccgcttcctgtggctgaaaaatacctctcttcccccatcaaaagcaaatactcaaatcctccgatttacccgtgtttcttttgggctcacatgctccccctttttgcttgcggccacaattctccaccatttatcagcttttccctccaatttgtccacggaaatttcccaaaatatttatgttgacaatatccttatttctgcctcaaattctaccgagggacagaagaaatcaacctccgccatttccttatttcaaaaggccggaatgccattacgtgaattcgccagcaattgtcaggaagccatttcccatcttccaaggcaattaaaactccccggaaccgaacaaaagtttcttggacttaaatggaacactgaaaaggattttttaattgtggaactttcggtccctccgcctgattttgtcccaaccaaacgctctgtcctttcctttattgcatcacattttgaccctcttggcctaatttcccctcttatcctccccttaaaattatttttacagtccctttttgaacttaaactcaattgggatgaacgatttcccacagaaataatcacaaattggcaaaaatcaattgaatcctggaaaaggacggacaaggtaaccatcccacgttcccccatttcgtctcctttatctgctcgtgaataccaattacattgctttacggacgcaagcaccttggcaatgtgcgcagccgttttcctccgagtttcacaccccaaattttcccaggcggaaacctttttaattttctcaaaaacaaaagttaaaccaattcacaaaggcgtcccattaaccatccccaaactcgaactaattgctgtagaaatgggaactcgtgctctgaaatttacccaagcccaatttccctctctaaatttagacccanaatttaaatctttggacagattctgcaatcgtc

SEQ ID NO: 53768 - DNA, 1979 bp, Heterodera glycines
  misc_feature (772)..(772): n is a, c, g, or t
  Genomic contig location: Contig_ID=SeqID_4254; Location=1..1979; Strand=+
  SCN-specific regions: Sequence locations=1-104,128-926,948-1979
cccccaattgtcattacaactgacattgaaaaagccttccttaagtcaatgtgcacccggcacatcgtgattgtacccgcttcctgtggctgaaaaatacctctcttcccccatcaaaagcaaatactcaaatcctccgatttacccgtgtttcttttgggctcacatgctccccctttttgcttgcggccacaattctccaccatttatcagcttttccctccaatttgtccacggaaatttcccaaaatatttatgttgacaatatccttatttctgcctcaaattctaccgagggacagaagaaatcaacctccgccatttccttatttcaaaaggccggaatgccattacgtgaattcgccagcaattatcaggaagccatttcccatcttccaaggcaattaaaactccccggaaccgaacaaaagtttcttggacttaaatggaacactgaaaaggattttttaattgtggaactttcggtccctccgcctgattttgtcccaaccaaacgctctgtcctttcctttattgcatcacattttgacccttggcctaaccaattcacaaaggctcccattaaccatccccaaactcgaactaattgctgtagaaatgggaactcgtgctctgaaatttacccaagcccaatttccctctctaaatttagacccaaatttaaatctttggacagattctgcaatcgtcctttcatggcttaattgtcacaaattgcccacggaaatttttgtacaaaaccgacttaagncattaaatccgttgatcatttaactgtccgacatttgcctggcccggaaaaccccgcagacattggtactcgaggaatttcttccgcacctaccctttccgctctctctgcctggtggtcaggccctcaatggctttctctcccggccaaccattggccaaataacccacaaataaaagagtattcatacggaaaatcagaacctataaacgccccttttcaagcaaaccctccccctttgttcacgttttttaccgaacagacacccgaattaacacatttaattgatttggcacgtttttctaggctaccaaaagccctcagggtgttaagttatgtgtttcgtttctcaaatggcacccgaaaaaattcccaatgtaaagcaccgaatccgatttcctttaatgagcaaagaaaggctctacaggaattaattttacgagagcaaaccctaaatccaccctctgatcaggtcacgaaaattttgggcctttactcagacccacagaaaattattcgcgcaaaaggtcgtctcggaaaaagccagctcccaccgtcggcaaaaaaacccaattttcctccctcccaaatcgccattaaccaatttaattgtttacgaaatacacttaaataatgtccatttcgagcccattgttgaccctttcgcgattgcgcagaatttattggattccaaagggacgacaaattgtaaaatcgatcatttcgagatactgtctaacctgtcgacgttttaacacccgaccatttgaccttcccccctttcccccccttccggaagacagggtaaaaccttcgccccccttttcgaaagttggcttagactttactggtcccatttatgttgtcacaaacccccacgtaccaaaaaagcgtaaaatgtcgaaaaaacattggatagtcatttgggtttgccttccgacgcgtgccatttctcttgatttagtcgaagaccagtcggcgcccgtctttaccctcgcttttcgccgtttttcctcaaaatacggcatcccttcgacgatttactgtgataatgcacctacttttgtcgctctttcaaaatttttggcggtccaatttccaaccctatggaattttcgtgttccacacgcaccgtggcgtggcgggcattatgagcgtttgatctcactggtcaaacatcatctacgaagggcatttacctcatttc

SEQ ID NO: 53769 - DNA, 726 bp, Heterodera glycines
  Genomic contig location: Contig_ID=SeqID_23067; Location=723..1448; Strand=+
  SCN-specific regions: Sequence locations=1-726
atggaaaattttgccagaactttcgttgaacaactcgcaaagcacacggacaacgaaacgagccgaaaagtccacgggggtcagctccaactgaacataaagcgtagaggaggaggtcaaacagtccaatttgacctgccagtccaaatcgggcgttttgccagtgcaaatcactcccagaagcatcaaataagtgaagtctctgtcattccaattgccgtcgcaattggacggagccgactgattgccgagtcggtaacaaacgccgggcagtccacgagtgagcgacctaagggcaacggacacaaaaaatgccatggaaataattgtgttggtcgtggagagtgccgatcacacacctggtcaccagctgttccgccacgtatttgctctgtccgtacccatctgtcagctgatgacagtgattttgcggtgggaagtgttcgtcaacgccgcgcaaatcagcggggaacacccgcgtcggtactgaacggaaccaaagagaaaatgggcacaaaagagcaaatgccgcggttttttggtcgatttgtaagcaattaattatttatgagacaaatacttcaaatatacggctgacctgatgtaatgcagcggttttaacttattcttcaggcagaagtcaagcacattgcgcgtgccgagcacattaatgccatgcaaagccttgggaaaagcgagcgaatctcagcaaaagaaatgctgtga

SEQ ID NO: 53770 - DNA, 257 bp, Heterodera glycines
  Genomic contig location: Contig_ID=SeqID_23069; Location=1554..1810; Strand=-
  SCN-specific regions: Sequence locations=1-257
atgaatttgaagccaattgtgtttgacgacacgtctagaaatgagtataacctttcattggaggacgaggaccacattcaattcgcggcattcatcgacaagatttggaaagcaaaaagtaggtacagggacggcacgcaattccgctttctgagatttttggggtcataattccgtccaaaaaaatatatttctttagaatttttttgtgcaaaaatagtttttgatataaattctgctttattttgactaataaa

SEQ ID NO: 53771 - DNA, 54 bp, Heterodera glycines; identical to SEQ ID NO: 53113
  Genomic contig location: Contig_ID=SeqID_23070; Location=70..123; Strand=-
  SCN-specific regions: Sequence locations=1-54

SEQ ID NO: 53772 - DNA, 852 bp, Heterodera glycines
  Genomic contig location: Contig_ID=SeqID_23070; Location=132..983; Strand=+
  SCN-specific regions: Sequence locations=1-31,54-852
gaaaaaaatatttatgaaacaaaaaaatcgattttttcaagaaaatttttcaatgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaagattcggtctccccataaatctgggcgcatcggttcggggggactgccccgaaaac

SEQ ID NO: 53773 - DNA, 781 bp, Heterodera glycines
  Genomic contig location: Contig_ID=SeqID_23071; Location=57..837; Strand=+
  SCN-specific regions: Sequence locations=1-144,168-439,461-510,584 -649,676-781
atggcacgggtggtggtgccaaaatgcagccaagacaaagtaaatggatcaaaaatgcttttcttaggtctgtaaaatgccatggccatgccaccgaattttggttaatttaatttttggtaaaaggtgtccaaaatttatgaggaaaaataattttggatttttttggggaggggggggggcgggggaaatacggccaaattttcggggattttctaattggaattgtataccctaatattgacaggacggaaagtgcccgagggtgagctgtgtgccgtgtgttccgacagggccaccggttatcattatggtcagttttctgttgcaaaaccccccagggggatttccatggcatatttctgggacaattccctgacaaaactccaccaatttttttttctccgataaaaattagagcacagaacttcgaagccacaattttcaataaacaaattctcgattttaaaaagacaccgaaaaacgccgccgggaaaattgcaaattgtgaaaatttacaaaaaaaaaaaaatttcatataaaatctctcatccattttcctaaaaattttctgtcaaataaacgagattgggagcatgagccaagtttctttcttgaagctaatcatttttttagcattttttttacgaaatttttttttaaaaatatatttaacgcccatttttaggggtggcaagctgcaacggatgcaaaacattcttcaggcgaaccattgtctctgaacacagttttggtatttgttcacattctccatttttaa

SEQ ID NO: 53774 - DNA, 66 bp, Heterodera glycines
  Genomic contig location: Contig_ID=SeqID_23073; Location=807..872; Strand=-
  SCN-specific regions: Sequence locations=1-66
cataaacatttatttgatttattttaccatattcacaatttgatcaaaatataggtggtcaaaagt

SEQ ID NO: 53775 - DNA, 981 bp, Heterodera glycines
  Genomic contig location: Contig_ID=SeqID_23075; Location=220..1200; Strand=-
  SCN-specific regions: Sequence locations=1-206,230-259,281-981
atggaggaattcacagctgttatgtctgcaaattgccgtgccacacattctgtggcgattttagcggagttgaaaacgaaggcttcggcggaaaagtcgtgtgcaacaactgaacgaatgagactcgacggagcaggtctcccagttcaccgtccggacatcgacactgaactggcagaatggatcgccaaaaaaagaaaaaataaacagcctgagtcaaggaacatcattcgacagagggcggctgcgctgttcatggacactgatatcaaagtgaaaaaagtattaagctacaaaaataaaaaattttgttcaggcatcaattggatggctgcaaaaatttctgagtaggcacaatttcatgctgcgcaaaaagacatcggtttgtcagaaacccccgtccaactatgctgaagcggtacccaagttcatcagttttgttgaacaaaggcgcaaggtgatgaacaactttcccggcggcatcttcgcaatggacgagacggccgtttggttcgattgtccggacaaccgatgcatcgacaataaaggcgcaaaggatgtaagttttttttggataaaatgaacttattctaacgaattaggtgacagttgcgatcacaggatatgacaaaatgcgggtgacgttgtcttacagcatggaataacggacaaaaactcaagccgtacgtgctggtcaacagaaagcgaccggtgccgcaaattgtcaaccaatttgctggaaaattggtgatcaatttcgctgggtcgatatggatgaatgatgacacaacggaggactacctgcacaaaatcattgaggcaaagctgttcgttggcgaacgcctcttggtttgggatgcgtttggcagccacaagagcgaaagaacgacgaaggtggtgaagggattgcgagtggaaacggtttttatccctggcggttgcaccaaattcatccaggtaccaaatcatccttctcaatga

SEQ ID NO: 53776 - DNA, 1787 bp, Heterodera glycines
  Genomic contig location: Contig_ID=SeqID_4255; Location=115..1901; Strand=-
  SCN-specific regions: Sequence locations=22-1381,1403-1563,1585-1787
  Gene Ontology: Mol. function=protein binding; Cellular component =extracellular space
atgtggctgcgatccgaccgggtgagactgactaggaatattccaaacctatcggtttaccctttggtgtttagctctgagactttggaatgcgacgtttccagtgggcagtgtttgtgccgacagaacgtggaaggccgtcgctgtgaccaatgttccgaaaatcgtttcaatttgcgcggtggttgtcccgcatgtgacgactgttacgcactgatccaatcgcgcaaaaatgagctcaacggaactatgagtgaattgcgcgaaaacctggacgagatcatcaataacccggtgattgtgagtgaaaaaaccttcatttggttgtttagatcaaagtggacgatcgcgaatttgacgcgcatgtgcaaaaagtgcgagtggaggtcgagtcactgcatgaaagagcactgaaaaaaatgggtaagttctacgtccctaatgagagagtaattacacatcgaccagcagaaggggacgactcgcacattcgcgaccaggcaatttccatgagggcgcaacttgcagaagcggacactttggtgctgggacttcgcgacagactccagcaaatcgacacgaatgctgcggtgattgaacagcaattgggacagtttagcacggacaagggtaataaataaacaaccagcgacgtattcacgggggcggggggatacactacctttcccctcccgtattgtttctcttctcgcgtcaattccctaccgtatcatttacagaaaccacccataaagagctgtctgttggagtgaattatgtgcaaacacaaggagaacagcacttggcaaaagcgcaggaggcgttcgaccgttacggggaaaagagtcagcaattgtcggagatcgctggcgaatccaagcagttgtctgatacgcaggagcagcgtcgccgggagatcctttcgttggctgagcaaattcggaaggagtcgcggcaatcgctcagcgacgccaacgaagcaatttttggaggtgagcgactcatcggagctcattgttcaaaatcacttacgaattattgcagcttcaagcaccagtctgcaaatttctgctttgttgaccgaggtccacgagttggaacagcgactgaaagccatccaacaaatggcgacggaacagtccctcgagacaaaccaaacacacgacggggccgccttcattctgagcggagtggacagtatccgtctgccgaacgttttttctgatgagttgatggagaaagtcaaaagggcacaggaagagggtttggaagcgctgtctaaaacacggtcggaggcggaaaagcaagcggaattggtagaaaaagtggataaattagtggaggaagcgtgcgaacagttgcgaaatgcgcaacagaagcaaatggtgggaaaagcataatgctttttattgccttctcttcccaaagagtgtggacaattcctttgacgaagccgagtcttttaatgcgcgcacccaaacggctttcgaattggccacgaagacgtggaacgatgcgaaggattcgcacgacgcgctttccggtttaattgttgcaaaaggcaaacaaataaaaatttatttgcagactttcatagtaaaatcgaacaaagccgcgcagaagctaccgaggaaatgaccaatttggcggatatcgaaaaggaaatcgaagaggcgcaggcgacgacaaaggaagccgaagatgcggtcggagacgcgagtcaaaatgcaaaagaagcggcggaagtggcggaggaggccaaaatgaaagcgcagaatttggccatg

SEQ ID NO: 53777 - DNA, 279 bp, Heterodera glycines
  Genomic contig location: Contig_ID=SeqID_4255; Location=4069..4347; Strand=+
  SCN-specific regions: Sequence locations=1-45,67-279
atggccgaaacagaaacacggagaacagccgaaagggttggaggaggacaacaggaagaagctgggcttgcacttatcacagcgctgaccctcaacattctaaaaacgaaaaaaggccatgagaaaacagaaaagaagaacaaatggaacaacctctttgcaaacacacgatccggaggaggaggaacaagtcggggtgttgttgaaggagccatttgcatcacaacgacaatctctgagggcagtggggaaaaactaagaaaaatgtcagtgaaacag

SEQ ID NO: 53778 - DNA, 888 bp, Heterodera glycines
  Genomic contig location: Contig_ID=SeqID_4257; Location=456..1343; Strand=+
  SCN-specific regions: Sequence locations=1-169,191-422,444-733,756-888
atgctcgttttgagcgattgtgccatgcactcaagggttttcggggtagctgatcacgaatctgacattcatttgcaccaatttcgaaccccgaacccgaattcgaacaagtactgccaatggtcaccccgtttttgggagaaaagttttgttcgaaaaagtcatgaaacatgttttgggggttttatgggtcgctgatcactaatctgacattcattttggaaaatttctatcccggaaccgaactcgaataaaaagtctaaagttgaaatttcaaatttcagttttatgttcgtatctgtacagaatgatcatgttttggttttgcaatggtttctgactaaatttagattgtttctggattagtcagctggggcaactcagctgacagacaaatcagctgatggacaacccagccgtacaataaaaaattatacaataaagcctaggcctaggcccaagcaagcctaagcctaggtctagcctaaagcttagtcctaagcctaagacttaggcctaacctagccattgtacgagttgctcttgtacggttgtctgtgtataagttatcatgactagggctcggatttttaagcgcgaaaaagtccaaaataagtgtttaaataagggcgaaaaaagcgcgaaataagtgcgaaaataagcatgaaaaaattccaaatgtagaggtgaaatttgttaaaattgctgttttctctatgtaaattagttaaaattaagtcaaacaattttatttactaattgcagttagaaatgaagtacatttagaaattttcaggatttaagggtcgattctcaggggcgtatttttccgaaattttttttgtcgattcttaggggtgtatttttcgtttttattacattttttta

SEQ ID NO: 53779 - DNA, 1505 bp, Heterodera glycines
  Genomic contig location: Contig_ID=SeqID_23076; Location=332..1836; Strand=+
  SCN-specific regions: Sequence locations=1-1475,1497-1505
  Gene Ontology: Mol. function=metallopeptidase activity; Cellular component=extracellular; Biological process=body morphogenesis (sensu Nematoda)
atggacagtgaggaagtgaagaagcataatgaggaaaaggagaaggtgaagaaactgttggcagaatataagcaaaaggtgaacaaacaaatggaaaagaatgtcgaggaaatggagaaggacgaaaagctaaaggaagtgctgagggaaattgaagaagcgcaagcgaaacacccgggggagaagagaaaagcggcgaaatccatcacagagataaatgagaagcattgggacgaattgtaccagggggacattgagttgagcgtggaacaggcacagtatttgctggatactgtaacaaaaaccgaaaacagagcgttgatgagagcgaagcgaggggcagccaggaatgctagaaaatttcccaatcacaaatggcctattcttgtcccattctcttttgacggctcaatttgtaagtttcaattaagagctgaatcaacatttaaatacctccgtgtttcctcgattattggcccctccattagaacccctactcccacttccattaaagccctcagaggggttgaaaagagaaccttcgggactcgaataaaagaaaatggtactatgattatagaaataaataaacgatcaattttttaagccagcgaaatgaaagcgcatatatatgaagctgtaaaattatggaacgataacacatgcttgaatattgttgaggatgacgaagtttctcctagaatccaattcacaaatattaagggcatgggatgcctttcaaacgttggaatgcaatcctcggatacataccaagaaattaaacttgaatacccaagttgttaccgagtaattaggaaatcatttacaacaataatctttaatattttcaaaagcttggagcaattgcgcatgaaattggacacgctttgggattttttcatgagcatgagagatatgatagggattcctttgttacgttttacgctgataatgttgaccccaaaaattattacgctttcgaaaaagaaacgattgagacgacagacaattatcaagttccttatgaccttggctcagtgatgcactataacgcaagtaagcacaaattaaaaaaaacatgttttatgccgagacctattttgcagaaacattctcaatcaatggtgagtatacattggtgcctcgagtgggtgcttcgtatataaacacaattggacaagaatatggtcccagcctcagtgattatattgttataaacaaacattactgtggattagagtttctcccggatggatcaaccataaacacaggcatttacaaatttgtttattgtacattgtttttgtaattaagaagcgtgtcatgttacaatgaactgtgacaatgatgggttccagaacccggacacttgtacaacatgcatttgcccacagggttatatcggagcgaaatgccaagatgttgacattggtggttatgcccctgccagcattgcaaatacttgtgaagggaatattttatttgcaacatcaaattggcaaaat

SEQ ID NO: 53780 - DNA, 1427 bp, Heterodera glycines
  Genomic contig location: Contig_ID=SeqID_23077; Location=19..1445; Strand=+
  SCN-specific regions: Sequence locations=1-1206,1228-1427
atgaaactccgagaattctatggaagcaacatcgaagagctaaaaaagctgcaaccagacgacttggcaaaggacctcgaagacaacaaagtgctcggcattcgatggaaaccaaaacacaatcgactcatattcaaattgccaatcttcgaaggaaaaatcacaaaacggacaattctgtcgcaaattgccaaagtctattacccgctcggactcatgtcacccgtgctactgccagccaagctcattcttcaagaagtgcaaaacttgaacccaaaatgggacgacgaaatgccagcaaacatcaacaagtactggctcaaattgatggcacagtggctcgacagaggcgaagcaatcacgatcgaatttccaggcacatccaagccatcgactcagtggaattccactgcttctgcgacgccagcatatacggcatgggaattgccgtgtaccaaaaggccaaaacaataatcagaaaggatgaatgcaacctaatctacgcaaaaagccttgtcaaaccaatcaaagtggcagtgcacgacggcacaattccaaagttggaacttcaagcactgactctcggagtaaaagcagtcaaattcatccaagctcaaatcaaattcgccgatcatcaagtcatcatgtggacagacagtcaatgctcagtcgaacgacttcgagaaaacaagcgccaagatcgatttgtggcaaatcgattacaaaaaatccgagaagcgaattttcaagtcagacacgtcagaaccgactcaaacccggcggatatggcatccagaggcgcagatccccaatgccttcgaacatcactgctttggcgctttggcccgatttggctttcaaaagcagacaaatggccagaatccaacgtcatctaccgacccggagatgaattcaaagaagtggaaaagccaccaatcgttgatattccagcgcaaccaattcaagaagtgcacagcttcatcgcatcggtcatggacgactcagtttctcttgccggcagcgacgacgaaagtcaacaaccacgcccaaagaaaaagttcaaaattccgaaacgacgctcagcactgttacgacccatcggtcagcagcaaagtccattgcaaggacaacacaaacgccgcaagcaactacaagactcaggcttacgcaagttatttcaagccatctcggaccaacaaggaagcagcaaggccaccacaaaggtcatcgaagaaagccgagaaatgcagaaggcaccacgtcatgaacagatcgagcacgaacaacgaatggtgaggaaaagtcaacaagaagcaaatcgacatcttcaaccgaaaaagcggcagcaaaaagaaattcaagaagtgccacattcaacaacagaagagcaacaacgagaaaccaaacgccaacaaatcgaaagataa

SEQ ID NO: 53781 - DNA, 581 bp, Heterodera glycines
  Genomic contig location: Contig_ID=SeqID_23077; Location=1..581; Strand=-
  SCN-specific regions: Sequence locations=1-581
caactttggaattgtgccgtcgtgcactgccactttgattggtttgacaaggctttttgcgtagattaggttgcattcatcctttctgattattgttttggccttttggtacacggcaattcccatgccgtatatgctggcgtcgcagaagcagtggaattccactgagtcgatggcttggatgtgcctggaaattcgatcgtgattgcttcgcctctgtcgagccactgtgccatcaatttgagccagtacttgttgatgtttgctggcatttcgtcgtcccattttgggttcaagttttgcacttcttgaagaatgagcttggctggcagtagcacgggtgacatgagtccgagcgggtaatagactttggcaatttgcgacagaattgtccgttttgtgatttttccttcgaagattggcaatttgaatatgagtcgattgtgttttggtttccatcgaatgccgagcactttgttgtcttcgaggtcctttgccaagtcgtctggttgcagcttttttagctcttcgatgttgcttccatagaattctcggagtttcatgcccgctgcttcgaagat

SEQ ID NO: 53782 - DNA, 420 bp, Heterodera glycines
  Genomic contig location: Contig_ID=SeqID_23077; Location=1530..1949; Strand=+
  SCN-specific regions: Sequence locations=1-66,90-420
atggatcagccggatccaacagagaaacaaccggaagaaacggatcagccaacgaaatcaaagcaacaatcaacaaagaacaaagaggacaaagagctggaacgacatcgcatcggcagaaaaaagacaatcgacatgcaagaaaaacggcaacggtcaagagacgaatggccagaggaaaacgaaacgctgctcagctacgttcaacgcatttacggaccggagaattggacgtcagcatggcaaagaggacgtgttctccgagaactccatgaactggaagatcaagggcgatggatgattcatcacaaatccgatcgcctacaactcagcgtctcgcgaatgtatggaggaaaacgaccatttgccgagttccgcttcgtggaaggcagatactactcacacatggtgccagaagat

SEQ ID NO: 53783 - DNA, 661 bp, Heterodera glycines
  Genomic contig location: Contig_ID=SeqID_23078; Location=166..826; Strand=-
  SCN-specific regions: Sequence locations=1-191,230-291,316-316,345-661
tcaaagacaaaaccttaaagcactagcagattgaaataaccgttcaaaaaaaagcaaagcaaaacacaagaccttaaagcactagccgattgaaataaatggacaaaaaagcaaagtcaaagacaataaccttaaagcactagccgattgaaataaacggaaaaaaaagcaaagtcaaagacaaactaggaactttatacaaatttaaaaaagtaatattttgtatattgtatatgcatttaatcaaatttctactttctttataaatgttagctaattagtcagcgtctatttattttctgtaaaaatttgcctctttatttaaaattaaattaatataatttcatgaaataagacactaaatgtatagagaatgaattaacgtggtcgattggaataaatggaaaaaaaagcaaagtcaaaacacaaaaccttaaagcactagccgattgaaataaatggaaaaaaaagcaaagtcaaagacaaaaccttaaagcactagccgattgaaataaatggacaaaaaagcaaagtcaaagacaaaaccttaaagcactagccgattgaaataaatggaaaaaaagcaaagtcaaagacaaaaccttaaagcactagccgaagcaaagtcaaagacaaaaccttaaagcactagccgattgaa

SEQ ID NO: 53784 - DNA, 655 bp, Heterodera glycines
  Genomic contig location: Contig_ID=SeqID_23079; Location=271..925; Strand=+
  SCN-specific regions: Sequence locations=1-312,344-532,570-655
atgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtcgtgctctgaagggcgtgggaggggggggggcgaaggcccaccacgaggccgcgaagaggccgagtgagtaccttcggtgcaggaaaattattaaattttaaaaattttttaattgctttttaaatatgccaaaaaatgtaggcttaacttttttagtgaaaattcgatcactcatatttttgctaattgagcagaagcgtaccaaactttgcagggatactccccggtaaaggactaacttacactgaaatgagcgccgagctagctggctcaaaaaaatttttcgaaaatctgagtctttcgtttttatttatttgcaaaattaattcataaatattttttcagaaagggttctgaaacgcaccaaattttatttacatgttagtttaggcactctgatgctttttctatcaataatggaggtga

SEQ ID NO: 53785 - DNA, 458 bp, Heterodera glycines
  Genomic contig location: Contig_ID=SeqID_23079; Location=1..458; Strand=-
  SCN-specific regions: Sequence locations=1-245,269-411,433-458
aatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggc

SEQ ID NO: 53786 - DNA, 747 bp, Heterodera glycines
  Genomic contig location: Contig_ID=SeqID_23080; Location=1511..2257; Strand=-
  SCN-specific regions: Sequence locations=1-231,253-347,380-470,492-747
ttgatgccacaaatgttgaaaaacccgtgggctcaatcgccgactacgaccctttggctgccgaaaagcagcaacagaaggccccagccgctggcgctgcggcgcctaaagcgaatgggggcggtttcactgtgaaggcattgtacgattacacggccgcggacaaagacgaagtgagtgaaaggagggaaaagaacacatttcggaaagcatttgttccttggcgatacattttccaatttgaataggtcagcttcaaggagggcgacgtcattgtgaactgccaaaaagtggacgacggatggatgacagggacagtgcagaggactttactgtatgaacaatgaatagataaatatttattatttttcaattggttggtcgtcccattcaactttcagctggggaatgctaccggcaaattacgtggaacaagtcaaacagcccgtgggacagtttaaattgaaatgaaggatttttagtcctttttgttagcgtccgtccgattgtttcatttcttttctctttaccgattttcttttgtggcctttgatttttcagtttttctttaaacaaatgtgccagaatgttcttcagcaatatttatttctgtttagcactcttagcaatcattttcattgtaagcatttattttctcaaattcacagttatgtatggttttaatttttgtcacatggctgctaatttccttttaatcgtaaccaagtatttgcttcgttcaataaa

SEQ ID NO: 53787 - DNA, 324 bp, Heterodera glycines
  Genomic contig location: Contig_ID=SeqID_23083; Location=1263..1586; Strand=-
  SCN-specific regions: Sequence locations=1-8,30-39,61-95,120-324
atgataattattgttttaatatgttatgtgattagtaatgacaaagaaaaggataaagaccatacgagcattggtaatagtaaagcgcataaatctgatctatattctgataaatctaatcttcaacctgaggatgctcaaattaatcaacaacatcgtaatgctaatcgagatagtaacaaattcgatcataatcataataatggaactaataccaattgtgatgctaatcaacatgaccaacatcatcatgctaatggagttgatggtgattcggatgataatcagcttgatcagctttatgcaaatcaccaactcgtttaa

SEQ ID NO: 53788 - DNA, 407 bp, Heterodera glycines
  Genomic contig location: Contig_ID=SeqID_23084; Location=66..472; Strand=-
  SCN-specific regions: Sequence locations=1-407
atggggggcaatgaaactgatggcagcacaattggacgacgagtgtgcagcgtaataatagagggaaaggaagacaatggaaaggagaaatggcagcaaaaggaaaaacacacgccctattatactaaagcatctcgcgcaaattctgaaatacgtaagtacattttatgatacctatgtttttgtaagtcgctctaaaccaaaaattgtttggagaaaatgctattttgagcttctctcgccataataaaagatcatttaagtcatgtttagaccaaaaatgtgaaattcgagaatttgagttttcgacttttgttcgaattcgggtccgggaatcgaaattggccgaaatggatgccggattcgtgttcagcgaccccaaaaacccctggaaatcttgtttttag

SEQ ID NO: 53789 - DNA, 1224 bp, Heterodera glycines
  Genomic contig location: Contig_ID=SeqID_23084; Location=537..1760; Strand=+
  SCN-specific regions: Sequence locations=1-272,296-473,495-1224
  Gene Ontology: Mol. function=endoribonuclease activity; Cellular component=synaptic junction; Biological process=protein amino acid phosphorylation
gctgatgatgttgctcctcccgctccttccgttgccgtcgatgactttgcgcagcgcaccggccaattcttcgacttcatccgccagggaaacatcgaccgattgcgtgcgctgatcgattcgctgagcgtcgatgagctgaacaccttgctgcagatgagatacaacgaacaacaatttgcgctgctggtcgcagttatggaaggacaccccgaaattgctgcacttttggtggacacaattttcaggggcaacaaataaacgacaataaattttgcccatttttcagttggacaaaggcgcggacgtgcatcagaccaccgttggccgagtgaacaatgtgaccatgggtgagcaattcggtttgcggaccgaccgattgtgctgtttgctaattcattttttcgccccattttcagccgttatgcccctgtggattgctgtcaatatgcgccacttggagatgtgccgtgtgctgatcgctcatggtgccgacgtggacttgggaagcgattcctcctttacaccgctactgctcgcatgtgccaaaggcagcacagcaatcggtgaagcaatcatcctgaataatttctcaaatttccctattttcagtcacccttctcgtggagagtggcgccaacgtcaatctcggggacagcgaaggagtaacgccgataatgatcacttctcgtttcggaagggtgaaaaaagcaaaacttggaaaaacttggcattttttgtttgttcaggtcgaacctgtgcacttcttactttctcacggtgcaaacgttgaacagatggattacagcggtggctttttgccaatttctaaataattatcgcgctaattaatgtcttttcaatttcagggatgcgatttgctcttttggacgccgccgctgatggccatttggaggtgtgccgtttactggtggacgattgggcagctgacgtcaaccagcaagcgatcgacggtaccacgcctttgatgggcgcgtgcagcttcgggcactttgaaattagtaagaagcaactggtgcataattcgactcaactttctgccccaattttcagcggtttttctcatcgaacacggcgccgacattgaccacgctgacatggacgggtacaacgcgttgatgtgggcagtgaagtacgagaaggctggtgtggcgcaacatttgctggcgatcggcgcgaacgcagaccaagtgggaattgacg

SEQ ID NO: 53790 - DNA, 649 bp, Heterodera glycines
  Genomic contig location: Contig_ID=SeqID_4259; Location=1387..2035; Strand=-
  SCN-specific regions: Sequence locations=1-7,42-176,200-231,253 -265,287-497,519-566
atgggttcagatccacttgcatgtaaaaatgttttttagggtttttgggaccactaatcaagaacttggcatccattttgcccaattccaaagccttgatccgaactcgaaaccccaaaagtaatttttttaaaatgttgcaggcatgtggatttgaacccatggcccaaaaacccatttttaacaaaacaaaaaatatattgggtataatatttctatatttgcttgaaaattttttagtgattttcatcaaaatcttttccagtgcaatttattaacagaaattttttctaagctattgcttcgctattagacaatttccaaaaaagttatacatgaaaattgcgaaaagtcgaaatttttgaagtttttttgtaataaaataaaattttttccaggcttgaaaatcttttcgcttttggtaaggctaatagagcatgttaagagctttcgagtgataccaacaatgttgtatttggatgtcaaagaaaaaagctatcgtggaaaaagagctggcgccgaaacgcgagtgccgaaacgcgtgggtcccgtttgtacagtctttctaaaatattttatgaattttaaaaaaatactatttttttcagaaaatttttgtgttttaaaagtatttaaaataacaaataaa

SEQ ID NO: 53791 - DNA, 585 bp, Heterodera glycines
  Genomic contig location: Contig_ID=SeqID_4259; Location=2646..3230; Strand=-
  SCN-specific regions: Sequence locations=1-64,86-167,189-249,292-585
atgcttatttttcctgttcatattttaaaaaatgtttgaatttatgtaaaaagttttgaatgtgtgaaaccattttgaattttacagatagaaagccctatattatgctattcctccgaatttaaaatattcagacaacacaaaccgaacagaaagagcaggattttcaaacttcctgagttttatttgtctaaaaaatgtcaccctagtacctatttctgctcatttataattaggacttgaaataaattacttcttgttttatttgaagggaccggccaacaaaggcggaccgtgcggcggacttgggtcggccatcgcttttatgtctctcgctcttcaaaagcctgtaaaaaaatttgtggctgtgactggtcggatttctgattgtggtgctgttggattcgtcaccggcatcccccagaaagtgatcgctgccattttgggaaatatgaaatagttgattttgcctgaaggaaaccgagacgatgttgataatcttacatttgggttggattctttggaaattatttttgttaaggatttgcatgaagcagtttgtaaatgtattaatgtttgaataaa

SEQ ID NO: 53792 - DNA, 434 bp, Heterodera glycines
  Genomic contig location: Contig_ID=SeqID_23087; Location=61..494; Strand=+
  SCN-specific regions: Sequence locations=1-348,370-434
atgggctcagacaacgcgctcagctgcatgatgagacgtcagaagaagaaaatcctgggaaacgtcgattgcgtcaacccaatggccttcgtgatccccgacaaattgcgcatgaaaaatggcgaggacattgtgctctacgacagtcgcaatgtccgaattggtgaaaaagacgtggtgcttgtttttgggagtgaacgggtaatcgatcaggatgaaattgtgattaaaatgctcattttagactttgggcattttgagccaaaacaatgagtgtgaatgaatcataattaatttgctaaatgccttctgttatgtcccatcatttcaatgatttccccaaccgattgattcattttataaaaataagtgaataatttattctaatttaggctaaagagctgctctttttctgtatagtgaaagcaaaaaca

SEQ ID NO: 53793 - DNA, 1024 bp, Heterodera glycines
  Genomic contig location: Contig_ID=SeqID_23087; Location=513..1536; Strand=-
  SCN-specific regions: Sequence locations=1-125,148-427,449-764,837 -1024
atggcaataaagattgaagaatatggaaattataataataaaataggtaataatctcttttttttcaaaaaagaaaggaattggtagatggaaaatcatagtagtttacatgataattcgaggatagggtggggtaaggaaaaggaaaggtacatggaggtaaaatggaaggaaatagagggagaggggggtggagaggggtccacatcgtttcggcgccgttcgtttcgacgccagcctagtttttggactataactttttctttttccaacaaatctaacattgttggtatcattcgagagcccttctgatgctctattattttgcataattccaaaaaatttgatcaattttgaacaaagttatggccaaaagtacacatgtggcctggttttttgaattcttctagtcataattttttgagcattaacgaaattttttgaaacttagcaggctaatagagaacacttagagctttcgaatgataccaataatgttagatttggtggaaaaagaaaaaagttatagtccaaaaactgggctggcgccgaaacgagcggctccgaaacgagggtgtcccccagattcgcactgtacttcattctttggcatctgttcaatgcgatcagtgcccacccaacatttcagtgctaaattaagtactgccttaatcatttcaatattttgttttcaaaaaaccatggttttcttaagaaaaccaaaattaaattcaatttttttgactattaaaatgctaaattccaaaaataaaataactataattttgaatatttttataaacacaataaattttatttattttttaatatttatacaaaagcgcgcatttttccttcattttacgagtctaatcctaagttgccatcaactcactgtttgcagacatcgccaaacatgacaaagaaacggccaaaaaaagggacgatgaagccgacatttgatttcaaaatgattgaaatttggaaaataatataaaataggaaaaattaaaaatgcaataaa

SEQ ID NO: 53794 - DNA, 630 bp, Heterodera glycines
  Genomic contig location: Contig_ID=SeqID_23088; Location=12..641; Strand=-
  SCN-specific regions: Sequence locations=1-265,287-437,464-630
atgaaaaattctattttgacttacttttttgcttttattctctttctgctgtttttgaagcaccaatttttcgtcgatgggacaaaaacggggaaatccgtagaagcgaagaaacggggagaaacattgggccaactgatgaccaaggaaggcaaagataaagcggagaatttacaagcagaggaaaagcaaaaaaagaaaaatttgggagatttaataagcgaggaaaagcatgagacattggccgatttgttggccaaggaacgacggaaagagaaggaaaacccggagaaaactaaaggaaaattgggagaactgttgaagatggaagaaatcaaggacgacgaatttgaccaattattgttggatttgaaggaaactgaacagataagttttgctgtgttcagcaaaccaaaaactgctgaaggggtaatgccaaaattattattataattaaataaatgatggcatttaaaatttattctaaattaggaattcaaaggaatgcttgcgcgagttttttcaaaacgaaagagcgtaaaggagaagaaaaacgatgatcggatgggacttggagaaaaatatgaacgttttatgagcataaaagcgaacgatccggcactgagccaa

SEQ ID NO: 53795 - DNA, 383 bp, Heterodera glycines; identical to SEQ ID NO: 51114
  Genomic contig location: Contig_ID=SeqID_23090; Location=394..776; Strand=+
  SCN-specific regions: Sequence locations=1-20,42-275,297-383

SEQ ID NO: 53796 - DNA, 412 bp, Heterodera glycines
  Genomic contig location: Contig_ID=SeqID_23091; Location=879..1290; Strand=+
  SCN-specific regions: Sequence locations=1-107,134-263,292-412
atggagaaggcctgcaaaatttggagagattatatcgattttagtgcgctaggttcgatgaaactttttaaaatataagcctaaactttttggcctgtttaaaaaggaattaaaaatttttaaaatatttattcatctcccttttgatagaaaaagcatcagagagccttatttaacttttaattaacatttggtgcgtttcagagcagtttctgaaaaaatatttatgaattgattttgctaaaaaaataaaatagtgaagctttaaaaattaataaaaaattttaaattcagaattactggagttagcatcatagcagtgcttttccttgtctttttgatgctctcgcaaaatctggttcgcttctgaccagtttataaaaaaaaagttaagcctaaaatttttcgcata

SEQ ID NO: 53797 - DNA, 76 bp, Heterodera glycines
  Genomic contig location: Contig_ID=SeqID_23091; Location=188..263; Strand=+
  SCN-specific regions: Sequence locations=1-76
aattactggagttagcatcatagcagtgcttttccttgtctttttgatgctctcgcaaaatctggttcgcttctga

SEQ ID NO: 53798 - DNA, 724 bp, Heterodera glycines
  Genomic contig location: Contig_ID=SeqID_23093; Location=243..966; Strand=-
  SCN-specific regions: Sequence locations=1-408,430-724
atgaagcgaaccaacgcatcaaacatcactccgcctcgcgcaaaacgttcaatggcacccccactggacctggacccaaacactgtcgcactcgcagagcaagaacgccaacgcacattggtcttcattggcctcccggaaagcaatgccgttcgcccatcggagcgcgttcaggaagacagggaagccactaccaaaatcttggaccatcttgaagttgaggccgaaccaaccgccgtctttcgacttggccggttcgacccccagcgaacaacacctcgtccgctcaaggtggtcatgccaacagctacacatcaacgcgtggcactcgggggatggaagcgcgagcgtgctcgactccgttctcaacagaacatggcccgtctgttcgtccgccctgcgctgaccaaagaacaactcaagaaggaatacgaagagcgcctccgaaaacgtcaacagacaccaactccaatggcaccggcaagctcacagacaaatgccccgacccccgttgtcgaagatggacctaaccagaaggaggccagcgacgacatttccaaaccgccggaggtttttgaccaaacaatcctcgtctgttatgaagcactaaactcatttccacccaccgacaaaattgttcaccaaattcaatcgctcaaaaaacaataccctcatcttttcaacaaatagttctaccagacctccaacaatttcttcaaataaa

SEQ ID NO: 53799 - DNA, 1215 bp, Heterodera glycines; identical to SEQ ID NO: 23097
  Genomic contig location: Contig_ID=SeqID_23097; Location=1..1215; Strand=+
  SCN-specific regions: Sequence locations=1-319,342-489,521-901,925 -1215
  Gene Ontology: Mol. function=carboxypeptidase A activity; Cellular component=secretory granule; Biological process=proteolysis and peptidolysis

SEQ ID NO: 53800 - DNA, 3847 bp, Heterodera glycines
  Genomic contig location: Contig_ID=SeqID_475; Location=1450..5296; Strand=+
  SCN-specific regions: Sequence locations=1-714,737-801,823-1702,1724 -1854,1876-2085,2107-3847
atggcagcggttgtaaaggctggcaaaggaccaggcccttatacatcggaaacgtcgtggaccatttgggaagaacgatttgagtttttcatcaaactccgaggcatcactgatgcggagacgaaaaaattgctcttcttctcggagattgggccaatatacaaagagcttcgccaaatggcgttgccagacgacgtccgcgacatgtcaattgatgagatcaaagcgctgatggaggaacgatttggcgagacgaagacgattgcggcaaaaaggtttgagctgttttcagccaaacagacgttaggactgtccattcgggattactcaatccaacttcggaccttaattgccaaagctgaatggcataaggattcagtcgacatgtgcctgagcgctcttttcatcaacggccttaaaaaggattcaattcgggccgagttgataaagaagggagtgaacgaaatgaagttcaaagatgccgttgaaacggcagtgcttctcgagcagtccgacttggacgcagagcaaatcggtgggcataagaaagcggaagtggcgaaagtctttgctccaaagggaggaagaaagagtagcgcaccaacgcagcaaatgcaatgccatcgatgcgggaggaatggccaccgcaacaacgagtgcccgaacaaggactcaaaatgccgaaagtgcggcaatgttggacactgggctgtgatgtgcaagacaaagcagggctccaattggccaaggaggcaagggaagccggttcaccaggtcaacactgaaagccaaaaagcacacgatattggaacactggccaagtctgaagaagtcaaatcgatttcggtgccaccagcgatgataaaacttcagctgagtaaaaaggcgacagatttcgaattggactgtggcgcagatgtcacactcatcactaagaatgattggatgtccatcggaaggccgaaacttggacaaacttcaggattgatggcatatggaaaaaagccgatcaaagtccttggatcgttcaaaacggatgtggtgtacaacggcaaagaagtgaatgccgaaatttatgtcgtggacggcgaaggcaaaaatttgtgtgggagagatttgatcggtgaattgcaaatcgatctcaacaaagcgttcggaatccgatcgatcaatgaagtcaagtgcaaggcagtggatcgagagctgggagcggtgcttctaaagtacggtgaggtcttcaatgacggactcggccgatgcacaaggcaaatttcgttgaaatttaagccggaagtgcaatcgaagaagtgcaagccacgccccgtgccttttgcattgagacccgaagtggagaaggtcatcgacaactgggtcaaagatggagtgttagagcaggtgacaacgtctgagtgggcaacaccgttggtgattgtacccaaagccggaaacaaaattcgcttatgttgcgactacaaagtcacggttaatcaatggctcgacattcatcaatacccgttgccgcgcccagaagaattgttcagcgtgttgaacggaggcgaaaagttttcaaagttggatttgaaggaggcttatcttcaactaatgttggatgataaagccaaggaatgcttgaccatttgcacgcataaaggcttataccaatttacgcgtatgccttatggtgttgcgtcagcgccagcaattttccaacaagtgatggaagacgtccttcgtggaatcgacggagtcgccgtctacttggatgatattgtggtgacagcccccaacgacgcggaacatttgaaacggctggaaatgactctccaacgcatccaaaaatttgggttgcgtgtcaaaaaggaaaaatgttcctttatgcaaaagcaaattgcttatttggggcacatcatcgacaaagaagggattcgaacgtcgccggacaaagttgaggccatacagaaaatgccagcccccaaaaacttaaaggaattgcaatccttcttgggcatggttgggtattatggcaagttcattccgtcaatggcaacaatttcggagccgttgaacgagctacgccgatcagagaccaaatggcattggggacaacaacagcaaaaatcattcgaacagatcaaaattatgctgtcgtcgaacgagctgttggcccattttgatcccaaaaagccactttatttggcaacggacgcatctgactatggagttggagcgatccttttccacaaagatggaaacacaggaaagtttggcgtgatcgcatacgcctcaagaacattgagcccagccgaaagaaattatgcgcagaccgaaaaagaaggacgcgcagtaatcttcggcgtggagaaattcaaccagtacttgtacggtagaaaattcattctacagacggatcacgagcctttaaaaaggatttttggaccaaaaggtgaattgcccgtggttgcggcacgacgacttcatcgttggagtttgaagctcatgaattatgacttcgaaatcgaatattgttcgacaaaaaatttcggttacgccgatggattgtcgcggttgcctagtccagaaattgatcaggtctgtaaggaaagtctcgagctgaacaaaatccagcaggagagccaaaacgctttgccgattactgcgaaggacattgcgaaagaaattggcaatgatccggtcttcgcaaaagtaaaaggttttgtgctcaatggatggccgacaaggatagaagacgagaaaattcgcccattttttctggtaaaagacgaattggagctgaataacggatgcctaatgttgggatgtcggacagtgattccgagcaaattccgtgagaatcttttgaaattgatccacgagacgcatccaggaatcgtccgaatgaaggcattggccaggcaaaaagtttggtggccgggcatcgacaaagacattgaaagcatgaaaaagaagtgcaaaatttgtcaaacgaatgcgccggaaatgaggaaagtccctctccatccatgggaagtgccagaaaagccatggcagcgacttcacattgacttctgtggcccatttttcggaaaaatgtggctgatcacggttgatgccaagacaaaatggccagaagttgcaatgatgaaaagtactacgaccgaggccacgattgaggcacttcgaaaattgatttggacccacggattgccagaacaaattgtgtctgacaacgggccgcaattcgcgtcaaaggagttcgaagaattctgctccaaacgcggaattgaacgaacgctgacggcaccataccacccgcagagcaatggggaagctgagcggtttgtccaaacattcaagaaaggaatgttattggtaaaaaaagacaccaactgggacaacgaattggcaaagaaccaattcttactcaaataccgagtaactcctcattctgcaacaggacggtctcctgcagaaatgatgttcggcagaaagctgcgaacactgctcgacctcgtgcgcccgtccgaatcgaccaaaattgaaggaggagaagagaaggcgaaagaaaatgctgaaaagcatggccaaaaatatttggctcgcgccaaaaagaactttgatcgacggacgtggaaacgatcgtttaaaactggacaaagagtctttgccaggaattacagagacggttcgaagtggatggcaggccaaatcatgagccaaataagcccatcactgtttcttgtccgaacagcccgtggggtctggaagcggcacttagatcagctgaaatcggacgagacgaagcctgatctggagagcaacaccgacgtggactcaacatcgtccatag

SEQ ID NO: 53801 - DNA, 614 bp, Heterodera glycines
  Genomic contig location: Contig_ID=SeqID_475; Location=2662..3275; Strand=-
  SCN-specific regions: Sequence locations=1-103,125-614
tggagagtcatttccagccgtttcaaatgttccgcgtcgttgggggctgtcaccacaatatcatccaagtagacggcgactccgtcgattccacgaaggacgtcttccatcacttgttggaaaattgctggcgctgacgcaacaccataaggcatacgcgtaaattggtataagcctttatgcgtgcaaatggtcaagcattccttggctttatcatccaacattagttgaagataagcctccttcaaatccaactttgaaaacttttcgcctccgttcaacacgctgaacaattcttctgggcgcggcaacgggtattgatgaatgtcgagccattgattaaccgtgactttgtagtcgcaacataagcgaattttgtttccggctttgggtacaatcaccaacggtgttgcccactcagacgttgtcacctgctctaacactccatctttgacccagttgtcgatgaccttctccacttcgggtctcaatgcaaaaggcacggggcgtggcttgcacttcttcgattgcacttccggcttaaatttcaacgaaatttgccttgtgcatcggccgagtccgtcattgaagacctcaccgtactttagaagcac

SEQ ID NO: 53802 - DNA, 76 bp, Heterodera glycines
  Genomic contig location: Contig_ID=SeqID_476; Location=1787..1862; Strand=+
  SCN-specific regions: Sequence locations=1-76
gcaagcactgccgcttccgttgacaatagcacacaatccaccgccgtggagcatatcgcttttcaaacaccaaatg

SEQ ID NO: 53803 - DNA, 3135 bp, Heterodera glycines
  Genomic contig location: Contig_ID=SeqID_476; Location=417..3551; Strand=-
  SCN-specific regions: Sequence locations=1-30,68-168,191-326,348 -404,426-479,512-565,602-613,644-994,1036-1119,1141-1313,1346 -1408,1431-1580,1618-1649,1688-1767,1791-1917,1940-1983,2006 -2196,2227-2440,2478-2578,2601-2721,2743-2789,2818-3135
  Gene Ontology: Mol. function=protein serine/threonine phosphatase activity; Cellular component=cytoplasm; Biological process=sodium ion homeostasis
ggaaacaactcgaggacggacgaaccttgcccggctacaacatccagaaggagtctactcttcatctcgtattgcgccttcgtggtggaaccctgtcaagcgcctcccttgacgcgatcatcgcaaaggtcaaccgttcgcctcctcatcgcttcacggatgaggtagaaaaatttttgagtttttcaaatattaatttcccccccccccccttttttccccaacagatcagtgacgatgaaatccgccagctcttcaaagccgcgaaggcagcatttcgagatcaggatacgctcgtcagaatccacccgccggccgtcatcgtgggcgacatccatggacaattcgcggacctgaagaagatcttctcaacgcatggcctcccgccggagcagcagtacgtcttcctgggcgactacgtcgacagagggccccaatcgatggagacgatcatcctcctcttctgctacaaggtgtggtttttgcgggatggggggagggaacccccaaaaaatgaaattcatttccccccatttttcaggtgaagtacccgtccaacttcatgctgctgcgcgggaaccacgagtgtgccaacatcaacagagtgtaagtgaaaaagttttttgtgtgtttttttgtgattaatcattcccccccccatttttaggtatggcttctacgatgagatcgagcgccgttacccgcgaccgggcgctcgtcgactcttcgacctcttcaatcaagtcttcgcctggatgccattcgtcggactggtcggcgagaagatatcacgcgcttcccgccggcctgaggacgacgagacggacggacagaacgcgcacacacactaactgcacacagaaggatggtggaactgcccggagagcgatgcgtgtggagaaatcggatcatctgaccccccattgttgtattgtattgtaaacccccatttcacatgatgaactcccccaaaaactgttgtcatttcaatatttgcgtgtgtgaatgtatgtatgtatatgctatgtgtgtgtgaataaacattgtaagcaaaaaaaaaaataggcaaaattcgttttttcaaaaaatagttaactaaaatagtgagtaaaaatgccaaaatagtgaagaaatagtgacaagaagtccgaaatagtgacataattttcagccaaaaattgagcaaaaataatggctctaatgcagtttacgcgtccaatcaatgaccatcctcagtttcttaagccataacttttttcttacttggtcaatccatacatccttggtatcaattgaaagcttaaagtctcgagaatttataagtacaagaaaagagcaaatatttgcattacgaaaaaaatttcaatgaaaaaaacctgaattcatcatttttcgcgtatattcaacagtaattttttgtctattgcttttatccaggcatttttctatacaaaaacttcagtgaactttaagctctcgattgataccaagaatgtaagttttgaccaagtaaaaaaaaagttatggcttaagaaaccgaggttggtcagtgattgggcgcgtaaattgcattggagccgaaataatttaatttaaaaggatttttataattaaaatgccattagtgtacgttaattaatataaatgctattaattaattatgtaattaattaattaaccaattgataccatttggtgtttgaaaagcgatatgctccacggcggtggattgtgtgctattgtcaacggaagcggcagtgcttgcttaaaaatgcaaaactagaaaactctacactgtccgggcactaattagagcatgttaatgctcgggattggcaaaatgtgccgggatttcttgatagaaaaattgccgctcgggattcaaatatttgcgcatttaaaaagttaccgtatttcttgaaatagggccccctggggctctatttttcaatccatctcaaaaaggggggggggctttatttcaggggatgggaactctatttgatttgttggcacaaagtataaattaattaggagaaaaaactgtttgcgaaggaaatctaaacccaaatatcattctgttgtcccaattctccactgtgataaaaaggagggagattaatgaaaattgcatatattaacatatgcacaaataaatgcacatatcttttatttctatgcttgtttaggaacagaaacttttaattgttttatttagtgtctgtattttattggaatctgttccagaaacttgaaaatttttcagttgaaatccggtggattttttgaccaaattgtgatcagttttgcttttacgcgaccaaattgcttttcagttgaaatccggtggattttttgaccaaattgcttttcaggcaaccattgttttaaacaaatcccttgttttcagggaaacaactcgaggacggacgaaccttgcccggctacaacatccagaaggagtctactcttcatctcgtattgcgccttcgtggtggaaccctgtcaagcgcctcccttgacgcgatcatcgcaaaggtcaaccgttcgcctcctcatcgcttcacggatgaggtagaaaaatttttgagtttttcaaatattaatttccccccccccccttttttccccaacagatcagtgacgatgaaatccgccagctcttcaaagccgcgaaggcagcatttctgctataaggtgtggtttttgggggatggggggagggaacccccaaaaaatgtaattcatttccccccatttttcaggtgaaatacccgtccaacttcatgctgctgcgcgggaaccacgagtgcgccaacatcaacagagtgtaagtgaaaaagttttttgtgtgtctttttttgtgattaatcattccccccccccattttcaggtatggcttctacgatgagatcgaccgccgttacccgcgaccgggcgctcgtcgactcttcgacctcttcaatcaagtcttcgcctggatgccattcgtcggactggtcggcgagaagatcctctgtaagttttgggggagggcaatttttgggggtcaataactgttttccaactgattttcaggcatgcacggtggcatctccgatcagatccgcagcctgaccagctcagccgcctga

SEQ ID NO: 53804 - DNA, 1249 bp, Heterodera glycines
  misc_feature (729)..(729): n is a, c, g, or t
  Genomic contig location: Contig_ID=SeqID_478; Location=2279..3527; Strand=-
  SCN-specific regions: Sequence locations=1-262,285-514,536-1170,1192 -1249
  Gene Ontology: Mol. function=ubiquitin-protein ligase activity; Cellular component=endoplasmic reticulum; Biological process=ER -associated protein catabolism
atgacaacaacgacgaggaccaacgccagggacagcccgagacgtgtgctgatgcgccagttcgaaatgctgctgcagaactcgaacgccaacatcggattccgtgcgtgtatcaacgatggcaatgtgagagaagcagcgaccgaccgaactgatctgatccgattttccgttacgaatatttcagtcccatccctttaaacagatcttcaaatggcgcattttcatcgatggtccgccggatacaccatagtgagtagtgggcggcggcggcagaggaaaagtgcaaatcaatcaaattaattgtttccccattaatccctcccctctcctttttttagcgcgggatgcacgtttacggcactgctcaaattcccagcttcgttcccgtcttatccgccaacaatgactttcctcaccgacattcttcatccgaacagtaagaaaagcgcgcaatgattcatcaaatcccagcaaaagcccccacccgtccctttcagttgacacgagtggcaaagtctgcatcagcattcttcatcagcctggcactgatccactgggctacgagcaggcggccgagcgttggaatcgcaaccgaaccgtggagtccattttggtgtccattcaactgctgttggtggagccaaacttcaacagtccggccaatgtggatgctgccgtaagtggaatgattcttcggcatatgaatgaatatatatcattttcatncaaaatttcaggttttgttccgcagcgacccggcacgatacagggaggaagtgcgtcgacgtgtggagatggagatagcgaggacggcaccaatactaccgggagcgcaaccgccgccggaagagcatgggacgcaaccgccggaagaacagaggacgcaaccgccggaagaacaaagggcgcaaccgccggaagaacagagggctcaaccgccggaagaacaggggacgcaaccgccggaagaacagaggacgacgcaaccgccggaagaacaggggacgcaaccgccagcgacaccgccgccggaagggccgcagcaacaaacgggcgaatggtacatttgatgtgatgtgatgccctctgagtgatgatattattatacttatgtatgtattgtatgtgattaacgatgtctctatgttcatttgccctgcttttgttcactgtacatatgtgtatatattgtcattcaccaattactgtatgtatattgtatatatgtgatgtatcgagcaataaa

SEQ ID NO: 53805 - DNA, 1527 bp, Heterodera glycines
  Genomic contig location: Contig_ID=SeqID_4261; Location=531..2057; Strand=+
  SCN-specific regions: Sequence locations=1-438,460-712,737-760,817 -1030,1052-1527
  Gene Ontology: Cellular component=extracellular space; Biological process=cell proliferation
atgtcatcagacgacgcggacaaagcggcggcaaaagacggaccggcaccggacactccgagcgatgccaaagtgacggacggcggaccaccaacggcaactgaggacaaaccgaaggaacaaacggaagcgaaagtgcctgatgagccaaccgcgacgaaggaggagccgaaagtgcccgatgagccatcaacgacgaaggaaccaacggcgccagtgacagacggaccgccatcagaggcaaagggagacaaatcggacgagccaaaagtttcggatgagcccgcaaccaaagtgccagatgaaccgcccgcaacggagccaccaaaggattcagcgacgacggaaggatcggatgagccatcaacggacactccaaaggactcggcgacgacggaaggatcggaggacgaagcgcctgcgccggaagaccaaccaaagaaggcggacgagaagaagtcggaggaagcagcgtcagagccaccgaaagcgccggaagaccaaccaaagaaggcggacaagaagaaatcagaggaagccccagcaaaggagccgaagaagaaagcggacaagaaaaagaagtcgaagtcggaagaatcagtggcctccgtcagcgtgcgtcttcagcctcgaaaggtgcccgtcaacagcttcaaggacgtgcgccccaccgtgcagaagagcctcgccgggctcaaatacccgttcatcaagaagctggagaagcaggcggggatggaccgcgagaaggtaaaaacattgtcatcctttcattttttaaacattttctttccattttcagctgttctactctgcactggccgtcctgtccgtctacctgatggtcggccccggcaacactttcctcagcgctttgatcggttggtttggctggggtgggtccaaatgtcacccctttctaatgttcttcattttagtcaaagcctggcccgtctaccaaaccatcctggccgtccacactcagaacagaagtgagtaattgcatttccttttgaaatgaacattctaattttcataattttcagaggatgacacccaatggctcgccttctggtgcgccttcgccgccttctccgtgctcgaccacttcttcgcccccctcgagctgctcttcgggctgtacctgctcttcaagacggctgcgctgctctacctgggtcttccgcaaacgtacggcgcgcacaatctctacgtgaagcacgtgcacccgctggtggaccgtctgggcaagatcaaagtgaaatgaagcgcaggcaacgacaactgatgtgagaagcggccaatcgatcgatcatcccccacccccccccctgtattatatgatatcaatattgtatgtatttgtaaccccggccaatcgttaatgatgcctgatttgttgtcaaatcccgagccctttatgtgacagtgatattgtatgtgctgtgattattgttcgcaatatgattccggaaatgtataagttatattgtattatgcatctgcgagataaacaatttacagtga

SEQ ID NO: 53806 - DNA, 296 bp, Heterodera glycines
  Genomic contig location: Contig_ID=SeqID_4261; Location=1..296; Strand=+
  SCN-specific regions: Sequence locations=1-221,243-260,282-296
atcagcaactccgaaaaccccaaaaaaagtgtttcttatgacttttgaaaacataaaaaaatttggaaaagggggggggggggacaatctgaactattaccaaaaaaacaaccgccattgctatttttagtatcatatttcgccagagtcatatttttaactttaattggctaatcataatgatgtatttgtatgtacaattgtcactggaacataaaatgaattttgttacatgcatacataggatattggttaaaaacaaatggaagaaaatgcaaaaattaactttgtatagt

SEQ ID NO: 53807 - DNA, 1939 bp, Heterodera glycines
  Genomic contig location: Contig_ID=SeqID_4261; Location=3327..5265; Strand=-
  SCN-specific regions: Sequence locations=1-233,274-432,460-789,811 -956,980-1187,1229-1287,1310-1381,1403-1939
  Gene Ontology: Mol. function=protein binding; Cellular component =voltage-gated potassium channel complex; Biological process=cation transport
gagcgtgttgcgacgagtcggtgtctccgctggagcgattgttggagacgagcaaagaggaaaaggtggacgaaatcagcttcgacaaattgtgttgcggccgattgcggcgccgaatgtggacctttctggagagaccgggctcctcgctgcaagccaagacttaaaaaaaataaaaattttcccatagaattcttttttcgaaaacggtcagcccgggtttagaatttgtcaaaaataaatatatatttaataaaataacaatttaatatagaaatttgagaccattatttttatgaataatttaaaagtcccatccaaccatgcttaacttcctctgctcttccttattagtttcgaattgtgctcaacactgttcgtgatggtctccgtgctcggactcagtttcggcaccattcccgactttcaggtaaaataaataaattaatcaatcaatcctttgggctcaaaacggacaacgaatacggcacacactattcctttgtttactttttctgctttcataatatttttcaggtgacagaatatattccgacgggcaatcgaagtgtgatcacttcgaatggcacttcgattgagcgcgaggaattcgaagcggtgcgcgtggaacaccccgcctttgtgttcacggaacgcatttgcatcgccttcttcaccatcgagtattgcctgaggcttttcgcggctccacggaaactccgtttcgcgctgaaaccgctcaatttggtgaaaatgaaaatgaattaattcaatttgaagtggcattgcatgccttttaattcctttttcccccgtttcaggtcgatattttggccattctccccttttaccttgaactgatgctcactttgctcggcgtcgatgacaaaaagctgcgcgacttgcgatgggcgttcgtttttctcgctttgatttcgtctcaatttttcaaatgataatttaacttttcagttttctcgtcgtccgaattctccgtgttttgcgggtcattcggattattaaagtgcgctatttgctaattgtcttttgtccaatcatttccttttccttcgcagttgggtcgcttctccagcggtctgcaaaccttcggcatgactttgcagcggagtcagaagcaattgcaaatgatggccatcgttttgctgaccggagtggtcagcatttgcaattaatttttttccaataattaaatttaattaaattaattcacatttttaatttgaaaatgattccaccttttgcaggtgttcttctccacaatgatctattttctggaaaaggatgagctcagcacgccgttcgtcagcataccggcggcttactggtcactcactaattgccccattattattttttttgcctaatttatttatctttttctcaggtggtgcattgtgacaatgacaacggtaaaccgaaaattgattttcaaaaaaagaaatttgtcaaattcaggtgggttatggcgacgttgtgcctgcaacaacaagtgggtccatttataacaaacaaattgtccaattgattgttcaaatacgctattaagtgggtaaagtgatcgcatccgcggccataatgtgcggggttctcgtgttgggtacgaacgatggaattttattgaaaattttaatcaattaatattggttaaatccaattaataggcaattagcaaatgaaaatgtgcatcgctttttctctttcagcccttccgatcacaattattgtggacaatttcatcaaagtcgcgcaggaggagcaacagacggaacagatcaaagcagaactgctggcgatggaagaccaggaaaagcaacaggcgcaggagcagcagaagaggcgcgagaaaatcgacaagtgcaacggcggggacaaccgcgggttcgggggcggcggcacgcaaatgcttttggcatcatga

SEQ ID NO: 53808 - DNA, 2792 bp, Heterodera glycines
  misc_feature (2634)..(2634): n is a, c, g, or t
  misc_feature (2647)..(2647): n is a, c, g, or t
  misc_feature (2649)..(2649): n is a, c, g, or t
  misc_feature (2652)..(2652): n is a, c, g, or t
  misc_feature (2660)..(2661): n is a, c, g, or t
  misc_feature (2663)..(2663): n is a, c, g, or t
  misc_feature (2665)..(2665): n is a, c, g, or t
  misc_feature (2667)..(2667): n is a, c, g, or t
  misc_feature (2670)..(2670): n is a, c, g, or t
  misc_feature (2672)..(2672): n is a, c, g, or t
  misc_feature (2675)..(2675): n is a, c, g, or t
  misc_feature (2677)..(2677): n is a, c, g, or t
  misc_feature (2681)..(2681): n is a, c, g, or t
  misc_feature (2689)..(2689): n is a, c, g, or t
  misc_feature (2692)..(2692): n is a, c, g, or t
  misc_feature (2695)..(2695): n is a, c, g, or t
  misc_feature (2697)..(2697): n is a, c, g, or t
  misc_feature (2701)..(2701): n is a, c, g, or t
  misc_feature (2725)..(2725): n is a, c, g, or t
  misc_feature (2728)..(2729): n is a, c, g, or t
  misc_feature (2732)..(2732): n is a, c, g, or t
  misc_feature (2739)..(2739): n is a, c, g, or t
  Genomic contig location: Contig_ID=SeqID_4262; Location=1..2792; Strand=-
  SCN-specific regions: Sequence locations=1-253,301-444,466-584,612 -638,661-667,706-765,787-907,948-1104,1127-1145,1169-1170,1239 -1469,1510-1512,1534-1603,1625-1796,1846-1955,2013-2223,2260 -2322,2358-2607,2641-2792
accaacttttattccgccaattacgtgccaattcccggcgccatccttggcattcattgccccgctttgctctccgccgccaatccttggcaatgttttcacattaatggacttcccaaacccatcaggaatattaaacagatagacaaaaacggaaaaacatttaatcaatttccccgttttgccttacttctaattcatgtacaattacaaatgtcaatttttggatttaaacttattaataataattaagcaatgttaaaaaacaaacaaatgcaatgttataaaggcttaattttagcggcttttatcattttaattgaatatttataatttcccttttaattgcctcaattactatcatttttctctcttcaactgatcagcggataatctcactttatctccctcttttatcccttttaatcgatgattgatggcactttggaattttttgtttctcttgtcaaatgcccccgaggcgttaaaaattattccgccgcccgtgtcaaaaattttcccaccacattctttcctaatgatttatttttcgcatttttttctgtctgaaacatttaaaaatgataattcccccttcccccaaatttttgtgcctttttgagaaaatgcatttttacaattcggctttccttttcccatttagtgcaatttatttttaaaataatttttcattttttaaatttaccctttataaattgataagttatctttttctcagttttaacaattccctaatattccgttcattaaaaataacacttaaaataataatgagctgtgtgagcggcgtcagtgccacttcaatgcttaggccgtaagtcattcaaacgaatattctcagaatgtttggcccatggcaaataatttcaaaataattaagtgactcttttattaactatttttcattattttaatttatttattaaccatgctaattgttgttttctttacttcacaatttcttcacttttttacgttttttgagtctttcaaactgataattgaaaaaagctcagcttttgccgaaagcgtataatttcgccgtaggcaaataagtgaatgaattaaagagagtagcttataattgtgagaaggagaagcattggaaaaatggaaatttttttgggaggagagaaaagagaaaaagcgaaaaataaaaaaaataggtaaaataaaaaataggctttaaaaacaattatatatatacatatatatatcaatcaaattggtgttattgttattaagggtgtccggaaacatgatcgccgctgcccagcaacagcaccgaaagcgccgtcagatggccatccgaaagacggactcaatgaatttggcggaacggcacaacggacgcattttggacctgatttggtgcgagggggacgagcagtcattcagcaaggcaagacaaatggggaaaatgaccgaggaaattgccataaattggcaaaataattaatttaattgagaaatatttaaaataaataagcattatttaattgtttttgctttaaatgatttaacaaacaaaataaaattccttggcgatcaacaaaaacctttgcctttgttcagacaattcgttccaaagcttcggtggtcagctgtcacgccaccttcgcaagcggtcacagaagctcatgcgcaagttctaaaaaggactctgccgaaaatttactgatggtcccatcttcgaccactttaattccgtctctgcttgagcaagttggtgaaagttttgaaaaaatttataacaaaaaattgtgaaaatttccaaaaaatattataaatgattaataaaaatttaaaataatataaaaattagcataaacatcaatgaggtagttagactttagcttcaccagcagaaggctaacaaatataattaattaaggtgcctgaagaggaggacggacttttggccaaaatggagcacgacgatgacgacgacgacgaggaggaggaggaggaggacaacgcgacggacgacgtggacgaggagctgctcaggctaaacatcggcggctcgacctttctcattcttgtcgaggccattctgcgggctgacccaactacttttttggccagatttgtacagcttaaccaccagacgaggctaaaagtgcgaattttgccaatttttgatcaccgaatacaaaaaaggcgatttgcctataaattttatcaatgggatttgtatccaaaattttgaaaaaatttaatcaaattaattaatttgtgcattgttaaggtagccgatgcttatttgcagtccgaatgtgcctattattttcaggtaccaaataaattttttttcaataattataaattaaattgatttcttttaagcggtctccattagcatttgaacccgttttgcaatattatgccaccggcgttgtgcacaaaccgcccgaggaatgtccatcggcgttcaatggtaattgttgtttatgggtataaaataattgcttaattttgtccttcattaaggctgagctggaattctggcgcatttccaccagttatattggtaattaaatgtattttaatggacttgcaaaaaatgacgggattgggcattactattttaatattaaatatttgtaaatnattaatctttttntnctntttttaanntncntnttntnccnantctntttctccnctncancnattnttccattcgaaggaagacccaaanatnnacnaaaacancttcgaccctgtgtgagcggccgattgcggcgccgaatgtaacctttctggag

SEQ ID NO: 53809 - DNA, 737 bp, Heterodera glycines
  Genomic contig location: Contig_ID=SeqID_23100; Location=963..1699; Strand=-
  SCN-specific regions: Sequence locations=1-3,35-63,86-109,239-253,275- 612,634-649,676-737
atgaaaatattattattatattttcttttattttcaattttccaattaaatcaaagtgaatccgaaaataaaaaattgcaacaacaaaagtcatttgacgaaatatttggagaaaaatgggaagaaaaagaagaagaaaaattggaagaaaaaagagaaataattggaaaatattataaaataaaagaaaaaatcaagcaaaagggaagaaaatacacagcaaaagaatggaataaaattaactcaaaaatagcgaaaaaattggggacaaatcgaaataaaactaatcaatggattaaagaattaggacttaatcaacgaatacagaaaagctataaatcaacaactgatgaagaaaaattagaaattgtacaaaaatttattggaataaaaaatgaatataagcaaaaaagaaaatattcagcaaaagaatggcaccaaaattatgcggaaatttgtaagaaaattggagtaagcaaagggacaattatcaaatggaagaaacaatttggaatgagtaaatttataacgcagaaggaaaaattggaaaaaatgaaaatttactggaaaataaaaagagaaaatccgaaaatgagtgacaaagaaattgcaaaaatattgaaaattgatagaacgacaatttcaaaatggaagaaacaatttggagaagaattgttctaagaaagtagaagaattttttttcccgccatttttccttcaattattttacgaataaa

SEQ ID NO: 53810 - DNA, 90 bp, Heterodera glycines
  Genomic contig location: Contig_ID=SeqID_23102; Location=231..320; Strand=-
  SCN-specific regions: Sequence locations=1-90
atgccgcaacaggaaaatgcagcaaattgtgttccctgtgcaacagaaaatggacggagaacacggaatttgacaaaaataaccgtcatg

SEQ ID NO: 53811 - DNA, 261 bp, Heterodera glycines
  Genomic contig location: Contig_ID=SeqID_23102; Location=493..753; Strand=+
  SCN-specific regions: Sequence locations=1-127,178-261
aaccgattcacaagaattggaacaaattaccaattgttccaattcaggcagataaggcaaatcaattcagggcattgctaaaagctatgtatgagttctaagggatttattgacatttgcattgacattcattccattttattttattttactttacatttcatattgttgtattttttgacattatttattttgattttttttttatgcgccacataagagcactaatgtgcctgtggtttgctcaataaatataatttt

SEQ ID NO: 53812 - DNA, 250 bp, Heterodera glycines
  Genomic contig location: Contig_ID=SeqID_23102; Location=504..753; Strand=-
  SCN-specific regions: Sequence locations=1-84,135-250
aaaattatatttattgagcaaaccacaggcacattagtgctcttatgtggcgcataaaaaaaaaatcaaaataaataatgtcaaaaaatacaacaatatgaaatgtaaagtaaaataaaataaaatggaatgaatgtcaatgcaaatgtcaataaatcccttagaactcatacatagcttttagcaatgccctgaattgatttgccttatctgcctgaattggaacaattggtaatttgttccaattctt

SEQ ID NO: 53813 - DNA, 567 bp, Heterodera glycines
  Genomic contig location: Contig_ID=SeqID_23103; Location=450..1016; Strand=-
  SCN-specific regions: Sequence locations=1-108,130-567
atgagcgcggaccaaattaagcaattccttgaggccatgcgtgtgcaatcggatgccatccaacagctaatgggccaagcaccgcaaaacgccgcgtcagcgagtctgaaccaggcaaatttggcaagttccatcgacggccgaatttcaaaattcaattacgacgccgaaaccggtaacactttcgaacagtggttcaaacggtttggagttttgattgaggaagatggtaaggacctccccgagtcaacaaaagtcagactactcctcggcaaactcggcgacgatgagtacggcaaataccgcgacagcatcagtccgacccagcccgacaaagtcacttgggtggactcgatcaccaagctgaaaggattatatgccgaaacgcgttcactatttgtccggcgctacgaatgtttcaaaattcgtcagcaaccgagccaggacatctcatcgctggtcgctcatatcaatgcgtcctgcgaaaacgccaatttgagtccgaccaaagaacagctaaagtgcatatcctggtcattgcactcaacgacgagcaccacgacctga

SEQ ID NO: 53814 - DNA, 869 bp, Heterodera glycines
  Genomic contig location: Contig_ID=SeqID_23105; Location=536..1404; Strand=+
  SCN-specific regions: Sequence locations=1-103,125-242,265-480,503 -668,690-776,821-869
atgccatcaaaaaaggcactcgtcgtattgaacacaaaattgtaaacattgagcagcaacaaaacagtcgcacatcaaaccagcacaaaaattcaaacagtaaactgttttgttactataaatatgcaaaaaaaaacaaaaaaaactttcctatgtcatgaaaaggatttttagtgcctgcaatttcagtccccgacttttggcgcttttccggtgacggactctaatgtccggcgcttggatttaaacatgattgaaatccctccatttttagtctaagattttgtaaaaaattcggcatttagggacaataaacgggtttttatgccatatctttaaatattattttccaaatttagaaatgccgactcgcccaaaacccgaagtgaacatcaattctcttcagccataaacggtggtgccacgctggataaatcaaaagcggacggaaatgacgaaaaggctaactaaatttaatcggaatgagggattgtgttttgaatttgttatgatgacaatgattgtggcattttcagtgttcattaactttatttttcatttttatttttaaaccatatttaaatttgaattagcgtatcaaaattgtggcacaaatcaatgagcgtctatttatatacctaatccaccatagcttttccattaatcagaattttttaaatttgtttttactgatgcccataaataatctgtgatacgacgcgctttcacatttaacctatttacaagttcaatattattaggaagattcattttgcaatttttatttatttttttatttaaaaatatcaattttattttaccattaatgtgagttaaaatttagtacatacataattaatcaatttaaa

SEQ ID NO: 53815 - DNA, 76 bp, Heterodera glycines
  Genomic contig location: Contig_ID=SeqID_4263; Location=1016..1091; Strand=-
  SCN-specific regions: Sequence locations=1-76
tagagaaaaaaagataatgtttttctctggcactctctatttattggtacacatctcgttttttcggacggtgtgt

SEQ ID NO: 53816 - DNA, 457 bp, Heterodera glycines
  Genomic contig location: Contig_ID=SeqID_4265; Location=506..962; Strand=-
  SCN-specific regions: Sequence locations=1-18,41-210,233-457
atggacacatttaaaatttctgacagacaatacagttattatgtaagtatggttttcaggtgggtaccagggatgtgccgaatcggaatcggataatcgtaatcggattttgccttgaaatccgattattacacccctaagaattgaccttttgaaggaatttttttagcgagaataccaatgaattttgaaaaaaatgttttctgaaacgaatgttttaatcttattttaacataatgactgaaattaaatttttctcacaaagcagtgccggattaattctccccgatataatcaagttttttgttatttagcaaaaatgtcaaatatctgggaatattctccaccgctgggttgattgtgacagatctgagaaaacgtttattgcctgagaatgtggacaaacttttatttttgcatcacaatcttaaaatttatgattttgattatgaataaa

SEQ ID NO: 53817 - DNA, 1618 bp, Heterodera glycines
  Genomic contig location: Contig_ID=SeqID_23111; Location=948..2565; Strand=+
  SCN-specific regions: Sequence locations=1-68,90-234,256-548,585 -589,611-745,767-985,1038-1312,1343-1405,1427-1618
  Gene Ontology: Biological process=body morphogenesis (sensu Nematoda)
cgcttacgatttcgggtcggtgatgcattatccagctgggggcaatcatgaacagtaagaaaaatctcggattttaataacctaaaattggaattaaaggggcttatacgacctgatcactttgccacggttttatcaacaaacgattggtcaacgagaacgaatctcttttaaagacgcggccataattaaccgaatttattgcgaaggcaaaattggtcgaaaatttcgaataaattttaatttgtttagactcatgcaaaggccatgaggacaagtgtcaaaacgggggctatttgaagccaaatgattgcacaaaatgcaattgtccggacggatacggtggtcaaaactgtaaagaactcgaagagagtgagaattaattccatcaattaaaacaaattatataaattaattgaagatttgaattgtgaggatttgagtggaattgcaagagaattggtggccaataagtcagcagtgtttttgaagacgaaggccaaatgtggggggaattggccgtgccgatgccattggcgaattaaggcaataaaataatgtttagaaaattataaaattattttgagtgttattaatgcaaattttaattgctttcagcctgaagcggggaaaaaggcgcgaattcagttcaaaagtttgaacaatttgtttgaatgcacatacaactgctcatcggcgtatgttgaggtcaaataacgagccgacgaaagggcccaaggcaaaaataaataaacaattaactaattagttacaattattaatgattatcaaaatattgctcattaaggtgccaagctttgttgtgccgcatcactcactgatctgaacgcaaatgaatataaaaattggattgcggctgaaaagccagacatggacattgtcatatccgcgcgcctttcaccaaaatggaccgtaccatctaccgtattcgagctgacgtatgaatcaggcaaggaaaattgtgaaataaatttttatatattttcaatttttctataattaatttattttaaattgaaaattgtctttatttcaatggctttcgtaaatcaaaaccattacacaattaaaactgttcaaaaatgttaaggcaaagtcaaactcataaattcgaacaaatgcgtaaataccgataatttgtttgccgagaaaaggaaccccggcaccggcggtttgaaatgttatgacgagatcaagcaccaatcttatgactgctcctgtcacggtgataagaaatgccttgctgaagaaaaatgggctcacgacgcctttctttgtccaataataaaggtaattaattaatttattattattaattaatgccaaaagacaccgccaagacaaattcatataatataggcaatttaatttttaagtagagtgaagcgggaccgggacctggtagcggacaactgagtaccaaggtttcggttttgacatggacctggactagtcccggttttcccagccaaaaattaacggttcttcaactcgaaaaggtcccggtccggttttacccaaattcccggttccgcttaactctatttttttttctatcaaaaaaccggaaataataaaaaaatagggacgataaact

SEQ ID NO: 53818 - DNA, 383 bp, Heterodera glycines; identical to SEQ ID NO: 51114
  Genomic contig location: Contig_ID=SeqID_23112; Location=527..909; Strand=+
  SCN-specific regions: Sequence locations=1-20,42-275,297-383

SEQ ID NO: 53819 - DNA, 1716 bp, Heterodera glycines
  Genomic contig location: Contig_ID=SeqID_23113; Location=319..2034; Strand=-
  SCN-specific regions: Sequence locations=1-401,423-518,540-1078,1102 -1211,1242-1514,1536-1716
atgctcatctcggcactccagagaaggttgttgagaagttggtgaaacacgtgacactgctgaatgcccttcacgatcgaggtgtcgaaaacaatcaagaaaatggaaacaaatacccaaacttttgatcaaatttcatttttccaaacattttcaccatttcacatttccactatctgaatattatgttgaacacatcttttccgctttctataatattattaaataaagagtttagtcaattgaataaagtttattaatgttaattggtcttcaaaaaaggcagtgatcagtatcttttgaattaacgcgcaaaaatttacgccaaatgcgctatttggcgttatgagcaattttgtctgacactggcgcgtacccatagtgaatcggcgtctattaccaaaagaatcagcgaagaagggaagtgaattctcttcccaatgcactctctatatgactgggactgaaattcagcactctctcatttttgcgttatctctctacataaaatgataagccactcaaacaaattttaaaaattatcgcaattttaaaaatttacgttgatatttgcggtcggggtcggtttagtacggccggtttagtacgagggtcggtttagtacggcaagctatttttgtccataactgttacaaatgttttttttgtcaattataaagaaggaaaaacttataatatctatgtttagctacaatacaaatggaacagcccaatcagtagtaatgaaatctcgaattcattaattcgtcattggatttcgaagttctctgctggaactttcaatttatagaaatgatttatcaaaaaaagacaattttaccccaaacacttcgaaatgtatttgatttgcgttgtatgggctaaaaatgataaagaatgagatttttgggaatttttatgcaaaaacacacttattttttcaatttttaacacatattttagcacatattttggcatttttgggggtttttagcacatatttcagcattttttagcacatattttattacatatttcaggatttttagcacataaaaatccgggccctaccaatcaggaaataaagacaaagcgaaacaaggagaagctggaacatgagggttcactttatgttcttcacaaactcagtgacgatggacttcggaagtattggcgatgcgagtttttcggagctaacgacaaatgcaaaggtaaatgcataaaataaaataaaaactatttttcaaattcagggcgccttcacactgacattaatggtaatgtcctcaaaataattggaagccacacatgcgacatgagcgccgcacatgtggagtgtcagcgacgtataacccagctcaagcggcgtgcagttgagacgtgcgaagcgccggctacaatccgtgcgcaagtattgcagaacactgcaacccccgtgttggctgcttttccgaccaaagctgcgacaaaacaggtcaacttttacgaatttttctgccaaagtatgctttgttcatttattttaggttataaaacgtgttcgccatgacgaaaatgtaccacctgctgcaccactcagtttggaagcattggaattgccgccagcgtacagaatgtacaaacgaacagagactgacgaggagaatttcttattggcggacaccggcgtttttcaaattcagggacaggctggaccgcaaaggtaaaaaaaataaa

SEQ ID NO: 53820 - DNA, 258 bp, Heterodera glycines
  Genomic contig location: Contig_ID=SeqID_23114; Location=153..410; Strand=-
  SCN-specific regions: Sequence locations=1-119,155-179,201-258
atgaaatgcggcgtctgcaacgagacgtttttattctatattgtgacatggcaatttagctcagagaattgggggttggtcgttgggtggactatggtggaagcagataacattgtgagataatttaaatttaaaaaatccaaaattaaaatttcagaaccaaaaagagttcatcgctctttttgcaaaagaaagagaagaatttaaacccgaattgaatatctggagagtggagcccatttgcctgtccccaataaa

SEQ ID NO: 53821 - DNA, 594 bp, Heterodera glycines
  Genomic contig location: Contig_ID=SeqID_23115; Location=55..648; Strand=-
  SCN-specific regions: Sequence locations=1-161,201-348,370-594
aaattttttgaatattatacaattgtgcattttgctctctatcaatttattataaaaaaattcacttcccttcgaaattgaaggcagaatgctcatttgaagctacgcaaacataaattaatatttgctataagaactgactatttagtcaacagaaaacaaataaatcataaaattagaacaaaaaatgattttattttagaatgcaaactgaagatgcataataagctaatatattcgaatttattttgaaataactgttcaacagattattagttgtttctaagaaataatgataggaagcttatctgaaatgtgtgctcacccaggttaatttgtcatttcctgcaataaatgttttcatataaaggtttaaaaaatttgatcgggtttaggaacattcaacaaatgcatagataaattttttgaatattatacattgtgctttttgctctctatcaatttattataaaaaaattcacttcccttcgaaattgaaggcagaatgctcatttgaagctacgcaaacataaattaatatttgctataagaactgactatttagtcaacagaaaacaaataaatcataaaatt

SEQ ID NO: 53822 - DNA, 673 bp, Heterodera glycines
  Genomic contig location: Contig_ID=SeqID_23116; Location=43..715; Strand=-
  SCN-specific regions: Sequence locations=1-114,153-187,220-449,480 -495,539-557,587-673
atgggaatgcgacgactgaagcgagcattgcccttccgcgatcggtaggtcagccgtccgggcgagaatgtcttcgacggaattcactccccgcccacgggttcacccccttactaattaatttattgttatttcattttttttttaattatcaacccgtcgcttttttatcgtctccgacactcataaatgtcccatttctttcttttcactccgtcaatgcattcattccctgcgggaatgataaagtgtcaacaaaaacaaaaaaataaatgccgtcgtacattttacggaagaaatttatcggacgacggtcattcatattcgttgatccggttaagcaaaaaaaggggggagcgacttaaaataaatagtttgaataaaaacccattctaattttttagcgcgctaacttcaaaaatgggctcaattttcttttttaaaaatgcaacttttgttgaataaattaaaaaactatcacatttattttgattcaaaaattcttaaaaattataatgattcaatttatttttaaattcgatattagttgaagaatgtattatttaatattatttttgatttaaatgaagaaattaaccattgaatcttgcaccaacatctctctttattctctctaatagcaaaatgctttgtgagtctaatctcgaataaa

SEQ ID NO: 53823 - DNA, 316 bp, Heterodera glycines
  Genomic contig location: Contig_ID=SeqID_23117; Location=1..316; Strand=-
  SCN-specific regions: Sequence locations=1-316
agaaaaaagagataaccattttttggtcaagaattttttttgtttgcgtttcaaatatcgtaagattgtttgatagggccagacaagagaaggcaactgttggtaccaagtttgcggtaaaaaaatgagaaaaaagagatagctattttttggtcaagttaattttttttgtttgcgttttcaatatcgtaagattgtttgatagggccagacaagagaatgcaactgttggtacaagtttgcggtaaaaaatgagaaaaagagatagctatttttggtcagaaattttttttgtttgcgttcaaatatcgtaaga

SEQ ID NO: 53824 - DNA, 469 bp, Heterodera glycines
  Genomic contig location: Contig_ID=SeqID_23117; Location=562..1030; Strand=-
  SCN-specific regions: Sequence locations=1-469
gtttcaaatatcgtaagattgtttgatagggccagacaagagaaggcaactgttggtaccaagtttgcggtaaaaaaatgagaaaaaagagatagccattttttggtcaagaattttttttgtttgcgtttcaaatatcgtaagattgtttgatagggccagacaagagaaggcaactgttggtaccaagtttgcggtaaaaaaatgagaaaaaagagatagccattttttggtcaagaattttttttgtttgcgtttcaaatatcgtaagattgtttgatagggccagacaagagaaggcaactgttggtaccaagtttgcggtaaaaaaatgagaaaaaagagatagctattttttggtcaagaattttttttgtttgcgtttcaaatatcgtaagattgtttgatagggccagacaagagaaggcaactgttggtaccaagtttgcggtaaaaaaatgagaaaaaa

SEQ ID NO: 53825 - DNA, 102 bp, Heterodera glycines
  Genomic contig location: Contig_ID=SeqID_23118; Location=606..707; Strand=-
  SCN-specific regions: Sequence locations=1-102
atgaggagccgggccaaaagagttgcaacggatgtgagccaagttgtgacaatccgaagccggagatttgcactgcgcgcttttgtgactgttcatgcgact

SEQ ID NO: 53826 - DNA, 49 bp, Heterodera glycines; identical to SEQ ID NO: 51181
  Genomic contig location: Contig_ID=SeqID_23119; Location=705..753; Strand=-
  SCN-specific regions: Sequence locations=1-49

SEQ ID NO: 53827 - DNA, 55 bp, Heterodera glycines
  Genomic contig location: Contig_ID=SeqID_23120; Location=1439..1493; Strand=+
  SCN-specific regions: Sequence locations=1-55
atgtgttttgcgatctttggacaacggatggccaatgtgagaggagcaattcaag

SEQ ID NO: 53828 - DNA, 1274 bp, Heterodera glycines
  Genomic contig location: Contig_ID=SeqID_4266; Location=483..1756; Strand=-
  SCN-specific regions: Sequence locations=1-245,267-696,737-740,762 -911,933-1038,1060-1157,1187-1274
atgtgtgagggatggggagcatctcgttcggctcccggtaaattggacaccagaaaattggacaccgaaaattggacactagaaaattggacaccaatggaaaaatggacaccagaaaattggacactgttgtaaataaaaatgaaaataaacaaaataaattactaaacaaaaattttggtttggcctaaaagatctttatcttaatctgccatatgttgtttataagcgtaaataatatggaaatgaatttgttattatttttgtaacttcaggagaagaaaaacatcatatcattcataaagaaataagttttattactcatttctggtgcattttttggcccattgatcaatcgtcacgttagagggaaaggaatgaaacgcaaacagctttatattgagcaagatgaaaatcttcgggaaatatttgcaacgcgtgccgatcgtcatcccctccaatatttgagggcaattgcctatcgaatgcctgatccactctaagtgccttaatgcattaacccatttattctactcaaatttattggcaatcatcaagaattggtgtcccgacgaaaaaaaatgttaaaattttggcaggtattttttctaggcttaaaaaatgcgccgatcacgaatctgagctcagattttgaaaatcattgatttttatctaagatttttcgtcaactacttgattattttcaattttttaaattatttttaaaaaatttttagcaatgaattttggcttaaaaaatattctgatcacgaatctgagctctgattatgcatgaaccttcattttgtctatgatttttcatcaagtgtcataaaaaaataaaccgcagccaaacggactcgaacccaaggtctccttctcatcctgcgcatgagtttttacgcccgactaaatttcttaaaattttggaaaaaatcaagtagtcgacgaaaaatcttagataaaaatcaatgattttcaaaatctgagctcagattcgtgatctgcgcatttttcaagcctagaaaaaatacctgcaaaatttttaatattttttttcgtcgggacaccaattcttgatgattgcccaaattttccattcccttgcaattcgttgattcaatttgtatttcatttttgaacccccaaaaatttggattttttgtaaattttttaaattttatttccagcaaatttccttccgttccattgctgtgcccgtgtttggcgaagcgcggctggccaaatgggacgcgggttgggagcgggtgaag

SEQ ID NO: 53829 - DNA, 168 bp, Heterodera glycines
  Genomic contig location: Contig_ID=SeqID_4266; Location=1560..1727; Strand=+
  SCN-specific regions: Sequence locations=1-168
gatcttttaggccaaaccaaaatttttgtttagtaatttattttgtttattttcatttttatttacaacagtgtccaattttctggtgtccatttttccattggtgtccaattttctagtgtccaattttcggtgtccaattttctggtgtccaatttaccgggagcc

SEQ ID NO: 53830 - DNA, 1680 bp, Heterodera glycines
  Genomic contig location: Contig_ID=SeqID_4267; Location=105..1784; Strand=-
  SCN-specific regions: Sequence locations=1-13,35-203,225-237,259 -301,323-593,617-1027,1051-1069,1091-1364,1386-1680
gtgatcccgaaaatctccaaacaactatagttttcacgactttttatcttttggggtcttttttacccttttggtttttcgtagccattcatttggtccactaattgatactatttttagccctggttccgattcgtttgcttatgaaaatccatggccaatgctgaacaagggccgtcttgattggtcagttttactcctttttaatctcatccatccatttttggaccggaattgaactggaccattcaaatggcctagcaaaagggctgcgtgccttccccgtcttcctaataagcaattcttccatttttaaacatttccgacaaatgttgactggcacaaacgcaccaaaaaaactaatagaattgggattttttcggtagccattcacttcgcagcaaaaaaattttaaattttttgcctaaatttctaacaaattattaaaattccaaaaaaactctccctggcagcgtttttcggcacagtcggacccctctcaattccccataaattttttgaagaaagtgtaccgcaaaaaaggtgctacgtaaagcaaccaccgaaatactaggctttcccggattatacaccatttttattttgcttttatttgaaggcttttcaacgacggttggcgtcgaccactcgcggctgaccaaggcgctcacatggtcgggtttttgtgctgaaatccgtcgtttcccccctttttaaaaaaattgggtttagcgtcgccaatggatctatttcaaatgcatccctcgcgacgagcacaaagactggaagaagtggcacggcacaatgcccatcttcggcaccggatgttttgtcatgttgacctttgtgtggcaatactgcaattccgactggtgagcacagcgagcaccagcagatgacggggggctcaatgggcagttcgtacaatggaattttgtatttattttttttaattttcggttaaaacttggaatttttttcaaaaaaccaaacctctaaaaaattttttgccaaggtttctactaaatttttcaagtttaattaaattttttgaacatataatatcttaggtttttggtttttcttgagaaaaactgtacgaaactccattgtacgaactgccatcacaccgggggaggggtgggctatgggcggaagatctcgtggttttttgcacaaaatggatatcactgccttcattttccatggtcatattttctgatttaaaacattgttaaaaaacaattagataactcgactatggtggcacaacacaatgccatttttaatcttttggttttttacacccacaaatgtgtgatcaatgaatgcatatattaaaatgtcatcagtttttgatgagtctcaaaatttcaaaaaatgccttaccatttaacttttcaattttaagttatggatttttgcccatactttttggttagagtcttgtatcaaaatgtctcatttttgtaatttaatgctaaattcggtcccttctaaacctttcccccggcgttaaggcccagcgcgaaagagtgggcactgcgcgaggcgcactttgaactcgtccgccgggagcgtgccggactgccgctgatcagcccggatctgatcgaacgcagccgggtggaggcggctctgccggcggaggaagagctgcgcgactttgagattctcatc

SEQ ID NO: 53831 - DNA, 877 bp, Heterodera glycines
  Genomic contig location: Contig_ID=SeqID_4268; Location=1281..2157; Strand=+
  SCN-specific regions: Sequence locations=1-494,517-527,550-804,827-877
  Gene Ontology: Mol. function=peroxidase activity; Cellular component =extracellular space; Biological process=protein targeting
atgactatttcgattttgggtcaaatttttgaggaaattccgggtaaaacttaggggtttaatttacatttttcgccgtttcccttcgctacgacccgccccattgcacagctattaggcattcgtcgtaacattttcatagcagaggcagtccttttctcgttttaaggcggttgcaaaccgttcccttttccgccaatgtctttttcgaggcgtttgcctttcgtttaccgcggtaagtgcgaggaaaaatgcgtaggatcacagcacaacggggaagaagaatatagcagtcaaaaaatgaaaagtaaaacactcggggacaatctgtctacaaaatcctttttgtcagcgatcgactggcacactctttcacgaaacgtctgctgggagcaagtgatcaaggaagaactgttctacaacggatcaattcccgtcgatttcattgtgtacaatcatttatttgtctatgatggtggaattctcctacagagaagagtatgttttttaataggggtccaattttgaatttggttgggggtttgggttacaatagattgaatactttcattacgttttcaatttttaggaagacggtgttcaaagaggtgcgcacgtcgttcgactgatcggttacggacgcgtgaactgtacggacggacggcgtgtcaagtactggttgggagtgaattcctggaacacatcttggggagaaaatggcggcttcttccgtatcaaacggggcgaaaatgtgtttggcattgaatcgcgtgacatcagttttgggcgagtcgagttgccatgagacgaagacgaagaggagagagacaaaatacggcacaaatttctagcaaatcccaggctttacgaaaaggga

SEQ ID NO: 53832 - DNA, 2933 bp, Heterodera glycines
  Genomic contig location: Contig_ID=SeqID_4269; Location=453..3385; Strand=-
  SCN-specific regions: Sequence locations=1-15,53-257,287-888,910 -1142,1190-1495,1517-1628,1651-1823,1847-2074,2096-2110,2132 -2620,2642-2933
  Gene Ontology: Mol. function=oxysterol binding; Cellular component =cytosol; Biological process=Golgi to plasma membrane transport
gtgtcattcatcgctgaacaggtcagccaccatccgcccgtctccgccttctatgtcgaacatcctgaggccggcgtttcatgcaccacacacatttacaccaaatcgtccttcctcggcctggccattggcgtccaaatggtcggcaaggcgaccgtccgaattcacaaggttgttggtctgctgggttctgtgaataaacttttttgttttcaaaagccgatgccattttgttcgtaaaatttaaatgcgttttcatttatttattttttgttttaaatattatcacttaaattgtagcaccacgaaacatacattgccaccttccccaacggttacggacgcgcaataatggcaacgccgtggtttgaactggcgggaaaggtacaaaaattgttcatttttggatgtctgtaacaaaattattcaattttttcaaaggtcgaactccgttgcgagaagacgggctatcgggccgaaattgacttcctggccaagccgttcttccgcggcaaagcccaccaaatccatggccaaatctttcacaccagtcgaaagactgcgttgatgcagctgaagggagaatggaacggggaaatttacttgaagcgggacggagccaccgactaccaactgttcaccgatgttcggcaaaagccggatgttcgaaaggtaaatgatgcgggataattctttaaaagtcgctcaaacaaatactcgttcacttgcatcgagatccaacaaaagcaaaaaacttattatgcatattgtaaccgctatttgctgattttttcacctataccgaaatttcaaaaaatgtttgccacaagtggaaaaaatctgaaaaaacctctttttaataaaattgctatattaattgaatttttatgagatttttaaataaattgttgatcactatgacaaaatttcgtggacactcaaatatttaagagttagttgattattttttgaagtatgagtaccatatttcttgaaaaaacaaacaaccatgtcttttttttataggaatgtgtgccggtcagggaacaggaggacagagaaagtcgcaaattgtggcgtcacgtcactgcagcactgttcagcaacaacatcgaaatcgcatcccaatgtgggcttaaagcaaatatttatgtatttaaaattacatcatttaaatttaaaaaatttacaatttggtcccttttcagcaaagcgatgcattgagcaacgccaacgggacgaaaaggtggggcgtgagcggctcggtcaccagtggcaaccgcgcttctttgtccgcatcggcgacggttcaccgtccgactcgtggcggtactgtgacgcgttggagcaacggacgacgacggacgggccgtagttatggagcagtacaacaaccaaacagagtgtgtgtggttgatgaaagaacagatcgacaaaaaacaaccaaaaactgcacggattcttctaattattattgtctattcgttcgttgttgtcctctttcatcatcatcagccgatgaaattaatatgttataattataattgtctttttgctcccttcgttttttggcaatgttgcgtttttcggagagcgacggaaagacggattttgtttttttctgaaatttaaatattttccattttcaaaattaaacgattgcctaatgtacggttcactctccgtcgcttttttccaagcatttctctcctcgtcattcagttcaaaaagcggcccaaagcacaacaaatgaacaaacacaatcaatcagtcattcatcaattgtagaattgtttatttagttacctattttaatttaaataaatgttttcttatttgtttgttagttatttttgtttccgatcattttcatgaattgttgcgcttttgctactgttgagtttctcatgctttctaagtctcaaaaatgaataaaatcaatgcgctcttttgtgttttttaccttattttcttggaatttgccaattgttttccaaagttccaatataattttcgcggcattggcattctaattactcttttttttcttttttaaacatttccattcgattgttgattgatttcaaatgggagcagcgctgacgtccagcttcaaattcattgggggaggtggcgttcctcataagatggtgtttgtcatcaatacttcgcttaggatggggcctggcaaaatggcggcgcaggtcgtgaaaaattgttcaaaaaatttttttttgaattttccttgttaaggttggacacgccgcggtggccctgtacaggtcggccctcaagtcggaggagggacgaaacgcgttggactattgggcacagcatggggagatgaaagtacgaagagatacagcaaaaataacctttccttaatcagtcaaatgcagccgagacactcaaaattcatcttttaggtttttttttttttactagagcgagccgagaccggcttttaccgggatcaatcattttggaaaggccggtttttgggagagcgcgccaggaaaccattgcctttgaaaatgtcagcgcggccctggaagattcggaaatctcgctctcaaatttttgcaagcatcattttctgttcagagcgactaaaacagaattttttggggtggcttggctttggtcatgaatatcatcgatgtcacattttgagtcccgctaagatttagtttttatgaatggcagttttttgtttttacacattttttctcactcagattgttctccgtgccgacagtgccagccaactgtcggagttatgcaaacaggcccaccagcatggattgattgcgcagctcatccacgacgccgggcacacacaaatcccggccggctcgtgcacagtgctcggcattttcggaccgcgtgaagaaattgacgaagtcactggccacttgaagctacacaattga

SEQ ID NO: 53833 - DNA, 1223 bp, Heterodera glycines
  Genomic contig location: Contig_ID=SeqID_23122; Location=1260..2482; Strand=-
  SCN-specific regions: Sequence locations=1-39,62-125,148-149,172 -248,270-308,330-355,377-504,526-1048,1071-1223
atgagattggtccaatcactcaacaatagggtgaaaaggaaaaaggaaaacgcaaaatgggaaccatggacggtaaaaaagaaaaaaaagcggcaataaatcttttttatggataattatgggaaaaaattggcgttctgtcacatttactttttatctttatttctctcacttttacgtactatctcttcattcttaataatgtaaagaacaacatttacttcgctctatagaacttttttttcgccttacagaatttcttcatattttgcatatcgatagagaaaaaaattctgaatcgattataaggaaatttaatacaaaaataaggccaactttagagttattttaaccgaaataataaaattatttttttcaggaattaatgagtaaaaaaaaattaaaacaaaagtctgacgtgaagaaacccgtggcgtttacttgccggtgccattgtccgccgcttgagccgatcgatcagcccagcaggacgaatgaaactgatcagtacaccaaaatctgtcccaagaaagcgcaactcaagtggacaacaacgcttgtcggcctgggatgacgtccgactttgccaaagcgttggaattgttcctgatcaacgaagaagattgaaacacgaactcggcctacttggacgcgacttttttgccacgtctcagtcgttcatggatgagtaccgcggacttttcaacggcgaagtgtatgccacccgtcgtattgatgcagaccgtttccctgtacttttaccaaattttttttcaaattttcttaaaattaagagcggccaatcgacagttgttcttttctgcacaaatgttgctggtgttctcacagagcgtgtgaaacggcttcgggccagcaacaaattgcgtgttcttcctggcaatgcgctcaaattgtgtctcgctggtgattttggtggcaatttcatgaaactgggcttcctaattggaaatgtggcaacccctggggcagcttcaaattttactttgcttgggtgctacaggggtaatttctgagcaagccaattgttaacatttacatgtgcattttataggtgcagaaacaagtgcaggcattcgcgttgcctttgcggacgtggcaagacaattggccgacatatgtgaaattgatggcctttcgacccaatttttcctcaccggcgacctgatttttcatacatttttcaattttttatatttaataaa

SEQ ID NO: 53834 - DNA, 87 bp, Heterodera glycines
  Genomic contig location: Contig_ID=SeqID_23122; Location=2131..2217; Strand=+
  SCN-specific regions: Sequence locations=1-23,45-87
ttaaaataactctaaagttggccttatttttgtattaaatttccttataatcgattcagaatttttttctctatcgatatgcaaaat

SEQ ID NO: 53835 - DNA, 1094 bp, Heterodera glycines
  Genomic contig location: Contig_ID=SeqID_23122; Location=2672..3765; Strand=+
  SCN-specific regions: Sequence locations=1-213,253-505,529-1094
tagatgttaaaaatggtttggaaaaagacagcagacattttgatcggtggcaaggtgccacttgcgatttatcactccaaccggtataactattaatacatgttaaatgttacaacaaaatgtttattctttgaaggtcaaaaattcgcgtatttgtggccgagacacctgggccaatggtggatgggcacataacttttggtaaaaaataggaataataaaaatataatttctattaaaaatttaatttttctgaaaaatatctgcttgttgtaattctttggatactggataaaagtccatttgactatacgtcccatgttttttttaattgtacggagatatcggtatttatttcttttgtgaccccctcccgaattttttttttttacattttttatcttgcataattttaggcgctggaaacgcacctgttgtttgcactttaccttaaaataaatggcgcatgcgttttcagcgtctaaaattgcccaagaaaaaatgcaaaaaaaaaaattttttttttttctgaggggatcacaaaagggataagtagcgagatataattaaatcaaccataaatataaacaaatcatgggattggtaatcaagaaccttttgaaaacttgttcagtcaccgaaacccacacaaatgatgggctgccccacacgctggaacaccttgtgttcacgggcagtcagcggtacccctacaagggcatgttggacataatcgccaaccgctgtcttgcgagcgggacgaacgcgtacacggaccaagacaataccgcgtacgaactccgcactgccggaagcagcggttttttgaaggttctccccgtcttcttggaccatctcctgcgaccgacgttgacggtacaacaacattggcaaatttgcggttttggcaaaaaatgatttaggcatttcaaaacttaaacatacaaatttgacatcaatatctttttttgaatcatttttaaattttactttcagcagtcacaatatgacacaaaggtgcaccacatcaatggcgagggcaaggtggcctcatataggcgccaccaaaaaataaaaagaaaaattacaataaa

SEQ ID NO: 53836 - DNA, 774 bp, Heterodera glycines
  Genomic contig location: Contig_ID=SeqID_23125; Location=781..1554; Strand=+
  SCN-specific regions: Sequence locations=1-19,50-695,717-774
atgaaaaagggtgaagacgacactgctactgctgctgctgctgtcccacgaggcaaacggcccaactcaaactctgtatcagctgcccatttttctactgaatcagaggagatgaaaagttgtaagaaggaagagccgatggcgaccggatgtcgcaaaggtgcgaaacgacaatacccttattcgttgatgtcagctcgagcccaagatgtgtggtaagttttcagacccaaagtaaagcgtatgaaaataactcaggtcgctaaaacttgaccagttggaggagaaatattcaagaatggaagaggagctttcggaagacagcgatgatgcaattgatttctacgaagacggtattgatgatattgtggaaaagtgagttagcctcctttataccagctagaatgttatccattcatcctttttttaaggataaatcgtttcgaagcaaaagtgaaaaaatggtcagtaaatcatggaaatacgccagttgtcaaaaaaccacggttagttgttttcaagcagacagaacgcaccacatattatgacaacatactgaattttacagttataacacaaatgctgatgagaatagcaatgatgctgatgatgatgcgccaacatcgactgtgtacctgaatttgcacaatgacaagatgatcgagaaaagcaattaaaaaaatccctgatatggtttaaaatgatgataatgatgaggatcataaaaaactccgatatataaaccgattattttgtgagtgttttattacccaa

SEQ ID NO: 53837 - DNA, 642 bp, Heterodera glycines
  Genomic contig location: Contig_ID=SeqID_23131; Location=177..818; Strand=-
  SCN-specific regions: Sequence locations=1-170,192-327,349-642
atgccatcggtttgccgagtcacgagaacgtgtgcacagtgagtgagccaaatgaacacaatgccaatgaaagcggcaaatccattcggtttttgagcagtccctttcagacggtcattcgctccgaccatcgcccccaatttggccgcggttggtccctttccttttggttggcctccgtttttggctaatcagctgcattttagaacagaatggcacgctagtggagatacagcaggatgaaaatcgccaattcagtgccacttttgtggagtgttcaaatacgaaaaaagggaattgccatggcattgacaacgcaatgtgagcaaaacaatggcacattgggccattctcagtttcattttaaatggcattcctccaattgcttcagcttttcctccgaatgcgtcactttgtatgagtttcgtccggcgggcgttcgtgtggagggaaattcggcagaatttgctgaaggatttgtccgcgtgccgatcacttgccaatgccaactccgacggaagaaaaagcatggaatttattccaactgagtggccaaattctcagaatgaatagaactcaatcaacattaaccgtttgatgaacccatttttcccctcgacgcattctttccaaccaaataaa

SEQ ID NO: 53838 - DNA, 1193 bp, Heterodera glycines
  misc_feature (1062)..(1062): n is a, c, g, or t
  misc_feature (1097)..(1097): n is a, c, g, or t
  misc_feature (1115)..(1115): n is a, c, g, or t
  misc_feature (1117)..(1117): n is a, c, g, or t
  Genomic contig location: Contig_ID=SeqID_4272; Location=73..1265; Strand=-
  SCN-specific regions: Sequence locations=1-111,156-230,253-303,353 -393,420-488,560-809,831-1029,1052-1193
atggaaattggcattgcacgttctttgcaattgcttcttagttcagtgctgctcatcagtgctttatacctttatttggtatgaaatttttaaatatccaattaattcacctaatttttaatttgaaaaattcatttaaattaattcaaaattttcggccgtgcctgactggtggatttacgcaatcccatgcattgtgggcggtgttttgaacgtttttccgcactccggttgtccattttggcgcttttttgccagtgcattaattgttctcggcacaattgagacgtatgtaatttggacatttttatttaatttaaaaattaataaacaaaaaacattttagccttttcctcgtttggtccatacggtaagaaattttttggtaatctattttaacaaataaaatattttctaaattgtgcaattattttttaattggccgcatataatgaaccaaaaaattcctctaaatttttacttgccagttttaataacaatttaaaaaattagaaattattccaaaactttctaattattttttgaatttaatttttttcgaattaagcctcgttgagcagtcacccttcttcactgcctcctcagaatcttctgcgcgcctagaactgtttgaagggcgcctgattttgttgccggcattggccgtttcacttaccatttccacacgactcggtacggtacacagaaaaaaatgcatttaaatttattaattcacaacaatttttattcgtgtattttaataacttttaatctctcataattttttaaaatagataaataagtgtgttaaatttttgttaagcattttctacactttttaatatccttgtaaattttgctcaattctgcatgctaaatatagacaaaatattccaaacaaaaaggggcctataaaatatgaaaaaattaccaaaagaatttggaatttagtcatttaaattaatgtatttaatttgttttcctgaattcggagtttaatatccatttcctacaattaatccaaaaaactaaattaaaatttttaaatttagaataaccaantaaaggtattttataaaaggatattttttgcttanaaaatgcttttatcatananatggcgttgcatcttccgaatgccaaaatcaaacctccgttcgaaaaatcatcaaatttttcaggcctggcaataa

SEQ ID NO: 53839 - DNA, 184 bp, Heterodera glycines
  Genomic contig location: Contig_ID=SeqID_4272; Location=2846..3029; Strand=+
  SCN-specific regions: Sequence locations=1-6,42-65,93-127
atgaacaacattgcattcattgcatttgcattttcagcgcttttcgaattcggtaaaaatttcagtaaaatattttttttttttttaatttaggcctcgctcaaccgaagccgacgcctgaaaatggtttaaataatttttaaatatcttgttttaatttaaacatgattatttattttataaa

SEQ ID NO: 53840 - DNA, 1342 bp, Heterodera glycines
  Genomic contig location: Contig_ID=SeqID_4273; Location=184..1525; Strand=+
  SCN-specific regions: Sequence locations=1-93,167-242,266-402,424 -639,661-920,942-994,1050-1101,1125-1295,1324-1342
atgttgaaaatacccaatcaccaatggatcagacatctgagattcatcgagaattggccaaaggtgtttaagcaattaaggataaatagccacaataaaaattaatttattaataaattattcaaaaatttaataaaaattaaattaaaatttatttaaaattttagagaaaaataaagaaaatgcacaaacatcaaaggaccagccgacatcggcgggtggtcaaaatgaagcaatcccttcaccaaaaaagccaagccccaaggggaagttgaaaagcgattttcggcctaaacttggccaagagcttttccacggccggttccgaaaggttacaacagtcatagggattaatttataaggatattcatcgagatcctcattctcggttctcgagttaagaaatttcttaggtttttcgtttctctgatccttgccttggctaggctgtcctaacaatttaaccatccctggtattaccagggaatgggttttttggatctagaaaactgtcaaaatatgcaggatttaggactcaaaaagcccttaaaaagaatttaaaaaatcccaattttatgggagggtattaaattggtcagaaaatttttttggcctttatatattattttgtttatttggtacatcatttttcattgaaaatggaatattttagcaaactttctgacgtacgccataataggacaaaattaacgcttcttaaatatttttcgaacctaaaaaactcaaaggtaaaattccaaaaatcctggtcctatttattcattcatccatttgatttaacagaattttattttcaaaacacagtatcattgacgcatttccttatccttatcattcatacgatttaggaaaaaaagttgaaaatacactatcatcaaaggactcggcatctgaagctcacaaagaattggccaaaggtgttcaagcaattaagaataactgtcccaaaaaatgttgttgataaaattatcccaaaaatataaattaattatttttaaaaaattttagagaaaaatgaagaaaatgcacagacctcaaaggtcccgacatcgatggaagggcaaaatgaaccaatcccttcaccaaaaaagccaagccccaaggggaagtccaaaagcgatttcgtcctaaacttggccaaagcttttccacgaccggtgccgaaaggttgcacagtcatgggcattaatttatatgcctctgggtccttttcttgattctcaagtgtagtaatttttctcaggttttttttttctgggtccccgttataggacaaaaaaaattctttaaaatatattttttggacctaaaaagctcagga

SEQ ID NO: 53841 - DNA, 1383 bp, Heterodera glycines
  Genomic contig location: Contig_ID=SeqID_23135; Location=199..1581; Strand=+
  SCN-specific regions: Sequence locations=1-12,34-141,183-253,275 -372,400-409,656-740,935-960,983-989,1111-1243,1278-1383
  Gene Ontology: Biological process=embryogenesis and morphogenesis
atagtcttaaaaggggtgtgaaaaagggtgcgcatttggcacgggacaaggcaaaagatgcaaacagttacatgcacgagaagggacggcatcactcggaaaataatggtaaaacgacaaatgccaatgtgaaatttcgggaattaaaattttgatttaattaaaattcatttttaaattaagaaattccacgccatcattcatcatcatcatcaatgtcaaaaggaaggcattattcatcagcaaaagaagggaatcaaaacaaaaggagcagaaaaggtgagaagttaaattggcaaggaaagttgaccaatttggcatttatgtatttaattatttaattttgcaatttgagagacaaaaaatttgaataataagggggaaaagggggaaaatgtgaggaattttgaagaaaacgaacaaaaaacaacggaagagaatttggaagaggaaaaggaagagaatatggaagaggaaaaggaagagaaagagaaaatggaagagaaaaaggaagaggaaaaagaagagaaaatggaagaggcaaaggaagaggaaaatgaagagaaagagaaaatggaagagaaaaaggaagaggaaaaagaagagaaaatggaagaggcaaaggaagaggaaaatgaagagaaagaggaaggaggtgaaaaatcattagaaagtgaggaactaagaagaagaaggcccggaagaaaatttgggtttaataatataagcaaaagcgaagaggaggaggaagaggaaagtgaggaagaaaacccattggaagagaagaaagaaaagggagaggaaaaggagagagaggaaaacgggggagagatggaaaaacaaaatgccaaaaaggaggaggaagaaagtgccaaaacgggggaagaaatgggaaaggaaaatgccaaaaagggggaagaaaaggaaaaagaaagtgccaacaaaggggacaaaacgggcaacaaaaccaataatgaaaatagtgggggagaaaagcagaaagaaacagcaacaaatgggaagaaaaatgacaaaaaggaaggccaaaagaagaaaaataatgaacaaaatgcaaaagatatggacaaaaatggtaaaaaagaaaaaggacaaatggccaaggaaaatgagacaaaaagtgccaataatgggacagtccaatccgcgacaggtgccaatgccaacggcggagcagcgaaatggggcggacagcgggcgagtgccaacaacagcaaaacggtacaataattaaggggatttatttaattaattaatggattttttactgatttagaagcggcagccaaaacggaggaggatttatgtgttcagtgacaacatttcgaattcggcgaaaagcaaaagaacaaaaaatatggtgaa

SEQ ID NO: 53842 - DNA, 1437 bp, Heterodera glycines
  Genomic contig location: Contig_ID=SeqID_23136; Location=82..1518; Strand=-
  SCN-specific regions: Sequence locations=1-390,603-758,783-842,870 -1142,1164-1437
atgggcgacgacgactggacacgtgcaaacatcggcgtgcctggtgccaaaacagtgcgcgacacacgctgcacggtgaaagacctgccagagaaggaacagttcgagttccgtgtccgtgcggtcaacaaggcgggcgagggcgaaccgtccaacctcgtgttcactaccgaccagccgggccgtcccgtattcgacatgtccaacttgaaagacaccacaggtggcggatgcattgcttattgttaaaagttgaaaagcttttatagtggtaattgtgtctaattaggtgttcgtcattgtgcttaatgctaattttctaagatttatgcttgagaatccaagtcttagttgaattttttcaagccctgattgcctaaacagcactacttttaaaatttacttttttatcaaattaatactttcattttatttaaaattatatattttttaaatttatatatttataatataaaatttataaaaatcttttaattttttaaaaacaattattttatataaaagaaaataactttttttttcaaattagataataatacttttcacatcattttatatagaatatgttttattaaaataatggattttgtttcagactcatcagatcaaccattgtcatccaccgcccgtcgcagcgagtcgcgcagaccgaaaagtgccagaaaggaagccgcagcattgacccccttggacgccatgcagtggttggttaaacaaaaaaaaacgaaaaaaagtttaatcatttattttattttttagttgcagcagccatttgacgccgccacatcccaaaaacatggtgagcaaattcgggtttttaatttttttttttttttttgtttttttttcaataattccttggtcatagtaaagtttgttccgcaccctttttcgaaaattttttccattggttttcatgtcgttgatcacgaatccggcctccttttcgaccaaatccgaatcccggacccgaattagaaccaaagtcggaaattgattcttcacaaatgctcctttagtgtccaaaattgattcaaatacatgaaatggccacgattccctattttctatacaattcagtgcatttggatcgatttgggcaataaggatgtattgtggtataaaaaattttgactgtgggtagaaatagaggacggagttcgaaaatgaagtatgtaaatattctatagaatttggccacattcgtggcctaggcagtcagaacagtcaggttcttccagcggcggtcggcacgaaatatcaggaatgtatgtcgagaaaagggatgagggggtaacaattagaggaagtagtggtcgggtagaaacaatactttgcataaatcgacatacatgtgaaattatattaatgcttttcgcgagttaattctaaagaagacaatgagcgacgaataaa

SEQ ID NO: 53843 - DNA, 1226 bp, Heterodera glycines
  Genomic contig location: Contig_ID=SeqID_23138; Location=655..1880; Strand=+
  SCN-specific regions: Sequence locations=1-201,256-365,388-489,522 -590,613-629,651-725,793-1135,1174-1226
atgaaaaggccttcttcggttgtcgcttttggtagtcatttatttgtcggctttatcctgttgtcgcttttcattggcactttgggcactgagaaaaaagaggtgaaaattaaaatgtaattaataaaaacttgaaaaaatcgaatacaaaacaaatatgaaaatgcgaagcaaattctgtgaaaaatattccattttctgattatatttcattttttaatttaatctttaaatttacttttaatagtaaattttctttgcacaattcagacgaaacctgccgctgctcattctcccgccgatgtaagaaaagcattaattattttaagttaattacataatttcatttgcattttcaggccaaacatccgccgccagtcgccgcccacgcggccgctggcgccggccacgcctccgatgtaataaaataaagcataaatatcaggggacattatgtattgtttgttcagccgaaacacgcttctccttctcccgctggggctgctgctgctgcttcccacgctcatccgcccaatggcggcgccgcccacgcggccgaagtgagtcgaaatttttagagaaattagtacaaattaatttgaaaaattaaaaggcaatttaagcagctcattagcttgttgatttttgtgctttttcagccaaaacatgctgcggctcccgctatcaaaataactgatgtaagttgggaaaaagcacttcccaattttaattaattttaaattgttttaattaattttaaattgtttaattaatatataaattattttgattaatccttaaattatatttctgattcacaggaggccaacaatgtttactcggtgtgtgtggagagagacgttctgccggcgccggaaaatgcgtcaaaggacaaattgaaggcaatcgctgcgaaatgcgacgaatgcggggcggcaaaatgcaaagcgaaatgcgggggcaaagaagtgaacgacgcatgccgaacatgcattatgcaaaactgtccaccggcaaaataaaaaatagcagaaatgaggagggaaagaaaggcaaaaacggcacggaaggaggacaaaatgatggcacgacgagaaggaatggatgaatgaatgcacataaatgaacaacatttcacccactttttgtgatttgaattggccaacagatcaccacttccaactgatcattctgatcattcatgccaaaaaaacaatagtccataa

SEQ ID NO: 53844 - DNA, 304 bp, Heterodera glycines
  Genomic contig location: Contig_ID=SeqID_23140; Location=557..860; Strand=-
  SCN-specific regions: Sequence locations=1-304
aaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagacatttttctgggatagagtataaatttaaaaattccctcaaaaataaaaggtctattgcgcaccgccctccctatcatg

SEQ ID NO: 53845 - DNA, 304 bp, Heterodera glycines; identical to SEQ ID NO: 53844
  Genomic contig location: Contig_ID=SeqID_23140; Location=937..1240; Strand=-
  SCN-specific regions: Sequence locations=1-304

SEQ ID NO: 53846 - DNA, 159 bp, Heterodera glycines
  Genomic contig location: Contig_ID=SeqID_23141; Location=120..278; Strand=-
  SCN-specific regions: Sequence locations=1-122,145-159
ggaagctattcccgaaggattcggtctccccataaatctgggcgcatcggttcggggggactgccccgaaaacaaaaaaaatcaattttttcaaggggccgtttgggggactccaaaaattatggggaggaaaaatccaacgccgaattaaaggacagg

SEQ ID NO: 53847 - DNA, 861 bp, Heterodera glycines
  Genomic contig location: Contig_ID=SeqID_4274; Location=1391..2251; Strand=+
  SCN-specific regions: Sequence locations=1-31,54-621,644-677,705 -750,772-861
atgctttccgcgccgttcggtgcactgctcggcgccgtcgtcgccgtcgccgttttgctgccgtcccattgcaatggtaaggcaaacaaaaactgttaatgtttgagggtggatggttcatggttcagttgaggagggcattcggacatttcagtcccaagccgtaactctttgttcatccatatttctccatttcagaccgaaaaagagtcggtccgggttcaacaccataagtttggtgtgttgcacaaaaaattaaactgcaccaattggtctgatcacacacaccaagggcgtagccagactcttggcttcggagggcgggaggagggggatcttcggcctcatgttttttcgccacgattttccaaaattttcaaattttgaaaattgtatggagattttgggtccggtggggctgataggcgctgccgggggaaattttgagatttttatgagatttcttaaaaattccattttttggatttcgggggggggagtgaaaagtgattgatgggcgacggggaaggaacgacggacgcggcgatgttatcgcattttgagtgttgcgagagactggcggtcgaagactgatgagcatttgctatttgagatggatgttggggaaagattagaaagaattgtgggcagattgccagcagcaaaatacagtggcaccaaaattaatttttaaatttgtgttccttggacaatttcagaaagggcgcggcattggcataatcttaaactttaaagtagatttaacccaatttttggttcaaccaattcaaatctctagagcagtttggttaaagaaacactttcatgattttcaaaattttagaaataactttctacaaa

SEQ ID NO: 53848 - DNA, 70 bp, Heterodera glycines
  Genomic contig location: Contig_ID=SeqID_4274; Location=524..593; Strand=-
  SCN-specific regions: Sequence locations=1-70
tgaagaaagttgaatttattttacacgaaatgaaaaagtcaaagtcattttaattcggctgatcggcctg

SEQ ID NO: 53849 - DNA, 1812 bp, Heterodera glycines
  Genomic contig location: Contig_ID=SeqID_23144; Location=106..1917; Strand=+
  SCN-specific regions: Sequence locations=1-297,319-573,601-813,857 -1026,1050-1266,1288-1419,1477-1626,1656-1812
atgctgaaccacttggaaacgaacttcaagaagcgctttcttctgccgcatttttggacgattttatgccatttgttttggcatttgaatttgtcgcaaaattttgcggagaaaacggcggcaccaccaaattgtgcaaagagaaagttcaattttcatatttaaaattcataatgtataaataatttcatttttagtgcctttcccaatcattggtcgccccaaaaacaaaggcaccgtttgttggcccaaccaaattccatggcacaacgccacgctctgtgccaaaaaccacttttggcattgtgccaacaactgaacaaacttttgcctttaagccatttgtgcggcatgtggaccattttggcacgaattgtaccaacattttcttcacgtcggaagtggacaaattcttgttgaatatcaccgcgacgccatacgaaattgcatgcaatgactatgaaaaacgtgccaaaattgacgagccaataccgtccgattattggtcaggcggacgctttgtgaatgcttgcatggcggtgccaagtgcaaaatgcgaaaagtgatttttggaatttattttttttaaattttaaatttgaaggcacgtcgaactttacgcatgctatgaaagcattggcaataagccaagtgtcaatgccattggcgaattgtgccaaaaacatctgaacaatgccataaatgccgctggttttgctgttcaaatttgtgcacatcggcaccaaacggaggcgacgaatgagctcattgttgaatcgttcatcaacttttcgttcactaatgagccgtttgttaattaaataataattatttttttattaattttattaatttaggttccaaaagacgcgcattttgccaatttcaatggacaaaatttgggacacaaaaaagaaaacgccatatttcctcatcgaatttggccaagacgagcaaaaaagtgcaatccgagaaaagggcgacggagaaaattttggcggcgccaaatggcttaatgaggcaaaaagcaatgttattaatttttaattgttgtaatttagaatgatggcatcggctccattctcaaagacattgcgccacaaatagtcgacggcactttggcaaaaatgattcattttgtgccgccgtcgaacgatgacaaaatgctcccatttttccaaattgaaaggcccaaatattcaaaattcataaccaacgacacggatttgttaccttacaaaaatgacccgaacaatacaagtcaggaataaaattaaaaatattttcgttttggcatatttttagggagagcaacaccatgtgatatatacggcgcagattgtgtgccgatcagaaatttgttattgaaaattgaggcattggaaaactgtggaaagaacgaaagcgaaaacgatgcggtaaaataaaaataaaaattttaaaaaatatttaaaaatatttttagatttttaaaatgccaccatgggccccaccacttccgccaccggtgaccatgaaaaagccatccgaaacattgttatgtggaggggatatgttttgcgacaaacgaaggcttcaacaacagtacaacagattgagggagagtgagtcattttaacaaatatgaattaattaattaaaatacctaattaaaaattcaaattcacagtttgtgggcttaagcccgaagaaatggagaaccagcgcgaaaaacgacaatacgacccataccaaaaatggaccgaatccccgatcaaaatcgcattcaacaaaacagctcgtaataatcttgccacatcatacagtatttga

SEQ ID NO: 53850 - DNA, 1220 bp, Heterodera glycines
  Genomic contig location: Contig_ID=SeqID_23145; Location=636..1855; Strand=-
  SCN-specific regions: Sequence locations=1-115,146-151,173-475,497 -555,578-579,601-1089,1111-1220
atgggcaaggacaagcaaggtggttatgacccggacatccacggaaattggcaaaatgaggagaagccatgtgcctgccattgttcgtatttgcgtgccaaaaaattctaccgagtaatttaaatttaaaaaacaaatttaataaccgaaaagttgaatttttcaattttgttaaaggttgaatgtgactttatgaaccgaactaccaaaagatgggcaaatgccggccgagttacgcttgggctgctctctgctccgcttctgtttgttcccgtggtaaatgagctagttgctaggccacaactgcagtcagtgggacaaggtaatgtaacgaatgtattgaaattttgaaatgtgtgaggtttgctccctcgactggcattttggcactttttcggggaaagttcccgtccccgaatggtgtctcatatttccgtaattacgtgcagccctctgctggtctcatccccgaactccccattcctccattccatcaattttttctgcacttggattctaagtacatacctacttggattctgctttcatgcttggaaatgttagccctacttaataaccaaaaaataatttataaattttgccgcatttataattttattccaaaattattttgagtcgaaatctcatttaaaaatcgcattaacattttttccttaaaatggatttgttttatccattgttgctgttcattcattgtttcttcagacattactcacaccgctttggaagtgcacttcgaatgcggcctttgtggtcaaattgcctacagaacttacgaaattgtgtgtgaagacgtaacgagtgaccgatggggccgttacatgaaaacttacggggacgagcccatctttggcattggcaccacggaatttgatggcattcagcgcgtgtttgatggcatgtggaagaactacgatttgatctacagaaattgcaaggattggaccagcgaaatgatcgaacgtctcagttaaacgagaaattcccataaaaaattcgatttgattgattttttacgacggaattcgaagtttaaaaatatcttaaatccattggaatttgttaattgatgcaaaattttgttgagataaaagtttaaaatgtgctgccttttcttgcgccaacttaaccaaacaattgttgaccttttcattattcgctatattataattggtttaaatttcttttttttaaataaa

SEQ ID NO: 53851 - DNA, 883 bp, Heterodera glycines
  Genomic contig location: Contig_ID=SeqID_23146; Location=678..1560; Strand=-
  SCN-specific regions: Sequence locations=1-410,549-770,792-883
atgcaaagccaaagtgcaaatgccatggagtgaggtcaacaacaaaaaaatttgaatgccatcataaatgcatgcttttttcagcggctcatgcaatttaaagacatgttggatgcaattggtgtgtaaataattgggcatgccagttttaattaatttatatcccgagttgatcctaaaagcgatcaatcattgatcaatagagattgaatttaacataaaatcagcctttatgccaaagaaatttcatgccaaaatttaaactaattctgaaaatgttgaaaagagttacaaaacccagctaaaatatcttcattctcatcataataatacctaatgatctggaaacattttcggcttggaattttgatttctttagacaccgaaattacaaatttcggtgtattcagataataataatttaaatattacaattattgttaaagttataatcgattgttaaaattataattgaacaataattaaatttaaatattataaaataaaattatgattccaaatcaaaattaaatttaaatattatttatcattgacactttttcaagttcgaccgagcacccaaatttaagacagaattttattcaatttaatacattcattatctttaaaaaatgcatttagcctccaatccgtcaaattggcaacatccttcagacaaagtacaagcaggcacggcgtattcagatcaacagccgcggaaatatgcaatttgatgagccaatgcgagtggaggacagcagaggccgaaggcagcagcaacaacaacggaggaaaaacagagcactgactgacttagttttcctggtcagatggaaaacttttttttttggggggggcatcagtttaatttgaatttaataaa

SEQ ID NO: 53852 - DNA, 599 bp, Heterodera glycines
  Genomic contig location: Contig_ID=SeqID_23147; Location=30..628; Strand=-
  SCN-specific regions: Sequence locations=1-147,169-202,226-259,340 -539,562-599
atgaagattaaggttcgtttttaaaattctcagtcaagtaattttatggaatttttaagcaaaaagccatttataggaataaaaaaaatttacaggtaaagcttttcggcgccggcgcaatttgccattttgaggatttctcaacacggtcagcagcaaaagcagaagaagtcaatttgtttaaaaatgtggtcatctacttcttttttaaatttaaacaaaaaatgttcttttttgtaaaagcgagaaaaaaggctccaatattattttatttagtaagttttttctataaaaaattaaatcgcaaattatttcatagaaatttttataaaaattattgaatttccaatttttttgttttgcttatacctctttttgtggaaatcattcaacaagttcattaaaatgagggaaatttgaatgagagagcaggaaagaatattatccgggattttagaggtcgctaatcatgaatctgacatgtattttgactaatttctaatccttaacacgaactcaaataaaaatcgaaattttgaatttttcaaattatattttttgttcaaatttagattaggaaatcggaattggtcaaataa

SEQ ID NO: 53853 - DNA, 648 bp, Heterodera glycines
  Genomic contig location: Contig_ID=SeqID_23148; Location=159..806; Strand=-
  SCN-specific regions: Sequence locations=1-417,440-500,539-648
atgaatgaattaatgagcaaaaaacaaaacaaaaactgcacaaaaatagtgaataaattgacgagaaaaagcatcaaaaaccattcgaagatacaattggagacaaatttggaaaaaggaagcgaaaatatatagtaagggatttacaaattcaggttgcaaacatttttttcgacgttcaatttcgaagatgaaggaatataattgcgataatggaggagaatgtgatattgaacaatgtaatattttaaagttaaatggtatattagataggattaaaattggaataaatgtttaatttttatataaacaagataaaacatgtaaactgtgccggctgaacaaatgcttaacggtcggaatgaatccgcggggcgttagcgcaacaaaattcagtggccaacaaatattggcatttgtacaacaaatgaaacagcaaatggcatcattagcagcaacatcaacatcagcaaatttgacaggatttgaattgtgcgcacaaaccaacaccacaacaaaaaatgggccacaacaattgggatcactaaattcggttgtcaaatcaaagacagaaataagttaaaacgcccggttaccgtaacccgttttcaaactttttatggtaactgatcggtaacggttaataaa

SEQ ID NO: 53854 - DNA, 613 bp, Heterodera glycines
  Genomic contig location: Contig_ID=SeqID_23148; Location=832..1444; Strand=-
  SCN-specific regions: Sequence locations=1-400,423-613
tcaaaattggcaaatcattggggcatcgttccgcttgccactgacaatggcactgctgatcagcaacagttgttcacattgcccaacaatgtgcacctttacccgggcaaatcattcgcttctgccggcatttcagtgaacggtgctgaccgtccggaaattgttattttggatgtgcaatcggttctttgcacggaaaagcatgacgatgctgccacgaattgagcagaatgaaaactgattgggacaaaaaaaactaattttacccccgaacgcctcgaaagttggcttctttttaataatagaatttgtaagcatttgccctctcattttacaatttcattaccactttcgaaaacgaaaaaattcttaccacaaaaatctttgttcaatttaaattagcaaatttaaagtgaatttttaattctttttagataatgaataagttattctttcaactagtaaatctttacaaggataattgtctccaactgatgcagaaaagctgaaaaaccaacaattggacacttgggaacaactgcaaaatgccattttgaaagaaaaggaagcgaggtaaaaatggggaaatgaattacatattataaaaaataaa

SEQ ID NO: 53855 - DNA, 741 bp, Heterodera glycines
  Genomic contig location: Contig_ID=SeqID_23149; Location=91..831; Strand=-
  SCN-specific regions: Sequence locations=1-741
atgtcaaaggagggcccgacagacgaagatgctattattgccgtcgccctgggcatttggtgagggactgcaaaacaaagaaaagagatgaaaggcaaaatagccgcgggccacaaagaaataacgaatattatgggaatgagagacattggaacagagggtcaaatggtggagaaaattctcgttttgtgaacggaagggaacaaagaaatgaacgagaattccgccggtcaccaactccgaatacgctccctaggggatacggtaataattcgggatcccccgggagaagagtgagctttggtggaagatttgcagcggcaagaattgccagcccaattttaatggcatttattgcaattctgtctctctttgccccaaatatagctgctaatactgcagttagcccaatgatttgcctatcggatgctccctcaagtctctggtctattccttctgaccccttttgcccaacttggaccccaacagtggaaccgattcccgcaaattttgccatttttaggcaaaatacaatacagtacaaaactgaggctacggcttgtaaatgtgtgaacaagcatttcaagaagaatcggtttctttggagggaaaatcgaagaaataagtacaagcccagtggaagtcccaacagcgatttgccaccaaatgaaagaaatgaagcattcacccaccggaaacttaaatttttatgatcagttttgccggtaaaaatccaataaa

SEQ ID NO: 53856 - DNA, 267 bp, Heterodera glycines
  Genomic contig location: Contig_ID=SeqID_23151; Location=316..582; Strand=+
  SCN-specific regions: Sequence locations=1-267
ctacataataacaaaagctgtaacatcgttgaaaagctgaacattaggaacacgaagcagttcaacattgacattcgcgtcgaggagggcaatgggctgttcactgtgacatttgacacgggcggaaaagcgacaaaatgccaatacagaagcccagatatgccaacatgggcagtccaatacataacagtgagaactgaattagcccaactaatttgaaagaaatggaaaaaacatttataaaggaatgaatttcaaaaagtcaga

SEQ ID NO: 53857 - DNA, 387 bp, Heterodera glycines
  Genomic contig location: Contig_ID=SeqID_23152; Location=1128..1514; Strand=+
  SCN-specific regions: Sequence locations=1-387
atgccttcaaaggagcagcgacgtaaagaagcaatgcgtttgcgctcgcgtgccattcgacacacgcctgatgtgggcaatgctttagtgggtccgagcacaattggccaacaacctcttgatctcgaccagggttctggctgcttttcatatgagaatttaaatctatttgtagaaccttcaacgtcgactggaattcgtgcccaaatcagacaacaacgaaatgatagacaagctattgtgggtacgccggcaatgcaactggacaccagtgttgtttcgactccgaccaccgaaggaatacggactttgactattgttggaggtcttgatttaagctaaattaaaactaaagctatatatataaacaactgccaggctcttcaa

SEQ ID NO: 53858 - DNA, 1185 bp, Heterodera glycines
  Genomic contig location: Contig_ID=SeqID_4276; Location=2..1186; Strand=+
  SCN-specific regions: Sequence locations=1-1116,1139-1185
atgtgggaccaatgcctggacaacgcggtccgattggagcagcgactgctgccccacgtgatctatgacgacgcagagcacgaagcgcatcataatgacctgtgagtgtggctttttatgagcggaattaatttacgaatatttggactcggaggagtgatacttttaaatccataaaattcctaactagcccgttttcagttaagggtccaaggctgtacgcaatcggattttgaattcgcttaaaccatattgctaaaccaattaatttaattatgaagttggtaaattttccgttaagactttgctggttttcctattcaaatctatattttccagagtttgctcgtgcgatgcatttttgcattatctaatttttttttcattacaaataggattttgtcattaaatgctaaagcgcaattcccaactcagaattgacgtcatccaacacgttgagcccgtccgaatcaccaacagcggactggagccattgaatggcaaactgaccgaattcatcaacaacccattgaacagctcggacaacgaagtcccggtgctgcctcgtgcaatcaccggcattaatcacgtgtaaactaatgttcaggctttattatttttttaatgaaaatgaaaactaagaattttctggagataaaatttcagcacgccttccttcgaccaaatcaaacaaatgattgaggcgatcagaacccagggcgactgtccagcggtggacattttggcaccggccgacaatttgactgtttacggtttgttttggacatcattaacgggggggggggtgcgctaactttggcattttgccattaatttgcctccctttaagacgcctttgtgtgcaaagtgttggcggatgtgctcgacattctgaagcgtcaacgtttctacaccaatttggaactgattgagcgcgacgcgcgtgcccggggggaggcgaaatggcaaaatgccgccgaagccgcaggggcggttgatgcatctgccaccggaagttcagcgacaactactgatggcaaagggacagcagcagccaagggggaggacgacccgttgatgttggctgggccgtcttcattgtccgtcgaacaacataaccttgtggcccatgtgacatccactcatgaaaaggcgggtgtacttcgtttttggaaaaaaatataa

SEQ ID NO: 53859 - DNA, 104 bp, Heterodera glycines
  Genomic contig location: Contig_ID=SeqID_4277; Location=486..589; Strand=+
  SCN-specific regions: Sequence locations=1-104
atgaagatgaaaatttcggacgacaatgtcacgtcgatggtttgtgcaaaaaacttcaccgagaacagtgatcagatcaaccacatcaactacacaccggacgg

SEQ ID NO: 53860 - DNA, 306 bp, Heterodera glycines
  Genomic contig location: Contig_ID=SeqID_4278; Location=1491..1796; Strand=-
  SCN-specific regions: Sequence locations=1-306
atgttaattggaaaaacgaataaggtatgccaaacatcggacgggcacgactgggccccagtagaaaacacttatttgttagggctatcaaattaattcaattaggacaactatgaaaggagttataccccaaaaaccagcctggggcccagttgcccccccccccccaattctgctcaccaattgcgtgcaggcggatgccaacatgaagtacttggggttgaacgccacctgctcgatgttgccggagtgacttgtgggaatttcgcggatttttcgaccagattccttcaaaacaaaaataaa

SEQ ID NO: 53861 - DNA, 895 bp, Heterodera glycines
  Genomic contig location: Contig_ID=SeqID_4279; Location=238..1132; Strand=-
  SCN-specific regions: Sequence locations=1-249,271-277,308-425,455 -476,500-734,756-873
atgcccaatttaattgtccatttatcaaattcaagagaaataaaggtaataatttttaagtttgcacaatgttttgatgcgacacgacagcaaaacaaagaaggagcacatgacggagcagtacccccatctgataattcatcaaatgacgtcgccggtcggacaacgcgtaagcaaagcgacgaaaccactttcggattaaatgggtgcacttcatttctcacccctaaaaattttcttataaaaagattttctacaattttttaagaaatttctaagtttgaaaatttttaaaaaataatcaaaggggaccgggaactaactgctccataaaaattaaaatgcactgcaattatggggatattgaacatacttttgttggtttttgaaatttattgcattaaaaatccccaccaaacccgcccaaaaaaagttaaaaaaaaatttttttaatcgttttccaattaaagtttttgcattcttttctttcccttttcccattgtgcagatcgccaacattctgaagttccttttcccggtgccgaagcgggacgcgcgtcgggtggtcacttttgccaacaccgacgacttcgtttcgttccgccagcacagttggaaaatcgacagcgaaaagggaggggcggtggaactgaacgaattggggccacgctttgaaatgcgacgtgcgcattttttgctgttttaaatatgacaaatataaacacataattttattccccacatttttacctaatttcccctcaagggttttccaattccctcaaaagtttgcctctctttttttgtctattagaaatgaatgcttctcaatcacagaaaaacatatgtgttatgggggtgcattacattttgaaaaattttttagaaaattaaa

SEQ ID NO: 53862 - DNA, 1866 bp, Heterodera glycines
  Genomic contig location: Contig_ID=SeqID_23154; Location=606..2471; Strand=-
  SCN-specific regions: Sequence locations=1-288,310-401,423-671,693 -1866
atgacttctgatctgctgttaactcattataatccggctcttccaataatcgtggccgctgacgcatccaaaaacggtattggcgcaacgattggccacgtatttcctgacaaatccgagaaagtgatcgaacacgcatcatgtgttttgtcaaattcccagcaaaattacagccagattgaaaaagaagcattggctctagtgtttgcagtacagaaattccaccgaatgctattcggcaggaaattcaccttatttactgatcacaagcctttgcttgccattttcggttccaaaaagggaattccgatttattccgctagccgattacaacggtgggcgttgatcatggcaaattatgatttcgacatcaaatacacgaatacagcatcatttggacaagcagatgtcctctcaaggctaatagccaattatccaaagcctgaggaagatgtgttgattgccaacatttgcgtcgaaacggactgttatattaacaccattttacagtcgcaaaccgatcatcttccagtcacggcacaagaaattgcggaatcaacaaccaaagatgagacactccagaaaattgttaattttgttatttctggttggccaacgaagtgcagggaacccgaaattgcaccatttcatccgaaaagaaatgaaattttggaaattgggggctgccttctctacaaaagtcgtgttatcgttccaagccaactgcgtggccgaattttaaaggcattgcattttgcacatccgggaattgtgcgaatgaaggccttggcacgccagtatgtatattggccaggaatcgattcggaaattgagagagttgtacggcaatgtgatgaatgccaaggtgcacagaaatgtccgattaaggcaccattggccccatggacagtcaccgacaaagcatttcaacgcgtacacatcgactttgctggaccctgccaagatggatatgtttattttattctggtggacgccttttccaaatggccggaagtctatcaaatgtcttcaattacggccaagtccacagttttcacacttcgttccataatccatcgccttggcattcctgaggaaatagtgtcagataatggcacacaattcaagtctgctgaatttgccgctttttgtaaagaattcggcatcaagcacaccttttcaccgccgtttcacccgcagtcaaacggccaagtcgaacgattcgtcgacactttcaaaagagcgatgaaaaagtgttcaacggacgataaaaattggactggaaaggtgctgctcgcttacaggacgacgccaaataatgccattgatggttattctcccgatcaattattcttcggacgaaaactccgaactaaattggcattagtcctcccgcaagagcacaaaaacaattcagagaacattgacaaaattcagcttaacaaaagaaggaaggactactcgaacaacatggcaaaacaattcgatggacggcatggtgtcaaagaaaaagtgtttttccccgccgaaccagtcctccttttgaactacaggaaccaaaaaacttattggctccatggtacaattgtagagcgagtcaggaattcgcctacataccgagtccatgtaacagttcttggtcgaattgtccaccgacattcgaaccaacttcgtcgaaattgtgttttcgaagagaattcgaaacacaatcctggtcccgatcagcagccaattccaccagtcaacggacaagctcaaaatttggcgcatcaaattgctgatccggtcgatcaacggactgatcaacaagccgcaaatgacccgccgacaatggctcttcgacgatcgcagcgtaagccgaagccg

SEQ ID NO: 53863 - DNA, 1413 bp, Heterodera glycines
  Genomic contig location: Contig_ID=SeqID_23159; Location=82..1494; Strand=+
  SCN-specific regions: Sequence locations=1-129,151-232,254-278,301 -334,356-544,567-1172,1195-1258,1284-1413
cttgcacttttggaaaatgcaaatttcaacaaagaaattgagaggacttccgagtttctcttcactgactacggagaatcggccaatttcattgacaatcgcttcgaatggcactgccgtcaattgtcctttctcattttgttggagggcccaactttgatggatcgaattgtgaacagagttttggaggataggacagaaagtgtgatgctcaatttcgtcaaagtgagtgtccatttttacatttatttgtcttaaaattgcgataattctgtggagggtgagcccattttcaaaaaaggttacctgacatttgcggaccgacaagtgcggaatgtccaccacctttttcagtttgtgaagtgcactcccgggttattgaactgtgctccgcccgtggaactgctcaaacgattgcgtgaagcgattgaccgtgaagggcaaaatttgttgcttgttcgattgaagtttgggcttacatcgcaatgtgacaacattaagcggattgaggacattggtcagttgattgggatagttttggaatggttttgtattttaattttggtcctttcgaaaattctaattttattggcatatttttgacgaaattagggttaggtgttgtcagtgtgtcaaatcggttttcaaattaggacaccgtccgattttgttttcgtttgttggagaattgctctttttccaggtcagtccagctttggcattgtgcatgattgtgggccgttgttcgacacttctgaaaaaaattctatcgagatagcgccagtgcaaccctcaagagacaaactgtcaacacagcccaacagggacaaattatcaatgcaaccaaaccgggacagattgccaacgcaactcaacaacgacaaattgtcagcacagcccaaccaggacgaattgccaactcagcccaacaaagacaacctgtcaactcacaatttgctcaacagagacaaattgttggcacaggcgctttacgaaataggggaaaggatgcaagacgaaatgcaacaaggcagcgaaaagctgcttaacaaaattggacaacattttaaacaaattgacaccaaattgttttttatggaatcgaaggtcggttttctttcaacaatgctttagtttcggcctaattgcattttccctggccaatagtcaactcattttgataaccaaattcttaatcatctcccacatttgctttagcttgagcatttgagtcggaatcagtggcaaaagcgacaaaacccaagcagcagcaacagcagaggcgaagtcagcagaggcggaggaggactggccaacttttttgaacggaaaacgccattccgaaacaatttttacgatgattacgatcaatttctgatggacgagcatcaatttcgttttgagcttttgtga

SEQ ID NO: 53864 - DNA, 992 bp, Heterodera glycines
  Genomic contig location: Contig_ID=SeqID_23160; Location=152..1143; Strand=-
  SCN-specific regions: Sequence locations=1-67,89-103,198-408,664 -795,829-883,913-963
atggagtccctaattatcattgatactttttttaaggtttgctccattgagacttttctctatgttgactcataatcagcacaattcaatctttcttaaacactttaaaaattatttcatgaattattatttttttaatttttttttctttggtattaataatttaatttttatgacaaaattaatttttattttttgaaagattttcttgcctttaggctattccgaagtttctgttaacacggaccttggcaaaattttctctgtgatttttgcgcttgttggcattccactgatgttcatcactgctgcggacattggcaaatttttgtccgacccaattttgtggttaaagaaataattggcggcgcatcagacaaaggacaaaggcaggcactaatttctaactaaaaataattaaaaataattttttgaaataaagtaaaaaattagttaaagtaaaatgatttattatttttaatttaaattttttataaatattggttaaaatacttttagcaaaaggaaacttttgaacattttttaaggccaaaaatatttatttcctatcaataaatccattttattaaaataaaaatattgtttaattattattttactgttaaaaaaattttttttaaattaatttatgttttttatattgcagaaggtgatctatgaatttttttgtattcacaaaattggtgggaaatatcgtcggaaatccattcaatcagcaactacttcaatgggcgcggtggcattagacatgctcgagggcatggaccgtaagtctaataatttttttttaatttcaaaaaattttaagaaatcgacgagcctaccaacctttggtttcccattggtatgatcgcataatgtcaaaaaaaaaattttttttgaaaatttttaggtgcctatgttatgtgcatatgcgtttattgctccatcggatcttttatgtaaaaattttttgaaattttttaaataaa

SEQ ID NO: 53865 - DNA, 156 bp, Heterodera glycines
  Genomic contig location: Contig_ID=SeqID_23160; Location=1936..2091; Strand=+
  SCN-specific regions: Sequence locations=1-156
cagttaaaaattatggaaaaaagtgccaacaatttttcgaaaatattgtggacacaaaatgagcatcgtttccaacaaatttgtgctctcccatttattcgtgaacaaaaagatgggacacttgctgaggaacgctatcgccactacataatacaa

SEQ ID NO: 53866 - DNA, 105 bp, Heterodera glycines
  Genomic contig location: Contig_ID=SeqID_23162; Location=912..1016; Strand=+
  SCN-specific regions: Sequence locations=1-105
atgatgttaagcgcagagtttggagccctgcttatgctgctgcttttgtccttcggtgccccagagatgtccttattagtgggaacagggtttggcgtagcacaa

SEQ ID NO: 53867 - DNA, 57 bp, Heterodera glycines
  Genomic contig location: Contig_ID=SeqID_23162; Location=1..57; Strand=-
  SCN-specific regions: Sequence locations=1-4,26-57
gggcttcgccttcggcttcggcttcgagtactaagccgagcttcgcccacccctgct

SEQ ID NO: 53868 - DNA, 642 bp, Heterodera glycines
  Genomic contig location: Contig_ID=SeqID_23164; Location=179..820; Strand=-
  SCN-specific regions: Sequence locations=1-336,358-434,473-642
atggatttgccattcggatatggtttggctgcatttaaactttacccaattaattttcttttttttagcttctggcttccctcttcccgcttggcatcatggacaaatcggctcaatttttggcggtggtggaggcagactgatccttttattattacaaatagcttgtttattttaagtgccgccttgctttgatttggaagagtcttgcctcaattttgtcacacattgcaatgttccggttggtttcttaaacaaccaatattataaattgtgtctttttaatattgaaaattcttattttatggaattggtcatgacttttgccaaaaattcttaaatttcattaaactttaataaattaatctgtttacttgttttctttgtagtatgaataatttttaggtttttatttttcattttttcgaataatgaaaaaataattaatttaaaaaagaatttgtattttaaagtcagtagcccaagtatgcagccaatcatgcggattatgccatggcccatttccatatggtcaaggtcaacttccctatggccagccaccaatattaacgggataagcattatcgaaatcaaagtccaatgcgttttcttataatttattactttatgtggataaataaa

SEQ ID NO: 53869 - DNA, 577 bp, Heterodera glycines
  Genomic contig location: Contig_ID=SeqID_23165; Location=441..1017; Strand=-
  SCN-specific regions: Sequence locations=1-270,292-577
atgtgcaatttggaatggcgcgttttcgatttttctcagatggtttctggtcgggtgcgccaactgaacagttacgcgtggaaggtttttgccatggcggtaatttaaatttaaaaaatgccaaatttattatcaatttgaagcatgtattttcggaatatgacaccgttgtttgggtggacacgtcaatttcttttgacaatgacaatttgtcgtcaattttaagacaaattcaaacaggacaaattggcccagtccagttgttaggctgtgagtgtgggaaggagcaaattttcaggtgaaatttaccaaatttattgaatttaagacagcggacatggcaaaaacattgcgactcatcctggcaaatatttcaataaaaaataaaatgaaaacaaataaaacttccagggatgtacaaatatttgccaatggtcgccaattttgggcccaacaaaacatatgaatggacaggaaacgacgacccaccacagttcgaggccaatctcgtcataattcacaaaactgagcaaactcggcaactgatgaaatggcatgattaaatattccaaataaa

SEQ ID NO: 53870 - DNA, 1694 bp, Heterodera glycines
  misc_feature (6)..(6): n is a, c, g, or t
  Genomic contig location: Contig_ID=SeqID_4281; Location=1..1694; Strand=-
  SCN-specific regions: Sequence locations=1-14,36-302,332-585,607 -1185,1207-1694
  Gene Ontology: Biological process=diacylglycerol catabolism
ttcaantcatttttaacgcaaactcaaaacaaaacgccacactaattcaaaacatggacacatccggacaaacaatcaactttattatataagattacacccctaaatttggaactttttcgccactatttttgccactattttggaatttttttctcactatttagttaattattttgggatttttatcactaaaaatccgatccctactaatcaccactatttatttaaaaggacaaaaagtgaataaaaaggataatttgtgactacctaagataagggtgttttcaaagaaacattccttccgtttatttgtttatttttcattcatatgaaaaggcagtcgcttcacagccctaacattaaaattgtctgttgtcccatatgaaagtgcttcggttggttttattcatttttacactcagattgggaattattttgactgtttgctatgaaaaccccaataaacaacaaattcactaattgcactccttcgactaaacggtcttcggtttccaaattatctgtccaacggaatgccgtttttgatcttttgaagcaggtaataaataattacttgtaaatatgtatttgatgttttattttattttaagctggccactgacaatttcacatactttcgccaaaactgcagctcatccgtctatggcaagcgcatgtccgagtgctgtgacgatctttctgcttcggctgatctcatgcgaggttggccaaaggattttcattgcctgtttcaatacaaataataattctgatggtcccatttcagtttcactcttttcatttttttagtttttaatgtaaagtgacgtccatttcctttcagaaattattcgcaaactccaatttgcttctcagaaatgcgattacgacgaaaacactcctggaaatggttttcggtcgtctaattcattttaaaaattaaacttacggcttttttcagttcattggtgtgtatcactgacattgtccttcttcatcttgtttcagttcttcgcatatgttccgaaagtcgcggaattttaatgtttcgtttggcgtattattgcaaagaaattgaggcatattcggcaattcttcgttttctcgttttggcatatcaacaggtggcatatcattatcatttcgggacgctgcatataaataaaggattgcaaaaatcttaactcgaattaattatttttcgtgtcctaaacaatccctcaaatttaaatctttgtgtttcaggtagttttgttgttcaaccggctggatggtggctcgttattccctccgctggaaggggattaccaacaatacaatattcttttcaaaggcatcgagagtcttgacgggtcgtgtttttacgggaggcctctcggctttcaggtatcactttccgaagaatatttttgcatttagcaattttcaaaaaaaattttccgactgcgcctatttgactttttcgttagccttttgccatttatgctattcgtttagtttttcccttctgtcacccgtattttccgtgtcattggccttgtgttggccacttacagtctttcctgggaaaatgggtcggcggctttgtcttctctgatcaattcggacggtatgcttttgaatcctgagcagagagcgaaaactctaaagaaagtaacattttagctttaagagttcttctcccattttag

SEQ ID NO: 53871 - DNA, 837 bp, Heterodera glycines
  Genomic contig location: Contig_ID=SeqID_4282; Location=33..869; Strand=+
  SCN-specific regions: Sequence locations=1-25,47-48,78-837
atgtcggacaatccgaaagaagcggagaaagaaatggaaaaagcaatgtaaataattttatttcaatttaatttaatgacaatcattttgcttttcctctttcagcttcatcgctgccgactgttggttggaggtgttcgatttgcttccgccatctcaacttggccttggcattgcgatgattagccgccgttttgactatttcatcgacgaacatttcaaaacgcgcaaatggaaattgggcaaaatgaaaattcgacgcaaaattggacagaatggcgcaaatgaaatgaaaattgtcaattccaatggaaaagcattgcaaatccctcaaaatccgttgccgaaaaaagtcatggcattcaaaagcattgagatcgagtaaaaaagaatttggaaatgatgtaccaatcaaattttctgattttcagcttcatcgaccaaaatgtgatcacttttcttggccattttcaccgttttttcgccgcatgctcaacaacattgtctatcgatactgaaaatgttcgcgtttcggagttcgttgttcgcaccatttggccaatgttcaaggacactatctatgacaccatgttgatccccatcgcttttcgtcgaatgcgccaattggtcccgtcaatgctcaatgattgtcagtctcttcaatttgtgtctttcgatggcgccatttccctcgaatttccgcccgacgacagtgccaatgcgacggatggccaaacggttgccaaatggctgttcacgcctcgtcacgataattttccgaagaagctcatatgctatatgaattcaaccatggaagtggaacaatcaaagcggtga

SEQ ID NO: 53872 - DNA, 150 bp, Heterodera glycines
  Genomic contig location: Contig_ID=SeqID_4282; Location=1810..1959; Strand=-
  SCN-specific regions: Sequence locations=1-84,121-150
cgtttgggcccccgtttttgggcccccgcgtttgggcccccgtttttgggccccggggtcgtttgggccccaacccaaaaatcgaaaaatgtgcttttttaaaaattaagattctaaaaactaagcctgagggatccctcgccacttggc

SEQ ID NO: 53873 - DNA, 3753 bp, Heterodera glycines
  Genomic contig location: Contig_ID=SeqID_4283; Location=1590..5342; Strand=+
  SCN-specific regions: Sequence locations=1-77,99-375,428-724,746 -979,1002-1010,1032-1185,1210-1241,1263-1575,1597-2199,2223-2282,2304- 2739,2762-2808,2890-2929,2953-2971,2994-3059,3081-3081,3125-3222,3244- 3452,3476-3513,3539-3555,3586-3753
gagcaaaccgcaaaaaattataaatgaaataaaaggtttgcttttcaatgctcgctcactctctaacaagatcccagacttaaattttgtaattgaaaataagcaaccaaaaattctaatcatttccgagacctggttaaataccagaaattcgatttcatcagatttatctataggtggcaaatatatacccattttagcaaatcgggtaagtaaaagaggtggagggtgtgcaatactaataagtactgatattcctatgcttgaaattttttctgggacaaaatttcaatgtgaaattattcacattaaactttgtttagcaaaagtgattcacatttttgctttgtataagccgcctcaatgttctacaccaaattttaaaaaattattagattatattatggaatttaattataataatattcttatctgtggtgatctgaatttaccgggaattgattggattaattaccgaatagagaacaataatcattcgaaattatttattgattttatagcacaaaaacaattggttcaacatgtaaaacaaataacacgtggtaacaacattttagatttagtgctctcaaatcctaagcaattagtttatgacacgaatgttacagaaagtttttcaacatcagatcaccacatgattgaatttaaaattaatgggagcttttcgatcaccaaaaaagacaaaatttatattagagagtttaaaccaaaaaattttctaaaacttagaaatatgcttcagcaaaaacgcattgacctacatttactgaaattatttaaagttgacgacaaatacaattttctcgttggcgaactttataattcctttgatcaattatttcctaaaaaaatattaagaaaagttctaaaaaccaattatccacaaaaaataaaaaaattatactccgaaaaattaaaaatacacaggcttattagagaataccctgatcatggacaacataaaataaaatacaaaattttaagtaggaatctgaaaagggaattaaaaaatattaatgataagaaagaaagccaacttgttaataaaggcaatttggctatttttaaatacatcggcaacaaatttaattctgacagagaaataagattgcttttcgatgaccaaggcagaatttacactgaggataggcagaaatgtatgctttttggtaaaatatttcaacaaaattttatgcaaagaaattataatacgaattatccaattaaaaataatataaatagcataacagatatcgaattaaatgctgccttggtctggaaggcattaaggaaattacccaacagaaattcaacatccccagacggtttaccttatatattgattaagcaatgcgcagatctattggcacctatcataagtgaactcttccgaatggttttagattatggggaaatcccaaacttatggcgtacttcttttataattccaatttataaaaaaggagacaaatcgaatccaaataattaccgtcccatctctctgacatgtactttatgtagggtttttgagcgactattagtatggaatattgttaaacatcttgaaaaatataagattttaacagatgaacaatttggttttttgaaatccaggtcgaccaccacacagttgttggtctctctggattatttttataaatcaatagaagatggacaaaatattgatataatttttatagattttgaaaaagcatttgattcggtgccaataaatttgttaattgttaaacttcagaacataggtatttctgggaaaatactgaaatttcttcaaaattttctaacgtacagatcatatagagttaaaattggagagtattattccgaaagttttagaacttattccggtgtcccacagggcagtgtcctcgggcctcttctttttttgatttttataaatgaccttactaattatattccgcctgaagtcggaattaaattgtatgccgatgatgttaaaatttacatttcgcatgataatgacgcgaaaagggatttactctctttagcgttggctaacttagccaaatggtctaaagataatggcatagcaatttcgcatgaaaaatgcgcagtattatatttaggaaaaaataatcctaaacatgagtataaaattggcgagaaagtaattttaagcgtagattgtgtccgtgatctgggagttttggttgatcaaaagctctcatttaacaatcatatttcaaaaattttaaaggcggcttatttcaaggcatatcaaattttaaaaatattaaaaacaaggaatatcagtaccttaatcctagcatataaaagctatataagacctcacctcgaatacgcatccgaaatttggaatatctcctcaaaagaacagagtaaaagaatagaaaaggttcaaaaatatttcacatgaatcgtatacaaaaaatgtggcctcaaggcaataccatatgaaaaaagacttgagatttgcaaattggagaaattaagtactcgaaggtcgctcactgatatgaatatgactttcaaaaaaattaggggcttaactcatttagatccaaaaaaatattttgaattttcttcaaggtcgcaacgaaaaacatttaggattcaaaacaaaagatgcagtaataaatctcgaaataatttttttattcgtacaattaatccctggaattgtctacccaaaacggctatggaaatcggaagtttagctaaatttaaaaattttctgagagaattttatttagaaaataagtcctgagtggtaattcatcccttttttattttattttatgtattttactgtattgaccatatcatattttttttttttttaaattgtattcattactttgttttccgctataagtgcaattacatgttgccttgcggtttgctcaaataaataaataaataaataaaaattaattgttattctaacaattttattataaatttaaattgggtttttataaataaattccgatttccctggattctatattctctaaaacatagtaggaaaagcatttacttttgttttcagtttgctaaaaataaaaaaaagattatatttttgaaaatttcaaaaattgtcataaacttaaagaattatgtaacagtattccctgttatcaatgttgattaaagagattaagtcaatggcaactcgtacaaagaatcgtacaataaaaaatttaagcataagctaaagactaaacctaagcctaaagcttagatgcttatggccactgtagtcaaatgtgcgctcgttttagcgctataagcaataccaaacccttaaattttaagggatttttgcgaactttcttcggattttgaaccggtacaaaaggcaattttaatttttggcaaaggatctttttagtcatgtttgggttcatatgagtttgctgggaacaggatttagctgattttattaacaatactttttcctagaatcaatcgagattttcaaattgcaataattttttttttaaatatttttgtgcaggcttttcttacataaaattattaagaataaataattttaaacattcgacaaaataaaattcctttctttctcatataattcccgatccaatatggcttatgcatgtttgcatccatatttatttctattaatctatccttaagtgatttgttatttagtatcacttcgtccactccccaattcagttccgattttctccaaattttgtc

SEQ ID NO: 53874 - DNA, 730 bp, Heterodera glycines
  Genomic contig location: Contig_ID=SeqID_23167; Location=504..1233; Strand=-
  SCN-specific regions: Sequence locations=1-7,29-78,108-363,402-730
ttcttccccgtccgtctctgtgctcgccatcgtcgcaattgtctgtttgatgtgccaatgttgcttttcggcaccgcgtattatttttaatttattattttaatttactaatttgttgttttccgacagatccgtgctgtcccggcagtcaaaaagtggtttcacttatgtccaattacgttggcacttttgccaattccatttccaagtcatcgctttgttcggatgcccaaaatgttgcggacgcgttgaaaggccaactgatcggctgctcgaaaggcggcgatcgaactcttttggccgacatcgaagcatcccttgccactcattctgctggtaataaccaattaatggacaattgcctaataattatttatttatttttaaatcattttaaatatctcttcccccttttagatgagtgtgcccttagcctcggcttcgtccgtgccatgttcgccattgccgcctccgcttcttcccatgccagcaacaacagcgaatggcagacattgagtgggcagtttggtcagaaagtcactgagattgactcgaaatgtgcagagtttggcattagcattggcaaagtgcccataaacggtcccaagggtaaagtcaattaagaaagaataatcaaatccatttaatctcttaaggtgtccatgttcaaaatgtgcccaactcggaaagtgtgatttctatgcctggattggccggctcacacacccaa

SEQ ID NO: 53875 - DNA, 1720 bp, Heterodera glycines
  Genomic contig location: Contig_ID=SeqID_23169; Location=577..2296; Strand=-
  SCN-specific regions: Sequence locations=1-4,26-108,130-393,441 -642,676-871,895-929,953-1005,1029-1201,1223-1280,1311-1498,1520-1720
atgatttggaaaattcaaaatttagggctcaatcgaataagagccgctttaacggaagagcgggcaaatgaaagaggcgaagggactaatgagggtgaagtcgctaatggagtgaataatgaggatggtgaagccgttaatgaggggactgacaatggcatcattattaattgcaatgtggcaacaacaaaacgacgaaagaccaccaaagagcagcacaatgagagcaacgggcgcaacactccgctggacaaatgctgctccaactcccctcaaaattgtggcatttgatggagaaaatggcacacttaccgtaccctaaatttacccttacattttcacgctttacggtattatgccagtgttaagcttcgatgttgtgcattacatgtgaattttttgatttaaaattaatgcaatttaataaaatatatttttttcatttctccaaatgaaaatagccaattttaaggaatacatacagtagtcaaatagctgttactaccgtagacgatggtgctgttgctgttacggtacttttcccaggggcacttctttcatcagtcattgtgccattccttcattcgtttgctttttctttatttcttttcattttttggccatgtcccttggcccatttccaaaaagaaatctttctcttttcattatttatttcgcccattcacttcttctattggcttttgtaatgttttaatttaatgcgctgacaaaagaaatttggcaaacgcaaaaaaaagaaaaaagaaaaagccacgtaaaataagcgccgcttttcctccattttctcgcttttccattcattcgattcattccattggcactcaccaaaaatggcaatcaatccaaatccattcatttttctcttttattttagcattttctcatttcgatggttcgttcctttcccacttttttctccccgctttctttcgtcctttgctttttgttgctcgtcgatggcacttttgctgaccaaaagaaaaagggcagcggtggcggcggcgacttaagcgaccttttggggggggttggacttggacggaatgctttcgggagtgcaggaaatgctgggcaaagccgggggcggagctgcgggtaatctgaaatccaaattggccagtagaattgctagccgatcccaaattccaatatttttcgagttcgtatccgattcccgaattaatttttagccatggaaagccaattaataccaatttttccctctttaaaagatggaaagaagggattcgacaaaatcaaagaaatggcggccaatttggacccgaaaatgctgcaggatatgctgggcaaaattgacacgggcaaaatcaacgaagtcatcaaaaatatgatgacaccggagaatatgtggaacatgcttccggcaaatgtcaaaggtgccgaaaaggcatttgctaaaatgattagtcaaaaataaatttaagagttgttgccacatagttggtttttgattggcaaaaaattgggcaatgttttggccaaagaatgggacaaaatcgtcgaattgatggactcggtggacaaattgggctcggcggaagagctgtgggcagcagtgaagcagaagacgccgatgctggccgatctgctggagaacgatttgtggaagggaagcaaagagcggtggacaaagttcgagggcaatttgggcgacgaggcgaagcagtacaaggaaaat

SEQ ID NO: 53876 - DNA, 812 bp, Heterodera glycines
  Genomic contig location: Contig_ID=SeqID_23174; Location=675..1486; Strand=+
  SCN-specific regions: Sequence locations=1-271,293-419,444-812
atgtacattacgtattgccgaggttggcatgttggtaaaaatgttgctaccgtttaccacccattctcccagctgtactccgaagaacagttcaagacgtacatgcacgaggcgggcgatgcgatccgcgactgtgcgttgggttgcgccgggtggcggttcaattacgacggtgtgtcaccgaacatgacaatgttgagcatcaacaacaacaacccgagtgatgagctgcagtccgcccgacaagtgagtggcgttaatggacttttccttcattgtcagaattatttttggcatttgtttttgtctttatccaaaatttttgccagccttttactcgcatgtgctcggcccgttcctcatttgcatccacaggttggaatcgctatttccagaaccgttcctcgcacggcactctgtcggccgagggcgccggtgcggcggaggcaattcaaagtttgaacgaacttggcaaagacgacgaggagcgggacgaattgggcaacaacaacggcaacagacagatgatggacggtggaggcggcggtggcttatcccaggaggaggacctcaacgaatttaagtcggtcgtttcgcatttaatttacttttaaaaccattcatttaatgtgctctttttcagtctttactattcaatggccgaggatggtgttcgtttggactacttccaattcgcctacgagggcgtgtccgagtcggacgagccggactcggtgacttgttcaaggcgtaattcccaagaaagcgaagaggaaaaaggttggaatggacgagttatggacacagtttaa

SEQ ID NO: 53877 - DNA, 503 bp, Heterodera glycines
  Genomic contig location: Contig_ID=SeqID_23174; Location=1923..2425; Strand=+
  SCN-specific regions: Sequence locations=1-204,226-273,295-503
atgcttaacgcattgcctttgccgtccaaccgagaacacgttgagaaagccgctgctgctgggcccggtcgttggagcccggtgccgaagagagcgcgcactgttgaggagaacatggcactgatcgaatctcgatggcaatatttggaggtatttaaaactgccgactaaaaaagggggcgggggtcaaccgaggataatgaattatgaggaaatctgaattttgaattcacaggaattgcgattggaaagagaggaaacagccaaaagggagggagaaaagggcgaagaagacggggacaatctcttccgattggacttaagcgaagtcgcggcaacagacgaaaatgggaacagcgaagaacaacaacgacagatggcggaagaacggatggacgacgaggagaacggcgtcagcggggacaatgacaaaaacgcaaataatactgacaacaataacaacaatgaggacggatttccgatggaatgcgtcgatggaatgg

SEQ ID NO: 53878 - DNA, 249 bp, Heterodera glycines
  Genomic contig location: Contig_ID=SeqID_23175; Location=188..436; Strand=-
  SCN-specific regions: Sequence locations=1-249
atgatttttaatatttccgtctttaattctcgcaagcggtcccgtattgacgccggccacccatcttctccccaaaaaattgtcgactcaaatttaatcaacaccgtcgctgacaatgttaagaatgttcttaaacagttggactccctctccgcactttcgactattgacaacgacgccctcaatggtgcttctctccgctgtcaaagcgcaactcctggtttgctctacacagctcacacaaattag

SEQ ID NO: 53879 - DNA, 1147 bp, Heterodera glycines
  misc_feature (1143)..(1143): n is a, c, g, or t
  Genomic contig location: Contig_ID=SeqID_23176; Location=25..1171; Strand=-
  SCN-specific regions: Sequence locations=1-201,223-565,587-863,887 -995,1018-1100,1122-1147
atggccggtggcggtggccgtgcagcactttctgcgtacgcgattcgtcaagaccaacacggcgcggatgctgctgatctactgaccaatgccggcgtcgccctcaacaaacacacgtacacgcttgatgacgtacgacaacttcaacaatggctaaacaatcagcatggagtggggcaaattcggctcgtggtgttcgagaaagagcaggagtaccggatagtgttcaaaggcgatgggtatgttaattatttttagtggattagtcaatgatatattgaagaattgccgcccgcttcaatctctgccttttgttggagcgcgcgcattacaactatattgggcgcattgagcagctgttcaaagtccccggctactgcattgactgtgagcgacgggcggatgcgcgttaccatgcctcggggtgcaaagttgcgtgtcgcctctgtctccgctttggtgccggatacccgtgcaagtcggaacaagtaagtattaatttgttgtcaatcatgtaattattttttcaaaaaaaaagttgccaaacggtgaaagcagtgcccgtcgttgtaacgagtgtggcttcgtcttcccctgcgacgactgcttcaactaccaccttgtcaaccaggcacctgacccattggacggccgtggtttgcgacagcgtcgtacgctttgtcagtggcgacgattttgccgagactgtggccgtgttgcctatcttgggcttcaccagtgtccaccacttggccaagccgatgagggagcgcatgactgtcgtctttgtgccggaccgcacacgaatgatcagccatgcttcatacagccacttggccctggaccatctcgcgctgcgcgagtcaacaacaacagcatcaacatcgacgttgcttctgaagatgatgatgagaatgacaccgatgaagatgacgacgaacaaccactccgtttttgcttctttgatgccgagacatcacaagatcggccacttcagctcaacaacaacaacaaccaggtggcccaaaagcatgttccgttgctcatcgtcgctgaggtgatttgcgatcgttgtatcaaggcgggaatcagcgttcacgacggtcatggacaacgtgcgctcggttgtgtttgtatgtgtgngtct

SEQ ID NO: 53880 - DNA, 1132 bp, Heterodera glycines
  Genomic contig location: Contig_ID=SeqID_4284; Location=1994..3125; Strand=-
  SCN-specific regions: Sequence locations=1-77,102-139,164-212,254 -737,761-928,953-1070,1092-1132
  Gene Ontology: Mol. function=RNA binding; Cellular component=nucleus
atggctggtggtcgtgccggcggcggtggcattgcgccgttccattcaccgccccactaccaatggcaacaacaaccacagcaacaccagcagcagcaatcttcgtacatgatggtcagcagtggtggtggtgggtcacgtagcggtggtggcggcggcaacgcaaattccgtcctcggcccctcgctgatgtccatggcgtcgccgtttatgccgcaacatcaacaacagcagcagcagcaacatcagccgctgggcaaggagtcgtggcgtggcagtcagcgccaactgatggacatggaggtgcagcagccgaagtatggcggaggaggttaccaccagcagcgcgggatggtaatttttaagcattataaataaatagtaaaattgcgaaaccaatactggttgaagaagggggccaactccgttttggccaattcagtctgattaggagcagtcaatttttagcctttttcattgttgactctaaatccaaaaaacttggtaccattcgtttcacagctttcaccaagctgatatagcctactatttgcaaattttggggcgttgattttgaaaatgtgagtgaaatttttttgacgtaatttactcacaatcagtatctttggttttattttttttcatttttactctatcttcagtgcctccataaatgtaaaaaaaacatatttgaattcgttcgttttcaatttttctttgtccaaggaacgtgacattggcggcggtggtggtggctacgatatgcgccgcagtagcggcggcggtggttacgacgattttggtgcttccgccggcacgtcatacggcggtggtggtggtggtggtcatgggatgatgcagcaacagcagccgcctccgctcggctcttcactggcgtccgccggtcactacaacacgtcgctgtacggcggaggcggtggccgcggtggtgccgggccgacaccgccgaagcgccatcgctacgcgtcgccgcaaccgccgcccgtggagcgcttcttttgaggagcaaaatggacggacaacaaatggacagacgtgcaatgtgtgagagagagaagaaaggctgagatttgggagagcagaaaaacaaaaaaatggttggatgaataaa

SEQ ID NO: 53881 - DNA, 1124 bp, Heterodera glycines
  Genomic contig location: Contig_ID=SeqID_4284; Location=663..1786; Strand=-
  SCN-specific regions: Sequence locations=1-70,92-376,399-409,432 -556,578-611,642-643,665-982,1004-1124
atggaagaaaagatgaaagacgacgaaaatgagttcggcgctcttcgcgctgtgcaaattgatgccgcgctgttggacaacactttgttggcattgatacaagcgcggattgaccaaattgtggacattggtggcgcccattgtctccaaatacaagcaacactttcgcgaatgcatcgcaccgctctattttttatcccattttctaacaggtccatagaattttgttaatttttcgaatttcttttttttgtgtttgtcagtttccttcgacccaggaaacccaaatttgccgaatttcaaaacacgaaaattgaaacaatttccgagttttcaatttttgtttaaatcctggttcaggatacgaattgggtcgaaatgaatgtgtgtaattaattctttgaccccggaaaacccaaattttccgatttcaattcaatttttttcttccaaattttaggccaaagtcccggccagcggctgctccaaattcgcaccaattttccaacaacattcaaagcattgatcaattatgtgctctgttttttgttgccatcatttgttgccctttttgtcaaactgagaccattcgatcggagaattcaggtttccgaaaatttatttatttatttgtcaataaagaaaaagtccacaaaagggaaaaatccgctttaaagctttggtacagcagggcgcagacggcccaccgactggtcgacttcatccacttttgcctgtttcttgcgcagggtgggccgataaggtagcgaagattcaggcacatagcaaaaaaaaaatcggcaatttaaaaacggctacagatttatgtagtagtaaggtttatcccaacctccctccccatttttcgaaaaaaaatttttttccaaaagattaaaacattttcaagggttttcagggtcgctgatcacgaatccggcatttatttcgaccaattccggacccctgacccaaaattcgagcaaaaagtcaaaattccaatttcacttattaaaactatcagacatttgaaaaaaagatgaaactcaaataaatacttaaattttacagacccaccgaacgactgtttggtagtcgacccgtttatgtgcagaaaccgacaattg

SEQ ID NO: 53882 - DNA, 680 bp, Heterodera glycines
  Genomic contig location: Contig_ID=SeqID_4284; Location=4416..5095; Strand=-
  SCN-specific regions: Sequence locations=1-348,370-680
tggtgatggaaatgcactcaaatgcatgttttattttcctcatggaatggaaatggcaaaaaggcatttatgcctggttttaagcttctaaggcaatatttaaaaaaaccctttaaagcggccaaaataaccgctaaaaagagcaacatatctctcaaattgattatttttggtaaaaataaaaaattcatgaattttttcccgttgttaagcccctttttaatttagggaaaagtcagggccattatgctggtgaacccgcaaaatccggaggccggctacttttccctggacgaaattcggccggtcgtccactgggccctgaggcaatgttttgaacattttggcgttttgttgcctattgtttttcattccattcgttcaattacagtcgcaatttgttcgtgcttttggacgaaatttacgatttgtccatttacgacgaggacaacgaatgtccgtttcgaagtgcggtagaactgttcgaagacgaacgcagccgacagaagctgatttggctgtggggactgagcaaggcaaaagcaaaaaatagaaagggaaaagggaacggaggagaaaaaaaaatgagaaaaaaagggacaaagggccaacaaaacggacaaagggccaacaaaacggacaaagggccaacaaaaaggacaaagggctaacaacagtca

SEQ ID NO: 53883 - DNA, 1269 bp, Heterodera glycines
  Genomic contig location: Contig_ID=SeqID_4286; Location=798..2066; Strand=-
  SCN-specific regions: Sequence locations=1-108,130-152,187-390,412 -584,606-1038,1060-1269
aaagaaacgttgccaaccattgaacacgtgcgtgacaaagcggcacagctgcagatggcactttccgacgctgaacaagttcccgacctggaggagcaggaacgtgctcggcaacgggaagaggagcgcgcgagacgggccaaactgccggcacaggtattatactttttcttggtttgtatgtatggcaccttttatttatagtattggcacgtgacaatattattgatgcttgagagactcgaaaatgccctcatttctaaggccaaaccccaaaaaatggcattgaatgttttgtagttaggctcataaattttttaagcgtcatatttataaaaaaatatacctaattctgttttggtgtggttttttttttgttcaaaacaatggttttatccattaaactttttacagaatgccaaggatttggacccgtgcactctgtcgcgtccgcaactgatgaagttggccacgctgaacgacagggcacagtttgcgcaggcgatcaccggctgtttcatccgtctgaatgcgggcgctgcaaatcattttgaggtcggcgcattttcgcggccatgccagacattttgtggcattctgttcattattagtggcgaaattaatatttaaaaaaatgtttccttttcagatcgaccaaattgtgaaggtggaacatccaccggcggccaccgaggaagcggcgagcaaaaaggcggcggacaaagccgtgctggagctgaaagtgaccggcaccatttcgctgaccgcgctcacctacattgccagcaacttcaagttcacggaggacgagtttcgcaagagttggttggccgagaccaccgaggtgggcgagggtcgggggatgatgatgggactgaactagccagttagttgtgggtgatgggactgaactggtcggctaattctgggtgatgggactgaactggccagttaattttgtacagtgggattgtacaataaaaaattactaaatttttttgaaggcaaatccactgccaacaatggaaatggtgcagcagaaacagaaggagttggaggaggcattccgcgccgtctcacaagctgcagacgcacagcaaagggtttgacaataatagcacggactttgggaagggattgggaagacagtccctttgttttaaggggtttttgtgatttgtaccaactacttcatcttgaaaaaaatttttttttggaataatgtttccgaaaaaatgcagcagaccctggaaagcatcttaaaataaa

SEQ ID NO: 53884 - DNA, 495 bp, Heterodera glycines
  Genomic contig location: Contig_ID=SeqID_23177; Location=657..1151; Strand=-
  SCN-specific regions: Sequence locations=1-153,176-495
atgaacatttgccaattatggacaacaattacgaagctaataaattttaagtaaaagtgtaagctaaagtatagttacttaatttgaattataagcaattttctttgataaatgaattaaaaaaattttacattagcattttttaaaaggagctaattttatttttttttaaattggcattgccaattacatacaattaaattggttcaaaaatggcacagatgacatcatatgtagcaagaagcattttcaagaatttatggctctattattaagtgaatagaattttttaaaagaattaaatttaagagaaaaattgacaattgacaattaaatataattaaattggttgaaaatggcacatatgacatcacagtctgttcattttaaagatttatggctctattattatgccgagtgagctgtgttaaattttcggttcaatgcttttccttttatcggcatttatcctttcaaattggtctataaaataaa

SEQ ID NO: 53885 - DNA, 956 bp, Heterodera glycines
  Genomic contig location: Contig_ID=SeqID_23179; Location=944..1899; Strand=-
  SCN-specific regions: Sequence locations=1-524,546-563,585-781,805-956
atggacggcacttacgaatgcgcgacggaagaaagtgcaaatggaaaagtgccattggccatttactcactgagagtggacggcggtaaggcaccaatcagcgaataattagccgaaattaacttccgtctgatccctcccccaattaattagtcaattaacttttccgtctgacccccttaccccccccccccttttctcagctgactgcgcccgtcccaaaagtgtggaacagttccgatcggctcaaagggagtggtgccgtcggatggacacttataggagcaatttgtcaaaatgggaaagcattcgcgatgccaatggacaaggcaaaggcctttgtgacacaaatgccgaaacggaaaggaggacggactcggggaattttgttgcctaactttggcattttcacacccacaaaatcagaggcttaaattggccctaagacaaacccaaggcaaaacattccatcgtaattctctacttccgattgctcactcatttattatctttctacgcctttcttttgtctgtgtttttaattattttgtgcataaatatgcttttcagagagagatggaaagatggaacagattttgaattaaactgaaatgcaaaattttttgaagttcaacaaacagtaaaatttgcactgtttcataattaaggcactgaacgaataatgaatgggtttttattactttatttttcggtcagtttttaatttattcaaaatgatagaaaagaaaattttggattgccgtttctcttaatggataacaaaaaaaaaaaatatataataatgaaaagttgaacattgtatgagcaatgtgcaaaaaaaaaaagaagcaaaaatatggaacaaccggccgtccaaactgtcaacctgcaaactatcgaagaaaattcagtaaaattaatggttataattttaatggttcgcatcgaaaaataaa

SEQ ID NO: 53886 - DNA, 704 bp, Heterodera glycines
  Genomic contig location: Contig_ID=SeqID_23180; Location=125..828; Strand=+
  SCN-specific regions: Sequence locations=1-704
atgacttccactgttccacaaattgtgctccgtctgttgctctttgctgtcctcattttgaactgcttcgactgttgccatgggtaagctttcggatttggaagcattttgcctcacttttttgcttatttctcggtcaattattttcccatttttcagcagagttcattctaagtccagcacagttccaacgactacgaagtccagcacagttccaacgactacgacgaagtctcctccagctccaaaaaaaggaagtattctcgacaaactcccaatttgggccaccattgtcatcgccgttttaattgggtgagtttgtctgctgcttttttgccgtgccattttcctccgtcttcaatttgttccccatgttcagcatggtcatcgcaattggcattgtttgctgcgcgtggtggtgctgccttcgtcagcgatatgttcgccgttctgcaactgatgggccctcctcgtcactgagcgacaccgaaaagtcaaagggcggcggatattcgtcgaagccgagcggattgatgtccaagctgcctttatggaagtcgtcgtcctctacgaccaaaaccaaaatgccggacagtctcaaatcggacatacaaccatcaagggcatcatcatcaaaaacgaaagacaagtcttcgtcaacaatcccggacagcaaatataccatgctgacgcagaagcattga

SEQ ID NO: 53887 - DNA, 1585 bp, Heterodera glycines
  Genomic contig location: Contig_ID=SeqID_23181; Location=84..1668; Strand=-
  SCN-specific regions: Sequence locations=1-45,67-131,153-269,293 -958,980-1305,1328-1585
gaaagacattttcgtgccttgacatcagaaaggcacttcaagcaatagtggaagtaaaggaggaagtgcagagatgtgcacatgtcctccgaggcgatgaacgaccacgttcatccgccttcaattccccacctcaacagaggggtgcctggaatcaaaggggtgaccaccgtcactccaacaaccgacagagccaaccaccaaggccatttaatcgcggaggaacgcctcagccagaatatagggcgttctccgctattaacaaaaatccggaaagggccaaaaccccagcaagaaaatggggtcggtcctgctcgttctgctcgggaactgatcatctcccgagcgagtgcccggcattcccaacaccgggagctcgtcgaaaacggctgaaagaacagcagcgctgcctcaactgccttgtgcaaggtcacaacactgaggagtgcacctcaccataccggtgccgaaactgtggcaacaaacaccacttcctcatatgcttcaagagggaggagtcccattcacggtcaaatgggaatcgttccgcttcctcccccaagtcgggaagagagccaggagggcgaaagttccctcagcggcaggtggaaagccaaacccacctgatcacggctggatttcaacagaacgatcagtcaaaccctccaccaagagagggggagatcgttcaatccatggggatgtccaccgtggacaccagcaaagggagagccaacaaggttcccaagtgcaaaaagccgcacgcgtatctgatgacgcgacggctgctggctaagtcaagtcgcgacagccggaatataatcaaagttgcagtgctctttgacccgggaagccaaacaacgtacggagcggatccgcttatcgataagctccgcccgcacaaactcacctccgaagagatggaggtccacgggtttggaggaaaacgggagccgttactcttccattcacccatttactccgtccttctccaaagggcggacggaaaatgggaggaaattctactcaatcggacggagaaaatctccactcacttcagcatggtcgaatggagcgccgatgaatccgtcacgaatcatcacgaagcttgtgaagcaatgtgcttcacaaaggaggagccaatgatactcctcagcgcaagacacttctggcaattcttccaagggaagagagaagtgtctcccgggctgtttgtgatcaacacagcatttagcccgctggtaaatggcgagtccactattggaccgccaaactcaagtcaaaaggccctttcgatgatggccatccacagcacaaatgtggaacaaatgccaaccatcaatgaggttgagcatttcttcaacctcgaatcactgggaatccaggatgatcctgcccaggatgacgaccaaacagctatggagctgtttaacaaatcaatccgtcaagagacagacggaaggtactctgtcaaatggccgtggaaggagtccaatccggacctctcttccaatttcaaaatggcccacagcaggctgtcatcggtgctaaccaagctccgacattctccacaaattctggagaa

SEQ ID NO: 53888 - DNA, 235 bp, Heterodera glycines
  Genomic contig location: Contig_ID=SeqID_23182; Location=945..1179; Strand=-
  SCN-specific regions: Sequence locations=1-49,103-117,149-235
atgttaacaaaaggactgcttgttcagcatatgaattggatgtaatggcatttttattaaaatttaaaaaacaatttaattttaataaatttacaatttttagagtggaaagaaagttgaaaagtgtaaaaaaggaagaagaaactgattggattgaggataacaaagaattataaacattaattaatttttgctttatgcacttttttgtatttttcgattattttttaataaa

SEQ ID NO: 53889 - DNA, 639 bp, Heterodera glycines
  Genomic contig location: Contig_ID=SeqID_23183; Location=2140..2778; Strand=+
  SCN-specific regions: Sequence locations=1-639
atggggacagcgcgcacctcagctggcttgccacatccggggacttttgacggaacagcggactttcacaattatttaaaatcttttaatcttgtggcgacggcacatggatgtacacctgttcgatgtgcgcaaattctaccattatatttgcgcgggtccgctcgggctatttacgatggattgctacaagacgataaatcgaattggaagacattagtcgacgcactcgccaccaatttaaagaaggtttcatccagccttgttgcgcggcagatgctggcaaaacggaagcaacacgtcggcgaaagcttagacgaatttgcccaagagatcaggactctagtatcaaaagcgtacccggatacgtcgcttgaaatgaatttcgatgcgttagtacttggagacatggaggaagacgtgaaaagggaacatgacgagcgactaaaaagattcagatcgggaattgccaaggattttttccgctcgaacatgacggcatcaatcaaagaaaaaattctcttcatggatgaacctcagtcatttgaagaagcgatcacacaggccaaaagggttcaacaaatgcagggagcgttggcagaagatctctggaaacaaacacaaggaaccaaagccgaa

SEQ ID NO: 53890 - DNA, 167 bp, Heterodera glycines
  Genomic contig location: Contig_ID=SeqID_23184; Location=789..955; Strand=-
  SCN-specific regions: Sequence locations=1-100,123-134,157-167
atgtttgatttcgttgacaaagaaaaaagttatagtccaaaaactgggctggcgccgaaacgcgcggcgccgaaacgcgcggcgccgaaacgcgtgtgtccctgctgctgtgcagcagcagtctgctggatgcgctgggagagggagggagtgggaaaaaagagaga

SEQ ID NO: 53891 - DNA, 642 bp, Heterodera glycines
  Genomic contig location: Contig_ID=SeqID_23187; Location=577..1218; Strand=-
  SCN-specific regions: Sequence locations=1-48,71-141,163-411,464 -543,586-642
ccgctccacagctgaatcccaatgccgaaatgtcaccgcaggacgaagcagggccgttaacatctgctgcatcggccgaagaagcgatggagtcgccgccaccaactccaggaccagtgcggacgcccgagatggacgacgaaattttggaatttggcttttcgctgccatcgacatctgtcacaccaatcggcgatttggtgccgttttcgacaacaccaactgcgtcaatggacaccggagagacgaccccgccaccgctggccattgacgagttgaatttgatttgaattttaaacattttagaggctgtaagaccaaaaagaaaacgacaattttttggagcattcggatggtgaaaatgaagatgacgctgtcattgatgttattgggtgatcaaattttgttttgttttttaaatttacttaaaaaaatttagaataatatgacttaattattttttctttattcgttgagaaaaatgtgaaatattgcttaattaaatatataactcaggtgggattgaacctgggactcccttttagagagagatgagagagagtgagagaaagcaagagagacagattgaatattagaaattttaataagtttcccgttaataattagtaataatttaataaa

SEQ ID NO: 53892 - DNA, 56 bp, Heterodera glycines
  Genomic contig location: Contig_ID=SeqID_23187; Location=40..95; Strand=+
  SCN-specific regions: Sequence locations=1-8,38-56
gtcccggttcccggtcccgggttttgaaaagctcaggccccggtcccggtagggca

SEQ ID NO: 53893 - DNA, 1349 bp, Heterodera glycines
  Genomic contig location: Contig_ID=SeqID_4287; Location=194..1542; Strand=+
  SCN-specific regions: Sequence locations=1-4,194-214,244-1066,1089 -1183,1206-1287,1309-1349
  Gene Ontology: Mol. function=chaperone activity; Cellular component =extracellular space; Biological process=protein folding
aatacgacaatgatggatcatcatcatcttccaaagattcatcatcgaaagattcctcatcatccaagggatcatcttcgcacaaggattcatcatcaggacattcatcagaatccaaagaatcacattcttccaaagattcatcactgaaaccatgttcaccaaacgaagattcgtcctctgtcaatgaaaagccctcaaattccaaatcatcggacactgtctccacatccgaagcctcaccatcgcatattgaagagtcgtcaacatttgatgatttatcatcagtcacggaagagtcgtcaacatctgaaggtttatcatcagtcacggaagaatcgtcaacatttgatgatttatcatcagtcacggaagagtcgtcaacatctgaagatttatcatcagtcacggaagaatcgtcaacatttgatgatttatcatcagtcacggaagagtcgtcaacatctgaagatttatcatcagtcactgaacagtcgtcaacatttgatgatttatcatcagtcacggaagaatcgtcaacatttgatgatttatcatcagtcacggaagagtcgtcaacatttgatgatttatcatcagtcacggaagaatcgtcaacatttgaagatttatcatcagtcactgaagagtcgtcaacaatttccgagtcttgtgcgtcggtgtgcagtggatttggatggacaaattataatggcaattgttacaaagttatcgaaggactgatgaatcagacgtgagtaaatgggaacttatccaagaaaaaaaaatttccatgagaaaatattagtggaatattttaattactatcctaattatgcttttaattagttcccaataaacgattgtttagtcaagcggtgtccgcttgtactgccgaagacccgcaagcgcaactcgtcagtatttgggatgaggccgaaaatcggcttatttcacaaattattacccggccgcttgcccgttcacttcagacctataatttggcatcaccaattttcaacactttttggtgaattaattatttttaatgggctaatcccacaaattataatgtttttatttttcaggatcggtcttcgccgtgtccttgtcggaaatcgctaccaaagcacatggacaaacggttcggcagcaatatttggcaatgttgtaagtgaaaagctaattaattaataattaaaaaacaaaaacaaacaaatagcccgaaattacaactgctgcgtcaagaaacacatcgccatgggcagcaggacaaccctcgggcaccaacaaatacactgacccaagttgtttgacttattgttacattgaaaaagcttttttaatta

SEQ ID NO: 53894 - DNA, 693 bp, Heterodera glycines
  Genomic contig location: Contig_ID=SeqID_4288; Location=22..714; Strand=-
  SCN-specific regions: Sequence locations=1-315,366-473,515-668,690-693
atggccaccaaaaatgttcaaatggcaaatgtttgccgcaaaaatgagccaaatttgacgggcaaatgcgtcccaaattggctgaacatttgcaatagacaactccaaattgatgctacttctgtcccaaatgtgcttgttggcacggagaaatgtgatcacggaatggtcaatgtaactgatgaaatatgcaatgctttaataccgcttaaagccagggatgcgatcgaaaatttttcaaaatcaggacatcgggcccaaaaaatcagattttggggtcaaaaatcagaacattttgcaaaattgcttcaaatcttttatttttacaattaatttaatcaaaaatcattaaatattatatttttcgcctccaattatcatctttaaaaattttggtgaggaaattaacaaatcgtaaatttcagtgcactcgggatcaaaaaatcagatttttaagaattttttgcggcgcatttttccaaaaaacttttgggaaatgggcgaggggggagggtccgggggagtttcttttagacacccatcaaatttgatgttggatcggcttagcgggaaaattgtgcatattgattttggcgaatgttttgaaatgggagatgaaaacggggaaatatattccggaaaaaaaatccgttccaactcacgaggatgtttgttcaagggggaaaaaataaa

SEQ ID NO: 53895 - DNA, 1256 bp, Heterodera glycines
  Genomic contig location: Contig_ID=SeqID_4288; Location=1093..2348; Strand=+
  SCN-specific regions: Sequence locations=1-220,242-415,455-528,550 -578,604-819,850-953,975-1159,1198-1256
atggtgtgccaaacgtcaattgagccatttgaattggtgaataaacggactaatgagaagctgacactgacaaatgaagacacttgtgggaaattaattggtggattatgcggcgatgcccaattgttggggagacggcggcggtccaacaggggccaatcacaattacgaacgacaaaagataaacgccaaatctgtcgtaatatacgtcgtttgtcgttatctccaatcacaattaaaaaatttgtcgtttgtctcccgaaatttggcgtttgtcgttttgcgttcgtaattgtgattgaaaccaacgacaaacgccaaatttcagacgacaaatgccaaatatttgggggggggggggcgctcaacaccgcccctcaaatttgtcgtctgagaagtgtcccaaaaatccaccaaattattttgattcaaaatttttatttaatattaaaaacatgtttctaagggtaaatgagttcgctgatcatgaatccgatctcagattttcatttctataacttttacctatgatttttcatccatttatttgggtctttcgaatttaggtttatgattagaattagagcaaaataaatgttagattcggaatctacgtacccaaaaacaaacgacaaatttacggtagattttcacacgacagagacaaacggaaaaacggcttcttcaaacgacaaacgacataattttttgtcgtaatgacaaattcggagacaaataccaaatttgtcttttgtcgtccgttttgtcgtttgtcgttcgtaattgtgattggccccagaacatactgtacacattcacaaattctttttctgtgtttcttaatattttatagggtactgtcgaaattaattattgtcgaatcacttgctgtcaaaatcacgcacagacagtgagaaaagtcaaaacagtttactgtcgaaatttttagattgtgtagaatttgggccagggttggaaacggccagaataatgccatattcgtgatcatcgtcctgaaagccccccccccgccacccttagacaaactaatatttcaagggctcccggacaatccgacagtggacaatccgacagtggacaatccgacagttggacaatccgacagtgaggacaatccgacagaagtggacaatccgacagtaaatttctattttaaaaaatattttcaagtcattagaacggattatttcctaaaaatatctcaatcaaatcaatttggttccggcattcgataa

SEQ ID NO: 53896 - DNA, 946 bp, Heterodera glycines
  Genomic contig location: Contig_ID=SeqID_4288; Location=2747..3692; Strand=-
  SCN-specific regions: Sequence locations=1-110,139-163,186-190,213 -338,361-394,430-499,539-581,604-645,681-946
atgatgtgcgactatataacatcccagggttgtatgtgaatggcttttttcaaaaaaatgaaaactatttaaaattgaaactgttattaaaattcaaacctggtttcaaagaaagaaaattatattttcaaactttaataacaacaagtaatattgtgtaaagtttaatatttttaaaaaataatgcactatttttcaattttatcttttctataaagtacattcttacaacaaattttaaatcttatatcgattcatattattaattccgatatattcaattgactgttttctaatccacaacactctcagtacgcatgacattcactgaagattttttaaattaataagaaaatgcccacttccgcagaacaacgtggatcttgatcattttagaataaataaatgtttaaaaaatgttaacaaaagtgaagtttaatatgctattataagttaagttattttttacgagattattagaattataacttcaatgatcaataaataattaatttaaaataaataaaattattataaagtacttctaaagatttaaattaggtatttaaaatcattggaaaagaataataaaggtatataaaagcatataagtgaattgaaaaaattttcggatcaacgcgagaaaaataaaagagaacataaaataataactcaagtccagtttatcgtgactggacaatccgacagtggacaattcgacagtggacaatccgacagttggacaatccgacagtgaggacaatccgacagaagtggacaatccgacagtggacaatccgacagtaaatttctatttaaaaaaatattttcaagtcattagaacggattatttcctaaaaatatctcaatcaaatcaatttagcttaaatttgctaccaaattaaaaaaagttagtttcgtatgctggtaacaaaagtacaataaa

SEQ ID NO: 53897 - DNA, 1236 bp, Heterodera glycines
  Genomic contig location: Contig_ID=SeqID_23188; Location=416..1651; Strand=-
  SCN-specific regions: Sequence locations=1-856,879-1236
  Gene Ontology: Mol. function=ATPase activity; Cellular component =cytosol; Biological process=microtubule cytoskeleton organization and biogenesis
atggcttctgttccaactcaaaaagatgagaaaacgaaacgaaatgaggagttggcaactgcgtaatattttaaaaatgctaaggagttgaaaattgatgacgttttaggattctcaagaaaatgccgaagccgaacagactcattgtggaccaatcgcccaaagacgataacagcagcgttctaatggcacaggtttgaaacttattcgttatttagtctaattatggcctttagactaaaatggatgacctgggattgtttcgcggcgattcgatccttctcaaaggcaaaaacgtcgtgagacaactagcattgtcataggttatccggcctcattttctacgtgaaattaattaatctcttcagccagtgacacttgtcctcccgagaaaatcttgatgaatcgagttgtgcgtcagaatctccgcgtcaaactgggcgatgtcgtcagtgtgtcgtccgcttcaaatacgccaaatggactgcgcattcacgtgcttccgattgatgacaccgttgaggggctgaccgggtaagccttgtaagacatgatattccctatctttttgcttaagaaacttgttcgaggtgtttcttaagccctactttttggaggcctaccgtccggtttacaaaggcgacacgttcactgtcaacgcagcaatgcgaactgttgagtttaagatacgttttttgactttatgttaatctaataaaaccccgggacctggtcaaacataaaaagatcacatccactatggagatttttttaaaacaagaaaaaattagggtatacttaactaactgtgttgacggatcagactttaaaaagttagagaatcattgtttaaacttgagaatatttggttttactcatgctgtttcccttttaaactacaatttttgctcctttaagtgattgaaactgatccggcgcctgcttgcattgtggtcccaacaacgatcattcattgtgagggggaaccgatcaaacgtgaggacgaggagaacaatctgaacgacgtcggctatgatgacattggcgggatgcgcaagcagttggcgcagatcaaagagatggttgaactcccgctccgccacccgatgcttttcaaatccatcggcattaaacctccccgaggaatgcttttgttcggtccgccaggcactggaaaaacacttgtggcccgtgctgtcgcgaatgaaactggcgcattctttttcctgctcaatg

SEQ ID NO: 53898 - DNA, 754 bp, Heterodera glycines
  Genomic contig location: Contig_ID=SeqID_23189; Location=54..807; Strand=+
  SCN-specific regions: Sequence locations=1-754
cattcaatcactgggactcaactcaccaacattacaatcaacgggactcaactctccagcatttcaatcactgggactcaacccaccaacattccaatcaaagggactcaacccaccaacattccaatcaacgggactcaaccctccagcatttcaatcactgggactcaactctccagcattcaatcactgggactcaactctccagcattcaatcactgggactcaacccaccaacattccaatcaacgggactcaactctccagcatttcaatcactggactcaacccaccaacattccaatcaaagggactcaacccaccaacattccaatcaacgggactcaaccctccagcatttcaatcactgggactcaactctccagcattcaatcactgggactcaactctccagcattcaatcactgggactcaacccaccaacattccaatcaacgggactcaactctccagcattcaatcactgggactcaactctccagcattcaatcactgggactcaactctccagcattcaatcactgggactcaacccaccaacattccaatcaacgggactcaactctccagcattcaatcactgggactcaacccaccaacattccaatcaacgggactcaattctcctgcatttcaatcactggggctcaaccctccagcattcaatcactgggactcaacctcagcaaatttctttagcatttttaactttttgtgtgccttgggatgttga

SEQ ID NO: 53899 - DNA, 603 bp, Heterodera glycines
  Genomic contig location: Contig_ID=SeqID_23190; Location=287..889; Strand=+
  SCN-specific regions: Sequence locations=1-101,196-522,544-603
atggcacacagtcagcagcagcaaatgatggcaccaaatgtggcagtgatccaaaacggaggcggcatcaaagggggcgaagaagtgcgaaaggagtcgacggaggaggacgagtcggacgacgaggagatggacgacgaggacgtggacgacgacgacgacgatgaggaggaagaagaggaggaggaggaagagagtgggagcggagaggaggcgaaccatcgtcggcacggcacggagagcggcgacacggcgacgaccacgccggcaggggccagcacggaggttccgctggcggcgcacatggcgacggacgtggcacagacgcaggcggcgccaggcaacgcggcagcagcggcaccgccgacggggactgaactgctggccatccgagcgaatctgcagattctgaaccatcaggtggtgatggcacgatgggatgaataccaaggagtggcatggcacaaaaaaagcgtacaaatggggaagtcggggctcattcaactgagtatcataagctacgcatcaaagcaatcaaaatggaattcacttcgggattcttccatgtgttccaatttatgtcatccttggctagcagtctga

SEQ ID NO: 53900 - DNA, 246 bp, Heterodera glycines
  Genomic contig location: Contig_ID=SeqID_23190; Location=1393..1638; Strand=-
  SCN-specific regions: Sequence locations=1-246
ccatctgttcaaaaattccaagaaaattgccaaaatttgaactcgaccgagaatggcacagacgggcaaaagcccccccgggcgagcctcatccgttcggccacacctttttctcctccggcgtgcagtatttagagcgtcggccccgcggtgccgattccgcgccgcttccgctcatgtcggcaccgccggcggagaacagactctgctgttgctgagtgccgggcgtcgcgaaggacgacgcgg

SEQ ID NO: 53901 - DNA, 563 bp, Heterodera glycines
  Genomic contig location: Contig_ID=SeqID_23192; Location=416..978; Strand=-
  SCN-specific regions: Sequence locations=1-563
atggcctcctccgagtattgccgtgcctttctctctctgtcgcccgtccgttgtcttctccatcacttccctttgtgcgcttcgttggcaaatgcgcgtcttaatgggtggctaattaactaattaattagtaattgcctttattcttccgtttcagtcattttgaggccaccgctttgaccacagcaattaacgaatcggccgcctccaactcggcccattttggagctcaacaacagtcatttaaaagtgcaaaaacaaccgcagaaaatggccaaattgccagcgaacctttgaaagaacggacaaatccgaaagggacacagggcgaaggggctgcgcggggaatggcggcggggaattcgccaaaaagcggggacagtgccgggggcaaaatgctagtgccaatgaacaaaggcaaaggcgggagagagtacatttggcaacacacgacgacaatggcactgatcggggaggaacacgacgactttctgtgatcaatcagattcatttggatttttgctttttttatttttttgtatttctgttaattaaccaataaa

SEQ ID NO: 53902 - DNA, 993 bp, Heterodera glycines
  Genomic contig location: Contig_ID=SeqID_23193; Location=134..1126; Strand=-
  SCN-specific regions: Sequence locations=1-111,133-859,896-920,945-993
atgacaaggacaaacaacaacagcagaagcatcgggaaaagcgcgtgtcgtttagcctccgtaagtgcattttttttgtttttgtcattttccttggcaataatttttttggcacactttacatgcatttataatcatagaacacttggctagaaatttgctggacatgttttttttggaggtccttgggttgaaatggaacggcttacaattagctgggcacctggccgaattagaaaaaaaatctaccccaccaattaaaaaattacacgcaaaacatacacaaatcactggcccgtagccagggcggagagtaaatgacaaattttacgattttgagccatttttagcagattttcatcaaaaaaaaatttcgaggaggcaccggagctttttttttgctattggtattttttaaattttcagcgatggggcgaaaaagaacgtctcttttgccaaaaaaatcacttttgtctattttccaaaaaaactaatcgtccaattgggtccgcggtgccgatggccatgaaaatttatgcaatattcttagcaaatgtggtgcctattattttaatggattatattttagcaaaaaggcttttggtcaattgtgtggaagttctgattgttgtatgttcccttcttcctgcgccgattctcggcagcattgtaagtttcgctacctttttttaagggggagacacacctctgcatccataatatgattaaaattttagctttttttggcactttttgcaacaacggcggttgccgaccgctataccgactacgttaacatcggcaacaacgcagcggcaaagggctgtgagcccaattgcggcacagaaacgacggcggaaacaacaacaacgacgacggcaacaccaacagcaacccaaacagggatattgattgggattgtcgtcggcgccgtcgtcgtcgtcattttggcaatttcttttgtggtatggctctgccacagaaggaagcgag

SEQ ID NO: 53903 - DNA, 313 bp, Heterodera glycines
  misc_feature (57)..(57): n is a, c, g, or t
  Genomic contig location: Contig_ID=SeqID_23194; Location=6..318; Strand=+
  SCN-specific regions: Sequence locations=1-313
agtcctcttcccggaaaagccttcaagcgccaattgcctccttctaaggacgacggnattttcgaggagggtttcatcgaagaacgccgcaagggactggaacagtttctgaacaaagttgccgggtcagtaccattgaaatgctcttaaaagcaataactttctttttagacatccgttggctcaaaatgaaaaatcgcttcatatctttttgcaaatgaacgagcttgacaagtgtgttttactggttttattagtcagcctttttccattcgacagaaattacgtcccgggacgcattcgtacggcctga

SEQ ID NO: 53904 - DNA, 905 bp, Heterodera glycines
  misc_feature (59)..(59): n is a, c, g, or t
  Genomic contig location: Contig_ID=SeqID_23195; Location=50..954; Strand=+
  SCN-specific regions: Sequence locations=1-810,832-905
atgtcatcgcttttctccgccgttttcgtcctcttttcgccgcttgtccaattaatttngttcatcaaagagaacagtgaccgcattttgatgtccattttccgcaacatttggccaatgatcgcgaaaaacatttgtggcatgcatttgtttccgaacattttccgccgtttgcgacaattggccccgtcttttctcaacgactgtccatcgcttcgctttttctctttgtacggcactgatgacttccccgattttccgtgcgatgacagtgccgcggcatcggatggacaagcggtggccaaatggtttttcacgccacttcaaaacaatgtgccaaaggtgtttgagtgctggatgccgaagtataatgtggattggcggctgaaaatgtcagccttccaaacggtgcttccatttatcatttccgtttttgctaatcaaaattttccatgttttagccatttgcatcggcttcatctcccgtcaatttcattgtcgtcatttggtttcactggtctcatgccgttgtgccatttgcgctgaccaacgaattgacgggggaacaattggcattcaaaaagactgacaattggcgtcgttttctgttggttcgttgtccaattgcgcgagacgcggacaaatgggcgaaatgggaaaaggaggcgattgattggcagattcgtgatcagtggaatcaaattggcattaaaattaatgatgaggacgaaatcggtgatgggtaagtgaatgtgaaggcttaatcaacaattcaaaatgattgcgtttctatttttaggcttctcgacgaaactcccggctcaagtgatcagcagcagaagtgaacgaatgaattgttgtgaagtgattggccaatttgaattatgcgattattgacgtgctca

SEQ ID NO: 53905 - DNA, 1897 bp, Heterodera glycines
  Genomic contig location: Contig_ID=SeqID_23196; Location=396..2292; Strand=-
  SCN-specific regions: Sequence locations=1-219,241-682,706-1620,1644 -1897
  Gene Ontology: Mol. function=sodium:phosphate symporter activity; Cellular component=integral to plasma membrane; Biological process =hermaphrodite genital morphogenesis
atgagtaagaaagtggtgaacatagacctctacattaaacatccggaccaattttttctcggacaattggccattctcgggggtaagcgcagttttgaaagtgaaaagcgcacaatgacaaaatactttcctagcacaggcggaagtgtttggctggtgaccgctactcttctccgtctgcccgtctcttccactcatagcattgtcggcgccaccctcggcttcactttggtgttgaacggtatcaaaggcatttcctggtggaaaatccttgaaattgctctttcgtgggtaattatcggtcaatttgtctctcgtaaattgattcttaacaaaaggttctgtcccccgctttgtccggtttcgtctctgccactctttatatgattgtcgactttgccgttctgcgaagagttggttatttcgttaagaaaactcgaataacattcaactttcagagaaacccggtgaagtgtggtcttcgcgctttgcctttcttctatttcttttgcatcgcttttaacacttttgccatcgtcaaaaatgggtcgcaaaaacttgagcgtaatgctctgttattttcaataattattgccactaaatttcagattttgaagtaatcaaagacagaattagtgtttgggtgctgattatgctttccattggatttggagtcgttgctgcactgatttctcatttcatattgcgtccgcggattttgcgctggatttatagtaaccagcaaattagcatatttgtccaattgaaaaataaaaacggtttttaggaggcagagaggaaaaaatcaacgaacaaaacgacgaacagaacgacgacgaaagcaatgaatggagcaatctctcatcaagtgaacggcttcagtcgtttcgactaagtgagagaaatccaaaaaaagacggaacccctcgggtttttcagctcctcgtggattgatctcgtggttttttccgcgcaaggaccgaaaagagaacaaagacactttgcgaatgtttagcacaattcaggctatctttttctgcgtttgcgatgccccgtttgaccaccttttcaggtgttcaccgcttgcttcgccgcatttgcccacgggcgcaatgacgtgagcaactccatttctcgcctggtcgcaatgctttcgtgtgggatcaacggcaccgtgaaagagaaggaggacacttccccgtggctgctccttttcggcgtgttttccatttgtttgggcctttggattcttgggcaccgaggtgggtcaacggcggatgagcaaatgaatggccgagcgttaaatttgcatttcccttttaagtgatcgaaatggttggccaaaagctgtctcaaatcaatccgtgcaggcaaatcatacacctgttcattatgttccttcatccaccacatttttcagtggtttcactatcgaatttggtgccgctttcaccgttgtgctcgcttccgaattggggttgcccgtctccaccacccattgtttggttggcagcgtcgtcgctgtcggcactattaactcgggcgaaggcatcgattggcgtcattttggctccattgccaaatcctgggtaatttaatttggcggagaaagtttacatgttattattaatttaaaataatttcagctggtcactcttcccgtgtctggtgctatttctgccgcactgatgtttattttgaaagtgtctcttttaacaaatgaataatccgattttattttttgcaaaccaaaggggtacaccacttttgtttttcccctgctctggtttttttcgactccaaccctatataagtgccaaaaaataattgtatttttcaaaaactgccaaattaactgttgaaaagtttcaacaattgtgaaacaatcaaaaataaa

SEQ ID NO: 53906 - DNA, 354 bp, Heterodera glycines
  Genomic contig location: Contig_ID=SeqID_23196; Location=174..527; Strand=+
  SCN-specific regions: Sequence locations=1-354
gccttttcgtcagtcgaaaactgatgatggaatgtttgcggggtgccggactgattttagaaaggtcggcacaattcgaaatgaaaggggaaaaccccggaacaaaacagagaccaattggacaacgaattgttttatgaattggacggaatgtacattttggtagcgaggaaaatggccgagtgaaaggaatggaaaaggattttaaaatttgttaatacatttatttttgattgtttcacaattgttgaaacttttcaacagttaatttggcagtttttgaaaaatacaattattttttggcacttatatagggttggagtcgaaaaaaaccagagcaggggaaaaacaaaa

SEQ ID NO: 53907 - DNA, 2944 bp, Heterodera glycines
  Genomic contig location: Contig_ID=SeqID_4289; Location=1054..3997; Strand=+
  SCN-specific regions: Sequence locations=1-279,301-339,361-2119,2141 -2746,2769-2944
  Gene Ontology: Mol. function=ubiquitin conjugating enzyme activity; Cellular component=proteasome complex (sensu Eukarya); Biological process=mitosis
atggtgaagaacccattgcctgagggatgcactgcacggccacttgatcaacggaccatgaccccctggacggttaccatccgaggccgggccggcacaccgtacgaaaacggcaacttccaactgagcatggcatttccgagggactacccgttcaaagcgccgcaagtcacgttcaccacgcgcatcttccacccgaacatcgacacacggggcaaagtgtgtctggacattctgcaaacgcactgggcaccgacgctgaccatcgaaaaaggtggcgtggatttggtggtggatttgatcatgttttaaatggattgatcactttaatgctcgtaacttttttcaggggcattaagatccgctttttttgtgtttgattagcaaattcaaaagatttcattgcgtttcatcagagttagcgaaaaagcgaatttttggaatttatggtcttaatcgggcacgaatttgatggcgttggttttgtgtggtatttgtgcagtttgagtgatcaattttttcacatacaatttttggctgcagaaatcgttaatttgtttctctgtctttacagttgtgatctccatcatcgttctgctgaatgacccgaacccggacaactcgcctatcaatgcgcaagctgccagtttgtaccggactgaccgtgcggagttcaacagacgcgcccgtgagatgacgctcgcctatgcacgatgagatgatcagcacgtctttctgattccactaccaattatgtattactcattcattgtatatattattgtactgtatgttgtaccatatttatttgtgtgccactactgtgtgtctatttttgtgttgtatttgtgtgcattttcaaagccggtaaagaattttgtgctttttctattggcgtatccaaccttcaggaattttttttcgaaaactccttgaaaatgggccctcccgcttgaaattcaccctataaatgagctgatcactgatgaatgtcagtcaactcagattttgtgaaactttcgctaacattaagcattcattacacatgcacaaaattcggtggggattctttcaaaaagatttagcaaattctgcatgagtccaccgctaaaattatgtaattacttaatttcccgtccaattatattcattagtcgcagaaatttgaattgaatgaatgacatgttctcattcattcactgacatataacaatcgattggggtcatctcaaagtgtaaatgtttttgaactatcaaggaggatgtgatgatgatgacgagtgagtgacaattgcaaatgtcacggctcagaaatggccgtgaagcgtggaccaccgacgcctcccccttccccccccttcccccacgcctttcactcaattcaattcaaatcattatccgtccactccctctcattaccgcacaataattggattcaaaaaacattccattttctctcactcaactcatcattccgtgttcgttgagtgaccgttcatttttgtctcatttttgactgggattttccgggaccattttttgtttctgttttgtacttcatattcctgggtttagaattcattttctaacctgttttaacatcatcaccgtataatgaataacaccaccagcagcaggtaaacaccacccgttattttatttaattaaattccttgcatttggtcgggtttcttgaccaacagtaaaatttggttgtatgcaaatatgaatcccgaataggcctaaccaacaacaagtcaaatgccgaaaataaacgttcggtgtcggtctttaaattgattttgaaaattcacaattttctcgttttggcataatgcacgtttaaaaaagcagtttcccaccattctcgaactcattcccatgcataaattgtcccctgctaataccctttggcaaatccataaaaagtgccaaaaaaattattccccaaaatggccccaacgaccaaaaaaatatgtaaacgcctgccaccagagcttttgtatgaaacggttctttacgtatatcccaacccgaatttgtcgaatcttttcaattcttcttggatactcagaaaatttatgagtttccgagtccaaagatgggaggaaatacggaaattattatgttaattcaaatttggaaatgtttaattgtccggcaattttgattaatttttcattaagaaacgagcaattcttgaagcactttatgagtgttgtcgagaacgtaggccatggagaaccttcgaatcgtacacagcagacgaccaaaatgcccaaattttctttgcggcgttgacagaatttttggtgagcacaatttaagaaatgtcatgtttaaatgtttatgtgaatattcagaatccatatgcggaaatcgtgccctgaaactcccccggagcacatttacgacactatttcgtcatctcgtccgccgatgattcccattcgccgcataagaaggtttaaatgggatttttttcaggaaatgcatacttaaatggatatttagttgagcactcccccggggcacatttaccatactgtcatgacgaccacgtccgatggttcgcagctctcttctgtcatttacgacgttcctccgccttcgtcgaccattcctcgcgaatctgttactaccacccctccgccggtgccgcaacacacggttttgttcagggttaatttaggttaaaaatgtgcaatttggctcgcttttctcgaaatttcttcagggggagaactttttggattcaaaattttatttccagcacggaggcgaaaagaatcgaaagaacaacgaaacgccgtcgccggcctcgaaatgctcggacgcgaaaaaaaggtcgtaattttggagatgaactgatttttgaaataaaataaaattgtttttttagcgcaaagagacgccgaagaaggacagcgatggaaagaattga

SEQ ID NO: 53908 - DNA, 1482 bp, Heterodera glycines
  Genomic contig location: Contig_ID=SeqID_4290; Location=1062..2543; Strand=+
  SCN-specific regions: Sequence locations=1-24,46-266,288-423,447 -682,706-805,828-942,965-1014,1052-1391,1413-1482
atggaattgataaaaatgtctgaactttatttggcattgcagggcgaacaatgttattacacagtgccatccattcataagggattcaacgttaaaaatgtttgttcggtcggggcggggggacaatttcttgcaaaaaagggaattttggacctcgggtcaaaactcggagcaaaaatgaaacttttaaaaaaaactgaaatttttgattttctccaaatagttttggagttcggcattctctgaaatgcatgccattttcctgatccaaaaaactccaatgttttcagattttttgttttaaaaccaacttttatcaccccaaaaatttgccgtttttacgttttaattttaagcttcctttcgagtgtccgtcattttcaattgcacttgaacagcagttgcaacaaattgtggacttctccggctgtgtgaaggcaattgaaacatggaaagcggaacacttgtacaaccgcacggactgcttggactcggtgaagaaggcaatcctggagtcaatcatcgacgcctacaacatttaccagaacgaggctgaccgaatgcgtcgcgaagtttgtgtgaaggccgggaatttgagtaataattgagattttagggattgagttacacacgaaaattcattggcaacctattataagataatgcctcccataaaaaaaatttttttgaaattttttccaaaaatggcggggggggggggggggtaccacttataatataagaaataatcaaccatttttcaattgttttgttgattgttctaggcgttatgccaaattccgggttttcccgggctgatggaaattattgaattggtacgtttccatacctgtcaggttccagaaaactttaaaacttgctcgattaaactaaatcaaatttggtattattgggaagctcaacgagatttgtttaaccatataaaatatcaattttttaaatatgtgctttcgcgctcgaatttcgctcttgaaaactcctcattttttttcgaaaatttatcaatattttaagataaatattttttattcgcatcgcatttttgacactttaaattcaaattgtataccggacactgttcagaatgtgttgcacaagtacagccacagtattgccgatttgtgtgcatttgttcgcacttggcaacaacggctcaaccatttgttgggtttgctgcaaaaatcggacggtctctgtggccttgagatgatgaacgtgttgtttggccagtggacattccagtgctgcatcaacgactggcgttacaggtttcatcaaaatccaaacattttttggtctttgacggtgcggaaagacgccaaaaatttttgattttttttttacgaaattgtcatggaaaagtactacaaattttttcaaaaattggccatcgatcggctttgatattctcccctgaagacaaaaactacaaaatttcaatcttgggggtccgaatttcta

SEQ ID NO: 53909 - DNA, 1474 bp, Heterodera glycines
  Genomic contig location: Contig_ID=SeqID_23199; Location=445..1918; Strand=+
  SCN-specific regions: Sequence locations=1-305,330-336,373-762,784 -1148,1184-1230,1253-1474
atgcgaaaactcagatatccaaataacgttggaaaacgaccagagatcgcaggtgaaacaagtaaggcacgcgacggagccgcactcgacggaggtgcatttgttggtgttgaaattgacgcagaaaaaatggtcggcaaattgaacttttatgcggccggaatattatacaaagaaaaagatgaaaacgtgcaaccaattgagaaagtgccagatgaaaaagtgccaattgggaaatggcacaaattcgaagggcaagaaattgaactgatgccaagagaaattgatatgacaggtgaataacgaaaatattaatttattatttaattcagtatataatttaaaataaattaaattaaatataattaaattttgccatttgaaagatgaaaatgacaacatttgcattgaatttttggcattcgctgatgctgatgaaatgaaagacgatgcgcactttaaaatggacgatacagaacgaattcaagcaaaattgggcaaatatatttgcaaaaacatgaaagaaaatgaaaaaaacaagcaaaagaatcccaaaaagctaaattacaaatttaattggacaacggtggacgatgttcaattttatgcggaagaagcaatgggcgcaatgcgggagaaatttggaattaattacaaggaattagcggtaattatccacatatcctaaacacattaatgataaaattcgattgaaactatgaacaattaaaagaccgaaaaaatgtattgttttataaatggtaaaaaatatttttaaataaactttttaggattcttttctatcggatgacttaactgacctgggtatcaaagggaaaagctcaaacaaaatttatcgtacagaagacgaaaagtttttgttaaagcaaattccacaaccctatcaaatggaaacaatggaaagaacgttgaaagattatctgaagcatatgatgcaaatgggcgacaaatcatttatcaacaaaatcttttttgtgtttcgagtagaaattgaggtaataaaatttcaaatttaatcaaatgttgtaattttgattgcttcctttttatattttaacaaattttcgattccttttttattcttgaagttttttgattttataaattaagagtgggaaatcacttccttaaaatcttttaaaaaaatttttatatataaattctttcccagaacactcaaacactctttctgctgatggaaaatgtgttcaaaaatgccaaggatttgccacttttgaactttgatgtgaagggcgtcttctcccgtcagcccaaattggtcgaagttgtccctaaacagcgtttaaacgacgtcgtgctcaaatggtacaattattttggtggcgaaccgccccttgtgccggaagaagtgatgccaatgtttccagagggtattttgttagacaaagaaacgcatcgaaacatcgtagaacggctgaaacgcgactttgag

SEQ ID NO: 53910 - DNA, 351 bp, Heterodera glycines
  Genomic contig location: Contig_ID=SeqID_23200; Location=1283..1633; Strand=+
  SCN-specific regions: Sequence locations=1-20,51-351
atgacttgcgcatacgctaaactccttggtccgtgtttcaagacgggtcgaacagatgaccggcttttacaccgagaacgcacaactgagagcccgagctggaccgaactggttgctggtacgtgtcgcacgcgaccgccaccgacccccagctcgagtcaacacggacccgaaaccattgcacaattcacccagagtaaacagcactcccccgatccgggtaccagaccccgaaaggctggcctcaagaccgagctcacgcagctactccgagcatctcagcgcactccgcctgcaaatgccccattcgccactgaacagaaggacagcaaaccccagtctggaggctag

SEQ ID NO: 53911 - DNA, 959 bp, Heterodera glycines
  Genomic contig location: Contig_ID=SeqID_23202; Location=712..1670; Strand=+
  SCN-specific regions: Sequence locations=1-52,76-96,118-420,442 -538,561-900,923-959
atgcctttgctaaatatggtggaaattgagccggatatttaattttctctcgatttattattttaatatttttaaggattccgaacgtggcaaattggagaatgaactgatgctaaacgaaatccaacaacttgtggttaggcattcagcagacgacaatggcactttggcgttgaacgctgtacagtcgcgtcaaattgcacaacttacccaagattacatgtccaacctgcttaaattgttttccgtttcgtgccaagtccgtggggaagggcacataaaatcccgagaaatttgataatactttaagttgaaccgtgagggacgggccaccgaaattgctcgtcggaccacaaattccaagttgatacaagcgatgtgcaactacgcgtccaaagcacgccgacccgggctcagtgaaaaggtaattaagaaatattaaaaatttgtgtttacattcaaaaaataaatcttttcgttgattgcgatcagattgcttcaattggacgcgaacatttacaagcggttgaggcggaacagcagcgaaaaaagcagcaacagcagagcgcaaatttaaattatggcaattccatgttataccatcggagagtgcaaaatggaggtggaacaataatgctgatcaaattttaaaattttacatttagctaaggatgggactgaaaggaccgtcgctgatacggtggccccaaatgtgaacaaaatgttggtaccgaagcgaaaagtcactgctgacgaattgttggattctttacgggcagaagacgggtgagtgatgaagagcaattaatctcacaattagcccttaaaaatcattcattccgatatttagagccaaaaagcataaacaaaatgccaaaatgtgtccccctccgccgtcggtgccatcatctttgtcctcctcatctgccactctttcttccgcgctttgggaccgatga

SEQ ID NO: 53912 - DNA, 532 bp, Heterodera glycines
  Genomic contig location: Contig_ID=SeqID_23207; Location=1463..1994; Strand=+
  SCN-specific regions: Sequence locations=1-362,395-532
atggctttcattggatacggcgctcttacggccgcgctgagtggcatcattttgtacgcaaatttgcccacccgtctgaccattggcgccattgtgccgaccgttgaatttttggccgagacccaactgaaaaagttggaacccggccaagctgtggctggaccacaaattaaggtcattagcgactaattgaatacaaaatttattatcaattactatacaagaaaacaatgttatcaacttgtaaatgcacattgttcaggctagcgatctgttcaatgccggccatcctctgcttgtgatggctgtccgtcgacctggtgcctttttttgaatattccatttcgatttttctaaattgaattctttctatttggaaagaaaattcttaaatgtttacatttttttgcccagagccttgttaagaaatgccagagggattctgatttttttttctgataaaaaatataataaatttcagggttttgatcagtatttggataaaagtcaggaaattaaaaatggatattaa

SEQ ID NO: 53913 - DNA, 58 bp, Heterodera glycines
  Genomic contig location: Contig_ID=SeqID_23208; Location=1916..1973; Strand=+
  SCN-specific regions: Sequence locations=1-58
aaacaaatttaaaaaacggtcgcgaagcgcccgcccaagcccaacaaaatttaaaaaa

SEQ ID NO: 53914 - DNA, 595 bp, Heterodera glycines
  Genomic contig location: Contig_ID=SeqID_479; Location=743..1337; Strand=-
  SCN-specific regions: Sequence locations=1-496,561-566
atgaccccgagggacgagactgagacgcgaaaaacccgagaaatttctcgagtcgagactctcgcacatccctacaaatttgctcaaatttgcgcgtttccttccccgctttggcacaccttcgaaatgtgttcaaaaatttgctgtccaccaccaccaccaaagtcggcactttgcacacaaagcgtggccaatgccgcggcacagaccaatgccgaagagctgctcagtccggcacttggcggaattcgactggccaccaccgcacgcattcctttggcctacgcacaaaaaaaacaatgaaattttgattattttcgaagctaaaactctttgtaaggcttctgtctctgtgttgacaccctcccgttgggctaaactctccaaaatgccgcgccaacccgccaaaaaatagtggtgccatttgggcacggcgccattggaggaagcgccggaaaacgaatcggaaatgaccaaagtgaagggacttggaaggaaattaattaattgttttagaaatatttaatactatttaagataaaaataattaaattaattaagaagcgaaaatttgattttaaatttcaaaaataaa

SEQ ID NO: 53915 - DNA, 3087 bp, Heterodera glycines
  Genomic contig location: Contig_ID=SeqID_479; Location=124..3210; Strand=+
  SCN-specific regions: Sequence locations=1-298,323-467,490-502,551 -583,719-1366,1388-1833,1865-2084,2106-3087
  Gene Ontology: Mol. function=protein binding; Cellular component =cytoplasm; Biological process=galactose metabolism
cgtccgtccgttgtccgtctgttccgccaacggtctgtcaactgcgacccgcaatggctgatcagatgcccgggccgagtgaataggatcggcgagcacatagtctacagtgactactccgtgcttcagatggctattgagcacagcacatgggtgggtcggttgatatacgacactcactctgatcagaggatcggcactcactctgatcagagggtctttactttgatcagagggtctttactttgattagaggatcgtcactcactctgatcagagtcccaattgggaaaattcgaattaaatttttgattcaaaaattcttgactcagattttcacttttggaacctttatttttcttgagtagctcgacccaatggtactcatttctctgatcaggtcgctgttggaccatcgccggaacggacggtgcaattggtcaacgaagaagaagaaaaatacccgtaaatgaaaattaatttttaaaacgtttgaaaggagaataaaacataaaaataaaaattaattctttatttttagtataattttcgaaagtgaaaattgaataggcttttaggcttgataaaattaacaaatataatttaaaataattaattctttatttttgaaatttaaaatcaaattttcgcttcttaattaatttaattatttttatcttaaatagtattaaatatttctaaaacaattaattaatttccttccaagtcccttcactttggtcatttccgattcgttttccggcgcttcctccaatggcgccgtgcccaaatggcaccactattttttggcgggttggcgcggcattttggagagtttagcccaacgggagggtgtcaacacagagacagaagccttacaaagagttttagcttcgaaaataatcaaaatttcattgttttttttgtgcgtaggccaaaggaatgcgtgcggtggtggccagtcgaattccgccaagtgccggactgagcagctcttcggcattggtctgtgccgcggcattggccacgctttgtgtgcaaagtgccgactttggtggtggtggtggacagcaaatttttgaacacatttcgaaggtgtgccaaagcggggaaggaaacgcgcaaatttgagcaaatttgtagggatgtgcgagagtctcgactcgagaaatttctcgggtttttcgcgtctcagtctcgtccctcggggtcatttctaagtctcggtctcgattctcggtaaaaaatcatttctcgcacatccctacaaatttgggaacaatgcccgttactctttttaaatttggcgaattgttgcttgcagaaagaattggccgaaattgcgacccacgcggaacgctttgtcggcttggagggcggcggcatggaccaggcgagcaaatggcataatttcgaattaaaaaacaatttttgtgccattcattctccgtaaggcgtgcgaatgtttggcgcgtcggggcgaagcgttgcgcattgacttccgtccgctgggctggcgagcagtgcaactgcccgagaacgcgctgttcgctgtgctgcactccaacacggagatgaacaaaacagcgagtgcctattacaatcaggtgggagaagggaggggggggggggaagtgatcggacggagagacaaaaagtgatcaaagtgaactcaatgtgaagcagggagggaaactgattgatcagtggaagggggagacatgttgagaagcaatgatagagaactaaagatcagagagagagaggagagatgatcagacaaattgatcactaaaggagccattgctgaggaaaatgatcagaaacaaaggcaaaataaatttaaaatttaactaaattatatgaccaatgaatggataagaaaactttgatcaaacacataagttcattgatcggaaaaacaatgatcggcactttgttcctaagagggttgtcgagtgccgaatcgctgcccaagtgattgccaaacaaagcgggtgtttgccggcggacactgattggcgttctgttcgaaccctgcggcagggtataaagttgggtggttagacatgattcggatttctcgggacccgaaaaacttttcttggccaagtttcagttgctgcactgctcggcaaagatggccatccggagcaaatgttgacgctggtggacgagcacttggcaaaacggtgccaacgccaacagcagcagaaattggcggatggcattcacacgagggaggaaatttgtgccattttggactgttcagacgcacaattggcccaatggtcgttgaatgcgaacactcagaacagtgaggagaatgatctcgaatcagaacaaatcccagggtttcttgactctcacaattaaattcgacttctacccaatgatttaaatgccaatttgagacttttctcggcttagaaattggatgcttaatcagaattgcgacattgctttttctctcacttcatttaattcatcacaatttctccaaaaagtgactgagttttggctggccaagcgggcacggcacgtttatgcggaggcggcacgagtgttggaattcgaatgggtgtgccgtgaagggagagaagacaatggcacagtggcaaaattgggcggtaaattgagacaaaattcatcattcaatgaccaatggtttcccgaacagaactgatgaacgcttcgcatttgtcgtgtgcgcaactgttcgagtgcagttgccccgagttggacgaaacggtggccaattgtttgagtgcgggatgcattggtgcccgactgacgggtgattttcacggagttttttgcctggtttagtggaccaaattctataaattttggtgccatcattctaatccattcaaaatgctttaaaagtgatgcttgggccctacttttgtaggaaaattatacaaaatttcattattatttggacgtccaaaatgcgggtcatggtcgttttcgtacgagcccatatttttggctataacttttttattttcaaccaaatccaacactgttgttatcattcgatagccctatgtgtcctctataagcctgcaaaatttcaaaaaa

SEQ ID NO: 53916 - DNA, 592 bp, Heterodera glycines
  Genomic contig location: Contig_ID=SeqID_480; Location=150..741; Strand=-
  SCN-specific regions: Sequence locations=1-265,287-592
atgttgggttttgatgacaaagaaaaaagctatagccaaaatcatgctggcgccgaaacgaggtgggccccaaattacaacctatgagttttttaagcatttaagtttgcattttgattttaaaaatgaaaaaacacgtcacgttcactccgagtatcggagacgatgtccattccaccaatgtatcgtcggtagcgaagtctgagttcagcgttaaagagcgtgcctaagtgccagaaatattcaagtccggcaaaatgggaaattgggttaaaattttgattttgtttctttgcaggaaattggccgacgatgcctttcaaatattgcctttgcccgacatcgacccgaccgtcacttcgaccccggcggtcgtcaacaatttgatcgaggtttggctcctcagctcttggcactgactttcccgtaactctttcaggcggtcgagtcgctcgactcgcggatgcctttggcgttccaagagcagcagcaaatcctgaaaatgcaaggcgaaatgctgcaactcggcgtcagttgcaaggaacactacaagaagatacacgagcagtccgtgatgcgttacaatctcgag

SEQ ID NO: 53917 - DNA, 992 bp, Heterodera glycines
  Genomic contig location: Contig_ID=SeqID_480; Location=1498..2489; Strand=+
  SCN-specific regions: Sequence locations=1-123,149-226,248-286,308 -329,351-437,471-764,818-897,919-992
atgcatcatccactgatggtgccgccgcacacaattatgaatttggaagcttctcaacctcaatggatgacagattcgtttcttcccacaatggcttctcattcggtgatttgtgctccgtcctcttctgctgctgctcctccacgactgtcacaaatccaacaaatggcagcaagaagtgatgatggcaccacgccacaagcatcgaaggtaagaaattgatgattgcaacaattttggtgcaatggttgttaaactatgggtgggttaatatacgcggggatgacttgtcatgtttaggctactgagaagtcggtagaagttggaagcagcaacaccgccgccgccgcttttcacgattatttggcatgtgcgcagatggtaagaaaaggcatttcatataaacatttgtttatcggttgtgtgtaagtataaagaattatttttattatattttttctttaaaatttctcaaaattgcataacttggtcatactttgacaaaatctgtcaacaaatcacccttaaattacaaaatttttccctccgaaccccccccccccccccacaaaaaaagttttttttaaaagcgccgcaaaaaaccttttaaaataaaaatattgtcgcaaatttgctcaaaatctaaaattttgaaaatcaaatttcgatttacatgacaggacacaccccaaaacgtcgccggacaaaaaaaaattaaaatttttcagcaatcgtcatcatcggaccctattcttaaccacacgccgccgcctcctcctccgccccttcggccttttcatccgcctccacttcctccacaaggcaaccgcaactttcttcggtcaccgccgtgtcttctcccaccctctccgtcggggactgtcgcctttttgcacacgccaccgcctcctcctccgcaccctcgggccgcaattcctcctttgatgatgcagatgtcaacagcgactacaccgactgcaatgcgactctaa

SEQ ID NO: 53918 - DNA, 1463 bp, Heterodera glycines
  Genomic contig location: Contig_ID=SeqID_480; Location=2580..4042; Strand=+
  SCN-specific regions: Sequence locations=1-328,350-533,676-733,755 -799,821-1220,1242-1402,1424-1463
atgactttgccggacacgatgatgcattttggcccacctcatacttctccaatgcctttacggatggcaccgccggacacaatgatgcattttggtacgtctcgtcttgctccgatacctcttcgtatggcagcgaggccaatgttccgatctgcctctcattcacaacttcaacaaatccaaccaatggtagcgacaactgatggcaccatgcaacaatcattggaggtagcagaagcacattttctggttcaatagtttaaaatacgcagcgggctgatttgtcatgtttaggcaactgagaagttgggagaatatgggtgcaactccgccgccgccgcctctgttgatgatgatttggcatgggcacagatggaaattccgcccgagtttggacagcacaccaaattcttcagcaacaaggaattgttggaagataacaggtgtgaggaaggagagggtggggtcggcttttacaaagtccatggcatgttttattgttaattgttctaaggattggttgctcatcgtcaggcggcagacgcggcggtggtgcgggtcgaaaaggcggcggacgcggcggtggtgcgggtcgaaaaggcggcggacgcggcggtggtgcgggtcgaaaaggcggcggacgcggcggtggtgcgggtcgaaaaggcggcggtgttgcgggtcgaaaaagcggtggtgtggatagtaaatactatcaggtgattcttttattagtaattaacacaccaacaaagagattgttataggaatttacaatttatgcattgttcccatgacctttctttctttatccccttggttgcaaccctattccatttataatgagaaagtccatctcattttctccattcactattttttgaccaaaaatgaaccctaaaaagagtaaaattccacccgagttacttttcgagcttgtttcttttcttccgtttgacattctttgggccatcacaagggtttcctatgtttttgatcgttttctatgggacaggcaattttggtggattcgaaatgttttaattcgctgggaggcagtaaggcgaaaagctgtaaaattttttgtaaattaacaattatttaagcaaatgacattctccggcgtttgcgcacgacttcgtgcatcctcaaaagatgctcccgagactgttcttatttgggcaaaagaaagtatatctttagccacttaattcatgaacttattttgaaaattcagaaatatgtgctcatttttccatttccatcggaacttttaacaacgaagaattcacagaaaaaatgaaatatttgtatggactgtacaaggatgtcagtactgaagagctaaagatccattgcgaatgtaatttttgtagttttttatcatttcattttgaattttagttctgtctggcatttgtgatgaaatgaaaagacacaaacgaatggcttgggaatccgga

SEQ ID NO: 53919 - DNA, 929 bp, Heterodera glycines
  Genomic contig location: Contig_ID=SeqID_480; Location=4772..5700; Strand=-
  SCN-specific regions: Sequence locations=1-140,162-514,545-632,654 -690,712-814,836-929
atgaaaaaacacgtcacgttcactccgagtatcggagacgatgtccattccaccaatgtatcgtcggtagcggagtctgagttcagcgttaaagggcgtgccgaagtgccagaaatattcaagtccggcaaaatgggaaattgggttaaaattttgattttgtttctttgcaggaaattggccgacgatgcctttcaaatattgcctttgcccgacatcgacccgaccgtcacttcgaccccggcggtcgtcaacaatttgatcgaggtttggctcctcagctcttggcactgactttcccgtaactctttcaggcggtcgagtcgctcgactcgcggatgcctttggcgttccaagagcagcagcaaatcctgaaaatgcaaggcgaaatgctgcaactcggcgtcagttgcaaggaacactacaagaagatacacgagcagtccgtgatgcgttacaatctcgaggtgagcggacaaaggcgaatttcaccatttgttgatgggagggggtggtaatttgtaaaattgaatttggcacattcgttgtacggctttaagaccatttttggaaatgagcaaaacacgggtaattttgtaaggctgtcccacccctccatttttgataaaatataaaaatttggtcataaaacattcttacaaattatggggggttcgtaccgctgataacgaattgaaattcattttgattaatgaaacaaatgatctcccaaaaagccaactatttaaaatgggaatttcgtcatttttcttatcttaaatcgtccccccttttagaagagtgtcaataaaaacatcgacgatctgaaggagggcgcagttgtcgcgcagaaattggtgaaggcgaagagtgcgtacgaggaaatggtagcgaaggcggaggcgttgctggccaaggcaaacaaatga

SEQ ID NO: 53920 - DNA, 813 bp, Heterodera glycines
  Genomic contig location: Contig_ID=SeqID_480; Location=9035..9847; Strand=+
  SCN-specific regions: Sequence locations=1-205,227-531,554-699,721-813
atgttcgcccgttccatcgcttctccaatgcatcaacggatggcgccgtcggtcacaatgatgcattttggtacgtctcgtccttctccgatgccttttcgtatggcagcgaggcaaatgttcccatctgccgctgctccaccgcaacggatgacggcgcccacttcggttctgcccacaatggcttctccccctccggtgatttgtgctccgttctcttctgctgcgcatcctccaccgcaaccgcgccaattgccggctgtgcaggaggaaaaagacgagcgaacgttgcgcattgagcggatggccgaccaaattttggatcagcgacagctgcgggcggagcgacgggcgcaggggataatgtacgacgaggtcagtcacaaaacaattgaaaaatgcaattatatggggacaacaaattcatcttttaaggagatcatagaaggacgagtagtgcggttcaattatgccggcgagttttgtgaacagcggggcattggcgaaatacatagacaggtgagcggtatctttattaaaaatattttaaattgtcttttcagttgaggcatttcatgatcggctggtgagttattaacgttgttacaacagagaaacactgaaatcaaatggttgcgaaacaattttttaggatcggttaaaattttgcaatcatatttttaaatttggccggaaaataaggaaataaaaaatttattcgcagtaaattttccccattttcagtgcattggtcggtgcagtcacatttgcttttgtgaagattgaccttaagaagaaacggaggaggaaaat

SEQ ID NO: 53921 - DNA, 853 bp, Heterodera glycines
  Genomic contig location: Contig_ID=SeqID_481; Location=126..978; Strand=+
  SCN-specific regions: Sequence locations=1-337,359-478,509-654,676-853
atgttcgcccgttccatcgcttctccaatgcatcaacggatggcgccgtcggtcacaatgatgcattttggtacgtctcgtccttctccgatgcctcttcgtatggcaacttcgtttcttcccacaatggcctttccccctccggtgatttgtgcttcgttctcttctgctgctcatcctccaccgcaaccgcgccaattgccggctgtgcaggaggaaaaagacgagcgaacgttgcgcattgagcggatggccgaccaaattttggatcagcgacagctgcgggcggagcgacgggcgcaggggataatgtacgacgaggtcagtcacaaaacaattgaaaaatgcaattatattgggacaacaaattcatcttttaaggagatcatagaaggacgagtagtgcggttcaattatgccggcgagttttgtgaacagcggggcattggcgaaatacatagacaggtgagcggtattctttattaaaaatattttttatatttaaattgtcttttcagttgaggcatttcatgatcggctggtgagttattaacgttgttacaacagagaaacactgaaatcaaatggttgcgaaacaattttttaggatcggttaaaattttgcaatcatatttttaaatttggccggaaaataaggaaataaaaaatttattcgcagtaaattttccccattttcagtgcattggtcggtgcagtcacatttgcttttgtgaagattgaccttaagaagaaacggaggaggaaaatgtgggaaagacagaatcagttgtacgaagcgcggaaggaagcaatgaaaaagcagaagcagcaacaattgatgatggccacatga

SEQ ID NO: 53922 - DNA, 1405 bp, Heterodera glycines
  Genomic contig location: Contig_ID=SeqID_481; Location=1283..2687; Strand=+
  SCN-specific regions: Sequence locations=1-113,136-151,174-212,261 -336,359-516,538-624,647-660,684-953,977-1405
atgtttcatctcaatgtaatttgctgtaaagagataaataaatgttcacaataaatatttcaatatgtaatattcttttgcagcttccaaaagtccatattcctttttttttctatattttacagctcttttcccttgactttggtgtcccaattaattcaaaacaaggccatttattcatttttgaatgctttccattcatcatatcagccaattcccattgaatttgttttgcttttatgtgagaaaaaagaaagaaatggaaatggcatttcgcaaagggaaaacgaagaagtgacgggagagaaagagagagtcggagagagagtctctcttttcgcttctcttcccttcgctgaaatggcggccattatccatttttagttcttcagtcatttctcattttttcattcattccattcaattcgcaagggcaatgggaggggacattaagggctcaatgagcaaaggaagggaatcattaaccatctaataataataacgtcattttcatttggttttttatctgtgtattttcgcgttttacttaattagataatttttttaattccgagctttttagtttcgagttttaaatgcttttttttgtaatgtctccaacagaaatttttggtttttaaaatctcgacaaacaatagtttaacaaattaattcaaatttttgagtatttacttcgaacacagcgttttcacgtttgtctgccacccccttttcctccttataattataacaaagcaattcatacatagccaactgacatcgataaaaaaatattcatttttagtgttcaatttctttttctgggtttgcttaaaagtcgctgtgcaaacaatgaatgaattacgcaagaaccccacaccaacaaaaaaagaaaaattcaatgattcttcttttttgcttgactcattaaactgtcatgcgttttggccatttctttctttatctctctccattttccctttttgtatattggcggaattgattgaatcatcctttacgatattcttttctgccatttactttttaatcgaagtatttttcagacagttcaaccaaacacctcaaagcttcattctcgagttgtctccctgtttatcgcattcttcgagtccgtaatcgcttccgggatagggcgtttatggacgtgtcatttgacgcgactaccctcaaaaccaatccaaaattacaccggaagagcctttagaacatctattgcccttcacacttccttcggtaagcattgtatgacatcaatttcgactgatttgtgttaatttttcagtttgtcgtccttcgcttggcactgctgaaaagtcactgcaccgaaccgcggccccgaacccgggcctcacaacacttggacgtgaacgcggagcctccttgg

SEQ ID NO: 53923 - DNA, 1060 bp, Heterodera glycines
  Genomic contig location: Contig_ID=SeqID_482; Location=239..1298; Strand=+
  SCN-specific regions: Sequence locations=1-684,706-1060
atgtgtcggctgaccgtgtgtttggcgcctttccctgttggactcggtcggcactgcgccaggcggaaacgtgtggcgtgtacacgctgtgtttcgacagtgagcgcgacttggaccgcatcttggccaaccactcaaacgccaggtagggaagacaatgtttggattactggctaactacatttattgtttttgtggaaaacggatttttttggtttctcgtatgcccttttttaattaattcatcgaagttagttgtcacactcttaattggccccgctattcattttcagattgcttttgcgtatctgcgtggacccctgcgcgactgatgcgaatgcgttgttcggagccccgcttgacgaggcagtcgaactgttgaagctgtgcgttcagttgggcctcaattgcattggaatttccctctcaactggcccttccactgatgataattgcaatttgtcatcatcgtctcttttccatttctcttccgtctatgcgtttgccattgaatgcagtgcgcgtctgtttcgcattgccattgacttgggcctacggatggacgtgctgaacattggcgatgcttttgcttgtccttggtcatcagcatcgactgaaaccgacgagtcactggcgcatttcgcggaggtatgaaccaaaaccgaagggacggaatagtaatcacttctttttcagttttgtaccgaatttaaccggtccttcgatgtccatttcccgtctgatggcattggccgtgggcttcgcattatggcaacccctggccaattctttgcgcgttccccattttcattggtcaccaatgtgatcggaaagcgaagcactgacgcaagtgcagtgaccaacaacggtacagaaacccaaagcattcgcttctttaacccaactcattaaatgcaaatttcagattttgatgctggcaaaaccgcttttcattaccagactaatgagagttattacggcacatttggctgtcgaatgatggtcaacaccgaaccgcgttgtgcaccgctttttgtaagcatataatttattttttcta

SEQ ID NO: 53924 - DNA, 2002 bp, Heterodera glycines
  Genomic contig location: Contig_ID=SeqID_483; Location=944..2945; Strand=-
  SCN-specific regions: Sequence locations=1-42,64-299,322-348,370 -648,685-773,795-1641,1663-2002
  Gene Ontology: Mol. function=t-SNARE activity; Cellular component =plasma membrane; Biological process=synaptic vesicle fusion
atggtcaaagaccgcctcatggaatttcaggtaaatagaaatgactgccttttccattttgttacgatatttatacatgcttttggtattttcagcagttgtccggtatgaatcggaacattgccgctaaatgcaatccgtcatggaacagaccaatgaaggaccggctggggaccctaaaaacggtcggttttttgttttattttcccaattaatgataattgcgttattaaaaacatttcaagaccgaggatgaccatttggtggcgagccaaagtcagttcatggaagactttttcgagcaggttgaagagattcgggccagcatcgacctgatcgccacgagcgtggaggaagtgaaaaagaagcactcggccattctgtccaacccggtcaacgacccaagtgagttttttgaggaaaagtgaagatgtaagactaaaatagagttaagataaaacagactttgtagaattggcaggcgtgtggttacatagctccacgatgacctaacctacctatatttttctttaaacgaaaatttttggatttaccaagaaaaagcgggttcaatttttcctcattgaattttattcatatttcgggatggggcgggggttttccgtcgtttataaatagtcactttcgaattttttaaaagacaatttaaactttttaaagaaatcaaagagcagctggacgaactgatggtcgagatcaaaaaaactgcgaacaaagtacgcgggaaattgaaatgtcagttcatttgttactttttatttgttttgggttttatttcatttataattattcggattggactttttcattcaaaaatttgcactactttcaactgaaattcgaaaaggaattgttagtgccaagacaaggctccaccagcagaatttaaatacttttttctatttccagccatcgaaaataacctcgaccacgacgaaaacggaggacaagcgaacgtcgacctgcgaattcggaaaaaaccgagtgtcaactttcgaattcggatacaaaaagcgagtgccgaccaacgaattcggcaaactcagcacgcaacactggcccgaaagttcgtcgaagtgatgaccgactacaacaaaacgcagacggactacagagagcggtgcaaaggacgcattcaacgccaattggacattggtcagtgggagggcacacgactaacgacggactcacttttgggggcccattgtatctagtggggaattaggaaaccccgactctgaaagtgggtggggaaagaccggactggtacaacttggtgccaagcctgttttctggagaatggctgctttaatattttgtgtcgtctcgtttatacaaagtgaacatctgtgcccctttaagcgggtcttcagatgccggaagaggaagtggaccgtgcgattgagaatggcaaattgttcaacaatgtcggggtctgttggtccacatgaattgggtcctattcattgttgcgcacacagaagataatgctggccgagcgggacaagaagatgctgttcgaggatgtcaagggcagacatgacgacattgtgcggttggagaagaccattggcgagctgcacgaaatattccaggacttggcgatggttgtggacagtcaggtgaaatgccacaggggatttttccattaactccattaattgttgtacgaaacagggtgaaatggtcgatcacatcgagcggaatgtggagacggcgcaggaacacgcggacggcgccctcaaaacggtgaaagctgcggaggtggcaaagaagcgcaacatgaaggtgatggtggcacaactgccaatcgtcaaacattttactgggctctagaacattttctttcaatttttccccttttgaaattgtatgtcatcgattcctattttccgatcagctttactattttgggttttctaagttcgcttcttttttttgacgacgatggtaatataggacagaaaaaaatatgaataaa

SEQ ID NO: 53925 - DNA, 188 bp, Heterodera glycines
  misc_feature (161)..(161): n is a, c, g, or t
  Genomic contig location: Contig_ID=SeqID_483; Location=9..196; Strand=-
  SCN-specific regions: Sequence locations=1-188
atgcactcattgctttgtccacgtgcgtccagctcccaattatcggccctttttaaacgtttttccgtcgggaatggcaccgcttcgaccgattgtgccaccaaaaaagggcctgtcgatgtgctgcgtgcacggcttctctaccagagcagaaagcgtgngatacgcgagaacgacattttgatcgg

SEQ ID NO: 53926 - DNA, 339 bp, Heterodera glycines
  Genomic contig location: Contig_ID=SeqID_4291; Location=607..945; Strand=+
  SCN-specific regions: Sequence locations=1-122,329-339
atggcccttaagaaatgggccgcaaatgtccgaggcgaaaatgtcgggccgcaaaagacggaccgcaattgtcgtttttggctggtggccgcaaatgtcgtgacacgaaatcaacaacagcaaaaaggaaacagcgaagggggaggagaaggaagagaaaatgggggaaaagagagaaaaagggaggagaaaaaggagcagcaactgaagaagaggaaaaagaaaattgcagctgaacaccagcagaaacaacaacatcagcagaagcaagaacattggaaggaggagagacggaagagaaagagaggaaaatggaggagaaaaaggagcagcaactga

SEQ ID NO: 53927 - DNA, 384 bp, Heterodera glycines
  Genomic contig location: Contig_ID=SeqID_4292; Location=4523..4906; Strand=+
  SCN-specific regions: Sequence locations=1-13,35-227,249-384
atgaaccgacggtaattaaattaaaagtcacaaattcgtcgtttatttgactaaactgttttcccatttcagttggatttgcaacgacgtttggatggacattttcccatcctttgaccgtcctcaactcggcctgaaattggcacttctttcgccacgtttcaatgcgttggtggacaaacatttcgatggcaaaagcgaattggcaatttggagaccaatcgaaattcacaagggcaaaggaccagaaccgaaactatctgtgtggatggatgacgaatctaacaatgttgtgccatttccattgcccgaccgtccgttgcccagcaaaatccgttttaaatgccttcggatttagtaattaaaaatcagagagctatgaca

SEQ ID NO: 53928 - DNA, 63 bp, Heterodera glycines
  Genomic contig location: Contig_ID=SeqID_4292; Location=2037..2099; Strand=+
  SCN-specific regions: Sequence locations=55-63
tgccctaccgggaccgggaccgggacctgagcttttcaaaacccgggaccgggaaccgggacc

SEQ ID NO: 53929 - DNA, 1583 bp, Heterodera glycines
  Genomic contig location: Contig_ID=SeqID_4293; Location=79..1661; Strand=+
  SCN-specific regions: Sequence locations=1-155,177-832,854-967,989 -1131,1161-1340,1366-1583
ttggatttgcaacgacgtgtggatggatattttgccctgttttgaccgtccccaactcggcctcaaattggcacttctttcgccacgtttcaatgcgttggtggacaaacatttcgatggcaaaagcgaattgacaatttggagaccaatcgaaattcacaagggcaaaggaccagaaccgaaactatctgtgcggatggatcacaaatttgtggaatttccattgcccgacgaccgtccgttgccctgcaaaatccgctttaagcgccttcagattgagtaattaaaaatcaaagctttatggcaataaaagcattcttttcctttttcagttacattgatcactccgtcatcgcttttcttcgttcaaatcaccaaatttttgagaaaagaggcatcgatttatatttgtggattccttattcacataccacggatggccagcggatttgggatgtttttgttcgtgaattatggccaattttttcgacaaacattcgctgtttgggctttttccgtggtgatcatttggacaatttgcttcgtctcatttcaccgacaattctcaccgatctcaacaaattgaattcaatcaattcctatgatttgttgcccgaggcgattggtgatgattttgatgtgccaaatgcaacaatttctgctggccaagcattgtccaaatggttgcactctccgagaaaagatggccaacccaagcgattgcgttgcgaagattacaacgcacaagcgaacactgattggatcaacaatttcaaggaggtgtggccataatctcgacaaatcactgatttttgttttcaaattgtttagcattttctttgtgccaatgccatttcttccgtcaattacgaaattcgttttactgttcgtgcgccgtcaatacaaatggtgccattcgaattggtgaacgaatggacaatggaaaagctgacattgaccaaagaaaacgaaaatgaatgggacaccatttggataatgaaacgaagcaaaattattggggagacagcggcggtcaattggaaagacggaaattgggacaacaattgtaactgtgtgttcttttggcttgatagtgacactaattgcattgggtgagcaaataaaaaagtcatttaattttgtttaattaattaaaatttcgcttaatttagtccattgtctccgccaccgaaagaagaagacgaagcaggacaaagcagcgaaaaaggggcgtcgtctgctgacaaatgagtgacggacaaaagaacaaaaacagtgatcagccgcagaagtagaaatgaattaattaagaatgatcgatcgaccgatcataattcatccgtgatcaaattattaaaagtaattatttggaacgttttcgccactatttttgccactagttaattattttgggatttttgccactaaaaatccgatccctacttctaacatgcatttttttgagacttttttttacactttttcggatttttatgacttttttgagtttttgcgacttttgttcgtgatttttttgacttattgaggcaaagtttgaattttacagaagaaaatgccgaaaa

SEQ ID NO: 53930 - DNA, 3155 bp, Heterodera glycines
  Genomic contig location: Contig_ID=SeqID_23209; Location=103..3257; Strand=-
  SCN-specific regions: Sequence locations=34-123,204-1038,1076 -1129,1151-2940,2962-3155
caccaccaacactgccatcaccaccaccacaactgtctatccacagaagattggtgtgcctcgtttggcatcatctactcgtatggggaaaggcaacgtgagtggcaaaccactaaaaattgtcaccaccaccaccgccaacaccaatatcagcaggaacacgaccaccaccaccaaaaacaacaacaacaacagcagcaaaatcaccactcctataccaaaaactgcaaaattggttgtggatgagcagttgccagtcgcaacactcctcccaacattgattcatcaaatgtgcaaggatcgtcccggggaagaaaacttttatcagcaagccatctgttgggcactttttgcactctatttaatggtgtttgtcagtctggtacttcatcagctttgttctatctgttggttaaagaagaaaaaggagtatggacagcgcgcagatttcgactattttaaggcaaagtcgggaaaccgcacgagttttccggggctgtttcccaagtgaccagctcccagcgccggacacgctacggtacccagcggcgctagtcgtgaacaacgacccacattacaaacaaggatcccattggtgcgcgatttatgccccttcaaagacggaggaagcggtcatttactttgatagtctcgcaaaaacaattcctcctattgtaaagacatcatttatggataaatttccaaaaggttttgttacaaataagcacccgtaccagtccccgctgactaccacatgtgcaattcactgtatcgtgttcatctatcacatgtccttatgtcacccatttgacgcatttctgcgtatgttagacgctagtgaaagccccgacatgtattctttgtgcattttgaataaaatgattaatccgtatttgtgtgtgcgtgccaattttaccaccctttgggaaagggcatagggaatgattgattaatttattataccacggcgcacgttgcgcgctgttggtgctgcgcatatatacagcgagctcacgcggaaaaggctcacttttttcgtaaaaaataaattaaaatattaataaataataataatgtcgttggaagatcacaattattgcggcgagttgggcggcaacgaagcgcccacaaagagaagaaaaagaaatgatgatgtggagggagagccgaaatttcaaaaaaactgcattcgcactctgagcgccgacaaacagtacagccaaaagttcaaagtgcagagtgtaaagtcgacttttatcattgaaaatctgcccgccaaccccgagtcaatgctgcgcgcattgttcgctcactgcatgtcaaccgccctggacgagtcacagcagaacgggatcacaccggatcaattgggcgctacaatctcttcagatctgctaaatccgagcatatggattcccatacgccgcatttccgcgccgactcaattatgaaccgcttccttgaggtggcacagtcaaaatcgcgggagggctctctgtggggctcgccgttcactgtgaccatcacaacgcttgatgttgcgcagctacctcagcggcaacaggtgcgtggcagtgggaaaaggacaacgaattcagtgcaacatatcatcaaagagagtgcacttctgcgaatcaacaacagtgatgattcctattgtcttttttacgctttggaggcaagcagaaaataccacagcaaagagatgagccgacaaaccttcagatattaatcggcagaatgggcgacgactggaagacgtgtttggactgatgagcagcgcaaacattcgcaccgatttgagagagtatgacgcggttgtatatgtgccgattgtcgtggactattggaatcggaaatacgccacatcaaaccagcgatttaaggtgttcatttttggcactacaggcacctatcggccaaaatttcaatatgggccggacaattacaacatcgaaatcccactctaccatcacaacggccattttgacggaattcgatgtggggtgggcaaagcggtgtttggacgtgactactactgcttttcgtgcgaatgcccctatgataatgctaatgatcacacgctacaatgtaaagcaaagtgcataaagtggtcgcataggagtggggcgaccgtgccgagcggatgacaacaacgacaattattacagagaatgcacagcatgcggcaaggatttcataagccaagactgcttcagtcatcatttgtcgagcaatgtgtgccgacaattcaaaaaatgcaaacagtgcggagttgtgtggaatgtcaaacaaaaccgacgaaaaggacgcagcggacacgtttgcggtgagaaattctgctacacctgcaaatgttaccataagccggagcggggctgcttcatacagcagttgaaggcgcgccgccccaaaaagtacagactgatcgcctttgactgcgaaacaacacagaacacacgaattgagggcgaccgcagacttcattccgtcaacttcatctcatgctatgtcgtctgcaccaagtgcataaacgaaattttatggcgaaattccctacaagcgccatgtggcatttgcggtcggcagcgcaccgtcacattctcccaccgcgtctatgaacgcacacaaaccgatgcccaattcatcactccgtgtccaatggcggcctttgctcaatggctgctcagcgaattcgatccgcgctatcccacaatgctcttcgcccatttcgggggtcgctttgacaacattatgctgtttcggcagttcttcctcaacgggttttgtccacagatgatccgccgtggtaacaaattatacgaaatgaaaattgcgaggggcgaaaaaaacccggaaatcatcgtaagagacagctggaaccttatgccggtgccactcggcgctctgcccggagcgtttggactcaatgtgcaggataaggagttcttccctcatttggcgaatgttgagacgaattatgggctcattctgcagtcgctaccgccaaaagctgactacttatacggtggaatgacgcccgaccgacagcgcagattcgaccagtggtacgcggaacaccgccatcaacagttcgacctatgtgaacagctcgcagcctactgcaccaatgacacgcgcatactaattgaggc

SEQ ID NO: 53931 - DNA, 1057 bp, Heterodera glycines
  Genomic contig location: Contig_ID=SeqID_23210; Location=648..1704; Strand=-
  SCN-specific regions: Sequence locations=1-292,314-369,392-455,477 -594,639-853,897-1057
atgccacttgacgagtcggaagcagccagcggtgcaaattcggtgccgatcgctgttcgcgttccgtcggaaactgttcctgacaccaattctttgccaactgctgtaactgttccgactgataatgtggctgcaaccggtgctaattcggtgccgcttggaacccgcgttcaagacgacggaaccccgaatggagaagcaaaggacccagccatccagaacaattctgctccattgccttctgaagacgccaacgatgagtggtgatttgagtagggtttattcggctccggactttcattgttttgttgttcagccttatttattgacgatctctaactcatttttatttatcgtcgggactgggttttcaaatttattctggtttttcactttctttttctgttaccaaaacccattgttttgatatcaattccattaactacttttgaaaacaacttacttttcttttattgttagatttttcgttattttctgagagatttttcgttgagtttcttttatatttttctgaatttgtgtttcgttttgttataacttatatccgaccacattttttgttcgtgtctttgatcgaattttgaagataggacttgagagcaaaaatatttattgtcagtcgtcttgctatgtttttatttggttgctcttcgatctccattatttcttttggttggtcctctctttcacactgagtacattttcatctgctccaccaattcctccttctcattgatgccaaacttctccttctgagactccatcattttgaagatggcttccaattggtcctgccgcgcttttcgttccttcgaaaatcattttaaaatagttttaatttttcaaaaccttttctctgtcctcctcactcatttgctcttccaacagctgggtttttgcacgaagctgtgcagttgctaactgaaggaaatcagaaatggtgatgatgtttaaactaaaaaacgatttgtaccgttttcgactaaaactttcataattttaaattctggaaagccgaaatttatagcctaataaa

SEQ ID NO: 53932 - DNA, 75 bp, Heterodera glycines
  Genomic contig location: Contig_ID=SeqID_23212; Location=188..262; Strand=-
  SCN-specific regions: Sequence locations=1-75
tccaagtggggaattgaacccaggcgaaaaattatgaaaggtagaaagtttaaccactacaccacatgcgcatgt

SEQ ID NO: 53933 - DNA, 684 bp, Heterodera glycines
  Genomic contig location: Contig_ID=SeqID_23213; Location=1104..1787; Strand=+
  SCN-specific regions: Sequence locations=1-468,491-547,574-684
atgcggccaaggggcccggcttttacggatgcccggagagctgtgcgcaaagcaaatttggctgctgtccggacggcaaaacgattgcccgagggccgaacaaagagggtgagtcattgtaattagatgatggtataattatgccattaattagcagagggtgagtgattgagatattcattatccgtgtgctatattcgtatcctgttcttggcacattgaccgaattgtttaacattgatcagtgatcagaagtagaaagaaaatttagatactgagatcagactcattaggaaggttaggagctggaaataacacacagatcaatgagctgctgcgaaataccaaattattgcactgatcagaactgttaagctgatcaaacccgttatgatcaagaccaggcaatatttattactttggaatttcattaatcaaacagtctcagttgattacagttaatgcctcaaccatttgtcaaattttattttgatcaatagatctgtgtccgttcattttattctatgatcataatgatacaaaattgaaaatttaaaaaattattatttttttcattttcccaggctgtccatgtcagtacacgcgttggggctgctgcccggacggcgagacaaccgcgttgggcccgctcaacgaaggctgtgacgattgtcgttatgccaa

SEQ ID NO: 53934 - DNA, 1141 bp, Heterodera glycines
  Genomic contig location: Contig_ID=SeqID_23215; Location=106..1246; Strand=-
  SCN-specific regions: Sequence locations=1-469,491-563,585-749,776 -852,874-1107,1133-1141
atgtggtgtagaggttagtgcatcacattgacattagagatcggaccggtcggtttttttcggtatttttcggtttcggtttttaaccgaaaagaaccgaccgagaaatttttgagtttttcggtttttttcggtttttatacggaaaccgaccgaccgaaataatcaaaaaaccgaaaaaaccgaccgacttttttcaaaaaccgaaaaaaaccgactggcgatttgaagcgacataacccgttaataacaatttttggcataatatactgtttgaaattcgatggtttttgattaagttttcggacttttgaaaagtttatcactaattttcatttctttttttaatttattgatctaaaacattacagcaatagtcaacatgccctctggaagtgtgatttggcaaatcgggctttataaaaaaagcaacaacaatgatttcgagtacgaatgtgccgagtgttgtaagaatattatatgtaagaaaggcaacacatccaatgcgataaaccaccttaaatcaaaacacaaaaacagcgaatatgaggcgaaatatgaagaattttttgtatttttcagacgccaaatttgttcacacctcgaatcattaagggaggaacaattcagtgaggaggtcctaccgttgccaaattctcctatttctaaaaagccgaagggattgcttgatttttgatcatacgctgtcagcatcgtcagtagtcgagacaaactcacgttaaaaacaatttgttttttcattaaaatttttgaattatagaagagaaaaatgcaacgagcgaaatcaatgcttattgttctgccgtcaccattccgtctaattctgatccattagaattttggaaagagagagccaatgaatttccgggtattttaatttgcccaatttattaccccgttctaaggaattttacatttagttttggcagaagaagcaaaaaaatttctttgcattccggcgacaagcgtggcaagtgagcggttattttcgacagcgcgcgacacatacgactaccgtcgacgccgcttgcgtccaagaaagtccgaaatgctgatttttttgaatcgaaatcttccaaaaattcaatataaatattaaaaacattttactgttaataaa

SEQ ID NO: 53935 - DNA, 908 bp, Heterodera glycines
  Genomic contig location: Contig_ID=SeqID_23216; Location=611..1518; Strand=+
  SCN-specific regions: Sequence locations=1-267,317-337,378-856,878-908
  Gene Ontology: Mol. function=acetylcholine receptor activity; Cellular component=nicotinic acetylcholine-gated receptor-channel complex; Biological process=synaptic transmission
cacggcaaattggccaaccgtgccaatgccaaaagtgccgatgccgaactgctgaacgaaaagctggccaagctgtacagttcgcctcaggcaatcaaatcgttcgaaaatttgtgcttcattgccgctctgttgcgcaaaaaggacatggacactaaggtggcttattgcttcagtatttatttatcaggatggaagtcggctcctggttcagttttccgattggaaaacttcggattccaattatggattcgcgaaattttaagcaaaaaattagaaataatgattaaaaaattagaaataatgatttaattatcaattgcgaaaagtatttcaacgactttttagcattcataataaaatagaaaatactaaaatcaaaggttatatttgtctttttttggagggatcagatgttcaaatcattcaattgaaacgttgcggcaaatctactgagaaaaaacttgagtttattgaatgaaatgcaattttaggccttttggacgtgttttaaatacaaaatgccctccttattttggaattgaaaaactgtttttatggtattaaatattttgaaaaattatgccctaatttttaaaaaccttgcaatttctgagcaacggatttttatctgatcagagagagccatgattgacatcagagcaattttgtttgggcaaaccccgaatttcttgatcaatcaatcaatgctggttgattatagaatttccattttagcaagaccaagaatggaaatttgttgccatggtgttcgatcggctgtttctgatcattttcacgttcgcttgcttgttcggcacgtgttggattctcttccaggcgcccaccttctacgacacgcgacagccaaaacagccgatgatgagcttatgataatgatcattttt

SEQ ID NO: 53936 - DNA, 1806 bp, Heterodera glycines
  Genomic contig location: Contig_ID=SeqID_4294; Location=1044..2849; Strand=-
  SCN-specific regions: Sequence locations=1-5,27-1706,1728-1806
atggctcaacaacagcaagacaacaaaatcaaatcggccaaaggaccaggagcatattcaccggaaatgtcatgggattcttgggcggaaagattcgattttttcatcaagctcagggggatcaccgacccggagatgaaaaagctattgcttttcaccgaaattggcccaatttatgatgagttaagaatgatggcacagcctgacgacatccgtgatatggattttgcggaaattacggcattgatgtgcgagcgttacggcgaagcaaagtcaattgtggcaaggaggcacgagctgttcaccgccaggcaacattccggccaatcgattcgcgacttttccattcaattgcgttcacttattgccaaaacggagtggggcaaggacagcatcgacatgtgcttaagcgcattatttgtcaatggaattgtcgacgactcaattcgtgccgaactgatcaaaaaaggggacaaagatctcaaattcaaagatgccgtcgaattggcagttgtgctggagcaatcaaatgtggacgctcaagcgattggatcggactcattgaaaggcaatgtggccaaaatttcaggaagaggaggaggatatgatcgcgccaaaggaaccaacaatagcaaaagtgccgacagtaagccatgctaccgttgtggaagaagcggacattgggctaatatctgtcccggcaaagccgacaaatgcaccaaatgcggaagagtcggacattgggcgattgtatgcaggacaaatggtggcaacaaaaacccggccagagtggaaagtcggctatggaaaagcagcaaacacgtgaagcaaattcagctgcagtgcaatgagaagccaccagtaatttcgagtttggagcgaaagtcggctaaaactgagactgttccgccgagcttcatccaactcaaagtgcataaaggaaatgccgaattcgaattggacagtggtgcagatgtaacaatcatcggtagccaagattggaaccatattggaaagcccgaattgaaggaaagtcaaggactactggcttatgggggcattccgatcaaaggcgtcttcggcatggcaaatgtaaatgtggaatacaatggcatgcaaatcaacacggatatttatgtggtaaaaggaaataagagaaatttgtgcggtcgtgatgtgattcgcagactgcgcattgatttgaacaaagcattcggcattaacgcaatccaaatcggatccacgaataatgatcaaaaagaggtggacaaaattctcgaaaaatttcaagaagtatttcgagacgaattgggccgatgcacccgtcaaatttcattgaaattcaagcctggagtgcaaccaaaaaggtgtaaggctcgtcctgtaccatttgagctcaaagccgaagtggagaagattttggataagtgggtacagcagggagtgctggagccgacgaacaacagtgattgggccacacctttggtcattgtaccaaaaccgaacggaaaaattcggctctgctgtgattacaaagtgaccgtcaaccaatggttggacgtgcaccaatatccactaccaagaccggacgacctattcagtgtgctaaatggcggtcaaaaattttcaaaagtggatttgaacgacgcatatctgcagctgatgttggatgatgaagcaaaaaagtgtttggcagtatgcacgcacaaaggattgttccaatttacgagactcccttttggcgtagcgtcagcaccggcgattttccagcaggtcatggacgaaattttgcaaggaattgaatga

SEQ ID NO: 53937 - DNA, 1465 bp, Heterodera glycines
  Genomic contig location: Contig_ID=SeqID_4296; Location=592..2056; Strand=-
  SCN-specific regions: Sequence locations=1-24,46-140,162-386,417 -429,452-545,567-1094,1136-1226,1248-1465
atgaaaggactctccacccatcggcaacaaacagaacaatctcagacatgggacggcccgactcgcccatctccgcccttccacctcaaacaacttccagcaaggcatcatttatttggcagtgccccccctccttcattctctccccccgccccttcagtcgaccgtctctccgagcagtgctgcgctggttgggactcgggactgagttcggctgctgcgactgatagtcaaagcggcagagggcagcagcagcacaacgcggccacttgtcagtcgacggatgccgcaagaacatcgctggaggaacgatgttgcgtttgcagaaacgagcagcggtcgtgcccaacaacggcttcaacttcccccgaatggtcgacactgacggaaaaggaggacaaggaggactgggtccgcattttggacgcattggaaacagtgggagaggaggagatgctgcgcaagttggaggagtgcattctgtcggggcaagcgtccaattacacgacgaacagaggcgcgaagaaatggtcggaaacattggcacaatgccaaaattccatttttgttcctctcagcagtaacgactttgccaactttactcaaaatggctttctttcgtgtcgttttccttccaattttccaatcaaagggatgaacagcctgaaaacgcctttggcctccacaaattaccgcgccggtgaaagtgtcagaaacattgcaagcgtaactctgccaaggcctcaaacgcccgtttcccgggaaaagcaaaagtattgccaaatactcgttttacctttccatatttacgaagatttagaggcgaacaaatgtgtcacaacggcaacacttttgtggttgagttgcccccgccgatgccttccccccgggccgcctccaatgcgttggcgcttctgacacagctgaactccaacagcaaagtcggcgaagtgtcctcaaccgtcccaccaatcattccttctcacaatgcgtccactttcgctccgtctgcggatgaagaagagcatcagcgagttcgctgctcttcagtagttccgttcatcacttcaccaacagaggatgatggaaattgtgagcaggaggaagagaatgaggcgaacgaagaggaggaggaccaattcgacagcgaagtgttcaccattcaattgtgccgttgcccgtacacgaaaagcttcggtttttcggtttgcgatggcacagccgacgaaacggcaaggggagagagggaacagcagagacagggcggcatttacgtgaaatcagtggtaaaagacggaccggccgataaaagtggacgattgcagccaggggaccgaattctgaacgtagggcaagcggaagcagcctctggccagcaattttggcattttattttcagataaacaggagaagcatccaatttctcacgtgcgatttggcacttccgttgttggccaccgatcgc

SEQ ID NO: 53938 - DNA, 117 bp, Heterodera glycines
  Genomic contig location: Contig_ID=SeqID_4296; Location=162..278; Strand=+
  SCN-specific regions: Sequence locations=1-117
aaattagtcaaaatacatgtcagattcgtgattagcgacctttaaaaccccggataaaaaattatcatggttttttatcttaaaaaaattttgcaaaacaaaagggtcccccctttt

SEQ ID NO: 53939 - DNA, 312 bp, Heterodera glycines
  Genomic contig location: Contig_ID=SeqID_23220; Location=57..368; Strand=+
  SCN-specific regions: Sequence locations=1-312
atggtgattagaagaggtacaactgtgattagaagaggtacaaaagtgattagaagaggtacaacagtgattaaaaaaggtacaacagtgattaaaagaggtacaaaagtgattagaagaggtacaaaagtgattagaagaggtacaacagtgattagaagaggtacaaaagtgattagaagaggtacaacagtgattaaaaaaggtacaacagtgattaaaagaggtacaaaagtgattagaaggggtacaacagtgattagaagaggtacaacggtgattagaagaggtacaattatggtttaaaatgaa

SEQ ID NO: 53940 - DNA, 1313 bp, Heterodera glycines
  Genomic contig location: Contig_ID=SeqID_23222; Location=268..1580; Strand=+
  SCN-specific regions: Sequence locations=1-2,24-304,326-632,654 -801,834-839,861-867,890-1248,1270-1313
atggccaaggtggaggaggacaggacggatttggccgcattttatgaaaaagtgagaaacgactgactgggaaagcaatggaaaggaaagaaatgttcgttccattagcatcatttgcgatttttccgctaccggacgatgggatttttactgagaaagccaatcgtccaatttttcaaaaaggcttatcgtctcagtttttatgagtagaccaatctcaaattgtatgaataggtcaaccctcccattttgtctgagtagactaattgtccaatttttctgagtaagccaatcgtccaatttcataaattatataatattatatcaaatttggcctgagtggcccaattgtcctcctattttgtctgttaggccaattgtccaattttttcagggtgggacaatccagcaattttatgagtaggccagtcgtccaatttcatctatgtatcaaattttgcctgaatggcccaattgtcctattttgtctgtgtaggccaatcgtccaatagtttgagtatgccaaatggtccaattttggggattcttcctggcttgatcatttcgatgaatattatgtattttttctttgactaatccttcaaactttgctttggtcaatccgaaaccatatcccatactgctgatcatttccattttactgcttctgatcagtgtttattttctcgttagcgattacctttttttgttgttcagtgtgaccccttttcctctgatcgttggcgattacagtatttttccaaatccaattcaagagatgtcccgtgaaagtctggttagtttatttgattaaattaaaaaatatataaaaagttccccagaatgttaatctattttgcacttggcaaaaatatttttcttttatttgtgccgctgaaatttgcctaaacccaactcattaaaagccccagagattagataagagcatagaactcctttttttgtagtggccattctttgcgataattttcccatcacaaaaatgtttttagtccccaaaaaattgcccgttgaattggtctttgatctgagccgtttcattaaatttgatcgaaaatggtcgagaaaatgccgagtttgctttttatttgaccaatatttgttggcacaaaaccgatattggctgaagctgatcaaaaaattggtcttttcctcaatacaaatgattttcatgatcaattttcagattactgagtgcattcgttccattgagagcttgcgggaatacattttggtggacatgaaagacgtgccggacctccgaaaaatggcggcacgcgccagttacagaa

SEQ ID NO: 53941 - DNA, 718 bp, Heterodera glycines
  Genomic contig location: Contig_ID=SeqID_23228; Location=377..1094; Strand=+
  SCN-specific regions: Sequence locations=1-504,546-645,667-718
atgcgctgctgttgtgctcattctgttgttccgggaacctataatctctttgtatatgccagcgtggcaatcgaggacaataaggaaatcgtaatatttttccatcgcgatgtattccttcgatctaatcccagcaatatatatattagtaatctttaccgggttcgaatgagcataagacaaatagttttgttactgaacaaaagagagtggttaatttctcctgtaactatagtagtcaattcgtttctaaattacgccgacgggtaggtattttttgctattattgcctatttttaaacttaagtgaattgcttaacaaatggaaatatttgccatgtcgtgccccgatattgaaagaaatatgttgcgataaaattgccagaagtaagttttctatgggacaatatcggtcacttcctcttagttttaaacaaattttttcaaaaattgaataaatatttatttctgaattttttgtattgctttttaaaagtttatatttctttctatatatttacataaagcattaaaataatttacttagtactttttggttttgcgtttggccaagaaaatagcaattgttgttgtctttctaatgaagagaaacagcagttctggcgttttattgagcttaatgactaaaatggaagcaatttcttacaattgtcattaagaaagtacatccaaaagtttttagcattgagaggaaata

SEQ ID NO: 53942 - DNA, 128 bp, Heterodera glycines
  Genomic contig location: Contig_ID=SeqID_4298; Location=1..128; Strand=-
  SCN-specific regions: Sequence locations=1-128
aattgttttgaagaaaggagctcaaaaaacgcatttctgcattaaaaattttcgattctgatgtcattatcggtcactagaaatcactattttggcgacttcgtcactaaaatagttaaaaatcacta

SEQ ID NO: 53943 - DNA, 1080 bp, Heterodera glycines
  Genomic contig location: Contig_ID=SeqID_23230; Location=55..1134; Strand=+
  SCN-specific regions: Sequence locations=1-400,423-1080
  Gene Ontology: Mol. function=pyruvate dehydrogenase (lipoamide) kinase activity; Cellular component=mitochondrion; Biological process=glucose metabolism
atggcgacatttatgcaggagttcgacctgctgcccgccaaactgttgcagacgcccagcgcacgccatgtgggctcgtggtacaaacaaagtgagtgaatcattaccatttggcatggtacagtaatccctaatccagcgggtaaacctgttggtcaatctaatccacaatccgtgccaaatgtccgttggggcctgatcagaaattgtttgggcttagtaaccctaaacagcttttggtcgaaggaatatgatttacatgaacttcatattatcgaaaatgcctggtccgacgataattgtctgggctaataatagataatcagtgctgattaaggaagattgacaataattatgttcggataagctaagcaaaatcgttttaaaatcgacttctgatcacttcatttttaaatatattattgacattgcaccgttcgttttcaaattgatcagcattttttattatccaaaaaactaattctgatcaaatccaccgaggatccatttcaaacagtaccaagaaaagagttgtttggatcatgatcttgtgattgtttggatcctgatctgctgatcagttctcccagccttgatcaaattgattaaattaacttcacccacatttcattcaggcttctctgaactgctccatttcgagggcctcgagcccagcgacatggtgttggacaagttcaacaaccaattgcgcacaattttgcatcgtcacaacaccgtcgtggagacaatggctgaggcattgctcgaactgaaggaaagccacggcgtggacattgcatgcgaacgcaacattcaggtggagtggatgaattgaattccagatatttgttgacacatggtatcgagtcttggcaagaggaaagtgttcgagagtctcgactcggcagaaatctcagccttcttgggtctcggctgaaatctcggcgttttttgggtctcgagtctcgggtcatgaataacatgaacttgtagctgttttttcgtcaaagccgcccctaaatacttttttttcattgaattacggtcccgaccctccgggccaatttttcgtcggcagaa

SEQ ID NO: 53944 - DNA, 248 bp, Heterodera glycines
  Genomic contig location: Contig_ID=SeqID_23230; Location=1210..1457; Strand=-
  SCN-specific regions: Sequence locations=1-97,155-248
atggccggccgggtccaccacgactgtcttgcgcgactgattgttagtgccattggtgtcgcaggcggcggcgaaaattgccacttacaaagggaggaaattaaatgtttttttaaaacaattaaaatttaataatttggtaataatattattacagtgttggttttgcaacattcgtatggaaatccgattcaagtagaaacgatccaagaagtactgaacaaatgcacaaatcacaaatgaataaa

SEQ ID NO: 53945 - DNA, 949 bp, Heterodera glycines; identical to SEQ ID NO: 23231
  Genomic contig location: Contig_ID=SeqID_23231; Location=1..949; Strand=+
  SCN-specific regions: Sequence locations=1-83,105-158,193-313,372-949
  Gene Ontology: Mol. function=pyruvate dehydrogenase (lipoamide) kinase activity; Cellular component=mitochondrion; Biological process=glucose metabolism

SEQ ID NO: 53946 - DNA, 791 bp, Heterodera glycines
  Genomic contig location: Contig_ID=SeqID_23232; Location=144..934; Strand=+
  SCN-specific regions: Sequence locations=1-135,158-356,382-420,454 -583,606-700,755-791
atgccgatggcactggactaccgcagcagagttgctgttgtggaggcggaggcggtgggtgatgttgttgcggtggtagcggaggtggacttggcggattaagtttaggcggcggtggaggcggctgctgctgttgcggaggagggggcggaggcggaagatgaagtgaccaaaaaatagcggaaaaattgggaattaatcgaccaaaaatttacaaatggaaaaaagaaattggaatttattattataaaaagaaaaaacaggaatttattgaccaaattgatgaaattaaaagaatgccaaaaaatggaagacagaagcaatttgcgaaagagttgggcattagcaaagaaacattaagaaaatggaaaaaggaatttggcattgaaatgagcaaaagtaaatttgaaattaatttccaatataattattaatattaaattttattatattcttaggtccaattcgattcaccgaagaacaaaaaatgagcaaaatgaatgattattatgaaatgaaaaaagcaaatccttctttaagtgacaaagaaattgctgacattttgaaaattggaactgccaccctaaagagatggaaaaaggaaaataattcgtaatttttcgtttttcttatttgtattggtttcaaaggtgctaggtcactttaaaaaaaagttcaaaaatcaaaagtctgatttttcttataattttttatcaattttttaaattataaacatgttataatttaattaaatgattcttaaatacgtttaaagttttgttgaatttcga

SEQ ID NO: 53947 - DNA, 640 bp, Heterodera glycines
  Genomic contig location: Contig_ID=SeqID_23232; Location=953..1592; Strand=-
  SCN-specific regions: Sequence locations=1-283,322-402,424-456,478 -483,535-576,615-640
atgccgaatccatttttatttgtgcttttcacgtgcccactttccgtcatctgggcaacgcgaaaatcagctactcgtaacacactcgaaaaggtaaaggtcgcttccatacgtgatcgccagacgcctatgattcgacttggagacaaaaaatgattaggtagagcatcaacatactcaaaatgcagaaatacaaaattattagtaagaaacagggacggagcgaggacagaaagctcacgcggtcgcgcagcgcggattcaaattgctgcgtcgcgctccacccctggtaagaaatttaaaagagaaattccgagattatgaagaatgaatggctggcgaccacctataaataaacatacaggattataaaattagcaaaaacgaagcacaaatacaaaatattttatgatatgtaaatgaccacccatatatcgattgacaatgagcaaataattttactttgaatttaaatatcgaatgaattttaatttatgaaaaattaaatgttttttcataaaaaatgattattatcactgacgaaatcccttacggacgaaatcacatgttaccgtctatacttagcttttttaaaatttattggcaccctttaagctccaaaatttaaaattttaggtaa

SEQ ID NO: 53948 - DNA, 660 bp, Heterodera glycines
  Genomic contig location: Contig_ID=SeqID_23234; Location=262..921; Strand=-
  SCN-specific regions: Sequence locations=1-123,145-152,174-457,479 -573,596-609,634-660
atgtccaatttgaaattgctttttgctggaggagcagcgggaatgtgttcatggctgagcaattatccaactgatgtggtcaaaacccggttccaatcggacgatgcgtatgaaaattgtgagaaaaattggggaggatggaatgcgaaaagaaaaattttcaaaccaaatttcctgggcgcgtaaatttttttgagaaaaacttgaacaaatagtttttcagaccgagaagttgtcaaaaaagcttactcggaacacggctggcgaacattctttgctggacttggctcaactttgattaggtgctaatttgattttattcgttggatcttaagcttcctaattacctttttgtttaagggctgtcccgacaaacgctgccattttcttcgcagtcgagtggacttatcggatattagcaagaaaaggtatgcagaccgaagcattgacaaaagaacggagtcaacagcagtcaaaagtggcgaaactaaggacatcagccgggggttttctttttccaatggaagcgggttgcactctccaagagccgatgatcagctaacatttttcatccatattttgttgtatttattcatataaaggaatttgattatataaaatttttatttttttccaactcaaaccatttgctcaaataaa

SEQ ID NO: 53949 - DNA, 163 bp, Heterodera glycines
  Genomic contig location: Contig_ID=SeqID_23237; Location=625..787; Strand=+
  SCN-specific regions: Sequence locations=1-13,35-163
ttgtcacacaaaaatgccgacgacgacgagcagcagcagaaggtcacgctgggcgttgaacgctttgcactgcccgaactgctgattcggcctggcgatgttgaagtgcagcaaatgggcatcccagaagcattgtgtgctgtcattgaacggctgccaaagg

SEQ ID NO: 53950 - DNA, 491 bp, Heterodera glycines
  Genomic contig location: Contig_ID=SeqID_23239; Location=444..934; Strand=+
  SCN-specific regions: Sequence locations=1-411,434-491
tcaatttgttccaaaaatgggggcgctttaaggctgccaatgcggcgatcgccagcacttgggacgcttctcgtgcgaatgccttcgccgaaatgcatttctccacaattcgaagtgccacttttcctacctccggattgctttctttggaaatgttcgacgattatgacaaaatgctaagggcaatgagcgaggcaatcaaatggcttatccttcaccttccaaaaggtcgtttcgtttataatcaaaaatctttatatatatgtataagttttcagatgaatttatgtcgagaaataaaagatttaatctttttgctattgctgaagattctggagaaattctaaccgttttgaaacagttgtcgcaatttgaatataaattccgaaaagtttttcaccctttttcactaaatgtcattttttaaagaaaaaattaaggcaataaccccattgaggaacaatcgtcaagattgtattaacgcacttcat

SEQ ID NO: 53951 - DNA, 1201 bp, Heterodera glycines
  Genomic contig location: Contig_ID=SeqID_23240; Location=86..1286; Strand=+
  SCN-specific regions: Sequence locations=1-269,293-394,416-531,554 -1173,1195-1201
gccgtccctcgggccgttttccatgaaatggccaaattaaacgactgtttcccaactgacacttcatccgtttccattgaaaaggcgcgaattcgtgaattttcggacttcaaaagacgaagcattttggctgatctcacctttaaaatatcgaaacttgcgctcggaatttcgaacacctgcattaaacagctcggtgacgtggaaattcagccgcgtgctctgttagccgatggactccgtcgtgaacttgatgtaacattctttcgatttgttatacctttttaattttaatttcaagattcggttaattcaaatttttgcctcggatgtccaaccaaatattctccgaactcttcaaaatcagtcgctgaaattgcaacaattccgaaaatcttttctgttcatctgtgaccatgtcggcattcgcgacggaatccgtatttggacggaacaactcaaaagcattttggaggagtcattaaatgataaaatattcaaaactgccgaggtttgctgctcccacaacagttatttttccccaagttgtttttcgtttagcgaacaacaatgaccacttccgtcgtttctttcataccgcagtcaaaattggtggtggaaaaactgctcgattttgcgctctccgccacagcgccacagttttgtcaatgtatgcctttttttatatgaattccacgttcagatcgaccaaatacaaccgaatggagtccatttggcgttccgctgatgggaaaacaatcaaattttacggcaacgttttcgcttctcttgatgtaattaatgccattaaattattgaaataaccaaaacattgtttcttcattctaagaattggttgctgtacggtttgaactcgatggtcgcaactctgttggccaaggatgtgtttgaattgcaacgaattgtcgcacgacttccctttgagcagcaccgttcgttgtccgcctcgccaacggcacttattgcccagctgacaacgaatgcggcagagtttacacagtccggtccgaatcgcgaactgttgttcgccctcgccaaattgggtcagcaattgctgttgttacgcaatctgcaaatgttcgtcaaagcggagaaacacagccaattgggcacactgcaaacagcggaacggacactccgaaggtcatccacgcatttggagtcaagggatcagggctaa

SEQ ID NO: 53952 - DNA, 1166 bp, Heterodera glycines
  misc_feature (15)..(15): n is a, c, g, or t
  Genomic contig location: Contig_ID=SeqID_23241; Location=353..1518; Strand=-
  SCN-specific regions: Sequence locations=1-386,409-476,498-551,574 -605,627-787,809-814,838-1067,1091-1166
atgacacttccaacncgattccatgcaaaccaaatgacgccccgtcatacggatgatgatgaccatggcaacgaagcgttgaacattttcaacgacgcttttggtcttccgttggcaccgccggatggtcccaacgaagcagctctgccagctgatcaacaagcggcacctgcacaacagacggacgaagcaaatgccgaacgaggccatgtccgtgtcgatcgcccgcaacgcaatcgacgtcctcctcaacgctacactccgagctgagatggactgatcactgatcaacggaccgatggatgaggacagactctttttaaggggggagatgttgggaagggtactgatttgtcccgcctaaattatttaattcctttctatctcttcccctcccactctctctctgctgttccctccataaatacccccgtccctttgaccatccgttcattccctcatttatttgttgtatgtgcccatctccctcaatcgatactcctgcccccatttctcttctttatttaattgtgtcttcaccaaaattggaataaataaatatttattctttggtcaagtgcaaaggcacaacagttcgcaaacacaaaaaagaaagtgtttttcctactaattaggctatggagaatccaggaaaaaaatgtatttacataaaattagcagccctagaaataaccaattatcaattatgtagcttttctcatttttttttctcgccaaattattggcattttcattttcaccaccggtactcaaacatacgctaatgttttaatataaaaatataaaactgcccttttttctcctctttctcacaaaaagattatgcacatataattttttggtaatttcaaatttttaatgagaaattgctgttttcaatttaccttctctaaaataagcaaattttttgctctctcattttttctaattgttctctctgttttaagttaacaacaaattttttgccttttgtgacacacaaattaattaattggaaaaagggaaaagcgtgctaattgaaccaccaaaatgaatcgacggtaatgaattttaaaaattataaaattttcattttccatgttatttttttcatgtttcagttggatttgtggcgacgtgtggatggacattctgccatcttttga

SEQ ID NO: 53953 - DNA, 50 bp, Heterodera glycines
  Genomic contig location: Contig_ID=SeqID_4300; Location=1184..1233; Strand=+
  SCN-specific regions: Sequence locations=1-50
atgcaacggccgttcggaaatttggcggttttccaaccgctgattgactg

SEQ ID NO: 53954 - DNA, 248 bp, Heterodera glycines
  Genomic contig location: Contig_ID=SeqID_4301; Location=1..248; Strand=-
  SCN-specific regions: Sequence locations=1-101,125-248
ggcacccccacaaagtgtccaagccacgaaatgtccaaaagagtaaaaacccacgaaatgtccaaaatttttcaaaatttataaaaacaaaatgagtctaatttaggatttttagggttttcggggtcgctgaatacgaatataccctttatattaccccttgcctaaccttaggcccatctgaataataaaaaactcaaattcgagacttggacatttcgtgggctggacattttgtgggtcagcga

SEQ ID NO: 53955 - DNA, 2541 bp, Heterodera glycines
  Genomic contig location: Contig_ID=SeqID_4301; Location=4264..6804; Strand=+
  SCN-specific regions: Sequence locations=1-112,136-316,339-460,503 -797,819-1548,1570-1678,1725-1771,1804-2460,2499-2541
  Gene Ontology: Mol. function=protein binding; Biological process =nucleotide metabolism
atgaccaacagagccgaatatttgttccgcttttttgaaagtatgccagaaaaagagcttcgcgaagaattgcgcaaggctccattataccaagggtattgaagcaaaaaacaaaaaaaaaaattttttttaattcagtggcacaaggaagcaaatgctcaaacggctgagggatcatcaccgaaaagagctgatagagcacaggaagaaaaaccaccgcaattttctcactgaaaatctctacgactatctgattgtaggtaaaataggaagatttttcgattcaaaattggcaaaaaaaatttttttttgaaaatttcagaaaaatgcaaaaagtcaccgaaacccaatttttaggtgatcgactttgagtgcacttgcgaggcgggcaaatacgaatatgacaatgagatcatcgaattcccagctgtgcttgtcagtgttaagggcaggaaaattgtaaatttgaaaaaaaaaatttttcaaaaaataaaaaattttagattgacacttttcatgcggtgatccgtccaaagatgaacccaaaattgactgaatattgcaccaaacttacaggttataatgttatttttttatatgatttccgtttcttgactaaagagtcggccaggccaaaaaatcgcaaaaaaaaaaaaaaaaattgaattttcagggtttgtaaatttttttcatttcctcacaggtataacccaacaaatggtggacgaagcgtgcacctttcccgaggtgcttgacatgttccgggattggatggccaaacacgggctggacgggctccacagagtggggggaagttgccgccgcttttgctacatcacggacgggttggtaaacaaaaaccagggtcgggttcagggacgcatcacggggggaggggaaatagtattttgtgctgaaaatttttttattggtaccccctccaagacctcaattcacccaattttctaaaataaaaaaaaatccacaaattaccaatcttttagtgaaaatcttaaaaaaaattttttttttcccgcggtgccaaacccctccttttcttctaaaattaaaaaaggctcgccgtaaaaacaaaaaatgttatttaatagccaaaaaatgtgaaaatgtttcaagtttaaattgtaataggggggggggggtgacaaattatgtaaaaaaaaattttcttgtatttgatagtgtgttttccaggccttgggacattggcaagtttttgcagtcggactgcctgcgctgggccatgccgttgccgcacgacttccgcagctttgtgaacctgcgccgtgcgttcgtcaacttttattgccacgcgcggcccggccagccgaagccggcacgtctgcccagcgcggagttgagcgaaatgctcaagcggttggacatgcaatttgtgggccgtgagcactgtggcatggacgacacggtaatatcataataggatgtacgggacaaccattggcaccaaaaaatcggattgggttgaaaaaatgttcttaaaaattcaaatccggggccctaaatttagcctaaatgtgggaaaactgaaattcaagggaagaaaatggaaaaaaattaaattgataccaaaacaacaattttcagattaacattgcccgaattgtgatccaaatgctgaatgaccatgccgaattgagggtatattaaaaaaagtatttgttacattattttttttaatttttttaggtgaatgagaagttggtgaacggtgctctacttttgccatgggtagaattttaacaaataaattttaaaaaaatttatgaatgcatttgttggcatatcccccccccccttaataaaaatttcgttagtttctctcacggcactcaagttttggtggtaaaatacatttggaaaagattttcggtgccaaggaacaaccaagaaatagtgtgccaaaaaactcatttttctgttttagaaattaacaaaattaaatttttagtcacccttaaaaatgtatggcatttcactttcaccaacaacaacaaaaaaaaaatttgtaccatattttccctcaaattttcagcatcagaaacagttgattttcacggaccaaatgtgggaaaagcggcagaaaaacggcaccaccaccaataataaccaaagcaaagcggcgccttcgcccccactggccgcgttggaagcgtcgcacgcggcgaccatgtcctttctggactcattcggctcgtccacctccgcctcgtcgtcagcggaggacatcatttgcgcgggcatggcacggatgggctttcgggatgtggacgatgacggatatgaggaggaggaagcagcggcggtgaatggtggcggtggcaccagcccgatgaatggtggtggcaacaacaaattggcgacagcgacgacgacggcaaaactcttccaaaatggcatcaccaccaacaccaatggcaaaaagggcggcgacgacgacgacgatgggcaggaggaggaggcgaatgacggcgacaccaccatcaccgcgcatggaaatggtgg

SEQ ID NO: 53956 - DNA, 1221 bp, Heterodera glycines
  Genomic contig location: Contig_ID=SeqID_4301; Location=1258..2478; Strand=-
  SCN-specific regions: Sequence locations=1-112,135-269,292-632,654 -703,729-903,926-1118,1141-1221
ccttttcaggtaaatatcggtttatttaatccaacccattaaataacccccacgtaagaattgaaagaaatggcgcccaaacaaaggatgagtgtggccaaccaacacttcagcaaaaatgtggtggcccgcggtcaggtggccaagtcattgaagcccaaggaaaatcagtacccggccgcgccatggctgatcggcattttcgtcagttttttccgggttttcttgccaaaacagactttgtgctttattggagggcaaattttgggaaaaaatgaaccaaaaataagacagtgagagcttaaatgggcacctaaaagctctcaaaaggtgtaaattgtctaatttttttatcatttctaactgtcgatttttttgcaggtgttcgtcgtttgtggctcagcagtgtttgaggttatttgaatcattttggaaaaaattgcgaaaaaaggatcttttgcaattttggaaaattcaaatttcattagcccttttatagaaaacccggcgctatggcactttaggcgcccaatcaatgaccaggcccagtttcttatgccataaaattaatcaatgtctgtattcttggcatcaaacgaaagcttaaaatctatatgataaattctaagctaaaacaaatggtttaaacaaataaaaaaatgcttgaatttaatcgccgaaaaaactgaatttatttttttctccactgtattttttcttatgtaagtttttaaacttccgaggcttaaagctttcatttgataccaagaatatggacattgttcaaataagaaaaaagttatggcctaaaaaattgaggctggtcagcagattggacgcgtaaaagtgcaataaacccacaaaaatccattttgaaaaatcatttccatttccataatccctctaaatctccccaatccatctcagatcatccgatacgtgaagttgggcttctgatcacagtgtgattatatgtgtgtgtttggcattttgactgacggacggacgagtgtttctttttttcttggtgttgtcattggcgcattgtttggcgggaaatttggactggatacacatttaaatgaacaaatgatgatgatgaccgataattggttgacttccctttaacttctactctttcgttctctctgtccattcatttccatccatttgtttcacaatttcctaacaaatcaccaacagaaatttaattatttcttt

SEQ ID NO: 53957 - DNA, 1194 bp, Heterodera glycines
  Genomic contig location: Contig_ID=SeqID_4302; Location=715..1908; Strand=-
  SCN-specific regions: Sequence locations=1-24,46-283,307-666,702 -1014,1036-1085,1107-1194
  Gene Ontology: Cellular component=membrane; Biological process =protein modification
atgaaagttgtcaatttatccttgaaattaaaattttcaataaaaattccaaaaaaattaatgaaaatcctcaacacctcctcttttgtgccgtgccaggaacgctttctgttccccgtctacccgcacatttgtgtgctggccgctctaggctttgacctgctacgacgactgtgccaagccagcttttccaatcgggacgatggcattgctgccgctgctgtgccgtcctcgtcttcgtcctcctctgttcgccgccccgccggtggtgccaccatccgtcgtggtcaacaacaacaacagcagtttggcattggaaccgcactgtgtgcgctggtcgccgcgctcttcgtgctgttcagtgtgtcacgcattgcggcagttcggcgcaactatgccggactgatggacacgtacaggtccggagtggaaatttcataatttcggttgccgaaacttcagccatcgagataccggtttccgaaattttttgagccatcagaatttccatttcgaatgccgtaattttttgaggacgtcaccccatatcccttgcataaatgcccgaaatataaatgtcacacaatgttttccccttttcagggcctttaatgagcagattctgcagcggcaacaattgctagattatgccgaaatgcgggtaagaaaaaaaaaatttttttaaaaattaaaaaaaaattgaggacccaattcgactgtgcgttggcaaagaatggcaccgatttccgtcctccttttttctgcctgaaagtgccgccattatcatcgacgacaacggcacaaataacagtggcacgagtggtggcaaaccacgccagcgcccagcagtcgaaatggaatttgtgcgcagcgaattccgcggcattttgcccgcccattttgcgggtagcgctgacgacggcacgtcgtccacacttcggcacagcacggcacacgcaccgctgggacggatgaatgacgcgaatcgggaagaaatggaccggtaattggaaattttatttttagggatttacacccgggagaattgggtacgcccggcggatttcaatttcaacaatttaccatataattaattatacataattcagatatgtgccggttgaaagttgcgatttcttggtccatctggaggacggacaggagaccgagctggagccgaactacgcaaaaatg

SEQ ID NO: 53958 - DNA, 506 bp, Heterodera glycines
  Genomic contig location: Contig_ID=SeqID_23242; Location=173..678; Strand=+
  SCN-specific regions: Sequence locations=1-419,448-452,479-506
atgcctaatttatacaatgtttggttcaacgagtacagtaatgttgctgacggtggtggcactttgtctgatcaaccgagcacctcccagcagccggactttgatcagtttgaggagtgctccgacgaggaatttcttgatgatccggaggtgccgagcacttcacatcagacgaaccctcatcagcgtcacccgccggcttgaggaaatcagtgccttgacaacattaatccatccatcgatcacaatcgactgatccaagtattcattggtgatcattaacgcagatcgttttgagccaatgaattttttacactgtatttttatgctcaatttaaattgcgagaattccgtcgggggcagtaatctttggggccaacacataaaaaatcaatgtatgaaaaaaaccggaaggaaacaaaatatttttaaaattatatttttattccaacaaatttgaaatttgtttttgacatttctttaaaaggtcaacattacaaattata

SEQ ID NO: 53959 - DNA, 416 bp, Heterodera glycines
  Genomic contig location: Contig_ID=SeqID_23242; Location=928..1343; Strand=-
  SCN-specific regions: Sequence locations=1-250,276-320,353-375,407-416
atgatgtttcggcagcgacgttttggagtgcatcgacggggacgacgaccccagggggtggcacgtacgacgtacctcccgacaaatcaaacaaaaaacgagaagggcactaacgtgccgtcgcgcgtcccatcgtttcggtgttggaccgttcaaattgctcaaacatggcaatcatttgcgtttcaaattggcactcgctcattgccaatgtgccattacaatcatcatccttttgatcttcttcgtcttgttgttggtgttgttcatcaaaaagagcaagtccaatggagccgacaaattgggacaatgccaagtcgaaaaaagtgaattattttaaaatattttagctttaagctaaacgatttcattgactaatttaaaatatttaaaaaaattaaaatttggggaataaa

SEQ ID NO: 53960 - DNA, 1419 bp, Heterodera glycines
  Genomic contig location: Contig_ID=SeqID_23243; Location=120..1538; Strand=+
  SCN-specific regions: Sequence locations=1-82,105-263,299-619,641 -897,919-1226,1253-1419
atggaatactgtaactgctcaattcccacagggcgtccattgcccagcgacgcttccggtcactttgtcgatcagtcggacgagcaaattccacttgatcagtttggccaaccgcttggccctgacggacttccgttgatgaccaattcgcgtggcgaatacgtcgtgcacagttcgcccgccattcccacagcttcgattgggccaacaacggtgccaattgcgttgccatttccggcactttccgggcccggactaaaagcggaggcagaaaaggaggaggaggagacggaggagggaatgccacccacggacagcacgggaaggctggtgttgccggtgatcagcgcggacacgggacaactgatgccgcgcaacgaggagggacagttcgtcaatgcgcacggagaggtgagacaaaacataggcaacaatagaactgatcagatccgcagagttgaaccgggagagagggcaaagactgatcagactgaaaaaatattaagactggtagtagttgatcagacctgggataaaaatgctttactcactgggaggggatcagactgattaggcggatgccagaaaagggtcatgaatttgggaactaagctgaaatttgcaagaacggcttaatttcagaaaaagttatttgaaggtcaagactggtaaattatttctttgtaactaaaatggtaatttttcctgatcggacacgagacttaccaaaaacggtgcctgtgttcccagttccgttgctgatccgacaaaggtgacattggttaggagaagttccgcttttctcgactctcgagtcgtgaaattttttgcgtctcgttctgtctaatcacccttctttcccctgtttttttaggtgattccaaccgacgactttggtcgtccgtttgattggcatggcaaagtgctgccgcgcaacgagttgggccaattcgtgttccacgatgctgtccaatggccagacgaccatcaaacggcgccaccggaagtcggcgacgctgcgtccacggcacttttggcgcaacgcgagcagcaacaaatgctgcagcgacggcgcaaccaaaccgcgcattgttttgtcggtggttttgtcgaactgctgaatgtgttcgacacgagtgccaacgtgaaaatcctggattaccgcatgatgaaggaggcggtcaaggtcagcgggggaaatggagaagcggcggatcagcatgtgtagagagagagagagagagagagagagcggacagagtgacagacagtgaaggaaattcatgtctttttggtctctgatacagtaatcgtgataattatgatagtgatcaatcagagataaaggacacggatgctctggacaatgccaatccccgacgcaaacttcagctgattagcagcagaattttacatgga

SEQ ID NO: 53961 - DNA, 1952 bp, Heterodera glycines
  Genomic contig location: Contig_ID=SeqID_23244; Location=1..1952; Strand=+
  SCN-specific regions: Sequence locations=27-198,220-417,440-1169,1195- 1308,1336-1689,1711-1952
  Gene Ontology: Mol. function=receptor binding; Cellular component =soluble fraction; Biological process=cell-cell signaling
tacacaaacaaaattaaatgaaaaatcgggctgctggcggtagatgggaacaaaattgacgtaaaattcatgataatatatttgaataaatggaatgataataatgtgcgaagcattaagacattaattgatcaattaggggatgaaccgttattaaaaaaatcctattaatgatgcgcgttatttaaaaaataaaaacaactttactatcaaaaagctttttagcgatttccaaatatcttctctattagccttggaaatatcaaaaaaaaattttgtcaaacttctaaaaagttatggccaaaaatgtcgcaaaacgaggtttttactttttttaaacttaaaattcttttgcaggctaatagaaaacattggttgcttttgaacaaagttttaaatagtttttgttaggaagttttcattttgatgattttttaattatcgccaattatagtgattattaggcaccgagcaagtatttattgatcatcaaagtgactgatcggtgatgggcggacgaatggaagggaccgatcgccatttgactaaccgtatccattaagcatgcaactgtaatttgcactcgcgcaagtgtcgcttcaacgccgaactttaccgtctcagcggataccaaagcggtggcgtttgtttgaactgtcgccataacaccgcgggcagaaattgtcacgtgggcaattgaacatttggcactttgaccttcctaattgctctttctcccctcctacagtattgtcgctttggttattttcgtgatcagagcaaaccgatcactcatcggaaggcgtgcaaacgtaagaaaaaggaacacaacaaattaaggacaacgtttttttcagcctgtctttgccatccgatcggctcattgtcgcgcaattgcaaccaaacaagcggacaatgcatttgcaagccgggggtcgacggtaattgggcaaaggcaaagctaaggccgaaccaattcgattgtgccgggttcaggcccgacttgcaatcgatgtgccaagggcttccaacagtccctgtcgccggacaccccttgcgtccgtaagtcgccccttttgccttttgcttcgccatttcaacgcgtctgtttcaggccctttccctcctcgcccgcccaattcactcgccaaatcaaccgaaccaaatggtaataaatgccaaattccgttgcatttgaacttgttcagcagatgaatgtgagaagtgccgtgcgtctccaagtcgtcttacccttaaaaaattctgtcggcgcgattacggtaatgtttctattttgttactgtcctttttcatcaattattttaaaattcaaattcagccctgaaattacaactcatcagccgtgaattggtggaggggtgggccaaatttcgggcccaactcctcgacgagccgatcaaagatgagctggggactcttctcggcgcggagatgggccgcggcactgaaatcagcctttggctgcccaatcgaaatttaatttgcaaatgcccacggctgaaagtcggccgcaaataccttctgatgggtcagtcgcttttgaaagtgccaaagcaaacggaaaaggcggaacaaaaagtgccaacttttccattgccttttgcctttcacttttggcactttttcctttccttccaataatttcgcatttctctttctattggctgttctttgctttgctgttttcctaatttgccaatttcagctcgtcacggctcatttaaatctgatggcaaaggcattgtgaaagaattgggcgttgaatttggcggaaaaggtgaaaaatctttggcgaagccttcgtctgcgattgtttttgatcggcacgtggtgatgatggaatgggccgatgaagtggcggaaagggcaacgcgattcgcacagaaacggcactttatggagaaatgccaacggatgagagcaaaggaaga

SEQ ID NO: 53962 - DNA, 876 bp, Heterodera glycines
  Genomic contig location: Contig_ID=SeqID_23249; Location=49..924; Strand=+
  SCN-specific regions: Sequence locations=1-876
  Gene Ontology: Mol. function=chaperone activity; Cellular component =extracellular space; Biological process=protein folding
atgataaatcttcaaaatgttgacgattcttccgtgactgatgataaatcatcaaatgttgacgactgttccgtgactgatgataaaccttcagatgttgacgactcttccgtgactgatgataaaccttcagatgttgacaattcttccgtgactgatgataaatcatcaaatgttgacgactgttccgtgactgatgataaatcatcaaatgttgacgactgttccgtgactgatgataaatcatcaaatgttgacgattcttccgtgactgatgataaatcttcaaatgttgacgattcttccgtgactgatgataaatcatcaaatgttgacgactgttcagtgactgatgataaatcatcaaatgttgacgactgttccgtgactgatgataaaccttcagatgttgacgactcttccgtgactgatgataaaccttcagatgttgacaattcttccgtgactgatgataaatcatcaaatgttgacgactcttccgtgactgatgataaatcttcagatgttgacgactcttccgtgactgatgataaatcatcaaatgttgacgactcttccgtgactgatgataaatcttcagatgttgacgactcttccgtgactgatgataaatcttcagatgttgacgactcttccgtgactgatgataaatcatcaaatgttgacgactgttcagtgactgatgataaatcatcaaatgttgacgactgttccgtgactgatgataaatcatcaaatgttgacgactgttccgtgactgatgataaatcatcaaatgttgacgactgttccgtgactgatgataaatcatcaaatgttgacgattcttccgtgactgatgataaatcatcaaat

SEQ ID NO: 53963 - DNA, 993 bp, Heterodera glycines
  Genomic contig location: Contig_ID=SeqID_23250; Location=30..1022; Strand=+
  SCN-specific regions: Sequence locations=1-301,323-450,480-993
atgcctcgggacgaagcagagaatgtgcgtcaagcggctaaaaagcaccgaattaggaaactgtacaatacagtacatcaaattgtcatttggcaatgcaatagaattttttaattgcctatcctaaaaattcgataatttttgcaaatacaaaaaaacacccaaaaatgttgtcaagtattttttggcttttttttggaaattcagcaaatttagttttcagtaacagcattccaaacagatttttcttgaattttagatatttttcaattttttcccaccttaatgtacaggtcaggcactgttgttgctgctgctttacgcctctgaacattctccgcactcatcaactgttcatgctcaacaccagcaacattgaaccttattacaatacattagcaaagcaacatttggtttgttcgtaagttttaaatgttaaaaataggtttcataaataatttaaaaaattgtttttttttgagttcctataggaaagtgaccagcagaaaaaaggggaccatcactttgtgaagttgggaaaaatcagtaaaaaaaaagtaagaaatcaaaagtacagtagcaaattaaaaaaaaaatcaaagaataaaaatcagccaaaatcttaaacttttttggaataatcaatggggaaacattcgaataaatccaaaataacatgataaaacatgtgttgttaaacccatctaacaatcagcactttttctgatcacttttggcgcataggcaaaacaaaaaaaaaaggcatcgaattcaaataacaaattgatatagaaaattcagtcactttttttttaccacgcaatttcgggcccaagccctgtcggattttggtacattgcatgacaagtggcggacaaattcttggccatttccatgtgcagtgatggcatgccatggtgatggccaagtgctaatgtgccagccagaaaacagaccaaatgatcctgggcgagggcacaaaacaatgtaata

SEQ ID NO: 53964 - DNA, 1215 bp, Heterodera glycines
  misc_feature (1210)..(1210): n is a, c, g, or t
  Genomic contig location: Contig_ID=SeqID_23250; Location=1..1215; Strand=-
  SCN-specific regions: Sequence locations=1-170,199-707,737-864,886 -1215
  Gene Ontology: Mol. function=mannosyl-oligosaccharide 12-alpha -mannosidase activity; Cellular component=endoplasmic reticulum; Biological process=N-linked glycosylation
ggttgatcgatgactacaaaaatgcaattgattccatgcacacgcgtctttggcgccattcaatgccaaacgcgttgcattttgttggcgaacttttggccgttgatgtcaaattctccccaaaaatggttagaaaaattcgagtctcactgggcgagttagcttttttgtttaaaataattaatatgtttattattacattgttttgtgccctcgcccaggatcatttggtctgttttctggctggcacattagcacttggccatcaccatggcatgccatcactgcacatggaaatggccaagaatttgtccgccacttgtcatgcaatgtaccaaaatccgacagggcttgggcccgaaattgcgtggtaaaaaaaaagtgactgaattttctatatcaatttgttatttgaattcgatgccttttttttttgttttgcctatgcgccaaaagtgatcagaaaaagtgctgattgttagatgggtttaacaacacatgttttatcatgttattttggatttattcgaatgtttccccattgattattccaaaaaagtttaagattttggctgatttttattctttgattttttttttaatttgctactgtacttttgatttcttactttttttttactgatttttcccaacttcacaaagtgatggtccccttttttctgctggtcactttcctataggaactcaaaaaaaaacaattttttaaattatttatgaaacctatttttaacatttaaaacttacgaacaaaccaaatgttgctttgctaatgtattgtaataaggttcaatgttgctggtgttgagcatgaacagttgatgagtgcggagaatgttcagaggcgtaaagcagcagcaacaacagtgcctgacctgtacattaaggtgggaaaaaattgaaaaatatctaaaattcaagaaaaatctgtttggaatgctgttactgaaaactaaatttgctgaatttccaaaaaaaagccaaaaaatacttgacaacatttttgggtgtttttttgtatttgcaaaaattatcgaatttttaggataggcaattaaaaaattctattgcattgccaaatgacaatttgatgtactgtattgtacagtttcctaattcggtgctttttagccgcttgacgcacattctctgcttcgtcccgaggcatttgaaggtgggtggcactcgatgngagag

SEQ ID NO: 53965 - DNA, 641 bp, Heterodera glycines
  misc_feature (473)..(473): n is a, c, g, or t
  misc_feature (511)..(511): n is a, c, g, or t
  Genomic contig location: Contig_ID=SeqID_23252; Location=757..1397; Strand=+
  SCN-specific regions: Sequence locations=1-208,230-641
tcaatggagaaaagagtttctggacggccgatacggatccaaacaaccaacccctccttccaccccgcgtgccccatcgcccagcttcccaatcccggtcattgttggtaattttgaatttgttttttggattttgcaaatatctatcttgacaggaaatcgtccacaggatgaaaattgtttggtttttccacaaatatcttgtctgattttttccattttagggcggcagatgttcccaaatgacgatggatacgaatcggaagatgatgaaattctcttgccacctccgccgatccccccgcaacttggccaccctccgccaaatgtgccggtaatttcggtctcgcttttcgttgctttttctcaaatttccgagtgcttttttcaggcagttcgagttcagccaatgcatgttgggcagcagcggctgccgctgagagtcctgccgcaaattttccaccctccaccanatgtgccgggtaattttgggtctttctttcgattgctntttctcaattcccgagtgcttttttcaggccgttcgtgtccaatcaatgcagcaacccgtaccaatgagagccgtgccacaattcctcaccttccgcaaaatgctcggtatcttgagcctcgtttttcgg

SEQ ID NO: 53966 - DNA, 1491 bp, Heterodera glycines
  Genomic contig location: Contig_ID=SeqID_4304; Location=932..2422; Strand=+
  SCN-specific regions: Sequence locations=1-11,33-78,100-112,134 -136,166-180,202-203,225-232,254-375,400-456,482-574,598-625,648 -739,782-824,875-900,922-1491
atgaaattctgtattttattatttttatttttgattgccctaattattccaattgaatcagaaaagaaaaaacttcagcagaaatcatttgatgaaatatttggagaaaaatgggaagaaaaagaagataaaagggaaataattgaaaaatattataaaataaaagagaaaattaagcaaaaagggagaaaatattcaacaaatgaatggagaaaaattgaaggaaaaatagcgaaaaaattggggacaaatcgccaatatatttataaatggattaaagaatttggtcttcaaaaatgcaaatcttacaaatcaaaaactgatgaaggaaaaatagaaattgtactaaaattcattgaaatgacaaaagaatataagcaaaaaagtaaatattcacaaaaggaatggaaccaaaattatgccgaaatttgtaagaaaattggagttagcaaaactacaataataaaatggaagaaacaatttggcattagcaagaaaataataacgaaggaagaaaaaatagaaaaaatgaaaatatattgggaaataaaaaaagaaaatccgaaaatgagtgataatgaaattgctaaaattgtgaacacttcaaatgcgaatatttgtaattggaagaaacaatttggagaagaaaattttgaaagattgaattgatgcttctaaaaattcgataaatttgaccaaaaattttaaattgaacaaactaagacaaataatctttcgcttaattatttaattttattcgtaaatgatttttatttaaattctgtcataaactgttgctttatttcaaagaaaaaaaactgttgaaattttaaaaattgtaatttacaagaaattataaattttttaattttttgaaacaaatcaagtagcaaagataggccagatttaaggccatattgtcatattcggattcttctggtcttgttcagaagaacaatttgagaagtcgcttttgttgtatcagttttcatttttgacgattaaaattttgagaaaattagtggccaattaccaattttggcatggtcgtaaaaaaattgaaaatggttttcgcgggacaaaaaatatgttacaacctaagtatttttagcagaataattctgtgttcatggttttaaacaaaaaaagtaggatttgaaggattggaccaacaaattttcgaacaaaaaaacaacaaaaataataattcaattcaaaaaccaaatttcgcagaattcgtttctcagtcttggagcaattcagtcaactggtcaaataagcgacagtctttgagcaatttcaacagcttttttgtaaacttgctttttattgaagtctcagtctttgagcaaccttcaaaacgtcggcggcttatttgcttcaagcgataacagtgagcatcccaagagccaggagcgccatgtaatataaaatcagctttatattgatgaaccctaacttaatccttaacaactttacactttaattcaa

SEQ ID NO: 53967 - DNA, 303 bp, Heterodera glycines
  Genomic contig location: Contig_ID=SeqID_4304; Location=4823..5125; Strand=+
  SCN-specific regions: Sequence locations=1-143,182-234,258-303
atggggagggagggggcgaccgccggcgcgcgctgcgaagggcacaatgtgagggtaaaatttaccaccacatttggtgcctgatactactaaccagaattattgtacagtttggagattattttgcttcagttcgaattagactagattttgctatcacatttgctcataagaacatgaaaaatggtgttaggtatttacaaattcaagtcaatctttgcatttacgataccgtcaaaaattacaaaatgaaaaaatgccacattgggaaaatatgaccaaatattgttgtataatcttata

SEQ ID NO: 53968 - DNA, 780 bp, Heterodera glycines
  Genomic contig location: Contig_ID=SeqID_4304; Location=6047..6826; Strand=+
  SCN-specific regions: Sequence locations=1-19,46-107,249-396,418 -479,501-604,626-728,750-780
atgaaattatttccgttactattattaattattttatttttaattgtcaaaattggatcagaaaagaaaaaattgcaacaaaagtcatttggcgaaatatttggagaaaaatggcatgaaaaagaagaagaaaaacgaaatgaactcaaaaaaagagaaataattgcaaaattcaacaaaataaaagagaaaataaagcaaaaaggaagaaaatactcaacaaaagaatgggataaaattaactcaaaaatagcgaagaaattggggacaaatcgaaacaaaatttatgaatggattaaagaatttggtcttcaaaaatgcaaatcttacaaatcaaaaactgatgaagaaaaatttaaaattgtgcaggaatttattgaaatgacagaagaatataagcaaaaaagtaaatattcactaaaagaatggcacgaaaattatgccgaaatttgtaagaaaattggagttagccatggaacaatttacaaatggaagaaacattttggcattcgcagtaaaataacggagaaagaaaaaatgggaaaaattaaaaagtattgggaaataaaaaaagaaaacccaaaaatgagtgacaaggaaattgcaaaaatgatgaaaattaatagaacgaacatttcaaaatggaagaaactgtttggataaaagaatcgttgaagattgataggatgattataagaaaaattggataaatttgccgaaaaaattatcagaaaaactatgacaatttctagtttttttttcaaattttttgtatttgta

SEQ ID NO: 53969 - DNA, 656 bp, Heterodera glycines
  Genomic contig location: Contig_ID=SeqID_23253; Location=191..846; Strand=-
  SCN-specific regions: Sequence locations=1-87,112-299,321-481,503-656
atggcatcgacaaagccgaacacactgttcaacaagatgaggaatttggtgggcgaacagtccagcaatatgcttggcaacatcgccggaggcggcggcggcgccggcactcaactctcgtcccaacaccgaccgtccacggcacaattccaccatttcaacgcgggggttgggttttcagtcttaaaaaaattttgggatagaaatgttttaaaaatctaactaaccttctcttttatacataaataaactgaggcttcccgaataaacaattctcaaaagtaccccctggggcggaaaaattttaaaaagatagcaaagctcgttttgtatgccaatagaatccggacgggaccggactcccacccgggactttcccggatcccggtcccggctttttggaaagaaggggcaggaccggatcccgaggttatcaatccgggagacatgattcaaatccggtaatcctagcgtttatatgaaaaatttcaccaccaccatcaatttctcagcaggcatcggccggaggcggcaccgccgccggggccaacaacagtgcccagcttggccaacagtacgtaaacttcttgcgcgcctcctctgaacagcttcagcaagtgattgctgatgaagtgtgggtgaaccgactgttggaa

SEQ ID NO: 53970 - DNA, 760 bp, Heterodera glycines
  Genomic contig location: Contig_ID=SeqID_23254; Location=1..760; Strand=-
  SCN-specific regions: Sequence locations=1-760
gcatttgcctggttttccgatttgcttgccgatcactccgaaattttttggtccctctattccgtggatttggacgccgcgttggagctgcaaccgcccgactcgtgggactcattcccgttgtttcaactgctcaacgactacctgtgcattgatcgtaagtgatcggagtggccgagaccaggctcgagatcatgggaatttgctttcgaacaaaaaaattgagttggagtttacttgacccaggattatagcttgatattttgaattatggaactgaattcgtcccagaaatcgagaccgagaattcctgtcgagaccaatgggaataaaaattgtccaatcaatccgcgaattctcgagtcaagagactcttgaatatttaattgtctgtacaaaattttatgccatacttttttttaatacgcagaaaacttgcggatgggcattttccacagcaaattgatcagccaattttctccgatggttgtccgctacattggtaaagttttcctactgtttttttaaaatatatgtaatcaatgatatgctagcatgattattttctgatcactcacagatttgatggagcattcgatcagccaatcgattgagaaaaatttttgccgcgagaaatgggaagtgcgcaagtgagttatattaattatctttatgcacattgaaacctaagcgtaatgatcagaggacccctgagaaagatttgcgcgatcacttagcgatcaggggcctgaccaggtta

SEQ ID NO: 53971 - DNA, 812 bp, Heterodera glycines
  Genomic contig location: Contig_ID=SeqID_23259; Location=18..829; Strand=-
  SCN-specific regions: Sequence locations=1-145,167-665,693-812
atgcaaatcttctcgtgcgctgagttttcaatgcaaaatgtggactatcaggcagtcaacaattgctaccgctacattccggtccaaatccgcattgagaagaagacgctcaacgcattcctggatccggagcttcacatcctcacagcgtcatcaccattcgcagattgtggaaatttccgctaccattatctgcagctgagccagaacaattggatcaaaatcgacacacgcaccgctacgatccagaaaatcgactccagcagcatctctgagatccgcgaagcctctggagacaaatcgttgttggaaatcacgccgctagtttttcatcgatgtacgatcgacaacgaaacaggcgaagggctattcgcgcacttggatgaatggctgcgtttggatcaatggaagtcgaaggagaaggagcacaaaacggcgcgtgcgctcacactgggagctctcccgaacggagtgattggcctcaccgaagaatggttcatggacaaacttcggctgctcgtctcctactggacaacggcatgctgcatttacgtcacattcatgtgccccccaattgtgccatttttccctttgcatttcccctcgcattttgtccccattgtcacaatttcccccctttgtatttctcacacatttcttatgtatgggtttaattacccaagtttgagtttgagataaacttgcggagtaattttggtgcaaattcttggggcggcaaattggcaattggcggcagcaaatcggaacaaacggcgcggacccctcccccttaaagacaaaggagtattaaa

SEQ ID NO: 53972 - DNA, 753 bp, Heterodera glycines
  Genomic contig location: Contig_ID=SeqID_23264; Location=244..996; Strand=+
  SCN-specific regions: Sequence locations=1-263,287-375,397-481,503 -567,593-753
atgagtccaaccctttcaaccgcgtcgcattgccccgtggtcagtgtttccgcattctcttttttaagtgttctgtttattttggaccttttcattgccctcgccgaacgcagcggaaaacgcgtgagcgaaaagcgaagggaagtgctgagaaaggctaatctttcctggtgattcaccgattaattagcctcgggtgatcagttgttctgataatttagcacaatttatgccacggatgaaaagccgagcttttcgttgcgaaaaagctgcgcaattcttttgttggaacgcgacaaattgtgcgtttttccttaggcgaattgatcaattaatttattggatttaaatttaattaggcaaaattggagccaatacatttttggagacaacaattgtgagggcaatgatggggaaaatgatggtcaacaattggcggatggaagcgaatcattgcgcgaaacgcaactcttggcctccattttgggccatttgcaaaatgcgcttgaggggcgaatggcaaattgcgtggatgccgaaggggaaaacgtagcgaaatggcaaattggggagaaggaggaagaagaaaaggggcacgaagaggaagcgaaaatggtggcatcgttgtgggaggaacaagtcgaaattgtgcgcggaatggcacggcatttgacgcccattttggacggatggagcaaaagcggggggactgatcagaacacaagtgacggatcagcaacaggccaattctga

SEQ ID NO: 53973 - DNA, 1239 bp, Heterodera glycines
  Genomic contig location: Contig_ID=SeqID_4305; Location=564..1802; Strand=+
  SCN-specific regions: Sequence locations=1-96,139-181,203-225,254 -465,524-657,680-750,772-822,847-926,956-1239
atgcacaacccattcgggctggacacgctgaacattgattacaacgatgacccattggcacatttccaagtgcatcaaataaacatttcgggtaagtaaaattattaaattaataaaaatatttagtaaaatataattgtgccaaaaatagtgtcggtattttggtttggatttttcaatcaaaaataaataaatcgaaaaatttttcaccacataattcggatgaatttgtttattttaacaaagtgcaaattaaaccttttctgaaatagaaggcattttttaaatgatttcaggaagtgcagcaaaagtgcatataattgctcccggagacaaactcccattcgcaaataactccgtcgattttgtgatcaattcgcacgtgttcgaacatttttatgacccaatcagaaccattgaggaatggcttagggttgtgaagccaggtcattcaaatatacaatgtttttttaatatttttaaattgaaaaatgaaatttttaataaatataaacattaatttccagtgataattttttttatgtaaatacatgtttttttcctggattctctatagcctaattagtagaaaacactttcttttttgtgtttgcgaacaaaagttgggacttttatttacatattttcggaattttctacatattacatatgtacatatttttatacatattttggactttttagtacatatttcgcaattttttcgtacatattttgggaatttttgagaatttataaaaaaaattatttgaaaatgtgcccctaaaaaatcggtttttttccaaaaatcagatgtcattaattttttaaatacttaaaagtgattctaagcctattttggtccttttaacggcattttatgattagttcactttttacgaggaatttttttttccaaaaaaagcattaaaaaattttttatttacattttttagtacataatttggaggttttaattagagaccggaaatttcaaatttgcggatgccgctgcgggattggtactgaaaatttttgcgggacgggatcccgcaggtttaaatcccgcatttcccaaaaaatgcgggattgggattgggaaaccgcaaaatcccgcgcgggatcccgtcccgcgccggtctttagttttaatacatattttagcattttttatacataatttatttacatatttcgcgatttttcttacataaaaaatgatccctattaattactata

SEQ ID NO: 53974 - DNA, 864 bp, Heterodera glycines
  Genomic contig location: Contig_ID=SeqID_4305; Location=3367..4230; Strand=+
  SCN-specific regions: Sequence locations=1-237,259-517,551-842
atgcccggcgcagctcatctggcccgactcatccaaggtcactcgctcaaaagccaaaacgctagcctccgttctgaccatttcgatttgtgcctttctgagtggctctgctccagccaacaccacatgcaagccgaaacgtggaaaatgcccgtcgtcccacgcacagagaggtcaggcgccttcgggcgttcaactcctgctgtcctccagaaaatggtctctgcgcgattgatgatcaagtgcccacaagttccacatggttgctggtgtgccaagccggacaagcgcagaacaactcgtaacatgtgaccgacaaattcttcgactcaacggattttgttgaacactgctcatttgtgatccaatggattgtgccctctgacacgaatacaccgacgaaagcgactatgcatgatctcaattcaggaagctcaagaagcacagagaaatatgccggaggatgacagaactgatactgccgcggggagtgtcggcaaagcggtgccgacgaaagataatttgtattaaaataatttataatttattagtcattcaatgtgatctttgaaaattgtgattttattccctcctttgaaacattttgtccatttagcattagtcactagagaccggcgcgggacgggatcccgagcgggattttgcgggatcccagtccgcaatcccgcattttttggaaaatgcgggatttgcgggattaatcccgcgggatcctgtcccgcaaagaattttgagttccaatcccgcagcgggatccgcaaatttgattttttgtgcgggattatgcgggattttattgattttttgaaaatttttctaagacagaatgccaaatatttttaa

SEQ ID NO: 53975 - DNA, 52 bp, Heterodera glycines
  Genomic contig location: Contig_ID=SeqID_4306; Location=159..210; Strand=+
  SCN-specific regions: Sequence locations=1-52
tcccacagtccaggaaaaaaatatggatttccatataattggactccctagt

SEQ ID NO: 53976 - DNA, 1344 bp, Heterodera glycines
  Genomic contig location: Contig_ID=SeqID_23265; Location=292..1635; Strand=+
  SCN-specific regions: Sequence locations=1-323,350-560,584-652,675 -676,701-901,923-1172,1194-1344
atgcccctccgatcgtccgctgaggctcgacgttcggatagagggcaacccggcgccggaagtcaaatggctgaaggtgcgctaattgacactaatgactggtcaatggccgagcaatttgacaggactggcgccctctggtcgagtcgtcgcgagtgcacattgtgcacgagccgggccttgacctccggtcgctgctcatcgaccagccgatttggagcgattccggcatttattcgtaagtgctaattgggccatgaattaatcactaatgggcaaaagagcattcattagttggattaaattgggtttacgaagcacttgaatcttgttttgttttttggcatcaattctgagcgttttcagttgccttgcaatgaatgacgctggccaagcggtcacttcgtgcacaattaccatcgaaggtaatggcaaaatgtcaaatgtaaaattattggccaatttcagccgccgaaacggatttcatgacagacataaagcttcgggcgttgaagaaaagcataaaaatggaacggggcccactacgcgacatttacgacattcaggaggccgaggtggaggagtactcggccagcgaagcgacctctgttcagaacggaagctaaaccaattaattggccattatttggaaccatttaatttggaagaaaattaaatttaatttgggggaaatattttcggtaaatactttaaaattcgattgattaatttgttggttcacaattttatttgccgaatcagcgcaagttttccggcactttttccgtggctcaaatttctgtccaaatagcaaatgttcccccgccgcccaccgcccccacacatttctttgctatttttcatagcattattttggaatccctcctccacttggatagatagcagctgttcccctccccccttccgaatcgaatatccccggaggggatatatccgctttgatgagattgatccatttcgaccatcattttagatcaagctcggtggaaagcttttcgtttagtttcctgaaaatagcattcatttttggcaccgtttcaatgtgtgcctttttcatcaaagaaaatgcaattgacaattattacataattaattatctcattttctctcctctctctctcttccccatctttctttctctggcgattccttgttgtgttttatgtattgttatcgccgtcaattggtattgtttattgattgattttttgatccattttcaattgattttttctccattgtcctgatcggacttgactgcccaccgatcgaaattcaaccactcccatttttcgttgtctccgtcccatggttttgcgccaa

SEQ ID NO: 53977 - DNA, 1535 bp, Heterodera glycines
  Genomic contig location: Contig_ID=SeqID_23267; Location=238..1772; Strand=+
  SCN-specific regions: Sequence locations=1-195,221-226,250-766,793 -898,920-1044,1066-1440,1475-1535
  Gene Ontology: Cellular component=mitochondrion; Biological process =aspartate catabolism
atggtttgcaaatgttgaaatgggtccaccggatgtggttgtttttttgcatttttttactagtcaaacaatcaaaaatatagattttgggcgtaactgaagcatttaaacgcgatgacaacccgaaaaaggttaaccttggagtaggcgcatacagagatgaccaggtaattttaaaataataatgttcgtgagattttattattattttttaaatattcattttctgtttagggaatgccttttgttctgccgagcgtaaaacaagccgaaaaagaattactcgaagcaaacctcgacaaagtaagtgataggacagtcaaattaatcttgatgcacttataaaatggagcagttcattctaggaatatgctggcattgccggtttgccggacttcaccgccaaggccattgaattggcgctcggaagagattctgaagttttgaaagcgaaacgaaacgcgacggttcagtcggtgtccggcacgggagcattgagaacgggcgccgaatttctcgttggtttttaagattttacccaatttttattgcctaaatagtgtaaaatgcactaacgctgatcataaatttgacaaatgcattttagtccaaatggtttccgcacaacaaagttgtttatcagccgacgcccacttggggcaaccatgtgcccgtgttcaagtgcacatcaaagcaaattaattgccaagtccaaatattcttgtcgtttaggtttgctggctttgaaatccaaaagtaccgctattacgacccgaagacttgtggctttgatgagaatggctgcttggaagacattctgaacatcccggcgaagtccgtcattttgttccacgcgtgcgcccacaatccgacgggcgttgacccgacagtgcgtttttatatgaaatttatttgattttttcatcattcctcatttttaactaacttatcacaatccggaatgacaaagaaacccctaattagccagagcaatggacaaaaatttcggatgcatgcaaaagccgcgatttgtacgtctttttcgacatggcctaccaagggtttgccactggcgacgtcgatggggacgcacacgcattgcgctatttcgttcaacaagggcacaacatttgtctagcgcaatctttcgccaaaaacatgggtctttacggtgcgaattattgtttttatacaattattgtatatcagaaatttggttttacgaattcaatcaattaatcatacctgtttttatacaataattttgtttttgttccaacaaaccctatatatgtttttttatataactctaaagccataaatgtaagtctgaataaggtaattaattgtacgagaaagaagagaatgctaacatttaaccaaagttacaaaacggtaaataatcaacgctttctcaattatcatattttttggcattgcaaaaaataaaaataaattatttttattaattttaggtgagcgtgtcggtgcgtacaccgtcgtctgtaaggaccaggaagaagcaacccgagtga

SEQ ID NO: 53978 - DNA, 986 bp, Heterodera glycines
  Genomic contig location: Contig_ID=SeqID_23271; Location=346..1331; Strand=+
  SCN-specific regions: Sequence locations=1-986
atgcccggtgatgttgaacgatgccttgccgagactggaattgatgccgtaatgagtgccgaaggggtgctcaacaacccacaccttttcgatggcaaaaatccattttcatttgaggtaaactattcctccgaattaattgtaaagtgcatataatttattttttggttgcacgcgaatatttggagtttgccgaccgttacaaaacggggacaagcgcagttcgtgcccacctttttcacatttgtcattacaggtgttttcgtcgaattatttttacaaattattttgctaattaatataaatttcagttttctgaaatacgacgacttgcgagaacggaatgcgattatttgttcgcttagcgaattttctgagaacattgagaaattgcgcaaaaggttttagtcttttgtttaatttcaatttaaatttgaccgtttcaatttgaggtgtcagctcgaagttctcaccaatgcaaatcattccaacgacatttgttggtccgcttccgtgcagcagtgttgtcccaacttcgaatcactccaacaaatggtttttaattgagtccaattatttctcgttgctttttttagtccatcattttcaggttctgtccactccccacttcttctgcaagccctatgttcgtcaaatgttaaaatgcgctgcggaagcctcggaaaatggagacgatgtgccaaatttgcccgtctctgtcagtgcgtatcgcgagaagcggcgggcggagatcgaaaggttggcaaaagaggcgggcgtatcgaagaggcaaattcggaagagagagaagcggaagagggggcagacaaaggagcagaaccgaaaacagacgtacccaaagtgtgaacggtgagtggaacagattgcacagtccgtgttcaaatggtttgggttttccggttttgaatcacttcggtttcaattcccaacagcctccggttctaccccaattgacaattcccaaa

SEQ ID NO: 53979 - DNA, 73 bp, Heterodera glycines
  Genomic contig location: Contig_ID=SeqID_23273; Location=1125..1197; Strand=+
  SCN-specific regions: Sequence locations=1-73
ctgcaaccaacgaaccacttcaatggccgaagaatattttttaatcgctgcggctgccttcggagcaggaatt

SEQ ID NO: 53980 - DNA, 834 bp, Heterodera glycines
  Genomic contig location: Contig_ID=SeqID_23274; Location=1191..2024; Strand=+
  SCN-specific regions: Sequence locations=103-114,141-141,169-169,234 -234,272-276,308-834
  Gene Ontology: Mol. function=transporter activity; Cellular component= plasma membrane; Biological process=apoptosis
acttccgtcctcacagaagggaccatcattttgtctaaatggtccgacccgacgtatttcatccgcacccaaatgtacaccttcacggtgcgcaaccccgacgaaatcacccacggggccatcccttcggtgaagcggcaggggccctattcgtttgaccaaattcaaaagcggaaaatccaccaaattgtcaatggaactgtgcagttcgagacgctgcagtcctaccacttcaacgaggaggccagctgtgccgagtgctttttgtacaaccgaatttggatccccaatttggtctatcagaaatttgtggaggcggcctccaaaccggcgatgagagtgggttttgcccgttggcggttcatttgccgcttcgtctgcgctttgcttctatcccggcatttccccttcagcccgccctcgccgcagtggccatgcaaacgccctttttggaggtggaagtggccgagttgctctacgacggctacaaggacccctttctggaccaaatctgctctttgcccgtcgtaaactttgtctgtgaacaaattctccatttgccggaccgaatcggacttttctataaagtcagacatataattagcaaattttaattcaacgaataaataatttcagaaaaatgggacggcgaacggagttttcgttgtggaggacggacacaccgaaaacgcggagagtttgggcagaattttgtcgtggaaaggctccaaaagccttcccgactattggtgggaaggggaccaagcactgctaataaacggtgggaatgagaagcaatcgctacaatcactgggccattcgcctccttttgag

SEQ ID NO: 53981 - DNA, 975 bp, Heterodera glycines
  misc_feature (941)..(941): n is a, c, g, or t
  Genomic contig location: Contig_ID=SeqID_23275; Location=56..1030; Strand=-
  SCN-specific regions: Sequence locations=1-975
atgagcgctaaaattatcagagtgccgaaaatcgcatgtgatctaagcctagaaaaaaatggtgtaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagcttctcaaacaattttagcgcatccaattccttctacaatcgcctttatacatcccattatgaacgctaaaattatcagagtgccgaaaatcgcatgtgatctaagcctagcaaaaaatggtgtaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagcttctcaaacaattttagcgcttccaattccttctacaatcgcctttatacatcccattatgagcgctaaaattatcagagtgccgaaaatcgcatgtgatctacgcctagaaaaaaatggtgtaagtaaaaatcgcttctcaaacaattttacgcttccaaaagcttctcaaacaattttagcgcatccaattccttctacaatcgcctttatacatcccattatgagcgctanaattatcagagtgccgaaatcgcatgtgatctaa

SEQ ID NO: 53982 - DNA, 828 bp, Heterodera glycines
  Genomic contig location: Contig_ID=SeqID_4307; Location=132..959; Strand=-
  SCN-specific regions: Sequence locations=1-115,137-362,384-508,691 -707,759-828
atgagttcactaatttggcaaataggtttattcaataaattacttgaaggaaaagctgagtgcacggaaacagccgaaatgttaatttttttaaacaaagcacttccggaaattaattacaaatactgaaatatttaccctcacttccatttgttgccaatttgttgctagttgtgttttcgaatatgaaaaaatttttaaaaaatccgtatccgtatacggatccgtatttttcctggatacggatttttacggagtacggattttccagatttttgtccgtaaatccgtatgtgtatctagtccgtaatcctgatcctgatccctattttctcaaaatgccgatctctaattttaatgtcaaataaatgaaagaataatagccgaagtaataaatatagaattggatataataattcaaattattctattcaattttatatggcttattcacattaaaaatgtttgcttaatattttatagagttgtgtttataaatattttaataattttatgttaaattttagtatttttctttgtgttttaatttattctatgaaaaataggttattttaaatttattgataattaatattaattttagttttgaattattatcttttcacatgtcactttgttttgcttttatttaattttgaaattgtttttttttaattttttgatatcattcccagtcacaaatgaccaaaattaatttatatttttattgaaaattaaaattttagaaatattttattcctactgcttaaataacaaatgagcagaaaacggcatcaaagatttagatatgacaatattaaaaataaa

SEQ ID NO: 53983 - DNA, 2521 bp, Heterodera glycines
  misc_feature (1126)..(1126): n is a, c, g, or t
  Genomic contig location: Contig_ID=SeqID_4308; Location=288..2808; Strand=+
  SCN-specific regions: Sequence locations=1-112,134-163,185-321,350 -841,865-1233,1477-1781,1810-2063,2090-2267,2289-2521
atgacgaaggtgtcttatttactttcatttaggtcatttaggtcaggaaacagtctgcagtggcccatttgggaacaggacattgctcatttttttttgccaaatgccaacaatgctatctctttacaacttggtaatgccaaaaaaagtgataaagttgctgttataattagggaaaagaaaacattaaaaatgatttgtttattcgttttccctaaatttggagaaaaaaaagctaaccctaatgccaagaagcttcatttataaaactaatcaaattgcaaaaaaaaaactaataaggaccaaactttttatgattagattttaattgaattttttaaatttaaaaggaattggtggaaagtgcggaaaaattatttttatgcttgttaatagattttgcaaaaaaaatgaatgatttttttttgagtttttttagtaaaacaaataaagaggttaggtaatgcggtgccaggaagaaaatttgggttttttttaattcgggtaattttaacttgaatttttgcagactttttgacaaattgtcacggccttatccaacagttgcttgccttccaattcaatgttggcattatggaaacagttgcatgggacctttcgttgagcatttttcgcgcattgcccacaatcaaaaaatttggcatttcacaaagcgcaacaccgacaatagcgcaatggcacattttgggttatgaaaaaattgttggcgcaatgccaggtgaattaatttggcgtttttttaaatttcggcacctaaaacatttttcattaccaaaatttcgaaaatttccatcttttcttcattaaaaaaatctttagctaaattaaatttaaaaattaattgacattttgaaaaaattttttgggtaattaattaagaatatgttttcttactaagaaaagttttaccgaatttttggtcagaaaaatatataagtcgaataatttcattagcacctcaatttgcccaaataaaaaaatcttttgaataaaataggaaaagatttggcacgaattggtgaccacaaatttgcaactgaaaatgccatcaaagtaaacccgaattattttcgtgaacgcaatgtgaattcgtatataaagctanatgaacaggcaataaaaacagtggtaatttatttttatccttggattttatgggctttgcatcttggacttttcaataaaattcatcaaataatgtgtgatttttggataaatatttttaataaagtaattataatttttaaataattttttatggtatcgaaaatttaaaatttattagcattttcttgaaaattatttttttcaaaaatgccgtttttataatatcataaaatgaacacattttaatcaatttttaattgataaaatatattttaagtactcattttaaatatgtatgctttatttttacaaaaataaaaaattaattgaatttttttttaaattttaggaagaaaagtttttggaagcaattcgccaagaaaaactctcacgaaaaatttttgaggatattcttattcaagaaaatttttctgaatgggaatttaaacatcggatggattttttcataacaaatactcaaccttttctcgattttccaattgttgagcaagaaattgcaaaagaacgatcaattaaacagaaaaatcgtattatttttattggcggaatcacaatgccaaagaatggggcattgccaagtttgagtgaggtaatctcggaaaatcttgtcaaatagtttgaacaacaacctaagaattcataaaaaattaaaagataattggaaaatggattttttggtttcttgaaattgagaaaatggttcctaaattaattgctaaatacattcaaaaaatccaaatagggggaaaaggtaaaaataaaatttccgaaattctctctgatcgaatctgtaaaaatttcaaagtacgcaataccataggcgttgtcggcgaaaatttttgacttttctccagtttttttatcaaatttattaaattgcgggaattggtaaaaaaataggtgcaaaaactctgtaaatttttttaaatattttttttttgagcgtttaatgcaaatcattcacagagttttacacaacaatttcaaaatatttacaattaaaaaaatatttggttcgacggtgccgacagggccctagaaatttttgaaattttcgcttaattattgcaggataacaaacaaatatttgaatctgcgcgcaataaaaatggtggcgttgtgttgctcagttttggctccgtggttccgatgcatgatgacgatgcacatgcagtcgcattcaaaaacattgtggtcaacctgttctccaagcagtacccgcagatgaacatgatcatcaaatggggcgaacggccaccaattggcatgggcgaccaatacaaaaaaatgtcggaaaatatttatgccaaggcttggcttgaacaatcggcaattcttggtattgccaaaatggcatcttgaacaaaattta

SEQ ID NO: 53984 - DNA, 524 bp, Heterodera glycines
  Genomic contig location: Contig_ID=SeqID_4308; Location=3045..3568; Strand=+
  SCN-specific regions: Sequence locations=1-71,94-149,177-265,287 -290,313-524
  Gene Ontology: Cellular component=membrane fraction; Biological process=steroid metabolism
atgccgaaattgttcattacgcatggcggacaaaacagtataaatgaggcagtgaaatttggcgtgccgcttcttttattcccattttttgccgatcagtttaacaatgccgaagcaatggcggcacgaggggtggcaaaagtgcttggtaaatttataataaaaattatttaaaagatctaaattcgaaatttaagacattcgttccaaaacattggaaaatgagttggctgaagcgctgaatgaaatattcgcaaattattcaatgtacaaacaaaaaattgaagaattgagcaacaagctgagttcaattgatatagctaaagaatttttgggcgcatttcgccaactacgaaaaactctttgacaagaaaatagaagcaaaatttcttgaaaacaattatatttcttagattgaaaaacaaaatttcttgtaatccactatatatctaagattgttcgctagcttatcattattatgttgtaatttgccttacattttctattcatattcataatccaaa

SEQ ID NO: 53985 - DNA, 1484 bp, Heterodera glycines
  Genomic contig location: Contig_ID=SeqID_4308; Location=3685..5168; Strand=-
  SCN-specific regions: Sequence locations=1-155,186-221,243-306,360 -389,418-618,642-644,669-704,749-760,782-881,903-908,946-1025,1057 -1208,1230-1329
atgatttttgttcatacatacatcatttacattggccatattctgtttgtcgagcgtacaatggccacatttatggccaataaatatgaaagtgtcaaaaacaattggttcagtgccagttggttcatcattttggtaattgttaattgatgtacttatttattaaagaattattttttattttagactgtttacagcttcattattggtttggagcaagcaaataatacaaattcattatcaacatttacgactatttcaacgtttttatctttggtcatcagttttcttgaaatttttgtaatcattttttatttaattttagttttttatttttgaaattttttaaattaaatttagacattttcaatgctgagtaaattcaatgaaaaaatgtttaacaaaaaattaaaatgttcaaacagcaatgggcataatttgactgaacgttatcaggtcaaaaaaaattaatattaattgattccgagttaatttgtatttgaaatttttagttgactgaaaacatccgaacaggccatcaattatggccaacttttctacttcatttttcaattataggctggacttccatctttaattttttgtattacataataatttattctttatttcttttctttgtgcaattcaattatttatttttatcattttaccatttgttaattgagtacactataataaggtaattaaaatagtaattatttcattttctatttattttaatttagtcgtcatccaatcttgcgccaaaatgccgtgcaaattttgaaaaaaattttcaacaaattttccatgaaaattccatgtaacaatcgcgtcaatgataatgtaaaacacccgacaattggtcgaattgacggaagaaatttgccagaaaaacatttgatgaatgaaactgatcaacatttcaaaatattaaaagaactgtggtaattaggatttgggattgtgttttacagcatatattttgattaatttgctaactttgagccagctcgatttggaatatttttattaaaatttttcaaaatttttcaagaattccgtttcgggattgcctgtccccattacctgtcccaaaattttataaaaacttgtctcaattaatttgtatattttttattgatttgaatgtaaaattatcaaccaaaaacaatggaaaattctattttttttgtattagaaattatataaaaattcaaaacacattgcgttacaaatattttccattgtaatattttacaatttttttcattatttttaagattgtattctgaatgattaattatttttggaaagaccaaaaagttatatttttaaaatataactttttaatttattggattttataaaatccataaaaaatagtttataataattttttataactattttttttatcaaacaatacaaaatgaaaaatattttaatatataaaaaaatttaaacaatataaaaataaa

SEQ ID NO: 53986 - DNA, 608 bp, Heterodera glycines
  Genomic contig location: Contig_ID=SeqID_4308; Location=5305..5912; Strand=-
  SCN-specific regions: Sequence locations=1-286,321-352,386-479,508-608
atgtcaaattcatctgctgatgaccaaggagaagcatctcaattcatcaaaattggcatcccaattgttttgggtttgaatgtttgcgtttttgtcgtccaaattccgctttctctgctcaacattggcattctgtgccgaacatcgcttttgcatcgcaatttgaaatttattcttttcattcaaagtgttttattctgcacattcgcattgacattatgcgttcagtttctgattattgcattttatggaatacaacaatgggcctcttttacaccattactcgtaaattattaattaaaaaatatttttataaatatggattatcacaatccgtcataataatttccacttttttaaattttttatatattatttaaaataagagaatttttaagagaaaatacaaaaattatgagatgtatccattttttaaattaatttccgacttgaaaccctgactgtaatcttttttttcgtttaattctttttaaattaaaattattagttgtagatacttttgcctctgtgggtcttttgtcgtatgtccttttgtccgtggatcctttgtgcatgcaccatttgagccgtaaagccacaaaaataaa

SEQ ID NO: 53987 - DNA, 301 bp, Heterodera glycines
  Genomic contig location: Contig_ID=SeqID_23276; Location=75..375; Strand=-
  SCN-specific regions: Sequence locations=1-45,80-97,119-162,191-301
atgactgatcaatgccaaagagaaaagggagatattcgcctgataagagcaagaggaaacggagaagggacggggagaggaagcgatgagaaggaaaaaggcaacggaagagcaaaggaaccaaacgaaggttggcgcgaagagaacatttcgatttctcatagaaaagaagcgaaggacagacaaattctgcagcaaaagtgccacagaccaatcgaccgcaaattcaaacgcttatgggtcaatcggacgccggcgatcgcttctgttcaccgatccgaccgaggatgaccgcgcatct

SEQ ID NO: 53988 - DNA, 1510 bp, Heterodera glycines
  Genomic contig location: Contig_ID=SeqID_23276; Location=328..1837; Strand=+
  SCN-specific regions: Sequence locations=1-429,454-755,777-884,909 -1304,1328-1510
tcttatcaggcgaatatctcccttttctctttggcattgatcagtcattttggctgtatcccgcttcaggtccctggccctgatcagctcactttcggtgtgcctctgctccgtccattccctttttcccctccgcgccctgcgcctttccgtcgccctcggcgtgcgcgacaacggcgcctctttcgccgcgacttggccgtaagccgtgacttccgtccgttgagaattcatttgcattttgaccccgtcatcattgaatcgtaagcatcgaaatctcagcactaattattttttaattatttggctttaattttcgcttagattattcgtttttcctcttcaattaagtttgcctccaagtaagcagatgttcatcaacgtgagttgtcgccgaattttcgctgcttttcccctcccaagtgtacgccgtcctttccctccctcccttttcagtccacgctgttgcctcaggcaatttccttctggcaggtaccgtaccgtacccaatggtacgattttacagtatttatttgttgcctcttcagaaatcgcttctcgtccgtccggccaatgttcccatccgtttgagtcggtcagcttcatgtatccattctcttttgcagtttcctttgcttttaagcaaatgcgagtccaatcagtattactctgatcagtctagtgcatttttgcgatgtgtgacgcggtgcaaggcaattacgaattgcggcgaggtgcaagtgccggacgcgcacctttttgtgagaagagagaagcaaataaataggggaggggtcgagagtctcggcctttaggacgacattggctacaacccaaaacggatgattgcttcccattctggttaagcaatgccgtttctgtctgcagtccaaccctttgtcctgcatcccttccggcccctcggatgggccgggagtgtccgacaccgattttctgctttacgtttccgccgtggacacccaaaggtgtcgcaacgaagagaccattgcctatgctgcgcattgccagcaagagtccgagcttgacaggtcaaaaagccaattgagtaactgcttttccaccgaccgtttcccttcattttcccctaattattaggccaattgccggtcacgtgaacatttgccccggggcactgtccacccatgcccatgacaaggaagtgcttttgtccaccgtcaaacatgaaattctccacgcgcttggcttctccgccggactgtacgcttttttccgcgacgcggaaggaaagccgcgatcgaaaaggtgagaaggaaaagaataaccccttttttcaatgattttcaagaaatgtgaacaaccgtccgctttcatttaaccgcgagcgcggctattacgacgcggacccatcgacggtgagaacggtggtgagggaggattggtggacggcagagggacaggtggagaggaagagagcataattacactaattaaccgaattaattgtcagatccctcacccaattcatttg

SEQ ID NO: 53989 - DNA, 235 bp, Heterodera glycines
  Genomic contig location: Contig_ID=SeqID_23277; Location=225..459; Strand=-
  SCN-specific regions: Sequence locations=1-46,68-177,199-235
atgtcacttctccgtaccgtcaaagattgtaagggcaaagtgatcgaaaataattcacaagcaaaaatagttaaatggtttttttcaaaattttttagttttttgtgctaaaataaaaaactagaaaatagttgctaataactagaaaaatagcttaagaaccaccgaaaaaacacgtttttcgtgagtttcaggccacgtggagctcaggaagaaaattggtaaaaaactataa

SEQ ID NO: 53990 - DNA, 1098 bp, Heterodera glycines
  Genomic contig location: Contig_ID=SeqID_23278; Location=148..1245; Strand=-
  SCN-specific regions: Sequence locations=1-463,485-803,837-953,975 -995,1022-1098
atgggaccagaaaatgtaagttttgccactctccaaattttatcggcccaaaagtctggggttttgagggtgcaaaaatttttcgaaactcgaaataaattcatgttttgttgtattgttttccgaattacttaacaaattcccccgttttcgggtcgatgtttgttggtgttttcaattcaaggccgcctcggacctttacgcgccggttgccggcgaagtggtggaacggaacgcggaagtggaggacaaaccggcgctggtcaacaaggactgctacggaaagggtaacataaatctcggtttttccttcattttacgagccgaaacaaatggccatcataaatttcaggcatttgtctaatttaggtattccccttttttcatcattttttatttttggcaattttatagtccaaaccagtttccgcaccaaaacaaatgcctatttgagacaattcaacaatttctgactaatggaaaacatgtctggtccgataatttcgtatgccaaaaaacagtgatttacaacgacaaaaaaaagatgtacatgttttttgaataatttatctataaaatctaattttgaagcatttctattctactgagaaataatctaaaaaagtgatggcaaaaaggggcctaaatagacaaataggccaatttcctagaccgtaaggcaacaattttcttagtgtcaatcgaagtcttgctgtttagagattttataaacacatacaagaaaacagcaaatatacctatgaaacattgaggagaacgaaatgttaaattttgaaaatgccaatttttactatttttaaataatttaaatttttgtcggttgtcctaatgcaagaattttattacaagggcttttattgacaaaaaaaaaaaattcaacagctaccaaaaattgaggaattctcttataaatggggaaaagctgttttaatttcacaactccttctttgtccaggttggctgtacaagatgaaggtgagcaacctgaaggagttggacgagctgatgagcgagcaaagctataagaactttttggctgaggagagtaacaaagatgacgagacgcaacacttttag

SEQ ID NO: 53991 - DNA, 760 bp, Heterodera glycines
  Genomic contig location: Contig_ID=SeqID_23281; Location=170..929; Strand=-
  SCN-specific regions: Sequence locations=1-297,319-339,361-441,464 -569,591-658,680-760
  Gene Ontology: Mol. function=protein binding; Cellular component =cytosol; Biological process=anti-apoptosis
tcctggttctggcaatgaacggagcatcgaacttcaatattcggaggccaaagtgattggcaacggttcatttggagttgtctatttggccaagttggtgtacaacaacgaggacgtcgccatcaaaaaagtgttgcaggacaaacgtttcaaggttccgccaaatgttgtgtggattggactggctggggtggtatattagaactgatgacattttttggtttaagtggcataaattttttcacaaacgaagagtgaccctattggtttgcaattttttttttgaaaattttgacgaaaaagcaaaattggcaaattaaataacattcaaaaaaaaggtttaattgtaagattttatttgtcaggctaactaatccagtaaatggactccttataaaaaaagaacacgaaattgtcgcaatccaagaaattatctaaattaaagggaaataaggtgaaaactacaaccatttttttggttttattaaaatttcttatgaacttcttcctaattgtcctcgattcgtcaatttctaccatcgctggctaaaaatttttggaattgatggaatttttataaataattttttgtgtagaatttttttatctcttttccagaacagggaactacaaataatgcgaaagcttgaccatcgtaacgtggtgaagctcaagtacttcttctactcaagcggtgacaaaaaggatgaagtttatctgaatttgatcctggaatttgtgccggacaccgtctacagag

SEQ ID NO: 53992 - DNA, 1551 bp, Heterodera glycines
  misc_feature (1202)..(1203): n is a, c, g, or t
  Genomic contig location: Contig_ID=SeqID_23285; Location=28..1578; Strand=+
  SCN-specific regions: Sequence locations=1-291,314-539,575-1231,1253 -1523,1545-1551
  Gene Ontology: Mol. function=protein carrier activity; Cellular component=cytoplasm; Biological process=protein-nucleus import, docking
atggccatccctttgaaggttgaaggtaatttaataatcaaaatatttctaacatagacattttggataaataaaaattacttattttgttagtgctcaagtccgacttccaaaaatacatcatcgagttcaagccgtttttgttgacttcgttggacaaccacgaggacccgcaggtgtgcattgctgcaattggtgtcatttccgatctttgccgggcgttcgagcagcacattgcctacgtgatggacgagattatggagaaattgcttggcatactccaagtatggcattaaatatatataatatttttggtttttttttgatcacattccattgatagcattttgtcgtttgcccctaattttcttgtttgtttttaggacccaaaggttaaaaggactgtcaaatcgcaggtgctcaacgcgtttggcgatgttgctcttgctttgaacgctcagtactcccggtatttggcctccaacatgaaatggttgtcggatgcaattgcggctgctcaaataaccaacccggttttgttaaatttattttattaaaacagttatattattttgaattcaattgttagacgaacatttaacaatagacgacaattttttcaaaaaatgcttgtaaaaacacacacaaaattgctaaccacaattttttttttaacaggacgactatgatcaggtggaatatgtggaaaatttgcgtgaaagttgctgctacgcattctccggcattgtccaagcgatgaacggcactgacgagggcaaacagcaaattcagcacagcattcagccaatgctgcagctcattgtgctgatcgccaattcgcagcccagtgcgcccgagtcattgtgcgcaagcgcttgtgcactcgctggcgatctgttgcacgcgtttggtgtccaatttttgcccgtggtggacgctgccgactttggcatttctgcactgatcaccaagtgcaagaagtccaggcagaacaaggccaagaccattgccaattgggtgagttcaggaagagttcgtctcaattaactcgacccttctttctatggcaatactgctgaatatgttaaataacaaaacgattgcttattacattttcttacgctttttgggagtttcggttgttgaagcctaatttcattttttttaaacaaccaacaaaatgccgcttttgggaatattgnngtcagaaaacttaatggatatttacgcttaaaaatttggccatgattttgtgtttgtcttgattttttttttaattttcaggtgaccagggagttgtcacgggtcaaacggcaggctgcgggtcaatcgtaaaaagatgtcatctcaacagcacataattaattcgaatcgtatactatcattgttttttgtcattgatttatttttttgttttcgtttgtcggccgttgttttttatatctgtcgtatgcgccgccgccgttttttgtttttgacaaaaattttttgattttttaaaagattatttcatcaatcatttgatatagtatacttatttatttgtccgga

SEQ ID NO: 53993 - DNA, 776 bp, Heterodera glycines
  Genomic contig location: Contig_ID=SeqID_4310; Location=4768..5543; Strand=-
  SCN-specific regions: Sequence locations=1-127,149-776
  Gene Ontology: Mol. function=calcium-dependent phospholipid binding; Biological process=vesicle-mediated transport
aacttgcgcatttgtacaaactgagggaaatgccaaaaatggtcatcgaagttggggagcacctggacaatgtctctttttgcgaattttttgtgggaggagagaagtcttctgtccgagtccaacactttcatctcttcaaaggtgtcgtaaccaacgccgatcacaataatggacaggggaagagcagaagccgaaagatggggggaggacacggtaagtggggaaagggcatacggtatgaatgctgagcagaaaatacggtaacagagatgagtgatacggtgaatatgattgaaaggagaaaccgtgcaggtaaacagcctgtaaataccttcacaatttcttccttggtctcctcaaaatcggtgatcgccccatcggtgacgatcagcaaaacgcagtagcgactgccattttcgggcaatgccgcggcacggcgagcggccaaacgaatggtcggcgtgaaatcggtgggcccactgaaagcaattggcagtgagaagcgaaaacgaaaagcaacagaagcgggtgggttggtccacctgagctccacgtgtgacagcgcaatggcatacgcctccaaaagtccgtcgacgccgcgacagcgcgggtcattgacttccaagttctgaacgaaacgaattggcacgaggcgaggaacggacagacataagatggatttgatgggtgatcagtttttgtttgatcaacaaatgatcaatggtcagtttcttattgataaatggaccaacaatttggattaacaatgtaat

SEQ ID NO: 53994 - DNA, 1458 bp, Heterodera glycines
  Genomic contig location: Contig_ID=SeqID_4310; Location=4447..5904; Strand=+
  SCN-specific regions: Sequence locations=1-949,971-1388,1412-1458
  Gene Ontology: Mol. function=transporter activity; Biological process= lipid metabolism
atgaaggaccaatcgtcgcttcaccgcttcgaccacagcaaccgcccaaaccaatacgaaattgcgatcggagccatcgccgaaatatgccaacattacagcaaaaacaaagtccgatcgctttttggcatttccgctaatcacttttttcagcttttcaatgcttatggcttcggtgcccgaattccttctttggatgacaaagtgcactacaacttcccgctggtaaattatcaaactaatgataacaaaagtgtaataacagacgaacattaacaaataccgaaactgatcgatcaatcacttactttatcagcagtaattacattgttaatccaaattgttggtccatttatcaataagaaactgaccattgatcatttgttgatcaaacaaaaactgatcacccatcaaatccatcttatgtctgtccgttcctcgcctcgtgccaattcgtttcgttcagaacttggaagtcaatgacccgcgctgtcgcggcgtcgacggacttttggaggcgtatgccattgcgctgtcacacgtggagctcaggtggaccaacccacccgcttctgttgcttttcgttttcgcttctcactgccaattgctttcagtgggcccaccgatttcacgccgaccattcgtttggccgctcgccgtgccgcggcattgcccgaaaatggcagtcgctactgcgttttgctgatcgtcaccgatggggcgatcaccgattttgaggagaccaaggaagaaattgtgaaggtatttacaggctgtttacctgcacggtttctcctttcaatcatattcaccgtatcactcatctctgttaccgtattttctgctcagcattcataccgtatgccctttccccacttaccgtgtcctccccccatctttcggcttctgctcttcccctgtccattattgtgatcggcgttggttacgacacctttgaagagatgaaagtgttggactcggacagaagacttctctcctcccacaaaaaattcgcaaaaagagacattgtccaggtgctccccaacttcgatgaccatttttggcatttccctcagtttgtacaaatgcgcaagtttttgccgccccatcgatcgctgactgagcaggaattggccacagcgaaggccaaactggccaaggaagtgctgttcgaggtacccgctcagctgatcggctatatgaaagtgaattggcaaaagggcgacaaaagagacagaaaattggaccatttcagtcaaaaggcatttgtccgcgaccgcccgacgaccctttcactgcggtgaatcaatgcgaaacattggcacaacgatttatgaaatgggaaagtggtgaaagtggcggaacagaggggacggcacaacagcaaaggagaagcagcagtctgaagagcagcaaagagatgctgcgggcaatgcaacagaaaagggcatccgccg

SEQ ID NO: 53995 - DNA, 497 bp, Heterodera glycines
  Genomic contig location: Contig_ID=SeqID_4311; Location=63..559; Strand=+
  SCN-specific regions: Sequence locations=1-156,178-312,334-364,395 -474,496-497
tttgtcgcgtccgtccatttctttgctcttcccatttctatggagtcccgcacctcaaatttgtcagcttccatccatcgccacggcgattatcagctgcgattggcccgctcttcggcctatgtgcgggcgaaagtggcgccaaatttgacgaaaaattttgtaagaaataacaaaaagctgaatatttttagtttagcaaaaatgtccaaaatgtctggtgatggtggacattcgactgcacgccaaatgcccagcggatgcaatttaccaaccgtaccaatgggttttggacccggaaagatggtatgtgtgaagaggaagcggacgaggcaaagccggacggacggaagagggaggtgaaaagaaggggaagaaggagaaggagaagaagcagcagacgatgtttgattactttttgggataatcaataaaaaaacacactgatcactcttggcattatgttttattgccaataataaacattcattcaaatt

SEQ ID NO: 53996 - DNA, 178 bp, Heterodera glycines
  Genomic contig location: Contig_ID=SeqID_4311; Location=2199..2376; Strand=+
  SCN-specific regions: Sequence locations=1-178
atggaggacagcctgtcgaagggattggcacagtatcgtcaaggggtcggtccacaaaattcgaaaatccgccaatcgaagtccgctcaatgttcagaccatcaactacaaccagctgtaccgcaactggataacttccaacgattgggacaagcgaccacaaagactgggggcaatt

SEQ ID NO: 53997 - DNA, 512 bp, Heterodera glycines
  Genomic contig location: Contig_ID=SeqID_4312; Location=696..1207; Strand=+
  SCN-specific regions: Sequence locations=1-512
atgtgttccgctccaactcgcgctattccgagtcccaattttctcccaccgttgtgcccatcggaatgccgtcgaagccgatcagtgtccatcgaccgtattggacttactccgcctattggccctatcgataccatcgaaatttcaacacttacgagtcggttaatattattgaccattgctttttgttcaattgggcaacaaattcagcaatcaaatcaccgattccttctattggcattaccctttccgcctttggacatcctacaaacacaattggtggccaatttggccaattagtacaattaaatggcaattttaaggtaccaatacgacagcccctattactatcgccgttaccatgacaattacaacattttctacaacactgaactgatgtcatacggtaacagagggaaacggttacaaaaagaggaaaatgcaagtgactttcaggaaatcggtcaaaactgatggagaatttgtaccaaggaacgccgatcacacaatga

SEQ ID NO: 53998 - DNA, 781 bp, Heterodera glycines
  Genomic contig location: Contig_ID=SeqID_23287; Location=381..1161; Strand=+
  SCN-specific regions: Sequence locations=1-107,136-304,342-534,556 -628,650-728,758-781
atggagcgcgacagaccgtgcgaaccgctcgtcaaatatttgcaggtttggctttcggcacagttttttttttgttcattgtgattgagtaaaatggagagataccgtaataaatatttttaagattttttttttgcgatttttttttcaaaatttaccgttttttttttaatttttcggggcgaaattgtcgccccaattcctttgtatttttaaagttttggcttaataatttggcaataataaatgggtgttggttgtgaacatgggctggccaaggatgacaggataagacgccctaaccaattaaatttattaattatttttaagttttttaatttgccaggaaaaaaacgccgccggtgtgatctctgtgcccggcgcagttgtgtacgtgctgaccgatacgccgatcacgcagaagctggtcaaatttttcacgccacgcctttgtcccctgctgacaccgacgcccaaccacctcgtcctggtgctcaaactgactgcccaaccgaccgtgatgggcggtgccaacagcggcggcggcggcaatgccatgacggcagcgccaacttcgtacggactgctcagcgcgacaatggcaccgccaaacttgacgacggcagagatgaaaaaggagttggtggacaccaccaccatggccatgatgacgacaaacagtgttgtgaaaactgaaacatggaaagtggtggggggcgaggaaattgcgccaccaccgccgccgccacaaccaccatcaggaacagcagactacacatga

SEQ ID NO: 53999 - DNA, 1234 bp, Heterodera glycines
  Genomic contig location: Contig_ID=SeqID_23288; Location=64..1297; Strand=+
  SCN-specific regions: Sequence locations=1-430,469-602,624-965,987 -1093,1116-1135,1158-1234
gcgtttggagcattgcggttctgatttttatgcatgtgttgaacaattgagttcaaattttccatcttttccacaaatccgggaggaaattgtcgaaaaggtgaaaaacaaataaaaaaaacattaatattgtgtccttggttttaaggcttttaaaccatttgaaattatcgttttctaagggaggatttatttaatgaaaaacattgaaaaagaaatatgaaaaaaccgggaataagttcgggtcaacaatgaattaaaaccgaaaataagtttggtcaaatgaattagaaactggaggataatttgggtcaactaatatctcagagcattttgaatgggttagtgcaattagttatttggaaatgatttgtcgccaaaggcaaagaacagaaatgacccaccgagacatgacatctcagagcctccgtttaaaaattattttagtatcaaataatatttttaattgtttgcagactctatccattttgtccaaaggtggtggtcaatgccgtaacattgcatttgctaaaattctgttgccaatttttgcttccattggcccaattcaaagggcagaacttatcagcagaattatttcatttgattattttgaccaaaattctgaatccatttccatttgtggtgcgcttggtcaaacaaaattgcatttacatcagctgttcctatttaaggaattggtttccaccacaaaatttggtaatcttctgacaattttttctaaatgcaaagctaaaactaaaatttagatttacggaattgtcaaaattgaaaaagactcatttttaaaaacaaaaattttattctaaaacaaaatcgttaaaattggtcaataaaatctatgtttttttaaaacataaaatatttcctttattttatacagatttagtggaatctagagaggaaatctttcaatttataatgcgaattattcaaattgcaatgaaaaggggacaaatggaaaggtggcgccttttttcaatggctggcaatgctttcggtgtgttttttttttttgtttatattcaagattaatttacgcatagtatttaatacggatattagttgtatcatttaattttttttttttttttggttaaatttttttgattaaggaaggttttgcatattttgaatttttcgagatacacgcatattttgcatttaagaatttttagagtatattctggcatttttgataaaaattaattaa

SEQ ID NO: 54000 - DNA, 109 bp, Heterodera glycines
  Genomic contig location: Contig_ID=SeqID_23290; Location=103..211; Strand=+
  SCN-specific regions: Sequence locations=1-109
cccatcggcgccgtttgccgtcgacactcagcgaattaactcagacacaacgatttggactcatttgtcagcagagggccctcaaaaagcgacgatcgtaatttgaaaa

SEQ ID NO: 54001 - DNA, 488 bp, Heterodera glycines
  Genomic contig location: Contig_ID=SeqID_23291; Location=114..601; Strand=+
  SCN-specific regions: Sequence locations=1-24,47-99,121-149,171 -277,299-354,376-381,415-488
atgaaagaatggagatttgaggttaagaaacttttaaataacatacctaggtaaacattttgcctatttggtgcatttgaataattatttcttttaacattttttcttttctcttattcagaatgcttacaaatggcatcctttaaaattacataattcattttttagtagatcaaactctataaatgtctgacatttggaaatatttcgacaaatcgctgaatgataaagcaatgatgaattttgaaatttttcatataatctatgcattttgatgaaaatttttggaatttttcatttttttcaaaaaaaattcacttgtgaaagttccggttggtcccggtcccggcttttctcgcggtcccggtcccggtcgaagactaattaattttaaattaaaattatcatttttttccaggaaattaattgacgtaatcgtaccaggcagttacatttaaccgaccgaacatttgattaaaaatggataa

SEQ ID NO: 54002 - DNA, 813 bp, Heterodera glycines
  Genomic contig location: Contig_ID=SeqID_23294; Location=493..1305; Strand=-
  SCN-specific regions: Sequence locations=1-34,56-114,136-151,180 -200,264-543,590-596,619-755,781-813
atgttggaacatcttggaattttcaataagacagtcatcggattttctgcattgggctatgaaatcatgcgcaaaaatgacggcgttttggatttaaacaaatttacgaaattgaacatttcaatggtaattaaaataattttaggattgctattttatgaaaattaaaatttttataagagaatgcttaaaaaaaatgcaataaaaatttaaaaaatttcaaaattctattaaacttttaaatttcctaaatataaatttttgagttattcaattgtatctcttctataataatttcaaaatgtgaagaggcacaaaaaaagttttttttttaaacagatttgttcaattctttacggtgaaagaaggagcgtactgtatgacagacaatcattgacaacgtcctttttacgtcataacacatttgtcatattcaacatgccataccaaaaatcactcaaagaaagggtacggtaatagtacacttaactttattataaataggttacctttttctcatttcattgaaaatcttagctatgtttttaagcaattaaaatttaaggactttataaaaatatttttaattcggtcgatgtttataaagattttctccaattgtaagtgattaatactagaacccggaatttttaaagtaccgaaaccgggttggtttagccatttgaccgggaccgggccgcccggtccaaaaaaaagcccttttaccgcgagtcgcgggcccggtctaaaattgtggccgggcgcccgccgggcccgggctttttcaaaatttgtgggattttgattaataaa

SEQ ID NO: 54003 - DNA, 1052 bp, Heterodera glycines
  Genomic contig location: Contig_ID=SeqID_23296; Location=383..1434; Strand=-
  SCN-specific regions: Sequence locations=1-1052
atgaggaatgtgccacggaacactcgtggcgaaatttgtgaaatgcgcttcttgccgctggaggacacacagcggcccgacttgttgatggaggtgctcatccagcatctgctagaccgtgtgctggacggtcacccgccgccatccctggttggtctgcagctgcacccaccaggctttgaccggccgtacgtcatccgccttcgcccgcccgagcagaacaacgctgcggcactggcggcagccattgagcggctcaatgagcagtcggcagccggcattgacctgtttgctgggacaacggtcgccaaagttctggcggtgtggccactcgagccaattcgtgcggacccacaaagaggaggtttgttcttcgattttcaagcacattacgttgaaaaaaaaaaacaggtggctgtgatttggaggcggaacaccatgcttcgcacaccgtgcaatcattggtgcgtgtcgttaacccaaacgaccgtctctgcctggcgcgtgccgtccttctgggtcttcgggaccgcgaaacgagaatggctggtggcggtggccgtgcaacatttacggagtacgcgcgtcatcaggagcaacatgggcgtgacgcagaagagctgctgacgcgtgccggcattccccttgacaaagggatgtacacgctggtggacgtggctcgactacagcggatgttaaacaacacaaatggaattggccaaatccgcctggcggtgtttgaaaaggagcgggaataccttattgtctataagggtcaggggtaaatttctgtcttaaataatggatatcaaattttggtctaattaaagcatggcggccaaattcaatttgtgcctgctgctggagcgcggccatttcaactacattggccgcgttgaacaactgttcgatgtgcagcgctactgcatcgactgtgagcggcgagcgcacttgcgctaccacttctctggttgtaaggtggtgtgccgcctttgtttgcgatttgggcccggatatccgtgccaagcacaacaggtatttttcgaaataaa

SEQ ID NO: 54004 - DNA, 516 bp, Heterodera glycines
  Genomic contig location: Contig_ID=SeqID_23298; Location=819..1334; Strand=-
  SCN-specific regions: Sequence locations=1-296,328-516
aaggaattcctgatcacaaaaacgcatctgtccgtttgtgaggtgccgattgtgctcggcttcggcacacgaccaccggcatataaatcattcaatttaaaaaaccatttaacatggattaacgacactcaagaatctcttgtcgggattaaaattggatgcgatattggtcttgcttatcgtaataactatgtaattggaagcgcaatttttcatcctcaacagcagcagagcggtggacagagtattctatatccatatttcgcgatttatgtcaatatttccatatttgtccatattttggcatttttccaaaaaacctttattataacggcccccatcaggtaaattggcatttttgacccctaaagaccgaaaaaatttcagaaaaagacatttttagcaaattttgtcgaaaatattgattaaatttaaattttcttgaaaattgggtaatttatattaaaaataagcaaaaacgtgaaaatttcgtaaatttgatgggaatacaataaa

SEQ ID NO: 54005 - DNA, 335 bp, Heterodera glycines
  Genomic contig location: Contig_ID=SeqID_4314; Location=2145..2479; Strand=+
  SCN-specific regions: Sequence locations=1-6,28-161,183-335
atggaagaggatataggcggtgaggagagcgacaacgacaccatcgacttttttgcggacagcgttgacgaaattatggaaaagtatgtttcaaaaaaataaattggctttgtgataaaaatattgtttcaacccttaaaagaatccatcgatcggaagagaaggtgaaaaaatggatgactacgcacggccgcggtgaagccaaggcgaccaacgctgagcttttgcctgctgcggccccaactgttgagaaaaacgattgggattccagcaatagtgagaaggatgaggatgagccaacatcaacggtttacctagaccgcaaaaaatcttag

SEQ ID NO: 54006 - DNA, 1080 bp, Heterodera glycines
  misc_feature (112)..(112): n is a, c, g, or t
  Genomic contig location: Contig_ID=SeqID_23300; Location=598..1677; Strand=-
  SCN-specific regions: Sequence locations=1-238,261-445,467-1080
atggagttgatcaacaccattcttgacaaaatgtacaatgacccatcctccccagcggcgtttgcaggcgttaccgcactgtggaaagaggcgcggaaaaagattaagcatntacgaaaagatcaagtgcagagttacttggatggacaccgcacttacacattgatgcgcccccggcgtgtgcactttccgagagccaaaactgttgcagctgggtttatgaccgatgtgcaagtggatttggctgattttcaagcgctttctcgtcataatggaggccaccggtacctgctcgtagcgattgatgttctctcaaaaagattatttgtcatcccactgaaaaataagagagccgaggagatgttggaggcattcaagaagcttattgaccaaatgcccatggtcccccaccgaatattctccgacaaaggcacagaattcaaaaacagactactcaaagaatttttcgaggagcaagagattggcaagcacgagcccgtccattcgtcagtgaaagcgtcagttgctgagcgcgccatccgaaatgtaaagcaacgattatacagatattttgcgcaaaaacagactctcaactgggtggatactgtgcagcaaattgtggatgggattaacaatgcaccgtctcgtgttcatgggatacgaccaattggcgtgaattttcaaaacgcacagaaggtatggaagcgaatgtatggcccacaatcatttgtcaaaaaatctccccgcttccgtaaagacgattttgtgcaaatgagcagagagaaggggcagttcgagaaggggtacctgccaaattacggtgacgaaatccttgaggttgaccaagtgctgaagacggtacgtcccatccgttacaaactgcgcgatgacaatggcgaaaagttcaggggtaccttttatgagcaggagttggcacgcgtgcgcaaggatgaagagacaagctatagaatagagaaagtgttgaagaagagaagaaaaccggatggatctactgagatgctcgtaaaattcataggctatcccgaaagggaatggattagtgaatcccagcttgtataa

SEQ ID NO: 54007 - DNA, 543 bp, Heterodera glycines
  Genomic contig location: Contig_ID=SeqID_23301; Location=1623..2165; Strand=-
  SCN-specific regions: Sequence locations=1-327,349-393,415-543
atgggcagaactacagtgagggtacaacattacatgaggtaagtcatattgagctaatgatataaaaattgaaaaaatgtatcatgaaataagttaaatagattcttttaattaattatattgccatattatacgaatagaaaaaatgaaaatttaattaaaggacaaagcaatacaaggaatgatattcattattctaaacacaaaagttaaattaatagatgctcattgatcagatagtttataatagggttcagccccaagctttcggggagcaaaatgtcgggtacggggagtaaattccccgaaataatttgtcggggatggctgtagaaatttaaaaaatgtcggggagcaacaccttcgtcggggaggaaattttcataaaaagtctaaaaaaaatatataaaaaatccagaacaaaaaagtcttaaaactcatttaaagatacttccatcttatttcaagtgcaatttacgactttcgtaatttcatttcccgaaacatgtcggggctgaaccctagtttataatatcaaataaa

SEQ ID NO: 54008 - DNA, 1544 bp, Heterodera glycines
  Genomic contig location: Contig_ID=SeqID_23302; Location=192..1735; Strand=+
  SCN-specific regions: Sequence locations=1-78,100-156,181-332,365 -391,413-639,661-690,712-724,746-809,868-977,999-1544
atggcgcttgacgcaaacaaaaatactcttatggtgtttctaatccctacaggcgccccatgccgagttcgtcccaattgctgcaccacaatgccaaacagtacatgctgtgctgccttgccaccaaaacaatgctttattggcaccaccactgttagctgctgctgctggtgctgctcaacaacccattccaccgctgccgccaccgcattcatcggccatgctgttgccagtgccaatagtgccaacaacatcaacaccagtggctgccatgcctccgcttcggccgcaacaaattggtgatggtggagtcagcggtggcgattgcgaaaaatcacccattaataataataacaacaaaattggcggtaacaatggcgattgttggagcacagctgtgacaggtgtgtgtcggaggactctcccaatatttcaggcccgtaggcagaaacaacaacaacaaaaaaattcggaaggcgggaatccgaagacttttttttccccaaaaattcgtgttattttaaaatttacagcgccatgcagaaaaatcaggaattttggtcgtttttttgccaaaaaatgacaatttggccattttcgtttcaatgttcaaaaaatatgattaattgaacagctaaatttttaaaaccacaattttttaactaattataagcaaaaaatattatcaaacttttgaaaacgccgaaaaaatgataaattaagagatttttctttgtttttaacagcattaattaattctctctgtttttcaaaaaaagatttaattattttagcttattgttagatagaaaaaaaattattattagaaaattttttttttttataaatttttgtaaaaatattttaggttgggaacaggcggcgatcatcaaaaacaaaatcggtttgctgatcaacggacgctttcgcattttgcaaagcattgcctccggctcttacggcgaaatttttgcggccgaagacttacagcagcggaggcaccgagtggccgtcaaatttgacggaggtcattataatgctaatggacccaaatttagtcgcaaatttcgcgctatttttttgttgtatttagcctgccgcgacaaccacttgagatacgagtatcaggtggagttttgtgttcttcgcttgaatagggcattaaatttaaaaatgatttaatatcgcaaatcaaaggtgtacaagtctgctttgtatgaggatgggaacggcaaagtggacggctttccacaagtgtattggtacgggcacgagtatggccataacattttagtgagtcaatttgttcggcgaaattgaattgtgcatcaaaggcttgctgattcgcggaatttctcaatttttgaataatctattcccgacgcccgacatttgcggcagcggtccgacattttgcgcctttgtccaaaatcgggttcaaaattatgttttttcaatccctgatcgcataaacagcattaaataagcgattgaaaatgattgtagccgatcatttgatcttcaaaaatttttttgaaaaaata

SEQ ID NO: 54009 - DNA, 980 bp, Heterodera glycines
  Genomic contig location: Contig_ID=SeqID_23303; Location=17..996; Strand=-
  SCN-specific regions: Sequence locations=1-43,72-222,245-281,304 -422,519-881,904-980
atgtcgggtcaactcagagcaaaaataccgttacttaaccgagtgttaataaaagaaatacagaaaattaagtcaaaaatagaagaagggaattttgagtatgataaaaataattttgatgattgttctcgaatttttaataaaactaaagaaatcattcaaagaattgaaccaaattttgaaaaattaaaaattttgcaccaaaaatggcaaaatttaatgaggcaaatgaataaaacagaatggaacagtgaatggaaactacaaaaaatattccgggaaaagcataattatttaaaaacaattaaggaaattgacgaaatccttgacacaattaaggatataaatttggaggtaaaaagaaggctgaaagcgctcaaaccaaattcccttcagaatccgaccaagagaatgaatcaattgatgaagagcaattaaacgatgatgaagaagccggagaagaagaagatgaagatgaaaaagaatatgatagtgatcaagaggacgaatcacaagaaatgcattcaagtgatcaaatacatcgtaatcgcataccatttgctcatcaacgatcaagaataaagcttccggcacaaactctaactcatttttcgggaaaattttcccaatggcccagtttttgggacgattttaaatcctcagtacataatgatccgaacatggaaaatatacaaaaacttaagtaccttcgtggactgttacatgatgagccttatcgaattgtatccccatacccccttattaataaaaattacccaataataataaaattgctgaaatcacgttacggtaaccccgaattaatcagagaaaatcttcacagtgaattacgtaacttgaaaaggcctattgaatccacgattgaattaagaaaatttattttactaattgatcgaatgattttgcaattaaaatcccaaggcgaagacataatagaaggcaaattaagcagtctatag

SEQ ID NO: 54010 - DNA, 529 bp, Heterodera glycines
  Genomic contig location: Contig_ID=SeqID_23304; Location=1057..1585; Strand=-
  SCN-specific regions: Sequence locations=1-258,280-529
gacttcaatcactgggactctattctcctgcgtttcaatcacccggactcagtttttatgcattccaatcaccgtgactcattctcctgcatttcaatcactgggactcaaccctccagcatttcaatcactgggactcaattctcttgcattccaatcactgggacctaacctcacctggtccttcggcatcgcaatcatcgagactcaattctgcgatattccaatcaccgggactcaattctgcgacattccaataactgggactcaattctccatcattccaattcccgggactcaatcccaccagcattccagtcactgggactctgttctcctgcattccaatcactgggactcaatccttcacttttcacggattcttcggcatcgtaataaccgaggactcagttctccgccattccaatcaccgaggactcaatccttcactattccaaacaatgaactcaattttacggattcatcggcatgtcaatcacgggacttaattcagacctgttcagcataa

SEQ ID NO: 54011 - DNA, 627 bp, Heterodera glycines
  Genomic contig location: Contig_ID=SeqID_23305; Location=647..1273; Strand=-
  SCN-specific regions: Sequence locations=1-264,316-453,543-627
atgttgatgcaggacaagcatcttgaaattttctacaacaacaaacaccatgaacacccacttttcagccgcttttcccagcacgcactgcgcaaggacggagtgagtatgtggcatggtggtgttgtacagtttggatgcatgtgtattaaattttttgcacggcgatgagaaaaaagctattaatgattctgtttcgctaaaaattaaatggttcgaccaacaccaccgagtgctgcagtcatttttggcaaattttaactcaaattttttttttaaatattacaaatttaaatttagaaattatattaatttcctaaaaatgccaaatcattctcttttttagctcctacttttttggttcattgaaagccatgcaggactaatcgtggcgcgagagttgatgggcgaactgttcgaaaccttcaaaatggacatggtattatgtattacaattatataacaaatagattttttaaatgtacttttaaattatacaaattcatttaatattatatattttttaacaaataaatttttttctgcagagcactggctcgctgtatgatgaaacgaataatggtatcgtacagcgttctggcaatggtatttaatgcaatgaataaa

SEQ ID NO: 54012 - DNA, 462 bp, Heterodera glycines
  Genomic contig location: Contig_ID=SeqID_23310; Location=34..495; Strand=-
  SCN-specific regions: Sequence locations=1-462
atgcattttttttgtcctcttctaatcaccgttgtacctcttttaatcactgctgtacctcttttaatcactgctgtacctcttttaatcactgctgtacctcttttaatcactgctgtacctcttttaatcactgttgaacctcttctaatcactgctgtacctcttttaatcactgctgtacctcttttaatcactgctgtacctcttttaatcactgttgaacctcttctaatcactgctgtacctcttttaatcactgctgtacctcttttaatcactgttgaacctcttctaatcactgctgtacctcttttaatcactgctgtacctcttttaatcactgctgtacctcttttaatcactgttgaacctcttctaatcactgctgtacctcttttaatcactgctgtacctcttttaatcactgttgaacctcttctaatcactcttctaatcgct

SEQ ID NO: 54013 - DNA, 421 bp, Heterodera glycines
  Genomic contig location: Contig_ID=SeqID_4316; Location=29..449; Strand=-
  SCN-specific regions: Sequence locations=1-235,329-421
atgggacactatgagcgattgcgcaagtcgtattcgcgctgcaggcgcgtgattggcaatttggagctgacgcacgtcgacgagcacgacgtacgacgagacgtacagcgacaaaacaaccaaagcgcgtcggacaaagacggagctgcttctttcgcgcagcgtctcaccgaccgcgcgccatttcatttcttggagcatttggaggaggttgggaattttggaaaattttgccattattactattaaaaaataaagttatatttaatatttatcgtatttttgatcacttacatttcatttaaaattaaaaatttattttaattttcagatcaccggttatttgctcatttacaatgttaaaattcgcgaaatttcgttgccaaaattgcgcttaatttggggcgcgaaaattgcatga

SEQ ID NO: 54014 - DNA, 576 bp, Heterodera glycines
  Genomic contig location: Contig_ID=SeqID_4316; Location=1618..2193; Strand=-
  SCN-specific regions: Sequence locations=1-399,437-443,514-576
atgagagttcggcattttctgcagttggtcctttaccgacactttgtccattccctaatcatttttctgatcatcactgattggtcatcaaatgcggcacgacgtcgcggcggtggaagcacaacacagcggaagaaacaaggcaaccaaaaactcacaacaaagaagtacggtgctggaggcgcaagtcgtacggtagcgcggaagggcggcacggaagaagtggaacggcaccaattgagaacttgtgagttaatgggtcgggcttaaagagtgccgaacagaatggcattttcatttggcgacgatttactctcccacattcattccatcgtccaattttatagggcgaaatgggtcacatattgcgaataatgcaaaatttcttatttttccaggaaaatttgaatttgaatattttgataattatcttttttagtcagtttttaaagataattaattttataaattttcttaaattatttttctgaaaaattaaatttttattattttcggggcttaaaaacagcagcgagtgggataagcccagcacatttttgttcaattggcaataaa

SEQ ID NO: 54015 - DNA, 1081 bp, Heterodera glycines
  misc_feature (69)..(69): n is a, c, g, or t
  Genomic contig location: Contig_ID=SeqID_4317; Location=1..1081; Strand=+
  SCN-specific regions: Sequence locations=1-163,200-721,743-747,805 -959,1079-1081
tttcacgaggacgtcaaagtgattagtcctcctcccctactagcggattgtcacgctgatgaaaatggnaattattcttacgaatatgctgttgccgatgattcaccgccgggcgttgaattcattggacaaaaatttgatgaaaacgaggcaaagttagatgagaaaaatgaagaggagaaggaaaagcattggatgcgcgagaaaggttgggatgggactagagcggaggaatcggaagaagatgaagcggaggcatttggccaatcgagaatgattgggtgtggacaaacgatgtttcacagggtaagctgttttctaagagtcagtaatagtgagtggtttatttcatttgaaattataagcatgttccttgatttttaaggtaatttcatttccgcttatttgaatgcaggttgagtatggtcagcaatcgccaactgctgattggccatgggcagcgtccgtacggatagcttgcgaaacaaaaggctcgaacaaatctgaagttcaacaggtgtgtaccggcgttttggttgataagcagcacattgtgacagcggcgcattgcttttaccttccgattcatgaggcaaccaaatgcaaagggaatgaaattggcggagcagtgcccgagggcaggtagagttaattttatcataattcaattgccgtggcaaaagctgtggttgcattttgttggccaaaattaaaccatggtaatatatggtttaattttaatcaaggttttaaattataaattagaattgtataattattaatgtgtaaatattttatatttttcttattcagctggcaggtcccgtttgaatatgtgaaggtgaccctcggcggcaaagattggcagcactcatccggactaagcataaagtcattctcaaaaattaaaagctttcactcacatgcgctgaacgacgacataggcgtaattgaggtgcttaaaaattcaattaaattttaataatattttttctttttaaattcatttgaaataatttaatataatttggtttcaaaatgaaaatttttatttttaaaataatatttacttaaaaaagga

SEQ ID NO: 54016 - DNA, 1877 bp, Heterodera glycines
  Genomic contig location: Contig_ID=SeqID_23311; Location=160..2036; Strand=-
  SCN-specific regions: Sequence locations=1-489,511-532,558-656,705 -999,1039-1579,1601-1644,1666-1828,1874-1877
atggacaatgcgacaaaattaagaagggacagtagagatcgtgtacggaccggatccgtatacggatttttacggatccgtagtccgtaatccctgtttttttgggtcgatacagatttttactgactacggattttacagatttttaaatccgtaatccgtatctatgcaagtccgtaatcctgatactgatccgtataaattatgatacggattacggattttttttttctaacatttttaaggtgaaatttaataaattttgtgcagtcaattggaaaattttactaaattggaaaaaagcaaacgttttatgttaaaaactcgaaatctttacaatattgatttagatttcttggaaatttttatgaagttttacataagttcgttttgtaaatttttcaaaattatagatagttttaatgaaatctgataaaaattcatgaaatcggttaaaaagcgcaaatttggccgataaaatctgtcaataaattgcattttaaaatttttcccggcggcgtctagggggaaacggccgccccccccccccccccccgttcctcaaaaatctttttgggaaaagcgcgccgcaaaaaagtgggatgaaaagcaaaaattgagcattttttatttcgtaaaattaagaccgagattcgtatttataaatcattttttattgaaaaagaaaaaaaaattaaaaaaatccttatccgtatacggatccgtatttttcctggatacggattttacggatttttagtccgtaagtccgtaatccgtatgaatggctagtccgtaatcctagtcctgatccgtattttctcaaaatcacgctctctaaggacatcataatgaaagcaaaaaaaaaaaaaacgccaaatatcaaaaaataacacacattaaaaaaatgaatgaaagttttgctaaatttgattagattttctccaaaaaatgtccaaataaaaattaaagaatcatagggtcgattttcaattttagtttgttttaaaaagtaaagaaatgtaaattaattgtttaaatatttaagtctggaaaatttaccaataatttaacataaaaaaactggtgaaggacaacaggacattgttctattgcagaaattaactaaataatttttctcagaaatttctccatacaatagaacataaggggtcccgattctgtgagggaattcccgagttttcccgcgggaattcgtttccgccgggctctatttaaaaccgacttttttttaaaatcaaaatgaagtcgcatttcaaaatatcaatcgcgcaaattgcctcatttttatcatagaaaatgcgtgcagcagataaatgccatttttaatagggtaacaattggtgtaattccactgggcctttggtgcatattttggccagcacgggaggcatcactctgtcaaaattcggatccaacacatttgaaatgtaagtgagaaaatggcggtgttttgtgccagagatgaaagcgaagttgatcagtcccatcagttccacgtaccgtagggcacccgccgcggcaccgtaattgatctgataggaataaatagagaaaaaagatttaacaatgaataataattcaccaattcaaatatactaatcacataccctcaattgatatttttaaatttaattgaaaattccaactttcagatcttatagacatcctggattagttcctttctcacgtaactctcggtcctgcccttttctcaaaaaaaacaaggtcgggagtcacggcaaaatctctcgggattcatgtcagtcagaaattttcaatttttatctcgagatatcagttacccattaaattttttcagatgaatataaaaacaaaatccattaaaaaataaa

SEQ ID NO: 54017 - DNA, 920 bp, Heterodera glycines
  Genomic contig location: Contig_ID=SeqID_23313; Location=101..1020; Strand=-
  SCN-specific regions: Sequence locations=1-191,252-891,918-920
atgctcaacagccaatcgtcggctacggttgcgcatgccaacaacggaaatttggtgccattacggtaaattaattgggcgccaccattttttatgggtttttggcgttgttttccttagacatttcgccaacaaattgcccgcctggccaatttcgcccattccgcgcgagtgtcagtcgccggaagcggtaattaaaaaaaatatttttattcattttctcaatttaaaattgaaaataattttaaattcataaatgcaaattttaagaccaacgaatacgcgtcaatggtgcaaggcgaaatcaattgtggagctcaatttgaggccaaatttgatggctttttggtgccaactttggtcaagaaaagtccaatttttggttggtttttttgtttttggcgtacaatttaatgttaatgcatttaatttgggtcggggtcgttttcatacgagcacaagtttttggctataatttttttctttgccaaccaaatccaacaatcttggtatcattcggtagccctaagtgtcacctagtagcctgcaaatttcaaaaatttcgtttagattcaaaaaaggggccagaagaattcaaaaaaaaaaaaacaatgtaactcaatactgatttggcttaattttttttcgtttttcaataaattttgttcattttacacccctaaatttgagactttttagtgcctatttttggggtttttagagtctaaagcctagctatattggccgtccctatttatcactcctgtggcctggtctactggatattcttatgtgatttatttccttcttttctcattcaattcttttcacatatcggtcttttttgaacattttttaagatttttgttgcaaactggcatttttatcattaagtaaaaagacaaaaatttttaaataaa

SEQ ID NO: 54018 - DNA, 1082 bp, Heterodera glycines
  Genomic contig location: Contig_ID=SeqID_23314; Location=218..1299; Strand=+
  SCN-specific regions: Sequence locations=1-411,435-525,553-991,1014 -1082
atggattttgatgacgaagtttttgatccaaatttaaacatcgatgagcaaaacaacactgaagcggaaggacaaattgttgagagggaaagaaaattggaaattactgaacccccatcatcgcttagacactattttgtctatgtaaaaggacaaaatgatgccaaatgtcgaatctgttcaaaaaaactaggccggaaggatgggacaacgggaggaatgcttcgtcatttgaaaagtgcacataattcattgttcaaaaaatacgaaaaagctaaatcaacaaaaactgagacaaaaaaacaaacaagaacgagttcatcattcgcagggccaccaccaaaacaactccgcatggacgaattgcatgtagtgaatttatttactttttccattttccatttatttttagggaaagaaagcggaaaaaacggaaaaatcgccagaaataattgacgatctgcttttgcgcttcatttgtttgagctgtcagcctttgagttttaccgaacaaaatggattttcggattttttaaaagcagtctgtccaaggtaatcaaatttaaatctcaaaacccaaaataaattttagttatgaattgaaaaaacgggatttttttacgcgtaaaatggaagaaaaatatggccaagtcttttctggtatcaaagagttgatgaaaaatgtcaattatttttctttttccactgatatttggtcaaataagcgaaagcggaacagttttttgaggtattttaaagtaaatattagccaataaaattcttgaatagtttgacagtacattatattgatgaatcgatgactcgccgtttttttgtgcttgccactgaaccatttgacaatgcacacacaggccaaaatattgctgaatgtttcagacaattgttaaatcaattcgaaattcctaatgacaaggtgcatttggtggctacatgtcgtttcaatatatgtcatttcaatactcagtgaaaatgtgtcatttcaatactaaatcgtttcgattcgattcgtcgctcaattataacgtcttttcgtgactgccttatgttaaccgaaaatttta

SEQ ID NO: 54019 - DNA, 1206 bp, Heterodera glycines
  Genomic contig location: Contig_ID=SeqID_23314; Location=1523..2728; Strand=+
  SCN-specific regions: Sequence locations=1-350,372-377,402-586,608 -730,752-793,815-1206
atgtctgcatatggtgcgataatgtctttaaaacccctcctagactgggggataattgtagattgggggattaatggagattgggggataattagagcaaatacggtatgtcaaatccaataaaaatatcgaaaatggagcattttaactgagtattgaaacgatttagtattgaaatgacatatattgaaacgacttagtattgaaatgacatatattgaaatgacgtatattgaaacgaagtgcaccggcatttggtgcttagagatgcacagtcttctatgatttctgggatggaatcgcttgaatttgagcattttgattgcatgatccataaaatgcaattggtaagacttcctatctaatttttactgtcctaattaattttaatttatttttttcttaggcaattcgagacggaattgatcatcctaaaaagggcgttaaatcaatttgtgaaatgttacaaaaggcgcgtaatgattgtcgctgcaaaacaataagaatttaaccgaagtgccaatttccgagtctttttgtgaacaacaaaaagcccttggcatggcttcaaacgttttgttgcaggtgtcaactatttttatttaatccattttttataacaaggatgtctgcacgcgttggaattcatcatacattatgcttgaacgtttgtatgaacagcgccgcccgcttatgcttattaacgaagaatacaatgatctttctttacctgattttgagcttgtaaaaaacatttgccaggtcctttataataattagtcttattgatttatctaatttttaggttttaaaacccttccttatatttacaaatcaattatcacaacgtgactaatcgctttcgtcagttatttcggtctacaaatgccttcaaaattatctccgtgttaatggcgaagaaaatgagcccattctgagtttaaaaaatgtcataaaagatggattagaatcccgtatgcgagaacaccaatctaaaatgtaaattttggattcttatttgtcatatttgctaattataatagtttaagctttttgcgcatggccactctcgttgaccctcgtttcaaaaacaatcctaacattttctcgacaaaagaacgagctcaaaatgaagtgttattgcttgaaacagtaaaaatggtaacgaatccatcacgtcgagggtctgattcggaacaaccgaaa

SEQ ID NO: 54020 - DNA, 402 bp, Heterodera glycines
  Genomic contig location: Contig_ID=SeqID_23316; Location=261..662; Strand=+
  SCN-specific regions: Sequence locations=1-2,24-402
  Gene Ontology: Mol. function=cAMP-dependent protein kinase activity; Cellular component=nucleus; Biological process=signal transduction
agccttcacaaagctgcgcaacttttgtgcgaacacaaaatccatcggttgcccgttttggagcattcaaccggaaacattttgtacattctgacgcacaaacggttgatcaaattcctctatctttatgtgagtgaggggcgctgcccaattatttcctaaattattatttttttccctaattaccactaattccccccccccccccattccgctgctgcttcttcagatcaacgatttgccacggcctccgtttatggacaaaacgccgaaggaattgggcatcggttcatggggccacatttgcacgattagcaaagatacgccgctgatcgaggcgatgaaaatctttctcgccaagagagtgtccgcgttgcctttgctcgactcggacggacgggt

SEQ ID NO: 54021 - DNA, 808 bp, Heterodera glycines
  Genomic contig location: Contig_ID=SeqID_23318; Location=646..1453; Strand=+
  SCN-specific regions: Sequence locations=1-539,562-808
attataaagcaatggaaaacgaggaggagcctcagcttcatattgacgtgttgcttaacgttgcagaaaagctaattttctcggtaattgtcgagaacacttatcgttagctaagctgacaaatgcttcacttttagcctgacaatgactttcgtcttgatttgagagacccaaacgccgacatcgtcaattttatggtattctttcccgcatttgtaaatgctttgttcaaatgttttagttgaagagggtctcttccttttcagttcgctgggcccgcctgtcgttggtcctttttctcgcagtttcggaagctcacccaagtcagtgtcaactcggccgaactccaactgtacgcgccgaagccgattcagggcattcgcggcactctttccaacaacaaagaggcgagtggaccaatggcaaatggtgtcacctttgtccggccccccccccctccctttgcagttcttccaagggcccttcgtcgtcaccgatcagttcttttacacccttttctgtcgtggcattctccgacccaccgtcgtggacactttcttcatcttcggcaatgacgtcgtcaccttcgacagcgttccgtcttcttcggcctccataatgatgaacgattggagggaacaattggaggacggagaagaaacggaagagggagagattgtcgagccgatgcacggagacagccaatggcatgaagagaagtgcgaaagcaacttcggcccttgcgaaatatctttcactgacggagagtcgccggccgagtcgttggttcgtctgtttctggtcagag

SEQ ID NO: 54022 - DNA, 334 bp, Heterodera glycines
  Genomic contig location: Contig_ID=SeqID_23319; Location=156..489; Strand=+
  SCN-specific regions: Sequence locations=1-334
agtcattgctgaccgcacttccaaattggtgttcgcctacacaattgacgttatcaacccggaacgcgactgcgcctttcacttccctaccaatgaattcgtcgcacttttatgttacatcgccgcttgttgtcccaatttggacactttttcgttgtcctttttgttgcaaggcgagttctctgacgaagacttcaagcagctctcttcatggctgtaccgcaccatccaaagtgttctttcgcttcgttgctccattctctgcatcgattgcaatttgaccatcgaattccgtgcttttttccctgaggctacacttatggcacacttttaa

SEQ ID NO: 54023 - DNA, 1340 bp, Heterodera glycines
  Genomic contig location: Contig_ID=SeqID_23320; Location=1..1340; Strand=+
  SCN-specific regions: Sequence locations=1-411,433-746,768-1340
taggaggacattttagaatatcgaaaataacatcaatttgccaaccccattgttaagggattgaatattcgggagagacaaattgagacactgcgcgcgctgctgattaaacaccacgagttggcccgggaccaagaaaaagaccatttccacgccctgcaacagctgaagcaacggaacttggaggagcagcactagttggagctgaacagccaaaaggacttcaaccgaagggcgttggagcagaagacgaaagagcacgcgatgcagtccaagcagcagccacgggaattgaaagtagaaaatgggtggaataatacattaattgcttgttttgggatgctttttttacttaaaatcgacgacattcgtcttttaaggccaaggaaacgatcatccgaaaacagtttcgacaagcggtcaaaattcaaacgcgccaattcaaagcgtaccaatcccaaatgctccaaatggcgccccgggaggagcacagagaactgctgaaccgactgaaggatgaacagagtcggaagatcgcctcccttgcggaccaatacgaagcgaccattgaaacgatggtcacggaacaaacggtgggaatcttgtacaattatcacgcatttgaaagggggtgggattttgccggtggattacgccgagattagggccatgatggcataccatactttccaaaatttactgataatataaaactgggtcaatctgaaaaaaaattcgcttttcactaaagatttacattttaagatcaaattggacgcccaacaggaggaggacttgcgacagctgaccgaaaaactgaacagggagctgagcatgttgacggagtaccaggagaaacagcgggttgaactgagcgcacaaattgagcgcgagcgagtgcaactgcaggaccgcgtcaaccttcggcttgctgtgctgaaacagaaagtgggaccacaagacaatttagcctataattagttaattaaatgacattggaatccgttccattttttcgaatcatttttttgtaaaaataaatgttttttatcgcagatgaacgaagaaaaggtccattttgagcggaacagagagcgacagttggcgcagttgcacgaccgacaggcgcaagcgttgagtgccttctccgtcgatgagagacggaagaaaagttccatgggaagtgacggggggcggaacgacgcgtcgtccacaaatttgtgaattgggcccagcgggcattcgttgccttttctctccttttgtcgccttcaattttcaattgtttcgacaatttttacttatctttttctttctccaacgaatttttgtatgttttt

SEQ ID NO: 54024 - DNA, 96 bp, Heterodera glycines
  misc_feature (94)..(94): n is a, c, g, or t
  Genomic contig location: Contig_ID=SeqID_23320; Location=2002..2097; Strand=+
  SCN-specific regions: Sequence locations=1-96
atgtcccttcgcttcttcggtttccacgattcggtcagcgaagggaaatttctgtgggagattctcacgcaactgagagggctcggagttggancg

SEQ ID NO: 54025 - DNA, 205 bp, Heterodera glycines
  Genomic contig location: Contig_ID=SeqID_23321; Location=1397..1601; Strand=-
  SCN-specific regions: Sequence locations=1-205
gtcgccgctgttggccgcgactcgcgtgttggacgtcgctttctccgacgatctctgtgagggtgcctattacgaggacagtcgcgtcaccgcgttaaaatgtgccgacgacccggaattcgtttggtcagtgggcacttccgtcagggacatgatcgtggacagcaacgcgaactccttcaacaaaagcgaaagcaccgaataa

SEQ ID NO: 54026 - DNA, 476 bp, Heterodera glycines
  Genomic contig location: Contig_ID=SeqID_23322; Location=1036..1511; Strand=-
  SCN-specific regions: Sequence locations=1-76,98-165,189-275,316 -424,454-476
atgagagccgactttgccatttgcgcattttttgcctattttttgtgtgagacattggccggcattgcttactccaaaagcaataagaataattcatcaacggcatcggaatccgacttgggcacaaccaactctagcaatactgaaaaacagggtaaatgaattcaactttaaattttggcatttttacagtaataatcaacagacaaatatttttgccattattcgggtttcagggctttactttggacaaattttgaagttttaataatgacaaaaaattaataaataaaaaattcaataaaatataaataagccaagaaaatatattcgactcaaaaaaaataaatttccagactaaaagtccgacttattttgccataaaatcaaattttttttccccgtatttagaagatacgaacgaatcaaatgctgctgctgctggtggtagcggcgaagaagcgccaaaaaataaa

SEQ ID NO: 54027 - DNA, 1254 bp, Heterodera glycines
  Genomic contig location: Contig_ID=SeqID_484; Location=29..1282; Strand=-
  SCN-specific regions: Sequence locations=1-103,126-357,390-600,624 -1254
atgcaacatacaaagcgctatttgttggtccccgaagagatttatcagagtttggcaacaccgtcaccgtctgacggttcaccaattgagctggtccgtgccagaattaaacaaataaaaaataatgacgccataaatgaggcggaaagagcagtcaaatatgagcaggaaattaagcgtctcaacaagctcaaaaaggacgaggatgaacgtcccgtcggtgttaaattagaaaatttgagtgatgtggttgacgccatgccaaaaccattcaacattaaaagaccgatttttgtagctacgcgtcgccatctcaaggttgggcgtgcgcgaaaagaaaatgttgaacaattagaagatgatgatgatgatgatgaagatgattatgaaactccacgcgcgtcgagtacaaataaacgtcaacccacacaaatggaaatcttaaatttaatttataaaaacgcccaatctctgggggtgtcggaggaaggacaggtcttgagagcgggtggacggccatttataaccagcagtgtcgatgatattgttagtcacctgctgaataaggacaagcgtggccaaaaagagccaacagcattcaaagaatttattgaaagggcaaagcagaatcgacaattgagtaggtatttatttcccgaaggccaatccggcaaaggaatttataaaaacactttacttaagtttaaaccatccctatggatttgaaaaaatttcgtttgctcgagttcttgtacaaggacttaagttcgcctgtctcattcacgagcgttgaaccgcttctgaaagaggcgcggaaaagtcaaccaaaaattaatcgaattgatgtccaaaattatttagctacccaacgtacatacacactgcatcgccaggcaaagcggcgctaccgccgtttgccaactttggcacccggcttgcatactgaatggcaggccgatttggctatttttgaccgaattgctaaacaaaatcgtggctacaagtacttgctagtctgtattgatacccttagccgacaggtgtttgtcgaacccgtaaagaccaagacgagcgctaacatgatcaatgcctttgaacatatattcaaaaggtctaaatatattccttggaaggtgttaacggatcagggaaaggaattcactgcccgcgcagtgcaacagtttttccgcacaaaagacgttgaacacttttgtatgctcacttctccccaatttcatgccagagtggctgagc

SEQ ID NO: 54028 - DNA, 1359 bp, Heterodera glycines
  Genomic contig location: Contig_ID=SeqID_484; Location=2414..3772; Strand=+
  SCN-specific regions: Sequence locations=1-123,151-176,198-730,759 -1359
  Gene Ontology: Mol. function=general RNA polymerase II transcription factor activity; Cellular component=transcription factor TFIID complex; Biological process=transcription from Pol I promoter
atggatttaattcttgctaccgattggataaacaacgcttatcccgaaatggaccagcaggaccataataaggaaacgccaaaaaaggaccagcaggaccataacaatgaaacgccgaaaaaagaccaggaggatgaggaggagacgaaggagcctagctggatcagcctcattgacgaagagcagaagcaggacccgttcaccccaatttatgatgagccgccaagagcaagtattcaattttcttttttttttttaaacaaattggttaatttaggtaccccaaagacttgtgcttgtgcagaacgcccgcgcccgatcccgctcgtcgagcacttatgcaagcgcttcaactgtagcgcgcatgagctgcacgtgttgttccgaaacttggagaagcgccgagacattgtcgagcacttgcgctctgctcagctgcggaccgcccacctgcgcccttttgttcgaaatttcccggtgcgctgtaacgacctctccattctcgacgcccactcagtcccggcctaccgcggcttcttgggaattacggtactttttggcaatttggtggacataattaaagattttaggtacgaatgcattactacataaaacatggaatccgtttgcatcatcccaacttgccgtgtgtcgtagaatttggaggcggtgatcacaaaacctttttcccgcttgaaattctcactattatgttttagatgtttttcaatatttaattgttgttgtttttaaaataaatttgttgcgtaaaatttttgtccattttaatttagatgaaaatttctaactgtactgttatttttaaaattaattccttgaacacgcaacagtttttggctattgcacaacgtggaattaatacagaatataatccacgccgtttccacgcaatcatcatgcgaatccgatatggagcaaaaactgtggctgcactcatatttcaatcggcacgtgtcgtcctcactggagttccacaccctgatcaagcccaaaagtttgcagcaagggttctacgacgaattgaatacacgcaatgcagaacgatgacaatctatgagctacgtgtggtcaacattgttggagttttaacgtttgaccaaagaattcgagtggagaaactacaacaatctctgggtggcatctatgatcctacgatcttcccagcccttcggtgcaaattagataatggagccacgtgtctcatttacatttccggaaaagttattcttactggggtgaaaaatgtagaaaatttaaaaaattcatttgattacttgtctaaaattgttcctaattattttcggtaaattttattttctcgtaacaaaaaaaaaacga

SEQ ID NO: 54029 - DNA, 549 bp, Heterodera glycines
  Genomic contig location: Contig_ID=SeqID_484; Location=2687..3235; Strand=-
  SCN-specific regions: Sequence locations=1-549
aaataacagtacagttagaaattttcatctaaattaaaatggacaaaaattttacgcaacaaatttattttaaaaacaacaacaattaaatattgaaaaacatctaaaacataatagtgagaatttcaagcgggaaaaaggttttgtgatcaccgcctccaaattctacgacacacggcaagttgggatgatgcaaacggattccatgttttatgtagtaatgcattcgtacctaaaatctttaattatgtccaccaaattgccaaaaagtaccgtaattcccaagaagccgcggtaggccgggactgagtgggcgtcgagaatggagaggtcgttacagcgcaccgggaaatttcgaacaaaagggcgcaggtgggcggtccgcagctgagcagagcgcaagtgctcgacaatgtctcggcgcttctccaagtttcggaacaacacgtgcagctcatgcgcgctacagttgaagcgcttgcataagtgctcgacgagcgggatcgggcgcgggcgttctgcacaagcacaagtctttggggtacctaa

SEQ ID NO: 54030 - DNA, 5692 bp, Heterodera glycines
  Genomic contig location: Contig_ID=SeqID_484; Location=3795..9486; Strand=-
  SCN-specific regions: Sequence locations=1-151,173-1547,1569 -1978,2018-2341,2378-3629,3664-4275,4298-5332,5354-5692
atgcggcacatcagcaaatgccggtatttttctttgtttttaatcggaaaaccattctgttttagtcgccattttgtgacgatggcactcacaccattcaatttttgaatgggagcgtctctattgtgggccgcccgctgccgtctgttattcattacaatgtttcttcaattaaatgattttttttcaggccgctttgtctcaccgtagtagcagtggaccaccgcccgcaccaacaaacgccagctggccctctccctgtgaccaatgttgtgcttcgtaacggcgacggtcaacgtgttgaagcttcgggttggcagcaccaggccagtgttctggcgtctttggacattgggagtgcctactggttcaccaactgcactgcgcgggcccgataccagcatctggactgttggtatcgcattggcgtcgatggcaaaactgccattgtcgtccctcacaccgcagctccacaggtaagtttttcaaacttttcttatcatcgaattttgtgttaagtcgacggctccgcaaagtgctggactccaccatccatttgcctccactttgggaggacaagtgagtttcatttcatttcttcaaaaaaatttaaatatcgaaatatttaaggcgactacggttcagactggtggaggccgtacagtcaatcagacactcgcccctcccgcagctggtccaattgaagaagaggacgaaaataataatgtgagaaaatgatttttttttgttatgtttttaatatttattggaatacattaatagacgattgaccatcgctttggggtaccgatacgcgcgcgtcttcctcagagacgggcagctcaattggttggttttggggtgtgattgttttcaattattttactatgactaaatttataggccacacgaccaattgaggattgtttcgtcattgagcggacgacgccaatgcgcaacaccctccgcaacaccaggggcgaactctgcgaaatccgcttcctgcctctggaggacgccgagcggcccgacctcgtgctcgagacgctcattcagcatctgctcgaccgtgtcctggaaggtcaccccccaccgatgctcgttgggcttcagcttcacccgcccggattcgatcgaccgtacgtcatccgactccgcccaccggagcaaaacaatgcggcaacattggcggcagccattgaacgcctgaacgaacagtcggcagctggaatcgaacttcttgccggaactacagtaaccaaagttcttgctgtatggccccttgaatccgttcgtgctgatgctcagcgtggaggttgtactctgcatttaatattgatttttctaatgaatttaggtgcttgtgactttgacactgagcacagtgtttctaacaccgtgcagtccctagtgcgcgtagtcaatccaaatgaccgcattgtctggcgcgtgccgtcctcctggggctccgtgaccgtgagacgagacagccgaacggtggtggacgcgacgctttcgatgcgtatgccgcacgacaacaccaacatgggccagaagctgtggttctgctgacacgtgctggaattgcggtggacaaggacttgtacacgttggaggacgttggtcatctgcagcgtttgatcatcaatgagcacggtgttggacaaattcggcttgtcgtgttcgagaaggagcaggagtatcggattgttttcaaaggagaggggtgagtattttgtaattttcaattaatgtctaaaatattctttcaagtgtggcagcgaatttcaatttgtgccttctgcttgagcatggacatttcaactatgtggggcgcatcgagcaactattcaaagtgccgaactacgtattgactgtgagcgaagagcagatgcgcgctaccatgcaactggctgtaaagtggtttgccgactctgcctacggtttggcgccgggtttccatgtcaaccggaacaggtaaaattaaaaaaaaaaaaataattgaatatattattatgtttttagttgccaaatggtggaagcagttctcgtcgctgcaatgaatgtggcttcgtatttccgaacgacggttgctacgactatcattttgccaacatggctcctgcgccaattgatggccgaggtcaacgccaacgtcaacccatctgccactggaggcgcttctgtcggatctgtgggcgtgttgcttatgcaaacaaccatcagtgcgcaccactccatcggcccgttggaccaattgactgtcggcgttgtcatgggcggcacacactggatgagccgtgcttcatccagccacttcttgacaggactgctcaccagaacaacaacgatgatgatgacgacgacgatgacgacgctgatatcctcgacgacgatgaagctgatgacgaacttccgctgcgtctttgcttcttcgacgctgaaacgtctcaggagcggcccctgcaattgaacaaccaaattgctcagaagcacgtaccgcttctcatcgttgctgaagtcatctgcgagccatgtcttcgagcgggaatcaacgtcaacgatggattcgggagaagagctcctgattgtgtttgtctctgtcggatggtgcgtggccaacagatgaggcgatggtcttcacctccgtttgtcaatggagcaggcgacaacactcctcacccagagggcgctccggcattcaatcagcgccgcttctactttcattccttcgacgatgaagccaatgacccaattgagcaatttttgctctttttgatgaagcacggctccaagaaggcccacacagtctgcattgcgcacaatggtggaaaatacgatttccatctcgtacttgaggcacttcatcgccgcagcattccaccgaagcgactctgcacgacggggctcaaaatttattcgatgaagttgcgtggattaaatcaacgacgaattacattcaaggactccatcaattacttcttctgtgaattggatgccttggttaagagcttcgatttgcctcaacatctggcaacggtgaaacccttcttcccgtacctctacatacagcgccaacatctgctgcagcgtctcaatggtcttcctgccatagaatattattcgcccgacacgatgaaggtcgaaaaacggaccaaattccttcgttggcacggtgacaacgacgctgactccaacttccagcttcgtgagcagttgatcatgtactgcgtcaatgatgtggcaatcctccgtgaatctgtccttcggtttcgtcagctcatcggtgaacacacccaaggcctggatccgtttctctgcgcctcaactgccgctggcctagcgctcgcaacgctccgccgatgcttcctccccgccaaccgtttggtgcactcaccagaaggcggctacctccgtggacgacgtgcttccgctgaatctcgtcgctacatccgattctttgagttggaaaacgatggagcccaggtgcaatgcgctgactggtcagtgggggaggcgcacatcgaggattctgggtaccgtgtggacggtctttggcgacgggagccaccccttcgtccgttggccatcgaatggatgggatgtttctatcacggtatcttccaatcaataaatatttattaaataaaaaattttttttttgaggatgtcctgagtgcttccctgatcgacaacagaagttggcagcaggacgaacagccgaagacttgtacgagcgaacgatgcgacgcctctttgaattggaacatcaacatgggtgtgagctccatgtcatctgggggtgtcagtggaaggagcgcctccgccgtgaccatgagctgaagcaacgatacgaagccgtcttcacgccatgcccattggacccccgcactgacgcgttgaggggagggcgcacagagcccttcaagctccaccacgtgtgcgccgacgacgaagaggtgctgtgcatcgacattgtcagcctgtacccttacgtcatggtttgcatttttttttatggattcgtttcaacaatatttcatcttagaaggtgaatcccttccccgtggggaacccgatggtgctgacgcgtgaagtgctcctccatccaccgacggcacctcttccgtggacatgcccagaaaacaacaccttccgtggtcttctgctcgttcgggttctggcgccacgaaacatccgtgtgccacttctcggctaccgtaccaaggacgagcgcttcacatttccactgtgtggcttatgtgcggaccgtcggcaacaacgaccgtgtctacatggtgacgacaaacgatcgtgggtgtgtgcgtacactcacgtggagctgaacaaagcacttcaactcggctacgtcgtcacagacctatttgaggtatttcttttgttgatgtaatttttgaaccaatttcaataggtgtgggactacgctgagtgggacgacacgctattcagtagctacgtcaacagcttcgtcggtctcaaagtgcaggcgagtggttggccggagggatgcgacgccgaagagcaacgtcaggccttcgtcgcagagtttctgcgtacggaagggattcatctggacccgacgaagatggccttcaacccgggtctccgtctgatcgccaagactttggcgaactctctatggtattttattttttctacgatatattaaaaaaaaatgatttgaaggggaaagctcgcgcagcgcgtcggtcacactgagatacagtacacgcgcacgcctgccgaattccacaagctgctcgacgacccgacttacgacaaactggactttgtccacgtctccgaccacatggaccgtgtcgtcgtccggaagcgacccgagttcgccaaagcaccattgaccaactgccttccagtggccatctttgtcacttcgtacgcacgcctccatctgtacggatatatggagcaagtgttggcattgaacaacgctgagcttctctactgtggtttgtcttctaccgtttaatgttatcagtgacggtaattcagacacggactcaatctattacgtcaacaagattggagctccgtgcgtaccggagggcgaagcgttgggacaaatgaagcgggaactcgtggacaggcgcatcgtggagttcgtcgcaggaggcccaaagaactacggcatccgacacacagcccgagatggagcggatgaacgtgcgaatctgaagatacggagcttccgtctctcctacgcaacgcagcagcttatcaatttcgatgcaatgaaggagctgacgctgtctacgtacaacattgatggacccatgtaaaaagtttccactttaattttttaataataatacaaattcaatttagtgatgacgtcattgacaacgacgacttgttcgtctacggtggtggagcacatcgcgccatccgcgtctcctttccgcagattgaccgtaacgtccaggccgacctcttcacccgggaggcccacaaggactaccggcccttctacgctaagggacgcgtccgccctgggatgcaaacgcgcccatttgggtacgtcgaagatgctccacagccaatggatgtcgaacagcacgcccaaccaccaccactaccgccaacagaacgccgaaagaggactttgattgaagccgatcccacccagccgggtcactcgcgatggttttaa

SEQ ID NO: 54031 - DNA, 595 bp, Heterodera glycines
  Genomic contig location: Contig_ID=SeqID_484; Location=7683..8277; Strand=+
  SCN-specific regions: Sequence locations=1-236,258-595
cagaaggcacaaattgaaattcgctgccacacttgaaagaatattttagacattaattgaaaattacaaaatactcacccctctcctttgaaaacaatccgatactcctgctccttctcgaacacgacaagccgaatttgtccaacaccgtgctcattgatgatcaaacgctgcagatgaccaacgtcctccaacgtgtacaagtccttgtccaccgcaattccagcacgtgtcagcagaaccacagcttctggcccatgttggtgttgtcgtgcggcatacgcatcgaaagcgtcgcgtccaccaccgttcggctgtctcgtctcacggtcacggagccccaggaggacggcacgcgccagacaatgcggtcatttggattgactacgcgcactagggactgcacggtgttagaaacactgtgctcagtgtcaaagtcacaagcacctaaattcattagaaaaatcaatattaaatgcagagtacaacctccacgctgagcatcagcacgaacggattcaaggggccatacagcaagaactttggttactgtagttccggcaagaagttcgattccagctgccgactgttcgtt

SEQ ID NO: 54032 - DNA, 612 bp, Heterodera glycines
  Genomic contig location: Contig_ID=SeqID_484; Location=9839..10450; Strand=-
  SCN-specific regions: Sequence locations=1-612
cgtacgcatgtacgatttctggagcattgaatatcgtgagtatgtggatgcgtacgcacgcatctaccgtataacattaatctaccatagtcatgtagacaacgtacgcatcaagaataaatatgtgttgatggacgtacgcatttctggagcgttgaatatcgtgagtatgtggatgcgtacgcacgcatctaccgtaaaacattaatctaccatagtcatgtagacaacgtaggcatcaagaataaatatgtgttgatggacgtacgcatttctggagcattgaatatcgtgagtatgtggatgcgtacgcacgcatctaccgtataacattaatctaccatagtcatgtagacaacgtacgcatcaagaataaatatgtgttgatggacgtacgcatttctggagcgttgaatatcgtgagtatgtggatacgtacgcacgcatctaccgtatacattaatctaccgtagacatgtagtcaacgtacgtatcaagaatacgtatgcgaagatggacgtacgcatttatggagtgttgaatatcgattggatgcttacgcacgcatctaccgtagacaacgtacgcattaagaatacgtatgcgttgatg

SEQ ID NO: 54033 - DNA, 352 bp, Heterodera glycines
  Genomic contig location: Contig_ID=SeqID_485; Location=786..1137; Strand=-
  SCN-specific regions: Sequence locations=1-352
cgtacgcatgtacgatttctggaccgttgaatatcgtgagtaagttgatgcgtacgcacgcatctaccgtaaaaccttaatctaccatagtcatgtagacaacgtaggcatcaagaataaatatgtgttgatggacgtacgcatttctggagcattgaatatcgtgagtatgtggatgcgtacgcacgcatctaccgtaaaaccttaatctaccatagtcatgtagacaacgtaggcatcaagaataaatatgtgttgatggacgtacgcatttctggagcattgaatatcgtgagtatgtggatgcgtacgcacgcatctaccgtaaaacattaatctaccgtagtcatgt

SEQ ID NO: 54034 - DNA, 1007 bp, Heterodera glycines
  Genomic contig location: Contig_ID=SeqID_4318; Location=80..1086; Strand=+
  SCN-specific regions: Sequence locations=1-193,215-219,241-885,909 -913,938-1007
atgtcgacgggctttatggccgtatctacagtctcatgggttctctatctggaatttataaaaaaatggttagcctctctggtcctggttgttaagcaaaaatgtgtggattaagagcaaaccgcctgaggacgctttcgtgatccgcggcatctgcgctccaatcggcacgtccgctttctgtatgcatagggaggaagagcactcttaccacctgaattttaattttggtccctccccaaaggtgaatttttgagttcttttgtttctcctgcatttttggcttcccaattagttgtggttttttgtggcggccgagctcgagggcaaagtgcgcgagctgggtcagcggttgtttggtgctcagtgggcgaagtgtgccaatccacttggacacatttcgtatcttttctcgcctgcccaatttcgagatgccggaattccgttcgaaatgcagttgcagaagccaggggaggctattctcaccgtggggctccattccggaatcaaccttggcccttctgtttgccttgtggctgaatttcaaagtccacgttcagtggcacgtttcaagggtccgattttgtaaaagatagagaaaatgttaactgcctaattcagaggtgggaagatggactcggtgcagttgcaaggatcgcgaggcttatcggttcaccaagcagcaggagaccgagtacttgcagttaactcagtaaatctcatgttttgtgtgccataaatagataggaaaaaaaaattgcaggtccttggtcgcttccgaacgtgccaccatggcctggcgaaagcatgatggttccggaaaacggcaaaaacccgatgccaaccgtctcgcagagctcgcggcacggaagcgggaacaaagagcgagacaaaagaaagaggggcatgtgccacaaaagaaaataaaagaaaaggataccattattaatttggatgacattgattttgattgagtaaagggaagagaggaaaaacaaagtgaaaaa

SEQ ID NO: 54035 - DNA, 3784 bp, Heterodera glycines
  misc_feature (809)..(809): n is a, c, g, or t
  Genomic contig location: Contig_ID=SeqID_4318; Location=1174..4957; Strand=-
  SCN-specific regions: Sequence locations=1-68,92-435,457-559,581 -1196,1218-1530,1552-2945,2967-3334,3357-3409,3431-3581,3604-3784
acccgtccgctgcttaatggacactggcgccagtttgactgttgcaccacgatcagttgcggatgaactcaattgtcgaacattttcatctgatctggaggcaatgagtgcctcaggccatgtcattcgcctcaaagaatatgctcaggtgaatttgaacattgctgggtacacagtccgttcattaatttattttgtggatgattccgaatttactgtggcccgggattacagtgtaattgtcggttgggatgtctttgaaaaattgcccccagtaaaattcgatcatttaaacgggaaattttttgttggggacaacgaatccaaattgtgctatcgttcgattcttttactgaacgatttgcgcgtgtcagcagagaaaaacacactcattccggccgactcccaaatattggtcgatgcttcaatcgaatcaaccccaaacccaaaaaattcattttgcattgatcgccctgacataagtcttattaaaaagggactgtcagtcattaatagcgtctcgcctgcgggccagaaacaaataaaagtggcggtggtcaacccaaccatggaaccaaaatggatttggaaaggaacacatttggcatttgccaacgaactgttatgtgaccgaaatggacttttgaaggaaaatagcacaaaagaaattcttacgttaaattctgaacgaaagaaaatggaaattgacccacatttgtagtcgacttttctaaggcaatggttgaaggcaaaaatttggaaaagctgaaggcattaattgaagaattttcagacgtttttagtaagtntaggtatgatcttgggcttttcacagctgctgaacatcacattacaaccacaactgaggaaccaatcgcatctgcgccaaggcgaatgccgtacaaatacaaagaggaactgaagaagcacattaatcagcttttagaagccggagtcatggttgagtccgataccccatgggtaactccaattgtcattgtacagaagaaagacggtggaattcgtccttgtttagactttcgcaaacttaacgaagttacggtgcccgacaagtaccctctcccacgccttgacagcatcatggaaagggttggaaattgccaattttacagctctcttgacttggccagtggctattttcaaattaaattgagtgaagaaacgtcaagaaaatgtggaattataactgaagacaaagtgtaccaaatgattacgatgccatttgggctgaaaaatgcaactgcagcattttcaagggccatggctatcgttttgtctggattggaggatacttccttggcctacgttgatgatgtgcttattttcacgaaaagcccaaacttttcagaacacctaacggcggtaaggaaagttttggagcgttttcggctctataatctgaaacttagcccgaaaaaatgcatttttgcctcaaatgagatgaattttcttggatttgttttaacagctgaaggttttaagccaagcttaagtcgaatcgaaattctcaaagaaatgccagtgcctttaaatgttaaagaggtaaaaagagtgctaggacaggcaggcttttacagacggcacattgagaactttgcaatggtcgtagagccattactgaaacttacgaggcaaggcaatagattcgaatggggcagggaacaacaaaagtctttcgacaagataaaagaattacttacgcaagccccgagtttaatttttccagattacgacaaagcatttcacattttcactgatgcatcatcgactggacaaggaggagttttaatgcaaaaggatgacgtgacgggcacattttctgccatttcctattgcagcagaaccctctctgctgctgagaggaagtggccggcagttcaaattgaaatgagtgccattatttatgctttaagggaattcagaccattcattttcatgtcggacattgaacttcacacagatcacaaacccctcgcgtttttgctgaaaaaatccgaaaccaatcagcaattggcacggtggctcattgaattgcaaaactaccaagttaagattgtccacgtggcaggaaaagccaacactttggctgatgcactttctcgtgccgctgaggacaagcccttgtcggaaatatacaatgtggatgaactcgaggacattatcgcatttccggtctgtctcgctttggcagcacattccagggtggtcgcggacccatttttgcatactttgaccatccgacacgaggatggaaacacttacgaaattaatttgttggaagagcaggcaggagatccagaagccgcagcctacattgcgtttgtcagggatggggaatttccagctgatttggatgaaaaagaaaaagaattatttgctgtaggcactgccaattacaaattaatttcgggaattctttattttgaggacaagggttcccccccaagaatttatgtcccaatttcattacgtgggctcattttcgaatcgtttcactcctctctattgggtggtggtcatttaaattacaggaaaacaattgccaaatgcaaaaaatatttttggcctaaaatgtactctgacgttttaacttgggtcaaattatgtgtcacttgccaattcagacacaatccaacacccgcgtaccgtgaagagatgctcatggtgccagccaacacactttttgccaaagttgggctggacttggccggcccctttccaatcactcaaaaagggaataaacacattttaaatatcgtttgttggttcaccaaatacgtgatttctgtcccggtccccgacacaaaagcacaaacaattgcccactcttttcttaccaattgttacttaaaatacggtggttgtgttgaattaatcaccgataatgcctctgcctttacttccgaatttttcagggaattttgctccatgctttacattgacaaaaagtatgcctgtcctcattggagtcaaggcaatgcgtcaactgacgcaacttttcgcacatttcacaacatcttggccaaatacatttctaagactcagcccgacttcgatgaatttttggatgctgctaatttttgctacaacacgtcagtgcatgcttcaacgggtgagactccattctttctaatatttgggcgtgacccaattttttgtgttgatcagatcattgatccgaaagttcgtgatccgatagccatttcggaccgtaatgaatttaaacagaagctggtcgtcgcaataagacatgcgtggcacgctgcagctgatgaatatgcaaaagctcagcgaaaaatgaaggaacaatatgacagaaaggcaaggccacaacaaatcacaattggtgatcgagtgctgatcagaaactacgacggacgggtaggaacatccaaaaaatttcaattaccgtggcgcggaatttttcgggttatcaaaattgagggcatttatgttactgtgatcagttgcacttcgccaaattcgaacccaaaaagacttcatttaaatcaaatcaaaaagtgcttcgaaattttgggccccccgtgcactacgccaatgcaaccaattgaagagcaaaagtgccttgaacatacacaaagcgtggaggatgttagttcggaaaggtctgaaattaggaatgaaatggaccccgagtcccgaaaagatgagaacttagaccaaatccaagcccgagggccggaaaaaagaccagaaattgaagccgaggcggagaaaatcaatgaaaaaacggatatggaac

SEQ ID NO: 54036 - DNA, 1608 bp, Heterodera glycines
  Genomic contig location: Contig_ID=SeqID_4319; Location=298..1905; Strand=-
  SCN-specific regions: Sequence locations=1-615,638-973,996-1134,1156 -1177,1203-1608
atgtttttgagtggaaaggatgatgagtcctcgatttcggctattgataggaaactttggcaaggaaagaccacgataaaaatctctgatttagaaaaagctcaaaatgatatggggaaattagaagatggagtgaacagagcttttcgctacctgaatcgttccttgaaccaaaaagtcaattgggtgaaagatgtcgtggccaatacaaatgccaattttgagactctgaaagtccaattcgagaccctaaccgaaagagttgatatgttggaacaagacagtgatgggacgaattcaggtgggactgttagcattactaatttgaatagagcgtcgcgtgcgccgtttgtgacgccaatgggcaatgcacagcccaaccaagtcgtaccgaaccaagagccaattcatcaattgtcaagcgaagacgaagatgacgggccgactctttttggcctgaacatgctctcgagcggacccacagtggggtcaggtttggaaatgttttgtgaggagtctgtttttgcatttgacgattgggctgaacgtttcaaggattacctgtccgtgtcaggcaaggcttacactgaacaagaaaaagtcacaagacttaaattggctctgagggacactcctcgggcactgtttaaggagttattgcccgcacaaatggacactcttgactcagcattgagtgaacttcgacagaaattggactcccctcagcgtcgggaaattgcaaaacgaactttatcgctgtgcaaacaaagggaggataagacagtggcgcaatttctgagacgcctgacgcctttggtggatgcaacaaattcgtcattgacaggtgaaattcgaaaagagaaaatttgcgaagaatttctggatagattgaagccaaacattagttttcttatccgtctggtgggactgtcacgggcaaaagatttggacttggtaagagcacaggcagaggagctggaagctttactgttgatgaacaaaggtgatgaagcatcacgcctctctcaggcagtccatgcgctgagcaatcagtcaccacagtcgaattggtctacaggagcgaacccgaacaatgaccgtgctggacaatggtcgtcaggcaacaatgtacgtgggtttagacctttttctggatcaaatgcgacgagacaacaacaaagaggaagaggaggacgaggccgctctcgcaattggggaggaggccgccaggagcaatttagccaaagaaactggtcaagcaaccctcgatgccattattgtgaccgtgctggacattttgcgtacaattgccatcaacgccgcgccaattttagaggaaattccaaccaatcgttccgtcaaggaagatggtcaaatcagcaaccacgccaatctcagggacaatggcaaaatcggcagaatcctgttaacgtgatggatgctacaagttcttacaacgcttcaccaggatttttcgagaacttggcccagtcgttgcttgacctcaaaatccaggacaatcgcaattacaaaaacgaagagccgagatcgggagcaatgaatgcgctcacacgcatcaaacccgaaacaacagcaagggattgtcag

SEQ ID NO: 54037 - DNA, 786 bp, Heterodera glycines
  Genomic contig location: Contig_ID=SeqID_23326; Location=448..1233; Strand=+
  SCN-specific regions: Sequence locations=1-200,234-386,432-567,617 -705,750-786
atgccaaaggaggtgcttcgacaaatcttggccaaactgcccgaccacgtgtccatgttggaagtggccaaggccaacgagacattccaagcactggtcgactgtgagcagaagcaatggcgaagcctgtgcatgtgccacttcacacaagcacaaattgacaaacacaaggcgggaaatggggaaacattttttttgacaaattttaattaatttgaaattaataaataaaagcgggggggggggggggaaattatagggccctaaaaattcaaattaataacgtccggcatctatcgggcaccaggggtgggatgcacactaaaaatgtcgcggtcggcatttttgcaaaattttcatttacctccaaaaaatgaaaaatagacaaaatttgattaatgaaaattataattattaatacaattaattttcagagtttcgacccattcacatggcgtcaactgtttttttcgctcaaaaaatactacgggctcaaagaagtttatgcggatctcattcacatttgttgccattgcaaggctttattttggaaggtgcctttttagcaaataatattaaattaattttgaattttatattttaaaacattatttaaggaccatggccatccgtgtgtttccaaggaaactgctccatccgtgcgggtaactccacaacaatttgttgacagtaagcaattcatacattatttttaaacaattatttaaattaaaataattatttatttagtgcaattatttctctgatcgaacaacgaaaaaacaa

SEQ ID NO: 54038 - DNA, 1050 bp, Heterodera glycines
  Genomic contig location: Contig_ID=SeqID_23327; Location=115..1164; Strand=-
  SCN-specific regions: Sequence locations=1-178,200-240,263-678,700 -920,1003-1050
atgccgccgcgtgccacctccgccaccgagaaggcaacagcgtctgcctggggcgtgctgttgaccactccattgcctactgtaagtaaaaaatgaaacggcacctgtgtacatgaagatttttaccttcgtaccgtacctgacggagcaggtcgtcccacccccccccccccccccgaaaaattaaaaaaattcctaagattttttttgaaaaaattctagtgtcctccccccttttcgtacatttttatgtttctttttcagtccgtcaaaaagtttcgtttccgatgccgaatttttcgatttcgtatttattccaattttttccggcgatgtgccaattgattccgccggctttccattttcccaaattggaaaaacacggaaatatcaaatttactataatttggtttttcattagtcttccccatcgctggaggaggagcgcgtctgccacgacacacacgagtgctgtgcccactgggcggccagcgatgcgtgccgcaccgcaccgcgcttcatgaacacgtggtgcccggcccagtgccgtttcgacgggtgccgaccccatccagagcagggcaaaccgggcaagtgggaaagaatggcacgacacgtgtccagcaagggctgggcactcaatttcgcatgcccaaataaatgtgtggacagaattacctataacaaaagtttcaggttgtcaaaatctttattcggaatgccaaagatgggcccattaccatgaaaaggctgttggcacgccgaacgaatgtcagcggaacccgcattggatggcacaaaactgtgccattgcatgccaaaagtgtggggcgacgaagccggaacagtgcatgtgggttcaaaaaaagaacagtgattttaataatacagtggaaaatttacaatgggtgggacaaaagttttataaaaatttagctttattatataaattttgaaaaaattagctaattaaaaagcattttaaaatttttaaaataatttcagcaacaatatgccgaaggactacgaagctccgccagtgggatttga

SEQ ID NO: 54039 - DNA, 100 bp, Heterodera glycines
  Genomic contig location: Contig_ID=SeqID_23328; Location=901..1000; Strand=+
  SCN-specific regions: Sequence locations=1-100
gtatacatttgagacaattgggcaggacaagaaaagaatgaagttgatgcctcatgaaactcggaattggttatgtttagtcgaaaatatgcttacataa

SEQ ID NO: 54040 - DNA, 358 bp, Heterodera glycines
  Genomic contig location: Contig_ID=SeqID_23329; Location=833..1190; Strand=+
  SCN-specific regions: Sequence locations=1-247,270-313,335-358
atgctaaatgctacacattttgcatttgcatttcaggtgcttttcctgtgcgtcgtcggcactcaaatcgcaatggcaagtgaccggtaggtaaatgtaccgtattatctctaattattaggaagcaacttttagtgacgaaaaaccccaaaatagttaactaaaatagtgagtagaaatgccaaaatagtgaagaatagtgacaaaacgtccgaaaaagtgacaaatagtcacataattttcagccaaaaattgagcaaaaataatttttattcactgattgcagttgcaaatgagtaggactgggatttgtaagaccaaaaaacccaaaagagttacctaaaaaaaattttttaaa

SEQ ID NO: 54041 - DNA, 101 bp, Heterodera glycines
  Genomic contig location: Contig_ID=SeqID_23330; Location=123..223; Strand=-
  SCN-specific regions: Sequence locations=1-101
ggaagctattcccgaaggattcggtctccccataaatctgggcgcatcggttcggggggactgcccccaaaaacaaaaaaaacgttttttttcaggggccc

SEQ ID NO: 54042 - DNA, 628 bp, Heterodera glycines
  Genomic contig location: Contig_ID=SeqID_23332; Location=314..941; Strand=-
  SCN-specific regions: Sequence locations=1-34,62-587,625-628
atggcatcatcgacaacaacaatgaacagcaataacaacagtggtggtggtggtggaagcgccaagacgacaatgttggtcaatgccgtttccatggagtcgcttgactcgtccgcgtccgccaccaacggcggtggcagtggtggaagcgtggcgggcggtggcgatgcgcaagcacaggtgcgccgcgtattaatggcactggaaaaaaagacagacaaattgtcaatgctaaagacacgggcagggacgttttacgaaaaatttaatgggaattagcaaaattgagagttgtcgtgtaattgaaaaaaaaaattgttttttttttcaagaaatgatgagatattcgaaaattttatgcatttttctaggagagttcagagcttctatgttaaaaagcgataaattctaagattaatgcaatttataggaaattgaaaattcagaaataatgaaaattatgaatgaatttcagtgaaaaattttacgatttttcaggttcgcactttgttcgtctccggtctgcctgtggatgtcaaggagcgcgagctgtaaatttttagttttgttgtaaaaattacagattgtaaggatttttataaagcaagcaaatataatcctaaataaa

SEQ ID NO: 54043 - DNA, 2334 bp, Heterodera glycines
  Genomic contig location: Contig_ID=SeqID_4320; Location=1414..3747; Strand=+
  SCN-specific regions: Sequence locations=1-10,32-86,109-212,234 -456,483-1174,1197-1901,1924-1999,2021-2108,2138-2214,2238-2334
atgtcaccgccaatcaatggcaacaacaacagtccggcaaactcaatctcgcgatcattcagctcagatcggtaagaaaagccaaacatgtgacactgttggatttttcaagagatgtttctgtctctgatcagcagaagcgatcagctgatatgaaattgttattaaaagactgatcaactgatttggttgtctcatttgacagtaatgatgaaggagaaaatgtgatcagtgatcaaacttacaaaagtgatcagtaagttattggtgaattctggtcagacaagtgccgagtgatccgaaattataaaaggacaagacaggattagctcaatggttaaggaaactgattagtggcctgatcatgatcagcaattagactgaatgactgacaattgtttgtccagattctaccggcttgtggatgacgaagaccaaagggccccgctgaacgcattgaacagcagcagcaacagcgaggaagaaagcagtgcctccaaccagcaacaacaacaacaacacaccggcggcaatttcagtttggccaacagcagacaaacgtcgatcacgatgcccgttgagggcaacggcacaaccgcggccaaattgacggtgggcgtgcgcgacttcaacacgcgactttgcgcagtgttggagcgcctttatgcactggcattgtccgaggacagacgagtaagcaattgaaaagcctattaaaccataattgtcgcggtttcatcgcgcccatttggacttgctggacgactgcgacacgttcaactgcgactaccgcgagctgtcgctggaggctaactttgtggacattggcgccgcaacggcacaggaaaggctggcgctgttcatcaacctgcacaacatgatgctggtgcacatcacgcacaaatttggcctgccgggcacaatttggcaacgccgaaaggtgcaatgggacgggcacataaatgccccattatccatttggaaatatgccaaaataacacactcacacacaccaatggatttacagtacctgtacagcacatactacaaaattggcggccatctatactcgttgcagtccattttcaatggcattttacgcggaaatcggaaaggcattggcatgctgtggaagccgttcggcgaccatgatcccagaaaagaggtgatggcattttagtacaatttaatattttgaaaaatgtcacaaatgttgtaagttcgtcatcgaaggcggcgagccgctcgttcatttcggcctgaacaattacacccggtcgaccgtgccgatccgagtgtattcaaccgaggtaagtaatactgttacagtaaaccggggactaatctccaacaaatcaactattacaatttccccaacagaatgtgtacgaagaactgaaagcaaacgcgcgggaatgcctctcgtccaaggagtttcttcaaattgaccccaaaacgggcaacattcggctggccaaactgttcaagcagtactcggaagactttggaccgtatacggaagacgtgagtttcttctcaaagcaaacaattcattaaatccctttatccgtggtttctgatttaaaacaaccctcaaaatggggattaaaattcggtatgcttatgttagcttgaacatgatcatggaatttgtgattgattgaatgggtaaatgtttggggcaatgatcaatgtgatcggaatattacatgacaaatgaccaggatgatcattacgcaatgcttttcaggtgctttgttggattgtgcgtctgctgttggacacgtccgaggatcggatgcatttggccaaacttttaaccaattcgtccgcctcgttggccaaccttagccaaacagtgtcctatctgccgatggacatggacctgaacatgagctacggggtggcgcccccgtcctccccatcgttgaggacatcgacagaaaatggagacgaaggaaacggtagggttgtgacggggtttgttgaggaagggtgccattcaaatggcaaacaattcaattgcattcagacaatggccgtggactggacggagtcgtcggcggagacatcgacatcgacggcaccaaagccatggcgaaagaacagcggggggaggaggaaaaggaggagtacaaaaatgtcagcaacaacaatgacaatgaggacggaagaaatgggaggcggcggcgggaagaaattgcggaccgggcaaacaacggcaacaacaacaaagacaatggcacgaatgaaatgccgggaaaattgatgctaatgccaacggatgcaatcgaagcagaaatgccaaatggacaactgacaatgaacacatag

SEQ ID NO: 54044 - DNA, 2219 bp, Heterodera glycines
  Genomic contig location: Contig_ID=SeqID_4320; Location=4202..6420; Strand=-
  SCN-specific regions: Sequence locations=1-254,290-484,506-652,698 -981,1003-1121,1143-1284,1307-1472,1495-1622,1658-1933,1955-1985,2021- 2219
ctgtaggcagctgtcactgtttggtcaatggtttggattaagcctgaacggttgttatttggacacagtttttggtaaaaaaaaaaacaaattgcaaaaatcgtaaacttttcttttattaggcattctgaacgtgccaacccgtattttgtgcttcaacgtcgaaaaggccatcgtgaagatgagcagcaacggttttcgtatcagcaaaaacagcacagcgacgtgtcctcctcatcgaagggttgaaaatgaattttttaaattttgctaaattataaattaaattccaaatttcagtgctcagcggaggactgtcggctttgtttgtgtccaccatcgactcaatttttgacactcgtccgccaccctatcgcatcatttaccagcgagaattggacgagggccaaattgcgtggggtcagtcatccgaggctaatgactccaaaatttggggatgggccaaactgggaattttgttaatcatattaatgcgatttttaaattttacaaaaattcatccaaatttttcttccgtttttcatctctcccaatattttccagtgattgcaattgccgtcgattggcgcgatgtgttggacaattggcaatgtttagagacttcgctgttgccaattttggaggtattttcaaaataatagaaaaaataataaattgtttaaattttctttttttagtcattgggcaccgatgagaacgaattggagaaatttgtgctgacaaaaattgacgggtttttggcgctgcgcgatgaaatggaacgccgtgaacatttggtggccgacggtggggaggaggacgatggcgccgagtcggctgccggtgaaattttacaaattaaattcaaaattccataatgttattgatcacgcacatattttttttgaaaaaataacttcgccaatgaatttagtaaagtggaatcttaggctttttggtactagtttaaaattttcggattttttaaaaattagcattattaatgtttgttttaaaatacaatgtttgcttatattggtcccatgaattcttttcgtcttttgcttcaattgagacgacacatttatttgtgttgaataattaaatgcataaaatgcgtatcatttatcataaaaaagcataaaagattaaataaacgttaattattaattactaacaaattattctgttttcccagtgcttgaacatgtatcaaatgccgcaattctgcgtaagtttctcaaactgttcgacttgccgccctgtgaaaaactcgtcaattgtaaataaaaatttcccccaattacacatgaattttcaatgtttcagattattcctgcacttattggaggggcaacaagccgttccagggcaaactgtacttgtccgtcaactttctgtgcttctacgcattcattgtcggtagtcaaacgcgcatcaaaattcgatggacggacattttggtaaaattcaaattaaaaaatgctaacaattgcggaaaagccgaggcggtgtgatcatttaattgttgtactgcttcaactttatgaattcaaattccgtttctcgatgacagatgaatcattttcttctcgggagaattcaataaattgaatattgccaattaaaacattttaaaaaatatttaaattaatttggttaaagtttacaaaaaatttcataatgaccaattctcatcacagaaaatggagcacaacagctcgttgtttctgtccaatgggctgactgtttcaacacgggatggccaaacgcacattttctccatgtttatgaacttttccgatgcgtaagtgtgggttaaaatgtatacgaatattttagcttttttagtgaaattttggaaattttttgggctaatagagaaacttttgtttgtagatgatatgaaattcattcaattttggaaactatgaaaggtattatttgcattatacccaaaggagtgggtgggctgtcttcccacgaaaaataaaatttatgtttttttttgaaattatttccgttgttttcagcttcaaacactgcactcagttggccaactttgcgatgaagcagcttatagaggagaagggcttcagcgaggacgcggcgttgcgcaccaaatttctgctggaggacccgcaaaagagggccaagcggagcatgtcatttgtgaagcgcgacttggaggcgcggcaacggaccgaggcgtacaggtg

SEQ ID NO: 54045 - DNA, 1082 bp, Heterodera glycines
  Genomic contig location: Contig_ID=SeqID_23334; Location=65..1146; Strand=-
  SCN-specific regions: Sequence locations=1-95,117-197,222-237,259 -356,400-921,943-1082
atggcccaagtatttttgcaccgaaatcgtccggctccaagccattcgatcaggcacctgagcaccggacttgacttttttttcataataattctgtttctgcaagtgacagatgtcatttcttacaatgaaagaataatctattttaatggatacagaatgcaaaagcagggaagaccaaatgggaatattcaagtaattaaatatttaaaaaacaatttgagtatgaagcatttgtttaaaaaacaatttgagcaggtatgggcgtgtacgacacgaaattgtgacgggagagctgagtctgaaggtcgatcgagaacgcttcatgaaaccgcaccacacaatcacgctccgaaccaagtttatttcattcactattccatatgattattacataaatatagtttcaattcagaaaaaattgaacaaaacgagacatgcaagatgtgcagctatcaagcgatggaacagaaacagagagttcagcgaggcaatggattttgaaaaaaaccaacatacgaatggcacgagccgcgacagcgtgcacgaatcaggccatatcatatgctattggtttttagaatatgcgagtgaatttacatcggtatgttaaatgcagcagatgaattttcaaatgcattattgggctaaatattgaattattttatgtcttaaccctattttaaaaatttcttattgcatcagagattttgaagagcaaatggctaggaaccggttcagtacgaaatgaaaaaaccagcctttttaaactccgtgatttttatttgcctaaaattctttcgaaacaactcttgaaataaattatttttagtgcgtaaatcgtaatatgcattttgcaacaaaaaaaacatgtgcctcaaactaatctcttacaattagacttttgatatttggaagctaattttgtttaaatattaaaattaagattgccgatataacggaaggtaatgaagatgcggtgttagcagaagcggaggatgaagtaagaagacttgtcacgccaaaaaagtgcctgatcaaaaaggtagaaaatgccaaatttaaagtaattattatagcct

SEQ ID NO: 54046 - DNA, 452 bp, Heterodera glycines
  Genomic contig location: Contig_ID=SeqID_23336; Location=174..625; Strand=-
  SCN-specific regions: Sequence locations=1-47,70-112,134-394,448-452
atggccgagttggcagcacgaatggaaagtgccgaacgaatggtcggccggtggaaaggggagggagcgatggagggggggggggaataaaaaaaattaaaaatggggacggggaaatggagggaggggacaaagcaaacaaaggccatcaatcaatcggtgggttggccaaccaattagcaaatgttgtcaggtgaatgtcagcattcaagcgggcgttcacagccgagtggtgccgataatgggcgcacgagaagggcacaatttgcaggacgaggagttcgacgtaagcacaaatcggacagaccgaaaatcgaattttgcccctgaacagtatttgaccaatccgacctatccgattgtgagaattgcgttggaattggaagaacaaagtgaggaggaaaagaaggaagaaaaagagaaggaaaaggaggaagagaaagagaaaagaa

SEQ ID NO: 54047 - DNA, 706 bp, Heterodera glycines
  Genomic contig location: Contig_ID=SeqID_23337; Location=393..1098; Strand=-
  SCN-specific regions: Sequence locations=1-26,57-142,171-249,272 -429,451-558,581-625,647-706
  Gene Ontology: Biological process=protein biosynthesis
atggacgaaaaggaggaaaaggcaacgaaagaagaggaagagaagtcaaaaagggggcagagaattgtggaaagagttgtggcaatttggagggggaagagggacagagaaagaccaaagacagcaatggacggagagagtggaaagaggtaaaaacaaataagaaaacacagtgacacacagagaaaaatgcaaattcagcagaaacgaagaagtaacatcatcttccaaggaaaaaatgaagaagcaaacgcagcagaagagaaaacaaacaatccaacaaatcggagagaatgagcaggaaaatactgaccaggaaacgaagaccaaagaagaaacagaaactgatcagcaggtgaaaagtgagattgatcaggaaatgaacaccaaacaagaaactgatcagcaggtgaaaagggggactgatcagaaaacgaagaccaccaagaaagaaacagaaactgatcagctgatgaaaaagggcactgatcaggaaaggaagaccaatgaagaaacagagactgatcagcagatgaaaaggggaactgatcaggaaatgaagagcatggaagaaacagaaactgatcagcagatgaaaaggggaactgatccgcagattaagaccaagaaagaaataaaaactgatcagcagatgaaaagggagactgatcaggaaatgaagaccaaacaagaaactgatcatcag

SEQ ID NO: 54048 - DNA, 255 bp, Heterodera glycines
  Genomic contig location: Contig_ID=SeqID_23338; Location=1585..1839; Strand=+
  SCN-specific regions: Sequence locations=1-255
atggcaaaactcgtggccatttttctaccgactttggtcgtcgtcagcgcagcaactgtgcccattctgccacaacaattgctcagtgccaatgatcaaaattcaaattcattaccaaatttaacaaatgttcttgctgatgaaatttcgctgagtgccattgattgtgccgcgttgccaccggcactttggtgtaccaaatttgtccgttataaatgcggcaccagtaatttgtgcagaaagcatgacgatgcc

SEQ ID NO: 54049 - DNA, 667 bp, Heterodera glycines
  Genomic contig location: Contig_ID=SeqID_23340; Location=907..1573; Strand=-
  SCN-specific regions: Sequence locations=1-522,544-640
atgttgcacagcgaatggaccctctctatggtagtgaataggcccgaaattttgaaatggccgggactggatccggcacttggaaaatggacggagggaactccgtttttccggcactaccggttccggtggtttgtccaaaaaaaggggaccggggccgggaatcccggcgggcccccggttccgtccgggcgggctctaatagtgaaattatttggcgaattctttttgaatttgaaattaactaaacagagagaggaaaccattttgaatattatttgactttatggcaatttttcattttaaatacatcttactaataaattattaaaattcacacagcacttgacaaccatacgcttgtgaaattggaccaaaaatggcacgacacggccaaagtgtgtgcctttgacaaacagtcgaaattgagatgttttgccgacaaaaagtaattgcataagccaaatgattaatcgctaaattaattttaaactgctaatttaagctgtgccgtcaaagcaagtgaaaaggaagtggaaaaagcagtcgatgagtgctatatggagcacaatgtggtcaatgttcaacacaaacgttgtgaatgcataggaaacaatgtgccatggtgaagatgacactgaaattatttaatataataataattaaa

SEQ ID NO: 54050 - DNA, 841 bp, Heterodera glycines
  misc_feature (497)..(497): n is a, c, g, or t
  misc_feature (547)..(547): n is a, c, g, or t
  Genomic contig location: Contig_ID=SeqID_23340; Location=1915..2755; Strand=-
  SCN-specific regions: Sequence locations=1-23,45-119,186-240,298 -369,403-583,605-841
atgatgatgattagggtgagggtttttgtttatttaaataactgctttattttgatgagaaatgcacgaaaaatatcacttttagccgccgaaaatgtttagttttaacgtcaatatccataaatataaaaaaatattttagactttattttgcatttttttaatcaatattttgataaatttttgttttgttgctccaaatttctcatttttggtcaatattttcttaaatattttggcattttttcttaaatatttatttaaatatttcgggattatttttttataaatataaatcctcatcctattgatgatgataattaaaactcttacatttaacaaatattacttttttcatgacattacttaaattcccaatgaaaaattcttttaaatggaaaagtggcatttgttacaaattagtatttccttgtttatttattagcgataatttcatgaaaaattggccataagttcaattaagaaatagaaattanaaattgtttttagttaaatgataatctacattttgttcttcctcgcattntcgttcaggaaggatccggcgattgcatatatcgtcaggtaattaagtaaagaaaatttattttttttttgttgtctaattaattctcaatattttagtgttcttgtgatgaacagaatcaatgttttggagtactaattgacgagacggcaaaatgctttgaagtggcatacgatgaagtgaaggcggatttaataaaagcggtactaattgccaaatattaaagaatatttttgaattaaaacttttgcaggctaacaaatctctccttagttttaaaattgtgtgaataaa

SEQ ID NO: 54051 - DNA, 562 bp, Heterodera glycines
  Genomic contig location: Contig_ID=SeqID_23341; Location=251..812; Strand=-
  SCN-specific regions: Sequence locations=1-37,60-377,410-562
ctacattgaccattctgtgctcacatttatccgttcaaacaagccaatttgggacagaatgggcaccaaatttgagttttttgcgaaaagcattcgccagttgggctttaccagtggcgatgcctttgacaatttgcgtcgtctgatctcgccgacaattctcactggtcttgaccaattgaattcaattgattccaatgaactgttccccgatggaattgctgacgatggaccaaatgcaactgctggccaagctttggtcaaatggcttcacactccgagcaaaaatggccaaccgaagcgattgtatcgcaataattattttggtccacagaatctcgaatgggtcaacaacttcaaagaggtgtgtctagccatattttctataaattgtttttgtttttccaaatttgtttagacatttatcagtgccaccacttctgtcagttacaatattcaactttattttcatgtgaacacaattccaactgaaccatttgaattggtgaacaaacggacgaatgaaaagctgacactgaaacaggagatcgacgaattcgac

SEQ ID NO: 54052 - DNA, 1021 bp, Heterodera glycines
  misc_feature (30)..(30): n is a, c, g, or t
  misc_feature (71)..(71): n is a, c, g, or t
  Genomic contig location: Contig_ID=SeqID_23343; Location=598..1618; Strand=-
  SCN-specific regions: Sequence locations=1-125,184-205,249-254,276 -357,418-514,542-621,671-716,739-1021
cagtgggggctgcgtcactactgctgcctntggatgtgttgtcgcacgtggacctgatcgaaaaagctgcncagcaagcgtacgtaatacaaactgattaaattactgagagtcataaatccaagaaaatttaattttaaaaaatggtctaaattaattcttcaaaataaaataattttatttcatatatgctacttacaaacgcaaaataattaattttattataaaagaatattaaaaaattttatgttacccaaaagaaatgacttcaaaatccatataattgatatattttatgattaaaaattttcatcgaattaactctataaaataaatagtttagcaataacgattctgaaataaaataatatttttatataaaataagaaaaaattaatttccttaattaatataattctctagaatggcttgataatttaaagcatcatacatttaatgattcttttatctaaaataaatatctatatgagaaaaaaaaccgtaaatgccaatcaaataaataaattaaattaatttaattcactaagatttagctggtcgaaaatgcaagaaaaatagttcataacaaaaaaggtacaattgtacatatataaatcggcgaaaatattataaaacttgtatttttttatttagaattttcttattttatcagcctaggttatacaatttaataattaatgttttgttataataccattttttaatcaataaaataaagatttcgagtgtgctcgcatatacattacaaaaccaaaattaaaaaaagaaattcagataatgttgaaacggaaatagaggttttcctggacttgccgggaacgacggttgcgacacagaatgcttttacgcttctaagggaaattagtgagttttatcagttaatggcttgcagcagcaatcaatcatactaaacattcaataaaactttattaatgaaaaacgtacaattaaaaagtgtgtttcaacaaataacaaatgtttctcttttcttcgaatatta

SEQ ID NO: 54053 - DNA, 572 bp, Heterodera glycines
  Genomic contig location: Contig_ID=SeqID_23344; Location=123..694; Strand=+
  SCN-specific regions: Sequence locations=1-150,174-231,260-572
atgaaggaattaatagtgtcatatttttatggctatccaaaaaatgtatggtcgtttaaatgcatgaaattgtttaaagatcaattaattcacactgcactttatatgaaaagatagcccaaagatttctctattattttgctaaatttcaaaaaattttattgtttcaaaaaagttacggtaaaattgttgagcccaaacttttcgagcttttttgtttacaactttttgtaaatttctattaaatttttaaaaattacatacctccatttagaccatttcaatcccggacccgaattcgaaaattttcttaaaattcataaaaaatttgttgtagtgttgcttatgcattgatgctaagaaaataaatcgatgtcacgcattcacgagtagaacacataaacagcaacaaaatagtgacaaaaaggccgaaacagtgacgaatagtaagggcggggaccggtaaactggacaccagaaaattggacaccaagcggaaaactggtcaccgttggaattttggacaccgaaggaaaattggacaccggaaaactggacaccaagttcctaaa

SEQ ID NO: 54054 - DNA, 1250 bp, Heterodera glycines
  Genomic contig location: Contig_ID=SeqID_4321; Location=1415..2664; Strand=+
  SCN-specific regions: Sequence locations=1-837,859-859,881-965,987 -1004,1027-1089,1132-1250
atggacctgaacaatcgctttaaacacctaattaatgtgctgcaaagagttgccgtcgagtcatcagcaaaagcaacggcaaaagccccaccgcccgaaacaccaccatcagtggtgtaagtgttgctggggtgtcgttagagcccggacgggattggaattttgtgggattttcccgtggtccccgtcccgatttttttttttgaagaagtgcctggattggaatcatgaaaaattggggtttgaattagggttaagccccgactccgagccccccgacccgacccgagacgttttttggacctattccccgacccgacccccgacatgtcgtcccccgaggtccccgacccccgactttttgccccccgacactaattcgggggattatggactcggagcgttttaaaaaattcatctacgaaggcggaaaaatattgaaaatttttgagattttgaacaaattttcttaataaaattcattaaaaattacaaaaaactttccggcggcgcctatcggcacccggcggcccctcaaaaccatggttccgatcggtaatttttcaaaatatgaacaccaaggccgaaaaataagattttagggtcaaaaataataacattagcaacattttttcaaatcagtaaatttttacaatttatttgatcaaaattcccattataaactaaggacaaaacgaggttaaaacgaagattttggacccaaaaataagattaaaaaaacggctttttacattgtaaaaacagggctgctaactgaaaattttcaaaacctgcatttagccaacaagattcatcatttggggtcaaaatcagcactttggaaattttagtcaaaaaggaaaaacatgcttttttgtgacgcgctttttccgaaaaaaaatttttgtacacaggtgccggcgggagaattttttgaaaatttgagttcattttgctcacagattttcaccaaaaatgaccaatttttgcgcgattttgagaaaatttttaagaacaattttgcggactggcggtgccgataggtgccgccggaaaaaaaaaaattgaaaattgggagtttttgatagcattttttacataaaaaaattttaaaactataaatatatttaagaaatctgaacaattttcgtcgctaccccaaaatcagaacattcttataaataacgtactcttgttggcgctaaatcagatgattaaagtgaaaaaaggaagatttacgagctttaaaa

SEQ ID NO: 54055 - DNA, 192 bp, Heterodera glycines
  Genomic contig location: Contig_ID=SeqID_4321; Location=4071..4262; Strand=-
  SCN-specific regions: Sequence locations=1-50,74-94,116-127,165-192
aatatattatgctggtcagttcatatttttggagaacgttttaaagaaggataaaaataattattttattttaccgtcactagatatgcatatgtattttaaattttttattgttatgtaaactttaatatatatatatatatatatatttatttatatacataatcatatgagttggcggttttaagaaac

SEQ ID NO: 54056 - DNA, 1166 bp, Heterodera glycines
  Genomic contig location: Contig_ID=SeqID_4322; Location=1516..2681; Strand=-
  SCN-specific regions: Sequence locations=1-143,165-240,265-283,315 -777,803-955,990-1116,1138-1166
atgacggtacttggaaaaatcggtaccggtacaaaacggtaattactagctggtacggtatcggtacaggcactggtaccgccctaatttcgtgggaaatgtaaattttcgggtttatggaaattcgttcaaaatataccatattgaaaataaaaaattattatgatacaagttgctaattaattgtacgcatttaaatgacaccgaattttttggccttccttcccatgttacaagtcttatcaaaattaaatataaatatatgcacttaaaaaaaagatggattttaaatttgaatgaattttttcagttgataaagtgcgattcacttcaatgagttgtgtacccacaaggtcggcttgtgcccgtggctactatgaagatgcatttgtgacttgcactaatttgtactgctgccgggccgacctttgcaacggcgtgcccgaccgtgtggtccaaccgtgggtcgaaagactagggtcggtcgacctgggcctggtattttctgtacccagctaggtcctggaaaattttgactgcctgttttttcgtggacctccaaattcatagcatattcatggattctattttgctcaaaaatccggcatttgccgggaccaacatcaaaaagttatatcattcggcttcaaaaagttacgtaaaaaaacggtgctaggtcgtttcttaaaaactgccaccatgggcgtttcttaaaaactgccaagttttttgtactttcacgacggtcattatgaactaataagaaaaccacaaaagataaattaattatttttatttttttctgataagcttattataattaaaatttccctttgaaagttgcaaagaaatattgtagcacttattgtggcacttcattttttgactcatgctttatagcaccagtaatatggttttgcaactttaaaaaaggtaggaagtgctgaatgttcattaacaaaagtctgttttatttgtattttaaatagtttattttagagtgcccacgggaccgggacctggtttgcccaaaattcccggtcccgtggcactctagtttattttttagaatttgttatgcttgtcagttcatgtttttggtgaacactttaaagaataagaaattaaaaaagaaatacggatatataaaaacttatatcaataaa

SEQ ID NO: 54057 - DNA, 420 bp, Heterodera glycines
  Genomic contig location: Contig_ID=SeqID_4323; Location=366..785; Strand=-
  SCN-specific regions: Sequence locations=1-1,54-190,212-420
atgaaaattgaatttattttgttgattttattaaaaatttattcaaaaattttggcattccgtcttttaaaattttcaaagaatgtatgcggatcctgccggattccgcacaaaaatcaaatttgggatcctgttgcaggattggaattcaaaattttttgccggaccggatccggccggattaatcctgcaaatcctgcaaatcctgcattttccaaaaaatgcaggattgcggactgggatcctgcaaaatcctgcgcaggatccggtcctgctccgggctctacaaaggaccgaccacctgccactccttagaacttttcttcattttcgacaactttccattagacatggaagaaaggggacaaaaataacgaagaggggagaagggaaacagcaaaagagaattagcgtaataaa

SEQ ID NO: 54058 - DNA, 2450 bp, Heterodera glycines
  misc_feature (2378)..(2378): n is a, c, g, or t
  Genomic contig location: Contig_ID=SeqID_23345; Location=88..2537; Strand=+
  SCN-specific regions: Sequence locations=1-288,310-840,864-1356,1378 -1999,2021-2450
atgcaaaaacctactccttctaaccgccccaattcctctgtctccaaaacccttgcctgcgggcttgaaaaaattgtgaatttgagtggaaatgagccactctcggtgccggtgctggcggatcggagtgatccgctggggctcaagtcggtccaacccgacccggtgccaatggaaagtgccgaggctggcacaaaagaattggaagtgatggaagtggatgaaatgagcggagaaaaagggaaaaagggagaaatgggtaaagaaaaggtgaaaagtggtggaattgaagaggaggaagaaagtgagtgcagtgagggtgaactgctaggagacggtggatttggcaatttgcaactaaaccccagcctgagggcgggaaataaagcagttgaaaaggaagataaggggaaaccctatctggtcgcccaagtgagaagcgacggtgtgatcgcggcacggatgaaacttttctgggatttcccggaattggtctttgtcccttttagcctcttcgacaacgcccagccgatcgaaatcggcgatttgttccgcttacataagtgtgagtggacgaagagcgaaacaggatgggaagagcgcggagattggctgtatgaagcaaccggacggctgaactaccaagccacggcaacggacgtgagccaattgcgccagcgcatccccactcaggccgtcggcattttggtcgatgtgcaaagagcccgtgaccgacacgtcaaagtggccatggtgtcagcacctgagctgagctgcgtgatgcgcgcctaccgtcgccacttcccggccgatttcacggataccgacatccgctaccgctctgttgttcgtcttcaacttcggcagatcaacagtccgccatgggtgctgtattcacagcagtttgcgtatgttttgccatctgattttggtaaaaaaaaggggcgatgaactgctcgttcatcacgcaaacgtcattgctggcgttgagcctgagccaatgggctatgagttccctttcagtgccgaactgagctgggcgaaggtccagctgggtgagaaggtcatggcggcggctgtcgcagcgcagtcgttcgatgtgaaggctgatctgcggaagcacactctgttcgtcgagccggtcgtcatcaatgagatctcgacaagaagcgtgatcatccagttcgtcatgccggtgccgagcatcgaagagctcaccgaattgtgcaaaatctgggaggtcgatttggcggtgggttgcaaagtcaatccggcagccaaggcaaagccttgtgcgcatgggtatgtgctaagcatcgaaaagcgggcattctgtgtaggatacgagatcgatgtaaaagtgatcctttcctatcaggcagcgaaggagcaggatgcccaggaggaattcgatcagctgcgcaccggcgaactcgacggatgcgttgaactcatcccgcagacgtccgtcagggccctacaggaacggatgttcacgctgcggtccaatgactgctcgaaagtggcgaaggatgaggcaaaggtgggccgaatcatgtcgattttattgggccgaccggtaaaaccggaaagcccaaaggccaataacccattaatgacttttggggctctttcaaaattgaaagagggacagatcgacaccgcgctgtgcatgctcgacgaggtgccgcgcctggtcttccaacaggctgggcccggcaccggcaagacgttcagcgcggcgtcgatcgtggccacggtcctggccacggatcccacggctcgtgtgttggcgctggccccgccgaatgtcgccgtcgtcaagctggtgctggagatgcaggatgccctggccgccggaaaccacgtggagccaatgcttgccttgttctcggggacaggtaagttgagatatgccaaggaagttgagcggatttcccccacctgctcgccaccgcggtggaggcacaggactttcaggaactcctacagaaggaccaagaacgcgtcaaggtggagcggtacctggacgcctgcgagcggaacccacgcctggcccaggaaatggcagtggcgaaaattgtgcaggagcacaaaaatcgccgcttgtgcttcgccaccttgtccttctgtgagcagctgccggcactgttcggggagacgacccatttgatcatcgacgaggccggacaggcgccatacgtccaaatcctcaacttggtaagccaactcccctgcctaaccaaggtgctgatcaccggtgatcgccgccaactgcgtgtccatttgccctccctgccgatcgcaatccgtgaggacttcggcatggacacggtcatccaaaacctggatgtggcgcgaggggacggacgtcacancattgggtcggtctgttttcgctcgcattctgctctcgtcgctgcacggagggccggctttacaaccgcacg

SEQ ID NO: 54059 - DNA, 1322 bp, Heterodera glycines; identical to SEQ ID NO: 23346
  Genomic contig location: Contig_ID=SeqID_23346; Location=1..1322; Strand=+
  SCN-specific regions: Sequence locations=1-109,131-134,157-356,378 -1322

SEQ ID NO: 54060 - DNA, 342 bp, Heterodera glycines
  Genomic contig location: Contig_ID=SeqID_23349; Location=534..875; Strand=-
  SCN-specific regions: Sequence locations=1-176,198-342
atgaatgttttttgcttagtaggcgaaatgaatgttttttgcttagtaggcgaaatgaatgtttttggcttagtaggcgaaatgaatgtttttgggttagtaggcgaaatgtcagtaggcaagatgtcggtaggcgagatgtcgagtaggcgaaatgtccgtacaccaaaaaaaagttccttttctcttttttaatttcaatcaattaaaaacagcacaaattataaatttaccaaattggttttcaatacaaacattcaaagtcaacagatgcaaaaacaagacgaagaacaacttgtacgaagtgtcaaggaagcgagtgagattatcagaaagttttaa

SEQ ID NO: 54061 - DNA, 760 bp, Heterodera glycines
  Genomic contig location: Contig_ID=SeqID_23350; Location=813..1572; Strand=+
  SCN-specific regions: Sequence locations=1-395,417-538,575-594,616-760
atgaattctgaaaaatcagaaaaagctaattctatattattggaagctgcaaaaaaagagacagaaagagcatggcaggatgtagctgcgctaacggatgaagtaagcgattttgccaaatcttctcgcgaaacacttaatcgtgcaataaaatctagagaaaaggctccttactaatggtattcgagaattatatcttaaaatgtccgattcaatttgggaaatcttcacaatcctggacaaaatcaatttggagtcagaaaaagccgaatctacgtggcgtgatttcgagagatgcaaaacttttgaccaggcaacaaagctcgaggaacaatcgcaaaattcattaatggaagcccgaagattacatttcgagtcccgaagggttcagagccaaatgttaaattatgaaaataggctcaaaacaattgtttgggagcacgttggtatataagaacaaaaaactaaaagggcaacagccaaaatggaagggtgttctgtaattgagtcactatgtcatgagggcttaaaatttggctttaaaaaatataaaaccaaattttattttaaaaatcctttcctaattaatgcggaggaaaattttaaactaatactcgcatcaataatcgaaaaaatttataaaaaggaacagggaaaattcaaaagcattctgaagctttcctttgggtttgaatcattttattgccctcttagatgccctagcgaaaacacagccaaggctttgttccaacatgtcata

SEQ ID NO: 54062 - DNA, 497 bp, Heterodera glycines
  Genomic contig location: Contig_ID=SeqID_23350; Location=186..682; Strand=+
  SCN-specific regions: Sequence locations=1-162,184-220,263-497
agaagaaaaagagcaatttaccagtgcccgaagaactgtagaaggcgtatttagagacataattaggttagataacgaagcaaaagaattttctttttctgcacataataccatggttgaagcccaaaatataaaaaataaaaaccctgataaacctggtgtaaatttttggcatagcaaattattagatggagttttaaaaattcatgccctatttgacaaaataaaaaaagaagaaaaaaatatgaaaaatattaaaaaaggtatggaaaaatgtctagacagaaaagatttaactatgtgtcaagaattagcagaagaggccaaacaatcaatcgaaatagccaaaaattatcggcaagaaattgggcatatttatcggaccgcttactcgcagccagatttaggtattggagatttggcaaataaactaaaagaaacaatgcgcgaaaaccaaatacggtttgaaaggcaaagacctcaggaagaatttaggg

SEQ ID NO: 54063 - DNA, 1796 bp, Heterodera glycines; identical to SEQ ID NO: 23351
  misc_feature (84)..(84): n is a, c, g, or t
  misc_feature (105)..(105): n is a, c, g, or t
  misc_feature (166)..(166): n is a, c, g, or t
  Genomic contig location: Contig_ID=SeqID_23351; Location=1..1796; Strand=+
  SCN-specific regions: Sequence locations=1-14,38-364,388-506,532 -660,688-877,900-988,1010-1014,1079-1203,1225-1309,1331-1796
  Gene Ontology: Mol. function=DNA-directed RNA polymerase activity; Cellular component=DNA-directed RNA polymerase III complex; Biological process=growth

SEQ ID NO: 54064 - DNA, 128 bp, Heterodera glycines
  Genomic contig location: Contig_ID=SeqID_23352; Location=1120..1247; Strand=+
  SCN-specific regions: Sequence locations=1-128
cccttctacttcgtcagctgccattgcctctccgtcaatgtctgtggacgttccccccttcaaaatggcaccgtcttccccaaattcggccccctcgtcggatggcactttctcttttcaccaacaga

SEQ ID NO: 54065 - DNA, 214 bp, Heterodera glycines
  Genomic contig location: Contig_ID=SeqID_23353; Location=988..1201; Strand=+
  SCN-specific regions: Sequence locations=1-214
atgtccgccgctgcttccgtcgctcccaatgccgccccttccttccaacaacaactcggttcccatgcctttaatgtcggtggcttttcctcgtcctccgattccgtcggtgggccgccccgaccgcagccgtctcagatcagcagcctgcgcgagaagcggaagaacaacgagtacgagtcgccattggcacgcattggctcctcctcggggg

SEQ ID NO: 54066 - DNA, 908 bp, Heterodera glycines
  Genomic contig location: Contig_ID=SeqID_23354; Location=798..1705; Strand=+
  SCN-specific regions: Sequence locations=1-77,99-141,179-563,589 -694,716-716,739-908
ataagctaattgattgtttattcttcccattcccttattaaagggttcaccaaagtgttccacacgaggacccgttttcttctgattgtcctttgccttttgtgtttggccagcgtttgggccaacattttatgtaagaacaaattaattaaaatatattaacaaatgaaataaattaggttttaactttgccatcatttgcattgatcacaacgaaaaaagtgccaatgaaagaaaacaaacggacgaattggcaaatttattgaatgaaaacggcacagatcaaaatgggtaattttgtggaggtattcgaaatatcgttattttttttctaaatttccagaaacggcactttctccgcttttgccaatgccaatgtaaattcaaatggctccgccgtccccgcaaaaacttcgaaaagttttacgccgcgacaaaaactgtacctcacctcggcggtcgctgcggccgccttagtcgccaattttgcggttgtcactttggtgagtttcggcatttgtattttatctaattggctaccataattctaccgtatccgttttcctttgtttttaattacttttgctttgccaggtgaacaattacggcattcgcacagtgttcgttttgctcggctttctctccgccgtggccacttgcttgctgccaacggccattgaactcggctttttctatgttttggcttgccgaatgctccagggtattattcttccttcactaattagtcccattttccttttaattaccctaatttgtccacaggggtcactttttcctgcacttttcccgtcatcggcgcgttcacttccaaatggacatattacaagcagaatggactgttcgtctccgtgttggtcgcttatgtgcaatttgcgccggcggttacg

SEQ ID NO: 54067 - DNA, 743 bp, Heterodera glycines
  Genomic contig location: Contig_ID=SeqID_23355; Location=17..759; Strand=+
  SCN-specific regions: Sequence locations=1-743
tcgccggtgtctttgtgcagcgtcgtcgtgcctccaccatcgtcaccaattccttgctgttggcgctggacaagcctctcgacctgagcatcaagagcacggtcattctgcgtgacgaatggcttctgctcggtgcccaggagggactgttcgccactccgatgagtccgcaacagttgcgcgcccccttccgaattgcgggcgtctgctgcgtctatgatgatttaatcaaaaaaaaatttaagttcagaaaaattattttgttgttacaatttttatttttgatgattaaatttagttgttttatgtgtttaattttttacacataatttgttgacatgcgaatgtgatcaaaaaatatgtcagaaagtctaatttgtatagtaaaataattttatccaatttaattaggtatataatatttttattgctggagaatgtcttcgtctgcgatgggaactcaacccggtgagcttttatacttccttcccactcccattggatactttcaaacaaaaaaagtgatggagtctaatttgtgtgcgtcggaattgagtcgatttcatttttattaagctctcttcgaccgttccaacatttccgttgcggtgtcctttttggccgggggtttggccattggctatttgctcggctggcgaaccacggcttcaaaattggcccgatgcaacacgcgagtgcagttgagcaaggacatggaacactacgaacaggaactgcagaag

SEQ ID NO: 54068 - DNA, 1298 bp, Heterodera glycines
  Genomic contig location: Contig_ID=SeqID_4325; Location=121..1418; Strand=-
  SCN-specific regions: Sequence locations=1-648,670-1298
atgcgcggtccttcccacctgaaatgtctttccgatggcaattggaatggcactgtgccaatttgtgtccccgccacttgccaaggcatcaaaaacaacacggccatcggactgttcgtccgtcccgactccatctcaattccgtaccgacacaatctgagctttgtctgctcccaagccaaccgtccgtcgaagcacagccccttgggcgaaacgcggcagtgcatttacgacccgcgcactgatggcactgagtattggctcagcggatcagaagtgagctcgagtcccaacttttgctggacaataagcttttcgcgccatctcagtcccagtcatgtttttcccattgtctgatcacaggtgatttgtccgttgatcgattgtgggtcgcccccggcactttcgggagcgtatttcgagagtgagaacaatgggccgggcaccttcaaagttggcagtgcgttcctcttccaatgccgactgccctattccgtcgttgggaagtcgtcgtacgacgaccgaatgatccgttgcaacgtggacggcacttgggatttgggcggtaagcgaacgataccaacccaaaattggattgccattctcagatttgcgatgcgaaggaccggtctgtggtgagtgaatgggctgaagaagctcatttgttgcctaattggatgtaataattggtaatgccaatttcgcagttgacccggggcatcccgacgacggacaaacgcatctcgactcaatcgaagagggcgcagtcgcccgcttcacttgcaatcggcccggctatttgcccttcccgagcgacacgctgagctgtgcccttggcaccgcctgtgtgttgagcgaagatgtcggcatttccactggattcattccggacggggccttctctgacaactcagacaaaaccatttggggctacgaggcaagctctggaactttcactttgacttggttggcactgatcaaacgcaatccatgccatcccaatcccattccgtgccattatataccagggttgccgctggataagaaaaaaatcaggaatcggaccgggacggccaaagtttttcgggtctgggtttgggattataaaaaaatctcggaactcggattcaagctaaaccctcttctaccctcattccccattccgtgccatgcttttccattcgatcccatcgcgtgccattccctcgcctctttagccacacaaagctcgcatgtcctcaacgggttggtgcggttccaaagatgcgttcatcttcctggcggtggacctgcaaagg

SEQ ID NO: 54069 - DNA, 2511 bp, Heterodera glycines
  Genomic contig location: Contig_ID=SeqID_4326; Location=1457..3967; Strand=-
  SCN-specific regions: Sequence locations=1-861,883-1095,1132 -1215,1237-2511
  Gene Ontology: Mol. function=selectin; Cellular component=integral to membrane; Biological process=inflammatory response
atggcaaatgtttgtctgatcgctttcgttgcgacggcatcgacgactgcggcgacttcagtgatgagcttaattgcccctgtaagaatttgcctactgaatgcgaccatattttgcaacagttcatggtgatgcttcttgtcaacgttatgaaaagggcgagtcgggccgaatcgaaacgcccaattttccgtcgccgtaccccgcgggagccaattgccgttgggtggtggagggacctctcaattcgcgcattcaggcaaagcacacaacattactctatttgacactactcattcagcttaactttgactcatttgaaacggaacagcatcaggacttggtcagcgtcgtggacggaggcccggccgaaaatgccagcatttcggtgagggcggagggagggaatactcgcgggcaatcagtgccatcattttattttgtgcccgttcagttggtcactttgtctggccaaccgcgtcctccccaatcgctaacatttgaatccgcttccaatcggatggtcgtccgtttccgttccgaccacgcaattcaagcgcgtgggttccaagcgtcgtggagagccggtcagtcgactctttcgcgagtttttcgttggccgagccgttgggtactgcttttgcttttctttcagtgtctgcttcatgcggaggtcttctgagtgttcagtcgcagcctcagcagctgatcagtccggattggccccgtccttacccaaatggcatggaatgcgtttggcatatgaacgcacccgagggacaactcatctctttggcagtgcgttgggaaagcggaaaatcaacggcataaagacggaattgccattaaggttgaagaatttgacttggagcaggacaaagattttctgatgatttacgacggggcccatccttcggcgccgttattggccaaactcagcggcaaagtgagccaaaagccatgggaaaagcaataaaagtgcaaactttttcattcagtcggacccccagctgattgtgtccactcagtctcgcctctatttgtacttcttcagcagtcaatttggcaacagaaaaggcttttcaatttcatacaaaaagggtcagtgtttttcttttattttgaccgaaacggaaagtgccaataaaattcggtaataatcagtgccattccctctcgtgataaattgcccaatttcactactccgtcctttctcaggttgtgacaatgtgatccgtcgttcgcatggcattttgacaagccccggcaacgcccattttccttatgcgccggcacaaatttgtcgttggaccatcgaattgccaatggcacaaacggaggaaaaaatgtgggaacggacggcggcggagggtaaggaaaaaggacgcaacaaaccggcacaatttgatttgcaatttataacacaatttgataatgcttttagaagcgatttcgctgactttggccgtcaattcgtgggatgtgtccgattcgggtgattccctgcgcatttttgagtattccgccgatggacaagccgaggaggggcgtccgttgcatcccatcgaaaagggattcggcgcggagtcgccgccccccaaaacggctagcgaaccagcgaaaaaacagacagtgaatgaatgtggatctttttgttcagatattcgctcgtcaaagtcgcgtggaattggtttggcgtgccgacgaacttcgccagggcgtcggatggaacatttccttctccacaagtcagcccccccagccccggcatttgtccattgatcgtcctctttggccaatccccgcaggttgtccccgactgtcacttccctcgcggcgcgtgttgctctccacgcggaacaccgcctacggcacgcgtgtgacggtcagctgcgaacgcggtgccgagtttgtttcgggtcgtggtcggcactttgagactgtgtgcgagttgggcggtcgctggtccgagtcggagcccatcccggactgtcaacgtaaagccatgtcaaaagcgtcgatttagcaattctcccattgcctttttcagccatttactgctcccccatcccgcaaattgctaatggtttcgctgtgatggcctcaaatgtttccttcgccggcatcgcccgctttcgctgctacgacggcttcggctttccttccggcaaagaaatggaggaaatcttttgcaccgacgaaggccgatggacccaaacgccgaaatgcaaaagttggcactttcgaatgccaatttgttgcttattttcttcctttaaatcccaatcagcacccatctgtcccatgttgcctgtgtttaactttggcgagcgatcgcttcaatttggcgacggcatcggatacggtagtgtctacagtttccaatgttctgccgggtacagacgagacggagcacaaaatattgtatgccaatccaacggacaatggtcagcggcccagccgcaatgtaaaagtacagtacaatgtgcagggagcattctattgccataa

SEQ ID NO: 54070 - DNA, 610 bp, Heterodera glycines
  Genomic contig location: Contig_ID=SeqID_23357; Location=555..1164; Strand=-
  SCN-specific regions: Sequence locations=1-99,121-522,550-610
atgacaattttctatttaaaagaaatttgtcttttctgtggcttgttcatcgctttatgtttagataaatacttaaaaaggagattagactcatgaacgatttgttaattttttatttattcgagttaacaaatttctttaacttgataagatctaacatttagatatttatgttacattctgcttaaaaatcgtgaaattaaattagtttctaatattgtctaaataataaaaaattaaccaattatcatattttagattaatttttgttgcagatgttttgcatttcataataaattttatttccctattttcaattattaatttacaggcttcagtattcagttaaatatttttgaactatctgtacaattttggttgttttctaatcagttaataatatccattgagttatgatcggttctctgaaaaatggccgttataactgttgaccccatatttgtgaaaatagttaggtatattaaaattacttactcatatttatactcttaaaagcttgagaaaaaattataattaaaatatatatttggttaatgaatatatcataaaattaaagttaacaaagcctaagagaaaaatattaaataaa

SEQ ID NO: 54071 - DNA, 2247 bp, Heterodera glycines
  misc_feature (4)..(4): n is a, c, g, or t
  misc_feature (86)..(86): n is a, c, g, or t
  Genomic contig location: Contig_ID=SeqID_23358; Location=15..2261; Strand=-
  SCN-specific regions: Sequence locations=1-129,178-754,791-1194,1216 -1226,1282-1322,1356-1890,1931-1958,1980-1982,2004-2108,2130-2247
atgncattcagtggaactcggaaacaaaaatatattggtggtcttaaaaattatattaatgtggaaacaaaggatgctaaggattngatggcatatgtgaagacggggagaatttgggtaaatcagtagtaaattaattctaataagaaaaataaatcaaattatttataatttttaggaaacgtttggaccgattccgcctccaatgtatgcagatcgtatgcgcgcttttaggtatatttgccttacaatttgtattttcttctgctcactttttcagacctaaaaattaccaacaaaaaaattaattaaatctgctaaaattattgttaaagtgtataataaccaaatgagttacaggcatcaattataggatgtcatgtcttaactaaatcccattgcctattcattctaatccccattatccgttaaaatattattttcaatttgagcatggcttgcgcctttcgctggaaagcatcgacagaaaatgttttgccgtccgaggccattcgacaagcgcttatttcggcattttgcgattcgtacggaaagtcaaaacaattcaaagaaacagaagaacaattggaggaagcaaaaacgaaaaagtggacggatttggtgcagaacgaatattcaattgcccaatacactgtgaccatttttggggtcgaactgttcaagcatttgatggagcaatcgggcaaatacacctggaactttttggtaattcgtttaaatcgaaatgaggaagataaatacaataaaagaatttttaatttaaaattttcatcaccgttaggtccacgctgattgaattttgctcggatgcgtaaaattggatcgcaatgagcacgacgaacagagtggcaattggcaacatcagagacgaattgccttattcaattaattatttgtgagcaatgattaaaagtggccaaaaatgggtccgtttaaatagcaaaaattttgtgaagaaaatggtgtaatattttgaaatgtgaattggttgtgcaaataacatttttatttgtattatttcggtcataatatttttaacgcaaataaaattatggaaatacaatacgagtccatctttgaaatcccaatcctcttcaagtattttgatcaagaccaacctgattttttctcaagatatttaaaaatttagtttttttagataaggccatcgccttttttcaaatttggttttttaactgtttgccaataattttttttttaaatactatttttatttttgtgtttttaaataataaataagacagaaaaaaagtttaataaaaaaaccgaaaatgcaaaacaataacattgcaaagaaaaattacataaataaatctaatactaagacagtttacccacacacaaatgatgctaatcgaatttagaaaactgtaatttaagggtttttttgagtaatgaaaaaaaattcaggaaatgattttataggatcatccaataaaaattctttggattcatttttccaggagaacaaaatttcgtgtcgccatttttagggccaaaacccaaatgtgtgcccagtcttacgaattatcagcatcatttgcatcccatgaaaaagaaaagtggtaaaacagaaaacacaatgctaatcaaatgatcaacaattttctatctaagctgttctttctgatcagctgatcaccatttggctgatcattggtccactttctttggtcgtcctcatatttgccgatcacttcgaaccactttggtctgatctgagaagacacccttcacatcaaagttctgcaaatccttaatccgttgatcaattcaaagattatgttttctcatgtttttttcatgtacaataaaattcaaaaatttcgttggcggtttgaaaatctctaaataaatattattattaaaaatttttaaaataaaaaaacattcctccatttttaaggaatgaaaattaactgttaaaataaaaatgtgacaaaattaattaaaataataaacggtttgccctctgctcaataatttaaaatagagagtattacatgtagtttcgtttttattttaaatatgctttttgaaagaattgaaaaattatttaaatagaatattttagtgcatttaaaagcattaaaaaagtttcagttcaatcaaatatatcaacttcgttcattattctatgcacttcacttctccatttgtcgcttcttctatccaattgcaatcaatttgagtgtagtcagctga

SEQ ID NO: 54072 - DNA, 163 bp, Heterodera glycines
  Genomic contig location: Contig_ID=SeqID_23361; Location=88..250; Strand=-
  SCN-specific regions: Sequence locations=1-117,139-163
atgtcccctcttcgttttctcgccgttctgctgctgatctgtgccatgttcagcttcaacaatttggggctggccaatggcgaggaaagcaaagacagccaagtcgctctccgtcccgatgttgctgctgttcagcctgacctcgtcgttgttcgcgctcgcc

SEQ ID NO: 54073 - DNA, 315 bp, Heterodera glycines
  Genomic contig location: Contig_ID=SeqID_23361; Location=988..1302; Strand=-
  SCN-specific regions: Sequence locations=1-192,214-291,314-315
atgaagagaatgaaaatgccaatgccaatgcacttgctgaggaaccaaatggagacgaagaactcactcaaacaacaggtgttttttgcgcattattaaacaatgtttttgctgaccccggccatttgccgaaacagaaaatccagctgatcatgatgaagaagagccatcagattctgagcttggccaatcgaaggttaatggagaagacggtgccgactcagcgccagcagcaatcattcaaaatggtgcgacaaatgcaaatttaaaaaacgcctattattcaagaattaaatataataatatagtaataaa

SEQ ID NO: 54074 - DNA, 691 bp, Heterodera glycines
  Genomic contig location: Contig_ID=SeqID_23362; Location=516..1206; Strand=+
  SCN-specific regions: Sequence locations=1-37,64-129,158-254,335 -410,441-452,475-691
atgaaaggtgtaccagcggaagaagaagaagcagtgacggcaccaccaccagcagcagcagaaaatttgccggaggcagaagaagaagaagcaccatttgttgttgtggaggacgaagaagtgcgaatggcagcagcagcagcagcagaagaagcagttgtggtggagaatgaagaattaggagtggcaccactaccacccccagcagaagaagaagaagaagcagttgtggttgtggaggacgaaggaatggaagtggcatcagcagaagaagcagcagcagtgattgatgaggaagcggtaccaccccctgcagcagcagcagcagcaacggaacacattttggatggagatgagggagcggatgcaatggataccgttttaggtagaaaatatcataaatcaataacaaaataaatacaatattaaatttatttattcatttccagttttggacgatgggtcacctggacaaccgggacaacccggacagccgtcgcataagcggcataagaggggcaaagtgagtgcccaattttttatcattcacctaaatataatttattcttattatagaatgtggcaggatctgagcgacgccgaagacggattgccagggaagccgccgcccaaaatcaatgattttttgagatgaattgttgcatttaattttttaaattgttgacaaaaa

SEQ ID NO: 54075 - DNA, 558 bp, Heterodera glycines
  Genomic contig location: Contig_ID=SeqID_4329; Location=1470..2027; Strand=+
  SCN-specific regions: Sequence locations=1-55,101-164,251-376,420 -434,465-504
atgacgtctaaactgataaaattggcggaagaaattcgaaaacaacggaaatgggtaattaaataaaaattgttttattgattaaacattttatttaaaagcccctttatgatggctgccatattatttctgcccattgattgccttttatgaataatttagcctaaatttacaatttttatttttaaaataaaaatatttaaattatataatagaaaattttcatttttaaaaattcattttatttaatcttctaactaaggctaaaagcataattaatttgaaaggtgctatgacgttagtcaaaaaccatcataatgggcgttagtcaaaaacccatcaaatcagacatttgacattttaatgtcatttactgatttttttttataaaatcaattaagtaataaatttaaatatttgcctttaccgatttcaaatatatttatataaatatattttatattgcagctatataaattccttttggaatctccatcatattagaataaattaattttaataattatttattgtaaataatatattataaaaattata

SEQ ID NO: 54076 - DNA, 1750 bp, Heterodera glycines
  Genomic contig location: Contig_ID=SeqID_4330; Location=961..2710; Strand=+
  SCN-specific regions: Sequence locations=1-892,915-952,974-1467,1490 -1536,1558-1750
atggaatgtaaggaaagatgcaagaagtgctgtagaatggggttcgggtttccatgtgcggatgtgtgtgctgggatttattgcgcggagtgtaatcgcaacttctacaatacggaatgttttgagtctcacaagaagactgcttgtagggagtacaaaaatgcgaaaagtgtggagagacacacaacacaaggaacaaacacacatgtggggagaaattctgccgaatttgtaaaatttatcatccaaagcggggctgtttcatccagaagttaaaaattcgttcagcgaggaaatacagaattgttgcatatgatcttgagacaacattgtataacggagtccatgcaccgaatctcgtttgcgcggcgttgacatgcagtgagtgcgttggagagaaaaggaaatgtgagatttgtgaggaacagaggatgttgacttggtcggcagcaaatgtggaggaccctattggcggatttatcgattggattatgggcttcaaacaatttgaaacggttgctttttctcattatgctggacggttcgactcacatttcgtccttcgtgtgctgacagaaagggggcttaacaccgaactgatgatggcagatctgaaaatctatcagataaaggctaagggtgtgtactttcgggatttctggttgctcagccaaaaaaaattagcggatcttccaaagaccttggggctgagcaacccggcaaagttgtactttcctcataagtacaaccaaaatgagaactttgggaagagattgtcacacctgccgccttttgatgattacaatccgaatgctatgaaggaggaggactatgagaagtttgaaggatggtataacgagaattttgagaccgaatttgagctaggttagagaaataaaattttatattttaaacacgaattttttaggagaacagctcaaggtttactgtcaaaatgatgtggaaattttgatggaggcaattttgaaattccggcaattgtttttggatattactgacgggatggatgtgttgaaggacagtgtcacaattgcgggggtcgtgatgaggatattcaggacgaaattcttgaaggacaggcacattccgatcatgccggagggaggatatgagagagccgagaatcagagcaaaattgccgtgaagtattttgaatggttggcgcactgggaaggcctaagagtcagacatgcggaaaatggtggggagattaaattcggggacctcaaagttgattgcgtcattggtgggcagaaaagaataattgagtttcaggttttttaaatagtagtcattcgtttaatgtcagttcattaaggggtgtgcgtaccatgggtgcaaaaattgttttttgccctgggctgttggaccgaacgggctgtgcatggaagagaattacagaaggacagagatgcggatggaagcattgagagatatgtgtaaaaatttcagagtggatgaagttttggtttgtcaatttccaaatttattgataactgaacaaatttaggaatgtgaggtgaaagcggaactgaagagaaaccgagagatgaagaggttctttgaaagtgtgccggataaggggccgatcaatccgagggatgcttacgccggaggacgaacaatgcctttttgtttgtacgcaaaggctacggaagaagttgagatatcaatgtttgatatcatcagtttgtaccccttcgtgaattatggtaaaaaatctgcttaa

SEQ ID NO: 54077 - DNA, 998 bp, Heterodera glycines; identical to SEQ ID NO: 23368
  Genomic contig location: Contig_ID=SeqID_23368; Location=1..998; Strand=+
  SCN-specific regions: Sequence locations=1-35,57-216,238-366,388 -545,569-621,643-998
  Gene Ontology: Mol. function=calcium-transporting ATPase activity; Cellular component=integral to membrane; Biological process=hearing

SEQ ID NO: 54078 - DNA, 1601 bp, Heterodera glycines
  Genomic contig location: Contig_ID=SeqID_23369; Location=174..1774; Strand=-
  SCN-specific regions: Sequence locations=1-216,243-463,497-647,677 -690,713-718,740-900,922-938,960-1334,1378-1549
atggcatttgtcgtacttgcgacggtaacagcaatggtggtggtggtcgtggtggaaaaggcaggtatggttggtggtgtaccggcaacggaaatgtcaaaccatcataccacgcaggctaaaaccgggtaagaaatgtacatttattcttaaacgaaaagattacaaaatttgtttgtccattaactgcaaacggtgctctaatttcagtgaggttctaaatatatttttaaagaggaaacattactgacaacttgccctcggattcgacattgagtgcgttgtgaaaaaaaaaataaaatacaaaagctaaaatggattctttttttttaatgtgcaaataaagtgacttatgcaataggcattactgccttttattacgcaaaaatagttggcctttttcaataaaaaaaaatcgctaatcattgtaacataataaacttagccaacagcgatagaaattaaataaaatccaatcatcatcattatcatataaatttaatgcattacagaatttaagaaaatgtttggggtcaaagattgacgaacggaggatggatcggaagggacaaaggggtaggtaactttttttgttgaaaactgtaataactatcaattttaaaagcaataagagaccaatggaaagcataaaataaaataatttactttatttaatgtgtaacgggtttaattcaattattttggtttatttgttaacagtgttgaaaattattatcaacatcgcaattcccaaccgataatccactggcaaattgagaaacagcccatcagaagggcaacatttcgacaatgttgaacagaaagtcgggcccgaaatttgccttgacggagtcgttcatgtccacgagagtacagcacgcatacatgtgaaacaattcggcttgcaaaaattggcttgcttaagaatgaaacaattcgaatttgttttgtcttttgaatccattcatttactcacaaattttgtggccattcaatgtgaaaaaaatgccccggttgtttgcgtccattccgcatccgacaacatcaccgggaccaaactgtgcgaatccgtcaagcacatccggcacgcatggcaatttgctgtggatagacccgtcgctccacaacgcaatgcttccctcaaaatgcccgaccaattcatgcatcctcatgtgcgctggggcaagtccaactccaacgtcccttaatataatcaaacttattttaaaacatttttttttaattcacgatttcatctgaagaacggtaatttcaaagtaaaacaatccaaaggcactgttggccggcataaccgagcgcaccgacacaaaatctttaaaaaaaaataaatatttatttattttattaatattattacagttattttgcgacaaatgctcgaccaacaaaaaatcataaacgtaaattccctcgttgcaatgattaatgtcccagctgtttaattgctgggccgcgagaatggactgaaggcaaattttgatggtttcaacagttcgggccagattattctgaaaaaatgaagagggcgaataattaacaatataagaaaaaatatataatttgttttttattcaattaaa

SEQ ID NO: 54079 - DNA, 49 bp, Heterodera glycines; identical to SEQ ID NO: 51181
  Genomic contig location: Contig_ID=SeqID_23371; Location=393..441; Strand=-
  SCN-specific regions: Sequence locations=1-49

SEQ ID NO: 54080 - DNA, 132 bp, Heterodera glycines
  Genomic contig location: Contig_ID=SeqID_23372; Location=13..144; Strand=-
  SCN-specific regions: Sequence locations=1-132
atggtttcttcaatacgttttactctttcagctgcttacgtcgtgctttcctgcaaagactttgtcgaatttggcgaaaaggtgggccaatgccgagagatcgacgacgaccaaatgccgggacagatcgat

SEQ ID NO: 54081 - DNA, 756 bp, Heterodera glycines
  Genomic contig location: Contig_ID=SeqID_23373; Location=890..1645; Strand=+
  SCN-specific regions: Sequence locations=1-241,280-441,477-615,637 -723,748-756
atgagttttgtattaggaaaagccgaaagctccaagtaaaaattaaataaaaaccattaatttaagaccttgttaatcaagaattgtaatcatttaaattaactaaaataaattgttcaaacagttatatgtacaataaaaaaataaactacacaaaacactggtcgaaatataacagtaaaagataaaactaatcacttttatgtgtttaattacccacggttgagattactcaacatgctattttaataaataacaaaatacaaataaatttataatctctgttaaatcctaaatgtttatatattacaccaacgaaacataaattaattgcaaaaattgacattggctgggcctaattttaaagttgatattaggccagatacattagttagttaaatttcttgccaaaaactacatgattttaacatataatacaacaaataaaattgtttaaaaataaaaatttaaaaaaaggtctaaaaagcataattttatcgccgaagctaaaaaaattgtttcacattacagcaacattgaacttttattggaaatttcaattaatgccaaattgaggggggcatcttaaaaatttcgtgttttatctctaaaatttcaaaattaagtttataatttttcactaaaaaatcaatctatttaagagattatgataattaaattttatcttaaaatacattgcattatgacgagtacgtgatttgtagggtttaaaaatgaaaaataataactttttaa

SEQ ID NO: 54082 - DNA, 625 bp, Heterodera glycines
  Genomic contig location: Contig_ID=SeqID_23375; Location=1392..2016; Strand=+
  SCN-specific regions: Sequence locations=1-542,564-625
atgccgtccaaaagcactgacggacagccgattgtggtcactgggcctgacaaagccagcgttgaagcgacggagaaggcgctgagagcactgtgcccagtgacggaactcatcgaaatgaacgcggaacatcgctcgtcacttatgggacgtggcggagcaattttacaagaactcatcaggaagcattcggtaactcgtcggaatgccttttttctcacaatcagcagggaggttacaattagtcagattttcgcgcataaataaacaataaaaccgttttttttgtatttaaactttccaggtccaaatagtcgttccccgaggtgaagcaagttcaagctgtaatgtttcggtttccggtgcccccgaagacgtccgtgcttgtcttatggaaatccgtgaacatattttaccaattacacgcacaattttggttacacctgaaattcgaggtgaacgcatactttattgacttatattctataaataatccattaattaattaacaatttcaggctccttgatcggctctgggggtcacaaggtgaaggagctttgtgacaaatttctcgtgaaaattcatttttcgaacaaaagtgcatactgttgtgaaattacgtaa

SEQ ID NO: 54083 - DNA, 792 bp, Heterodera glycines
  misc_feature (119)..(119): n is a, c, g, or t
  Genomic contig location: Contig_ID=SeqID_23375; Location=161..952; Strand=+
  SCN-specific regions: Sequence locations=1-527,550-792
atggagaagcaattccattgtcaagtgatcggaaagggcggcgagtttttacgaaggctgaaaaggaagcacggagtgaaggaaatcaatgtgccatcagagttttccaactcggaccnaggtgggcatggagaaggtcaagcaaagggacccctccgtttttcagattcatattgaagggccctctctcttcagtcttcgctcatgcaaagacgacctgcttaaactgttggatgattggcgcaacgattgctacgaggaggtgccggtccagcgtcgttttgtgccgatgattcggggaaaaaattcgaacaaaattgtcaatctgctggacggactgcccagggtcgaagtggacttaccgccgcacacaaacaacgacgcgacggaggacagtctgataaaaattaggggacataaatctgaggtgagtcggacaccgacagaaattatttgaaaataatgccctccaatgttttccgttaggtcactgtgtttgttgaacgtctcaaagagttcgtcgacaatttggccaagaatcatcacgaagacttcattcaattgcccatggacgaccctaatcattcttctttggagtttgccaaattcgtttgtgcaaaaaagaagcagatagagcatcggttgcccaagttgaagttggacttccaaagcgatgacgacacagcacaaaatgcgaaccgaacggttcgactgattgggccgctggatcaggtggaagccgccaaagagacagtgttggaactcatcgggagccttagggtctgcatttga

SEQ ID NO: 54084 - DNA, 741 bp, Heterodera glycines
  Genomic contig location: Contig_ID=SeqID_23376; Location=1292..2032; Strand=+
  SCN-specific regions: Sequence locations=1-206,228-356,378-621,643 -673,699-741
atgggcacctgcccgccagcgaaacgtcgaaatgagcactcagacccccgcccccaccaaccccatgccccatgggcacctgcccgccagcgaaacgtcgaaatgagcactcagacctcatggattccacacattgtcaaaagtggagtccttctgtctttgattgatagggttgtctttgtacctgataaaaatagtcggtcataaatttgaagtccttctgcctttgattgctagggttctctttgtaccgcataaaaatagtcggtcattaatttgaagctccaaatcacccacacgctatgcaatgctcttcatccgtccacgccagtgtggcaaatgcccacaacaacagcggcgggagccaataatgccaaggtggagcaaaagccgccggaattgaatgccgtgccgaaaataatggcatcgacaatggcattgcgcaatggtggtcagctgcagatgaacaacggcgggaactcaacaaaatcgacagcaacaaacggtgccgtcgtcaaccattccaagcagtaccaggaacaactgctggagcaacaacggagagcgagggaggcgcagagcaacgacgactccaacgagtcagcagcaacaacaacgatggcatatgatgaggagctgcagcagcacaaccaccaaagtttgaagcaggacaggggagaggaggagagagaagaggacaacagcaggcgaagacaactgctcagggaacaatgcttcaag

SEQ ID NO: 54085 - DNA, 972 bp, Heterodera glycines
  Genomic contig location: Contig_ID=SeqID_4332; Location=591..1562; Strand=-
  SCN-specific regions: Sequence locations=1-972
atgcacagcggatcgggccgaccgaaaaaactattaatttctccatctgaaattgctacgacttcgaaagctaatatggaagttattaatcatccacaagctaatgatttgttgaatttattcgcttctgaatctattcaatttccaattagtcaaccaatgattgatattgaccgtgtgacagttgctggtgtcaataaggaagtaatctcaagcatgtggaaagacaataaggaaatgtttactgaggatttgatctttgcttttcaacgatatctcacgagagtgattacaaacaaaaaagtggttgttgtaaatcccctttatacagacttaaacatgcattttggcatgcatatatttgattacaatgctttagacaactgttataattattcgaatgattatgatattttgcttatgacaataattttcccagggcactttgcacttataatatttgatagatctgatcgtgaaaatattcaatgtttgtttatcgattctctgccagattacgatcgccttactgatacacaatatccactttatgatttccgcaaaacagaaataattaaaaagggaatctgcgagttaacgcctgggctttcacaaactgatattaatattcgaaccttaaatcataatgaattcacacgtcagaatgacggcattaattgcggcgtctttgtaattttatattccgaattatatttgctgagcggttcattgtttttaccaaatttgaacattaatgttgaaaggcaccggatcctttggcatttaatgaagttattatatagtaatgatgtggcacatgttggacgtaacaatttgattacccatcaattggttcaaaatccgtcgttacctttgtataatgtggagtcagttgttgatgaaacatgcccaagggatggaaatgcagcttttatttgtgtagagcctgaattcgacactgctccagaggtg

SEQ ID NO: 54086 - DNA, 384 bp, Heterodera glycines
  Genomic contig location: Contig_ID=SeqID_4332; Location=2401..2784; Strand=+
  SCN-specific regions: Sequence locations=1-346,368-384
atgaagggaactcaaagtaacaaaatcaattgggttttgattttttgtgaaaaaatgatccatcttttgttttttcgtaagaggcagacgggaaattgtagcccttgaagttcgaggtgtactcaaaccaattttttgaaatggattgatcattattgtctgaaaattttctgacactgttcgttttcttgaatttaagttttgtgatgcactcaaatttaaaaattcagtgaacgcggaagcttcactaagggacgagtgccctaaggaggacagtggtcgatcctcagtttgcgtcttcctcgcatcacgtcttcttcgttcttttgagggcattttttaactaaattcaaaaagataaatatatcaatgaatgcatcaaaa

SEQ ID NO: 54087 - DNA, 431 bp, Heterodera glycines
  Genomic contig location: Contig_ID=SeqID_23378; Location=743..1173; Strand=+
  SCN-specific regions: Sequence locations=1-140,173-222,244-431
atgaaaaaagtggacatagaagcctcaaaccaagttagaaatgcgtttttcatgcttattatcacgccccaagttagcaaaaaaacaaaaaaacaacagcatatgctgcaaaatgagcactctagtaatctattttacctaattgaaaaatattcaaaaaattaaatttaatcccgattttagtacggaatatcggcaggcattccaaacggagttccaatttgttttcagaagaatttcaaatcaaaatcaagtaattccactgcagaatacgacacaattatgagaagtttttttttgcaaagaaaaaggaggaaattgaagttctctactgatatttttacaattagccaatttttaagggttcgtgataacgttcggatgtctaattgttgtctataagtaatcaactaatttaatgggtttatcga

SEQ ID NO: 54088 - DNA, 872 bp, Heterodera glycines
  Genomic contig location: Contig_ID=SeqID_23378; Location=1629..2500; Strand=-
  SCN-specific regions: Sequence locations=1-34,56-134,158-182,204 -388,411-548,570-617,646-753,776-872
atgcggtaaaaaaaatgacgggaataaaattaattagttaatgaatataattattgttgaaataattgcttttaaagcccggaatagggctcgttggtactgagatgggctttttgctcgaactttcttagagaaaaattttggaaaacatctcaaaaaatgcggcaaaatttttccgctcctggccttaaaatttagtttgtaggaaaaagccgtcaggcaacagcatgccaaaaagcccgttttggccaacggagcgccgaacgggccttttccacggctttttaaaacgggcttttcgtaataaatttctttaccaagattgggtattaatcaaatttggcttagcattaatgttagcatgagagatatttttgagaattacaaaattttcaaaaatttgataaaaaatacgcttaatccaattaaaaaaaatcgacaatttgaaaaggcctaagtctattcgataattctttaagataatacattttttcgaaaatttccgagatgtcagatttgcagaaaagttattaggtgtacaatttggcaaaaaaaaaatattaaattttccaattacctaactgaaaattcgttggatcaataagggcaaaaattcaaaaattaaattccaaataattttttaggagattgatcaacagaacagtgaggacgagaaggggagcagcaccagcacaaagcgtgtaaatccattcctaaagccggatggaagcagctacaacaaagacaaggatgaataaacagaatgccaaacattcgaaggaattgatcaaattcaaaaaaaaacgattggatttatagagccctcccccaacaaatattggcacatgttatgaaatgaattagttaataaa

SEQ ID NO: 54089 - DNA, 752 bp, Heterodera glycines
  Genomic contig location: Contig_ID=SeqID_23379; Location=377..1128; Strand=-
  SCN-specific regions: Sequence locations=1-61,83-253,327-550,576 -593,636-752
  Gene Ontology: Cellular component=integral to membrane
atgttttttctaaaattttacaatttaaataacgtactcgatccagttcctgatccagtgcctgatccagttcctgatccagtgcctgatccagtgcctaatccagttcctgatccagtgcctgatccagtgcttgatccagtgcctgatccagtgcctgatccagttcctgatctttttttaggtaacaaatatttgcaaatcgatttacgtaagtatttcctctaatagagccgcagggggctcaattttcaaataattaaatttatattattataaaacaattataaacggtaaataaatttaaaaatctataaattattaaactagagtgccacgggaccgggaattttgggcaaacccgggaccgggacctttttgggttgaaaatccgggaatttttggctgggaaaaccgggaaaaaaccgggactagtcccggtcccggtcaaaaccgggaccttggtactcagttgtactcagttgtccgctaccaggtcccggtcccgtggcactctatattaaaccatatacgcattctaagaagaaagtttattttattttatttttatttttgtaatttgattatacgctttaacctttttactaaaaaacagaaaacattttttggcataactccaaaatcgtttttaacagctttatcggagagggggttctaatagagagggaggctattaatagaagaaatacgctaaataacttaacacattattatttttttgaaaaaataaa

SEQ ID NO: 54090 - DNA, 505 bp, Heterodera glycines
  Genomic contig location: Contig_ID=SeqID_23380; Location=285..789; Strand=-
  SCN-specific regions: Sequence locations=1-74,112-400,488-505
atgatcaaaaactttgatgagaatataatgaacttttcccagctgataaaactcgatttgaaccttgataaaggtaaaaatggagcattgattttcattttaacctcaattatttcttaaagataaacaacttttcattttgcccgaattgatcagtgaattggaacaaatgcaaaaaaacggcaattggaattatgccaatttaaagcatataaaaatggcggaatggaatctgttggaattggcacttcataaagagggcgaaagcaaaaaatggttggaaataaagaaattatggaacaaatggaagaaggcatttaacggaaaatttaaaaattcaaacaaaatgccaaatttcaaaaaattaatggacgagcttaacaaaaaattgaaagatttgagggaaaagaaacaaaaagaaacggagaaaaaggaagaaataaaaggttaacaaaaagcacagaaaagaagcggaggaggaaaggaagaagccaaatttaataaa

SEQ ID NO: 54091 - DNA, 1054 bp, Heterodera glycines
  Genomic contig location: Contig_ID=SeqID_23381; Location=273..1326; Strand=-
  SCN-specific regions: Sequence locations=1-312,358-625,648-785,813 -947,969-1054
atgcaattttgcgatgctcttcaaaacgccgttcattctgcgctcaaagcgcgcgaggtgaaaagggaaacaattcaaaagatcaccgaattggatgaattcaaatttttggaagctattctaagcagcttggaatataaaggagaaagcacagaaaaactgaaaaaattttcaatggttttttcgaaaaaatcatttgcggataaatgcaaatcgttgagtgcccttttggccatattggatcagatcaaaacggagtacaacagaagcagtgaaataatcagttccaaatctgccaaaataggcatagaattaaatgaatgggaattggaaaatgtaaaatttggtgaaattttatacgaaactctgaaaagccattcgaacaaagtgaaatatgacgaaaagcatcaattaatggaatttcctctgcaaatgtgcgaacaattcattgagcgactttatgcattcgttgaaaggtccgaatttcatttttgacattaaatcgaaataatcgaaagttttttcaatggggacagaaagaaaatttttctaaaaaaattatttaaactattcaaattttggtggaaaaaatgaaactttgctgtaattcttaaaaaacaaaaaatttattaattttctctatctttttcaaaaacttggaatatctctttccatatagaaaatcaatgaattaaaatgtttttttacgaaagaaatgacaatgaagttttggagaaattactcatcttaatattagcattagttttatttctgatgccattaacaaaaaaataataaaatttattttttaagaaatttggctaaaaatatgccaatctatgaagaaatagactttataaaaacaattgaaagcgttgtgtcggaagaagaaaaagaattggtgatggaaaagcggcaaaagtcaatttggccatcagtcaatttgaaattgttcaaattgctttttacaatggcaattcgtttgtgctgcttacaaatggaacaaaaggaatttgcactgtcaacactttcatttgcactaaaaacggagtaa

SEQ ID NO: 54092 - DNA, 1042 bp, Heterodera glycines
  Genomic contig location: Contig_ID=SeqID_23385; Location=214..1255; Strand=+
  SCN-specific regions: Sequence locations=1-164,186-265,295-770,792 -928,951-1042
atgatgcatggaccatgttcagaaaaatcattgtgttggaacaaaacaaaaaaaaaatgtaacaaaaaatttcctaaacaatttcgagaagtgactgttataaatgaagacggttatccgctttataaaaggcctgataatggacgttatatatatagaaaagggcaaaaactgtcaaatcaatttgtggtaccatataacccatttttgagtaaaacatttagagcacacataaatgttgaaagagtaacagatatttcagttgttaaatatttatatgaatatatatataaaggatatgacgcagcaaccatagaatgcgtacaaattggagaagacggcacaaaaaaaatattaaattatgacgaagtcgctaaatatttagaggcacggtatttaagtccatgcgaagcatgctggagaatctttaaatttccgatgcaaggaaaatcccattcagttgatcaattggatgtgcacttagaaaatacccaaagagttttttatagaaaaaatgcgactgatcaagaaatcgaagaggcattgttaaaaaattcaaccttaactgcttattttaagttttgcctagaaaatcctgataaagaaattaaatacactgatatgccaaaatattgtacctgggttaaaaaagataaaaaatggaaatatccaagacaaggttaccaaaataaaattggtagaatggtaccaatacacccatctgaaacagagaaatattatttgcgttttcttttgctaaatgtttatggaaaaagttttaaagatttaaagaccgttaatggagttgaatatgattcattcggtaaggcatgtttggctagagggttggtgagagacgatgaggaatggcacaaatgtttagaagaagccacgtatttttctcgaaaacacgcgaaaggcttaagaactttatttgcaaatatattggtacattgtgcaccaaaatatcccgccagattatcgggattcattcaaagagtttatggttgatgacattaaaagaaaaaatccttccttttca

SEQ ID NO: 54093 - DNA, 358 bp, Heterodera glycines
  Genomic contig location: Contig_ID=SeqID_23386; Location=422..779; Strand=-
  SCN-specific regions: Sequence locations=1-89,112-115,257-291,331-358
atgaatttattcatattattccttttgaatattattttatttttgatcaccaaaattgatcaaattaaaacagtcaataagaaattagaacagaaaacatttgacgaaatatttggagaaaaatggcaagaaaaagaagaagaaaaattggaagaaaaaagggaaataattggaaaatattataaaataaaagagaaaataaagcaaaaaggaagaaaatacacagcaaaagaatggaataaaattgaagagaaaattgcattaatttttataaaatctctttacattgtgaatttattttatttttattgaaaataagtttattattttcgaatgagctccagtagaaagtaataaa

SEQ ID NO: 54094 - DNA, 1293 bp, Heterodera glycines
  Genomic contig location: Contig_ID=SeqID_4337; Location=766..2058; Strand=+
  SCN-specific regions: Sequence locations=1-482,506-565,587-595,656 -672,694-950,1060-1117,1139-1293
  Gene Ontology: Mol. function=DNA binding; Cellular component=nucleus
atgaacggcactggtgccatgccgtcgtccgcgccgccgatgtccagtggcaccaccaccgtttcgccggcaaacggatgtcatgccggtgcgcaaattatgccgtccgccgatggcggcatcattggcacagtgggacaatcgatcggtgccggtgccaccgtcacaaccaccgctggtgtcagtgttgttgatcaccaacagcaacaatatttgatggctgctgcagcaatgaacggatttggtgggtttttgagaagtgatcaggaaaattttggtttcttgatcaataaatttacaaagcaaaaagtgatcggaccgtaaaaacttatgatcattaaaatagaaaaggtgatcagaaatgttttattagtcggcaaatatttaaaaaagtgatcgaaaatgataggtatattttgcgcataaaaactgatcggaaatgttttttgaccaattcaaaatattgcccaaaaatataagaattaaatttttggtcttttttctggccttattacaaaccaatgtttcttcgtttttcaatttatttcatgaaataaatgcattttcaagtgaatatttaacaaaattttcagccaaatttaaatttaaatcattttaaatcattaattaatttatttatttattaattattattctccaccaatttttagccccaccccatcctcatcttggccaatttatgctgaatggtggcggcgcgccgccgaccgccatgccgccaatgcctgccgacttttatggcttccccgggtcggcggcggcggtgaaccacgggccaatgatggcatcagcatttgccggcggtgccatcgtcggcgccggaggcgctgccggtggcggtggcccaccattttcgccatcatttcaccaccaaaatcagcatcatcataatctcctaaatcagcatcaaatgcaagcagtagttgcagaacaacaacaacaacaacagcagttggagcagtacatgccacaccaccaacaccacctgcaccaccaccaccagcagcaacaacaacagctgcaacagcagtaccagcagaataaccatgcggcggcgaccattcttcaatgaaaatttcgcaaaaaaaaaaatgggaaaaaatgaaaattcctaattttaattagacgtcacaattgaatggcatggcatacatatatgtatttgcttatttcatcataaattacctgatcaaaacatcatgaaattatttgaatgtagcgatttcggaaacataaaaaaaaagttacggtccaaaaaatattaatggttaa

SEQ ID NO: 54095 - DNA, 1602 bp, Heterodera glycines
  Genomic contig location: Contig_ID=SeqID_4338; Location=1022..2623; Strand=-
  SCN-specific regions: Sequence locations=1-407,431-565,610-1285,1307 -1351,1377-1602
atgattgctgcggcgcctggcggtgccggaagcaccagcggctatcgccattaccaagcggcacggccggtggacggatgggcagcgcacgcggccgcgctgaacggaggcggtggcgcggacaatgcaccgccacgcgtcatggtcgactcaacatcaacgcggcacacgcatgttggcacgccgttgcatggtggcggcggtggcatggctgcgtcaacgacggcaccgctgatggtgagcaaaaccaaaaaaaatcggggaaaatgttgcataaaaggcgtagttgctacggcatgataggtactgtatattattgattggttggatagatcggtgcagaaattatattttgaattttttcagtaggcaagcaagcctccagaaaaagaatttttcttgttttgtgcccttgttcgtacttggtactgtagaaataccgtaacggcacccactgtatcgtttttgggcctgatgaccaaatctgagcaacacccaagacactgactgatcaggaaatttgtgatctgtaatggtggctgtcttgatcaaatttgtagatggcaaaaatttcaaaaaattttaaatgtttttcaaaattttatttttcggatcaccgaaagaattgtgccaaaccgttgtgccggatggcgtcacttcctttccataaaaattgtgttggccggcacagaagtccgagcagtgaatgaataataaagaaaagtgaaattgtgccaaaaattttccgattttttttctttttattgtaaaagtgccaatttttgttttctgtttttttcgataaaagagctttttcttaaaactttttttttcacatggtcatcttattagtataatatccacttttgcttgtagtaattaagcctaattatggcaattatctgagacaggtatttacattgttctaatgaagaggggctatttattaattagcccctaattggtgtgccatttgatttgcattaccaaattcagatgaacagcagcggcggacgcggcggcacaccggtgaaaggcagcggaatgtttgttgccgcgatgccgtcaccggaacacgatgggggctatcatcagcatcattatgacactccaaatcgtcaatatccgcatcataatccgcaacagcaacaacatcattattccgcgagcgcaacgcgcgacgacgcgtcatcggaacccggcaacaacaaccacctgcagcaacagtctccgcccacgccaattagtccggcgacatcgtccggcgccgtcgctaatgggcaactgaaggtggttgttgttgatgcggatactctgattaatgacgataacagtgataacatgctgattaattgctgggagcaaaacaaaaactctgatcactactgatcagggctaggcttcttaattacggaaattatgcgggcggcgtttttggactcacgtaattagggcattcgccaaaaaaaaaaattaacgaaatattgccgtttttcaaaaaaaaaactgaaaattttttaaacgcaaataacaaaaattcaatggattaatcagagagtgatcagagcaattgcatttaccaaaaaaacattgatcaataaa

SEQ ID NO: 54096 - DNA, 485 bp, Heterodera glycines
  Genomic contig location: Contig_ID=SeqID_23391; Location=1168..1652; Strand=-
  SCN-specific regions: Sequence locations=1-172,194-485
atgaaagcaaatggacaaaatgggaagatgaagcgattggatggcaaacttatgatcaatggaacaaaattggcattcacatttataacgaggacgaattcgggaaagggtaagcgaatgctttttcaaaattcatatttattttgcgtttctatttttaggcttctcaacgaaactcctggcccaagtgatcagcttacagaagtgaatgaatgaactgttgagagtgataatcaatttgaaattgcggtgttggataattaatttgacgcttataaaactgttttttttgttgcggtgatcacaaattgtgttatacaatatgccttaggatgaattaagcgatttgctgaaatcaaggtcattctttgaacatgcttccagggtcgctgatcacgaatccggcatccatttcgacctatttcaatcccgaacccgaattcgaacaatttttttgtaaaaattttgaaaaaattgtcaataaa

SEQ ID NO: 54097 - DNA, 595 bp, Heterodera glycines
  Genomic contig location: Contig_ID=SeqID_23394; Location=519..1113; Strand=+
  SCN-specific regions: Sequence locations=1-13,43-57,79-199,224 -494,525-595
atgctcattgtgccatggctgctgctgctggtggtggtgttggcattggtcattatcaccatcattttcatgcaattggtgttggccatcagcagaaggcgcagtatcattagtggtggtgaagacggtgttcatgttgattttctgtgtccagtgagtgttcgggttgctggaatagcatcattaaaaaacaatttccaaaattatataaaattttttaaatgccagccaacccattttgtttgaaaatttaagaaaattttcggtggaaaacgaaaggctcccaacccactcacccatatttggcaaaatttgtgaagaagccgccgatgatgcgcatcatttgcttgtcatcccaattcggtcgaaatttggcgtacaaacccttgcccagcaaatagcgcgcgtcatgacaatgggtggcagctgaggggggggggggggggggaaatgctaaatttaacacaaaatttttggatttttaccgaaaatcgattttaagaatttttttttatttaaaaaatgtcgagtgaatcacttgtccggtctctaatactaattcatacccgaaatatgaaaaattcataattcaaaa

SEQ ID NO: 54098 - DNA, 373 bp, Heterodera glycines
  Genomic contig location: Contig_ID=SeqID_23394; Location=489..861; Strand=-
  SCN-specific regions: Sequence locations=1-120,145-265,287-301,331-373
atgatgcgcatcatcggcggcttcttcacaaattttgccaaatatgggtgagtgggttgggagcctttcgttttccaccgaaaattttcttaaattttcaaacaaaatgggttggctggcatttaaaaaattttatataattttggaaattgttttttaatgatgctattccagcaacccgaacactcactggacacagaaaatcaacatgaacaccgtcttcaccaccactaatgatactgcgccttctgctgatggccaacaccaattgcatgaaaatgatggtgataatgaccaatgccaacaccaccaccagcagcagcagccatggcacaatgagcattgcggtagtgacagcgaacaaagcatttag

SEQ ID NO: 54099 - DNA, 974 bp, Heterodera glycines
  Genomic contig location: Contig_ID=SeqID_23395; Location=629..1602; Strand=-
  SCN-specific regions: Sequence locations=1-429,451-665,687-727,752-974
atggcgaaatggtgtgtgaggtgtgcggcaccgacactttcacgttggacggtggcttttattactgcgatgggtgcggtgaacggagcaaggtggaagagacagaatcttttccgtcgatccgggaaaaccgagattcaattttttttttggaatttcgtttcgtttgtttttgaacgcagcttttcagggacaccgcgagactgaaattgagtatcaggacgcaccgttggtcaacataaagcgcagtcagaaaaaggcggatcggtccaaaggcgagggcaaaggcccgcgggaggtgagccgatttctcttttataaaacgcaaaaaaactggcaaatcgcgaccttcaaaatcgggtttccattgataatggactgattcatttttctgaccctagagttcgatattttgcttgtcgaactctaataaaataatcatttttatggctttttgctaaatgccattcagcgtcctcgcaaactgcgcgtggacccgcacttgtgcgagcgtgcacttgcgcaggacggcgacttccccgcctatatggacacggtcggcacacgcatttgtacatcgacaaaagtgagcagaggggtggggcaacgctaactccacgaagtttttcactcaacccctcccctccctcacatcgatacaccccaattttccattaaattttttccaaggtgttggccattttcaccgccggaaaccaaccattactaaatttttttttaattttaaattcccaaaaattcgtcattttgattattgttagtaaaaaaaaaattatgtcgagaaaatatttcgaaaatttaacggtaaaattcaaatttttactgtctttaagattgttgccaaagtggccagtgttctcacggatgagccctttcggttgccgaaacaatgcgtggttagcacattttccatgaaattttatccgttttttttctaaaatttttataataaa

SEQ ID NO: 54100 - DNA, 181 bp, Heterodera glycines
  Genomic contig location: Contig_ID=SeqID_23395; Location=1717..1897; Strand=-
  SCN-specific regions: Sequence locations=1-48,70-181
atttcttgcttttggccttatggacaaatgttccatttttgcaagtttcatttgtaatatttgatcatttccaatatctcccagcatttgtctctttcacgcttttgtccatgttttgaacacagacgatgcctttcactcactcagaattaaatttttaataaatcagattctcgactta

SEQ ID NO: 54101 - DNA, 80 bp, Heterodera glycines
  Genomic contig location: Contig_ID=SeqID_23398; Location=206..285; Strand=-
  SCN-specific regions: Sequence locations=1-80
atgaacggctacagcattctgtgtgtcatgctgctcgtcgagctggtggtcgtgccaattgtcaatgggtcacccgttgt

SEQ ID NO: 54102 - DNA, 964 bp, Heterodera glycines
  Genomic contig location: Contig_ID=SeqID_23399; Location=18..981; Strand=-
  SCN-specific regions: Sequence locations=1-194,221-232,255-300,423 -483,545-773,795-964
atgacatcatcgtcggaaagcaatgtgccaaaaagtgaaaatttgggcagcagtgaaatggagacggcggaggaagcggcacaaacctatttgaacaatttacgggttgatttaaataaaatgtaggaaactttaatattgatttaaacattaaatataaacctaattaggattggcttagttttttcactcacatttaaataaatttaatataaaaaatgtttggttggaaattaaaatttattaactatttttgtcatcaatacaccaaattatgatggttggcttagttatctgacctttatttaaatatttatttttaaaaaattattagaaaattcaaatatataattatcatagttcttatatgtatgttttattatatatttaaaaaaatttattggtaaaaaaaattaaaaattcatagatatttttccatcaatacaccaaattatgattggcctagtttttagcacttatctgttattattaatttttaaaattatttataaaaaaattaaaaatttttataaaacattatttagtatgctaataactttaggataatgaatataatcagaaaactggaaaaaaacttttttttttgaatattcaaattttaaatttcagtccttcgatgaaaattccattccttgaaccaataattgaaaaatatgttgatgaatacaaaaaaagtcgtcaattattcgctgaatgcatgcaaaaaattttgcgaaaatcgaaaaatcctaatcaaacggtgaagatcatcgaatttaaaaagacaattgaaaaagaaatgaatgatttgttgaaacatacggatttgccaccagatcaattgattgatctgttgaacactcgtgaatggctattgtcgatgaaaaagacattggcaagggcaaaaatagcccaacatcgtcctttgatgccaaaagggcgcccttgggaatcgcttttttag

SEQ ID NO: 54103 - DNA, 1260 bp, Heterodera glycines
  Genomic contig location: Contig_ID=SeqID_4339; Location=1029..2288; Strand=+
  SCN-specific regions: Sequence locations=1-3,43-86,133-1260
atgccttttttaaatatttattttctgctcctttttcttctcgtcaatcgcacattttgcgatgaaataggtcattaaaaatgccgaaatttatgaaaatatttttaaataaattaataaactttttttttagctcactggattgaatcgtgtaaaaaaattgcacaaaatatacattcattggccacggaattggaccaaattccggatagtctcgagacagaaaaaataattgaaaaaataaacaaattaaagaatttcgcagtgcaattgagtgaattcagaaatgacgaaccaattttgttggaatcgttggtgattgagcatgggcaaaaaattggccaattttgtcacaatttgctgatctgtgatgcgaaggatggtgaagtgatccgtgaaaggttacggcacggaattgaccaacaaatggcacgtgcagtgcaaatccggcaactgatcgacaccatgctaattgattgggaaatttggccaattcttcacaattttgaactcgccgaagacccgtccaatgcggtagcttatctgattgacgagttgggccagaaaatcgggaaaatgcacaagctgttggccaactgcggctcatattacaacactgacccatttgatgaagcgctgcgacggctgctgatggtggccatggacgaggagcaaagtccgatcaaaaagctggaccaatgccgtgccattgtgccaaaacttatggccaaatccgtgcaggaaatgctggagaatttgctaatggatctgttagagccgacaagtccatttttcggcatgacctttttggcagaaattgcaaatgaattaaatgttgcggaaaatatttgtgccggaattttgcgcagttcgaaactttcgccgatggcacagtttacggtcaatgagaaacttcaaaaattgagagcaatggcaaaagcaatgtttttggaacaatacagaacaacaattgaggaacaaataaaaaacattggaacacaattgaaggacggaatgggccgccttatccatattggtatgtaaatggatatttaccagtttaaatgaattagtctcttatttaatgctaatgataattcttttctgtgctcaatttagtttaatgatgtaccaaaaatttacaacagacaaatacattttaggtgggggggggagtcaatctctcccctcctcgatcacaaatgagcttagcaagtcaaggagggggtcgcaaattttgaaattttcacaacaaattca

SEQ ID NO: 54104 - DNA, 607 bp, Heterodera glycines
  Genomic contig location: Contig_ID=SeqID_4339; Location=2540..3146; Strand=-
  SCN-specific regions: Sequence locations=1-607
atgtttggtcgcgaaattggccatttctttttcatgcctttttcgatgggttcgacattcagacagctcagaattcgttcagttattgccacttggtcgtcttcgtcgttcggtgtgccatttccattcttttcattgtcctgcaattgtgccattatttgccccaattcgtccaacttttgctccattactttttttgtttccaacatttcaatcattgccaactcattatgagtaattacgaacaaattttgaacatttttaagtgtttcaattaattgcactcgtttcattgttcctttttctaaagaatgcgtggtttaatttttaatttgaggaattatactaaatttcaatataacaggaaattttttgctaaaaaaataatagtttagaacccacggtgccgaaaaacacatgccagattctaggtttatttgggttttatgaaacatgccagattctagatttatttgggttttatgaaacatgccagattctagatttatttgggttttatgaaacatgccagattctagatttatttgggttttatcaaaaatctgagtgtcggaatgcccttgcttgtctgtctgtcatacgttaa

SEQ ID NO: 54105 - DNA, 431 bp, Heterodera glycines
  Genomic contig location: Contig_ID=SeqID_4340; Location=485..915; Strand=+
  SCN-specific regions: Sequence locations=1-401,423-431
atgaaacgagtgcaattaattgaaacacttaaaaatgttcaaaatttgttcgtaattactcataatgagttggcaatgattgaaatgttggaaacaaaaaaagtaatggagcaaaagttggacgaattggggcaaataatggcacaattgcaggacaatgaaaagaatggaaatggcacaccgaacgacgaagacgaccaagtggcaataactgaacgaattctgagctgtctgaatgtcgaacccatcgaaaaaggcattgaaaaagaaatgaccaatttcgcgaccaaacatttgttctaattgcctttgatttatttgccaattctgttgacttattctttcttcatcgtcaaactttcttcattatgtacaagtttagtgtttatagtaaaatactgttgcttataaaaaatatataatggatttta

SEQ ID NO: 54106 - DNA, 2071 bp, Heterodera glycines
  Genomic contig location: Contig_ID=SeqID_4340; Location=2901..4971; Strand=-
  SCN-specific regions: Sequence locations=1-136,171-589,691-826,848 -1326,1363-1400,1450-1637,1660-1670,1692-2071
atgagtcaacgaaattttttcgcaagatcaccagtgtacgacggatggtcttatggttatgagaaagatgggcacaattgtgttgattttgtgtacgaatttgtctgcaatttgttcgacggaaattgtccacccgagaaattttttccaaaaaattttgtggaaatcgacaagaaattaaacggttcacacgcattcaaaaacaaaacaattcaattatacggtaatattttatagtaaacactttataattttataacagcaggcagggctcccaactctgctgatttatcatcattagggttataatttgtatgattttgcattttttttctgcgcatatgctatgaagaaggggctcaaaaatagcatttctgcgttaaaattttttgatttggtgaaggtttttagtgcatataaaagcatattttgggggtttttgagaataaatgcatatttggccatttttgcatttttagagcatattttggctattttttgcaaattttcataagaaaaatgcgaaaaaagcgaaaaatacacctccctaaggatcgacttttttagaatttttttaaaaaatagacccttaaaaattgaaatttttttaaatttttgtaaaaacttttggaaaaaaatttatataaaaaggtaattttgttttagcatataataaaaatttataaatttggaaattcaatatttttacaatcgctaaaaaatgctccttagcccttgttttgtggtttaaagtcaatttttaatttatatacaatttttggcattttttgagggttaaaagacatttttggcagtttttaaaaacatattttaatacatattcagggattttcgggtttttagggcatatttgggggatttttagtgcatatttggcattttttagtgcatacaacttataaccctaatcatcattttgatgcttttcaaggggtcaatgatgattgtttttttagtttctaatttaatggtttttgatgctttttgagaacgtttgctgattatgctgattttgggaaaaatctcttaaaattggccatttttagcctattggcactgcctgccccctgcccaaaaagtttttgtaaaaaaacgcgccacaaaaaatgaacgttttttattgatttttttcatttggagtaaaattttccaaaatgctgattgtttgtcggccaaatgctgattttgaaaattttcagttgggcgacctgtgtaacagaaaattttgtacaaaaactgttaaaaatcagtccaaaattatcaatgccttcctgccgcgcctatcggcatcaccgtgccacttcctattttataaattttagtatttttttttctttttttgtccaaaaatcaaaggctttgctcaaaaaaaccggatgattttttttaataatttttcttttttgtcaaaataattaaattttaaaagaatccttaccgaatgcaaaaaattaaagaaaaaaaatgaatgttaggctgaaataaggacgattcatagaaggaaggattttaagtttcaaagttccgacccctccaaataaggaagggcatctctgctttaattgtacaaaaatgataatgaattttttgccaatgccgtaattttacatggttcaattcaaaatgcacttataattttgctttgatccgtttacttttctaggacagttcaatgagtgttctctcaaagtgcacgaattacgcattgaatacgcgttggcaaaacatggaaagtacggcacccccgtggtcacttatgagacgggcgtggtcgaagatccattcgaaaagattatgagccttgacgatgtgaggctaatccaagaaatacgaaatgaacaaaaatgccatgttgagagcattgaaagtgacggggctgtgctgtgcaaagccgtgctgcacgtttgctccaataaatatgtgatgtgcatggcgatcaaggattatacggcaagttttacgatcaaaatcacttcaagtgccaaaaccaattaaaaagggtgtccgcccaatttgttgcaattgctcgatttgctgcaaatgaaataaa

SEQ ID NO: 54107 - DNA, 757 bp, Heterodera glycines
  Genomic contig location: Contig_ID=SeqID_4341; Location=386..1142; Strand=-
  SCN-specific regions: Sequence locations=1-3,25-92,124-349,381 -381,419-757
atggaaaatattttccattttttatccctttcactatttgccgctttcgcacttcaaaacggcgttttctcatcacaattcgattgctatggtaaattttaattttaatttcttttaatttttgtgaaatttttagtttttttgccccctattggcctaaatccaaaaagcacttccgaatgcccaaaagggttccaatggttcccatctgttcaattttgttgcatttctgccgaccaaaactttcgtccaactcctgccaccgatggccttttctatcagcagcgttacttctcagtgccggaattcgctgcaaatgattccgtgccggagggatgcattcgtaagcatttaaattttaattttaataaaaattaaatcaaaatacaaaaacattacaaatttattgggtttttaattgtcctttttaggcgctgtgcactttcaaaatgaaagtttggcctattgtgggccacgaccattgtcgccatcagtcgaacggcaaattgccaaaatcagtcatcaattcaccgatatgttgactattccagtaaaggatagcttggcacagaacatttattgctgttcgtccgacggcaaattgtcggccaaagaccaaattaaatggcaaagcgtttaccacgggacaatcgctgcaaattacatgctaattgcagaaagcggcacaaaacaaatctcaattcgcgcagcttgcaacaagcaaagtcaccaaaatttattgggggaggagtattaa

SEQ ID NO: 54108 - DNA, 738 bp, Heterodera glycines
  Genomic contig location: Contig_ID=SeqID_23401; Location=257..994; Strand=+
  SCN-specific regions: Sequence locations=1-738
atgggcacccttctcagctcaaccattcttaaactgaagaaggcgttcaacattggcattatgaattgctctgaggaaccctttcggtttagttatcgacgagagatgtccactcggatggaggacaattcgttgtttctggaggaattggcgcgtcagactgatgaaatccgccaaaatgggctcgacgcaatgccgaggcacggatcactgacagacaaagtctgaagcaaaaatggaaatttacctgggattaaggaggctattgttatttccccattcagattctcgaacttgaggaagaggtggaacgacttcatgcggagaatcgcgagctgaatgagcagtgcacggatttgcaagcgcagttgctgcacaattcggtggaatgtggcagaaatttgttggcggacgcgggacagccgagtttggccgccgaactgagtgggaccggtgggatggaccaccacagggtgagaaaacagttcaaacggtcaaattacccaattttgaattgagatgttggacatcataaaggagcaagacatcgacaatcaaaagcttagaaattacataaacggttggcacaatgataattgccaatttgtgatcgcatccctttcattcgctttaggaattttggtgagagtgatcgagctgcatcccgagattctcgagatcaaggacgacatgaacagttcacaatcagtggcgtccaacggctccgcccaatcatag

SEQ ID NO: 54109 - DNA, 356 bp, Heterodera glycines
  Genomic contig location: Contig_ID=SeqID_23402; Location=377..732; Strand=-
  SCN-specific regions: Sequence locations=1-41,71-126,212-218,241 -245,276-356
ggaatcgaaggtgttgtaagcttttttccttttttcacttgtaaatttatttaaattttcaatttttttagctttttttcgaaaaattttttgtctttttttcggcaggcactgcctctgacaatgttttttatttatttagaaaaataaattgattttttttctttttgatttattttaattatatttcatccttaaattttttaataaacattttcaaactttcaccttattaatttaaggcgaattttgccttttttaataaattctcttgtgaaaaggcaaaaaaataggctcttttaaatatgcctatttaaattactttaattgctttcctttcgcttacgaccatacca

SEQ ID NO: 54110 - DNA, 348 bp, Heterodera glycines
  Genomic contig location: Contig_ID=SeqID_23402; Location=814..1161; Strand=-
  SCN-specific regions: Sequence locations=1-34,63-118,204-210,233 -237,268-348
aggtgttgtaagctttttttccttttttcacttgtaaatttatttaaattttcaattttttagctttttttcgaaaaattttttgtctttttttcggcaggaactgcctctgacaatgttttttatttatttagaaaaataaattgattttttttctttttgatttattttaattatatttcatccttaaattttttaataaacattttcaaactttcaccttattaatttaaggcgaattttgccttttttaataaattctcttgtgaaaaggcaaaaaaataggctcttttaaatatgactatttaaattactttaattgctgtcctttcgcttacgaccatacca

SEQ ID NO: 54111 - DNA, 1424 bp, Heterodera glycines
  Genomic contig location: Contig_ID=SeqID_23403; Location=36..1459; Strand=+
  SCN-specific regions: Sequence locations=1-343,373-396,419-1197,1225 -1283,1305-1329,1352-1424
atggacaatccgtcagtgaaggacaatccttcactaatggacaatccgtcattggacaattcgtcagcaaattttttttccaaaacccgaaattcgaacgcaaaaaaaaagccgctaattttcgcaatttgagttttcgacagccccagaaattttttttttacgcttatcaattcccagttccgccacactttttttatattaaaaatcgccgatccctcacaaatattaaaaaaaattccattattcattcattgaaggaattattgttatgtgcagaacacctattgggtgccatttgaagaacacattccgcatcgattggacgagcgacaaaagtgtgaattgattaattaattacttaattgattatttgggggggggggggggtgttcaaaataaatttaattaccaaattcaaggaccatttgatgattaaatttcagacgacaaattggttattatcaatgggtgtcttttgtacttgctatttctgcgctaatgttccatttgccggtgagttaaggtctcgactcgagaaaagtttatcgggttttctggtttcgggaccaagtctcgtcggtctcgagtccaccgattcgagaaaagtcgtctcggatttttttcggtctcgagcatcactctgtttagcgtgctttttgtgtgtaaatgcgaattaactacaaaacaactgcatactaaaaaacaaatactaaatttggccgcttacagtagtcctcttttctactgatactgtaggctctctgctggcgaatgctgtccaaccaatcgggcctgcaagtgtccgttgtgctgggcgtggcatgccaggaagagaatgtggacccggaggtgcgcgaccgtaccatcgacgtgatggcggtaaagcaacaagggagggacatacctaattcgagagtggggttgatcgggaatctgggccaaggatggatttttggaaattggccggtggcctgaaaaattcggtgtcaggggtaagagtcagggacggttcacacgcaaaatttatatgtgaaaaatggtattttgtgctaaaattttcatttttaatattggtaccttctccaagacctccacacccaaatttttcaaaaaaattccgtgaaatttacataaaattagcaatttttagtgaaaattcaattttcgaatactttttcctgtcctcatttcacgtaaatttaattaaaaaatttttttatagcgtcacattgatgacgcactgcgttaccaacgtgatctgattgcccgatcacggggcgtttttctgttcgcactgatcaatgttggccgaatatacggtaaacgaacaaaacagatgcaaaaattagcataatttgccatttaaggagcatacgtcacgtgagccgaatgctttgcaatttttaaattcccaattttta

SEQ ID NO: 54112 - DNA, 679 bp, Heterodera glycines
  Genomic contig location: Contig_ID=SeqID_23404; Location=15..693; Strand=-
  SCN-specific regions: Sequence locations=1-10,50-367,399-679
gctgatgacattcctcctcctcctgctgttgctgctgatggtggtgatgtcgtcgttgatttggagcaacatgttcgccaactcatcatgtccatcggccagggaagcgaggacgcagtgcacgagctttccattctgatcgagtcattcaaccaggagcagctcgtcgactttctgcagattatgggtaatggcatggcgtccaaattttgatggcatttgttgtgtttaactctgccaacatcttttttccagcaagaatgtacgtcgagagcggattcagcgttgacatgccgggtggccaagaaggaatcaccatgttgatggtcgctgcgtcctctggaagggtaggaaaaaaatgccgttttttgaagaaaaacaaaacatttttccatttattcaggtggactttgcgcgctacttgctcgcccacggtgcaaccgttggacacttggacgccaccggtgagtttaattttgaattttttgatcatttaatttgtttgtttcccctccccccgtttcaggaagcgtcttcccactaatgctagctgccgaatctggtgagttggaggtgtgccgtctgctggtcgaggaatgggcagctgaagtcaaccagcaagcaattgatggcacgacacctttgatgagcgcgagcagtgagggacgactggacgttg

SEQ ID NO: 54113 - DNA, 400 bp, Heterodera glycines
  Genomic contig location: Contig_ID=SeqID_23406; Location=56..455; Strand=-
  SCN-specific regions: Sequence locations=1-57,79-351,373-400
atgttttgtcatgttgagtcaccgtattatgctgaattgccaatggaagaggtattttgatttgaatttgttcttttggcgttgtgtctgtctctgtcgtttccccttcagattgtgaacaatgtttcaatgacaaaagacctgaccaatgaattacagctttggaaaatggtcgcatttgtgcgtgacccaattgagcgatttattgctggttttgttgacaaatgtttccagtaatcttttctaccatttatcttcagtagggtgtcaaattatatgcacataaaatcgtaaaatatgcaccaaaaatggcaaaatatgcacataaaaagtgaaaaatatgcacgtaaatttttccaaattgggggcaaaatttttacaaatcttcatattcattaaa

SEQ ID NO: 54114 - DNA, 838 bp, Heterodera glycines
  Genomic contig location: Contig_ID=SeqID_23408; Location=401..1238; Strand=+
  SCN-specific regions: Sequence locations=1-122,148-553,575-685,752-838
  Gene Ontology: Cellular component=integral to membrane
atgttggtgatgtcttctgcgctcaattttgtgatgagtttggctggcgctgttctcttctccgtttatttggtgttcgacatcgatgacataatggtaaatacaaaaagcgaaatttcccctttttaaatttaaaatattatttttccatccaaattcttcatgctttagtattccgattcgacatttcgtcccttaaatccttcccattttctgttcagaatcattacaatgaggaggactacatcatcgcatgtctctcaatttacttggacatcatcaacttgttcttgcgcattttgcagattctgaacgaaatcaaccgcaattgaaaaaaaaagaaattctttccacgacaggcccatattctattcggaaaatggttggggaaggctcccccggttttggtcggttttcatatattcccccggtttcgaggcctggtacacctgtaaaaaacatttatttgcaaattgcaaaacaaaaaattattgtgagattctttgggatggactcatccttctgtgtatttgtgttactgtatgtctacctattttatgtatgcacagtgattaacttatacaatcgcatcgaatggcaattgtttgtgcttttaattcggggagaaaatgttttcgtaatttgccagttcaattaaagtcgtctttcgagtgaattgactgacttatttatatatttataatttgatggattagcggcttcaatttaaatatttttaaattaaaatattgtcaatacatttaattgtttttctcgtgtaaaaatatgtaacttttatcggtctttttgatctcgtcattccttccaaatgtttaca

SEQ ID NO: 54115 - DNA, 500 bp, Heterodera glycines
  Genomic contig location: Contig_ID=SeqID_23408; Location=1504..2003; Strand=+
  SCN-specific regions: Sequence locations=1-19,64-104,127-280,302 -385,407-500
tagggttatttgtcgggaatttcttattctttctacaaaatatttccatttcaaatgttgccaccgaaggaaatttgggaaaacgatgcctacgatcggtggaatgattttaatgtgaattttaatctgtcgaaatgcctttgccccccccccccttgtttgtttacttcgcctcacatgtcaaattcccgtaaacattctcggccctcccaaattcattcatcccttttcttggcttttatttataccccccccccccaaaagtatcatcttccaaccaccaaagaattttaatgcttttcccttttgatttgctttatgtaaaagcattaattaattaaaatggcctattggaacttccaggggttggaggtcgaattaaaatatgtaagtgtttaataaacttaaccattgctcaggtggctctgatcattgtgatttgtgtcattggctttgcactgatcgcttgcaccacagctgccatttggtttacagtggcg

SEQ ID NO: 54116 - DNA, 289 bp, Heterodera glycines
  Genomic contig location: Contig_ID=SeqID_23409; Location=466..754; Strand=+
  SCN-specific regions: Sequence locations=22-169,191-289
cacacattttggccaacaactgctttccgacagtgaagttcgtcaagtgttgggtttcatggtcatttccggtaaaaattactccggaaaatgcaactctaccgccaagcttatgtataaatggcatgacaaagaatacctcggggcggcgcacggcgtcagcggaatttaccaaatgatgttgaggtgggcggcgaatcgagtcggtgggattaaactgacattgctttgtcaattggatgctttagcttctggaacttgcttgatgcctctgcgaagtcggacttaa

SEQ ID NO: 54117 - DNA, 911 bp, Heterodera glycines
  Genomic contig location: Contig_ID=SeqID_4342; Location=121..1031; Strand=-
  SCN-specific regions: Sequence locations=1-911
cagacgttgaacgttgcatttggatgtaacgaacaaatctattctctccatctgagtaaactgtttcgtagtgggcgcgtctgttaaaaattcattttagactacatcattcctacaccagacgttgaacgttgcatttggatgtaacgaacaaatctattctctccatctgagtaaactgtttcgtagtgggcgcgtctgttaaaaattcattttagactacatcattcctacaccagacgttgaacgttgcatttggatgtaacgaacaaatctattctctccatctgagtaaactgtttcgtagtgggcgcgtctgttaaaaattcattttagactacatcattcctacaccagacgttgaacgttgcatttggatgtaacgaacaaatctattctctccatctgagtaaactgtttcgtagtgggcgcgtctgttaaaaattcattttagactacatcattcctacaccagacgttgaacgttgcatttggatgtaacgaacaaatctattctctccatctgagtaaactgtttcgtagtgggcgcgtctgttaaaaattcattttagactacatcattcctacaccagacgttgaacgttgcatttggatgtaacgaacaaatctattctctccatctgagtaaactgtttcgtagtgggcgcgtctgttaaaaattcattttagactacatcattcctacaccagacgttgaacgttgcatttggatgtaacgaacaaatctattctctccatctgagtaaactgtttcgtagtgggcgcgtctgttaaaaattcattttagactacatcattcctacaccagacgttgaacgttgcatttggatgtaacgaacaaatctattctctccatctgagtaaactgtttcgtagtgggcgcgtctgtt

SEQ ID NO: 54118 - DNA, 913 bp, Heterodera glycines
  Genomic contig location: Contig_ID=SeqID_4343; Location=85..997; Strand=-
  SCN-specific regions: Sequence locations=1-913
cagacgttgaacgtggcatttggatgtaacgaacaaatctattctctccatctgagtaaactgtttcgtagtgggcgcgtctgttaaaaattcattttagactacatcattcctacaccagacgttgaatgttgcatttggatgtaacgaacaaatctattctctccatctgagtaaactgtttcgtagtgggcgcgtctgttaaaaattcattttagactacatcattcctacaccagacgttgaacgttgcatttggatgtaacgaacaaatctattctctccatctgagtaaactgtttcgtagtgggcgcgtctgttaaaaattcatttttgactacatctttcctacaccagacgttgaacgttgcatttggatgtaacgaacaaatctattctctccatctgagtaaactgtttcgtagtgggcgcgtctgttaaaaattcattttagactacatcattcctacaccagacgttgaacgttgcatttggatgtaacgaacaaatctattctctccatctgagtaaactgtttcgtagtgggcgcgtctgttaaaaattctttttagactacatccttcctacaccagacgttgaacgtggcatttggatgtaacgaacaaatctattccctccatctgagtaaactgtttcgtagtgggcgcgtctgttaaaaattcattttagactacatcattcctacaccagacgttgaacgttgcatttggatgtaacgaacaaatctattctctccatctgagtaaactgtttcgtagtgggcgcgtctgttaaaaattcattttagactacatcattcctacaccagacgttgaacgttgcatttggatgtaacgaacaaatctattctctccatctgagtaaactgtttcgtagtgggcgcgtctgttaa

SEQ ID NO: 54119 - DNA, 412 bp, Heterodera glycines
  Genomic contig location: Contig_ID=SeqID_4344; Location=73..484; Strand=+
  SCN-specific regions: Sequence locations=1-185,207-381,410-412
atggtcgaattgaaagtggaaacgatgcaaatggaacaaagggacaacgccagcgcacgggtggcaccagcggacgcggcacttgccgagttggcccccttttgctacgattacgccgccatttatgacggaccgaaggtgaagggatggccaaccccagcagaaggaatggcccgaccgattgcttcttcccatggcttctccaccgtttgttctcttctttcaaggccacttcgccctttctgatgcggcccaattgtgccctttcctctgattcgacgggcgatcagtcgaagccctcttttgtttcctcccaccgtcgcgtcgatgtgtttttcgtttcggacttgagcacagaaactgccgggggctttcaagtccatttttaattaattttttaactttttatcaa

SEQ ID NO: 54120 - DNA, 513 bp, Heterodera glycines
  Genomic contig location: Contig_ID=SeqID_4344; Location=3052..3564; Strand=-
  SCN-specific regions: Sequence locations=1-513
actacatcattcctacaccagacgttgaacgtggcatttggatgtaacgaacaaatctactctccacgtgagtaaactgtttcgtagtgggcgcgtctgttaaaaattctttttagactacatccttcctacaccagacgttgaacgtggcatttggatgtaacgaacaaatctattctctccatctgagtaaactgtttcgtagtgggcgcgtctgttaaaaattcattttagactacatccttcctacaccagacgttgaacgttgcatttggatgtaacgaacaaatctactctccacgtgagtaaactgtttcgtagtgggcgcgtctgttaaaaattctttttagactacatcattcctacaccagacgttgaacgtggcatttggatgtaacgaacaaatctactctccacgtgagtaaactgtttcgtagtgggcgcgtctgttaaaaattctttttagactacatccttcctacaccagacgttgaacgtggcatttggatgtaa

SEQ ID NO: 54121 - DNA, 753 bp, Heterodera glycines
  Genomic contig location: Contig_ID=SeqID_23413; Location=433..1185; Strand=-
  SCN-specific regions: Sequence locations=1-11,48-90,112-141,183 -224,246-303,436-467,490-516,574-599,671-753
atgcgcagccaaaaagaaatgaaaaaaggagggcgacgacgacgatggccttttgatgtgcacaaaaacatgatgacaatcgctcaaatccaaaaggcaataaaaatttcttctcaaggttagaaaattcctttcaaaatgtttttattgatttttaattattaaaattaattaataaaaaaccattaaatgttttcttgtaaaaaacgatatttttaatagattttcaaaacaattgaaaatttttgcctatatagcagggggtgggacgcgaccgcgacgcgacccgcgcgattcgcggcgttttattttaagattttaataatataaaaaataatcaatttgaaaaattgaataaaaaaaattatagtttttgaaatattttcaatttttaaatgatattttattttatttttatttttatattaattaaatcataacacgcttttaacaattttaactttctaaaaaataattgcccaaaaataagaaaaacgtaacatttttattgctaagaaatttaaaaatatttcctaaattatataatctaactaattttaacattaattttaacgtttttgtcacttttaaatttgttcaaatattgtaaataaaaaattaatatgctttattttaattaattaatatttcttcaaaattaaaaatatatcgcttttttaggcgggaattatggacggaattgctgcttttgtgtaggaggttaaggcgattaattgaacaaaaacaaataaa

SEQ ID NO: 54122 - DNA, 263 bp, Heterodera glycines
  Genomic contig location: Contig_ID=SeqID_23415; Location=855..1117; Strand=+
  SCN-specific regions: Sequence locations=1-200,223-263
atggccaaatatggaccaaaatatggagaaaaactgccaaatttaagtttttaacccacaaaaatcttaataaatggttatatatcaatatttgcttaaacaaacttaaaaaatacactaaaaactaccaaaaaatggatttaacctaaaaatgcaaaataaaatttatttcagaagcgaacaaattgcaaaaagtcgactattttaaaagtcaggaaaaagggccaattattgattataaagccaaaaatgaccaaaactaa

SEQ ID NO: 54123 - DNA, 989 bp, Heterodera glycines
  Genomic contig location: Contig_ID=SeqID_23417; Location=1815..2803; Strand=+
  SCN-specific regions: Sequence locations=1-4,37-68,157-178,230 -543,565-627,661-672,697-755,804-824,898-989
atgcaattaattaattttaattttaattttaatttagtgccggtgttgccgttgtcgaattctcaaggtaatttaaatatttataaataataatttaaattatttgattgcaaaataataaaataattaatttgattaaatttttatttatttattctttaacagatttgaaatatataaaattctgaatttaaagggttttatgacaaaaaatacaactacaacaagacctataactacaacaaaaagccagcctacagtgtcaaaaaaccggcctacagtaacagctacaggaaactaagcaacaatgatggcaacgcaggaaaaaagcccagctatggcggcgacacggtgaagaactatgactacagtaaacaagcagcggggaatggacagtacaaaagcggtgctggccagcaacagtacggtgatcaatcagcggcggcatacggtggctacaacaatgactatgacaaagacaaatcgagacctgcatataattatggagacgcaaataaaaatggtgacattttagactgttttttatttaaacttattttaaaaaacaaggatatgatggccacaatgaaggaggatatgactacaaaaagccaatctaccattatgatgacaacaatgacaaccacaaaaatggtaaaatgagttaaatattaaatttttgttttcaaattatgaaatttaagaggataaaaacaggaatgcttataaatactgtaataagccaaaaatattgcataataaaaataattataataaatatttaaatgaatattttttatattccatagagaaggaaagttctggcagcagcagcagcagaaaaagcagcagcagcaaaagcagcagcagcaaaagcagcagcagcaaaagcagcagttcggaggagtacggtaatgaaaagcacggagaagacccttacaatccggaaggaccaatgccaccatacatttatccaccttacaaagtaa

SEQ ID NO: 54124 - DNA, 547 bp, Heterodera glycines
  Genomic contig location: Contig_ID=SeqID_23420; Location=106..652; Strand=+
  SCN-specific regions: Sequence locations=1-8,30-256,278-432,455-547
atgcccatgattcagttcgtattttattcatcatccgaagaaaacgcgcatcgcaaggattacggtaggaggtggtacggtattgattagctgtgattgagttagaaaaatttggcaaagtcggattggttggcttttgcctagtaacaattttgctgccgacagggattcgcattcttcgtcggcactgttcggaattgcctctgctaatggctttgacaacaaattgtcggggtcgagattcccgaacaaacaacacccattattccgatagctttaaggtcgattgacacggaaatttcccgatgccagtgaccaaaaagccgagaaccgagactctcgagtaagcatcatttatgtgtagtgtaatgtccgactgataccgattaaattgattatatttttagtgaataaagcagaaatattacgcgcaatttatcacaattaaataaattacgtaattaaaatgaatttcgagggacgggaaagaaaatcagcgaattgccgccaatttattattatttttgaatgtattataattatcaaa

SEQ ID NO: 54125 - DNA, 799 bp, Heterodera glycines
  Genomic contig location: Contig_ID=SeqID_23421; Location=411..1209; Strand=+
  SCN-specific regions: Sequence locations=1-207,236-265,306-683,707-799
atggatggtccaattgctgccactgaaaattaccccaataatgaacaaaccgttattgagccaaatgataaattgaaatttcattgccccgagtgcaattacgaaatgtgtcgcaaatgcaatgcaaaatgggtggaagagcacaacaatttgacatgcgaacagttcgccaaacaacaaaatgagcaaattcaacgaaatctcaagtaatgtaaaaaataaataaatatagcatttttaggttccggttgtgccgataggcgccgccgggaaaatttttggtatttttaatgaattttattacaacgtatcgccctttttagacttttctcggagacctctaaattcaggacaatctgaaaattcatgacattttttgatttttcagataggtaccctcaaattcaggacaaatctgaaaaatcagtagacttgatagccctgcagaagaagcaaaaaaattcaacgactaattttaacgaaaaaaaaatcaaaatgttaccccgccaaaatttattttatttagtcccgtcatttgagtcctaatggtagaggaaatttcagtaccgtcgcgaagatagatgacttatttttcggaattttcttcactaaactcaaattttggctcaaaaaatgacgaaaaaagtcataaaaacgcaaaaaagccataaaaatgccaaaagatattttaaaaaattttaaaaaaggtcacaaaaaaatgcattttagaagcttcaaacaaagtatagaacacataagtcatttgacttaaattcccatccctaaatatgaatgtaga

SEQ ID NO: 54126 - DNA, 718 bp, Heterodera glycines
  Genomic contig location: Contig_ID=SeqID_23421; Location=1296..2013; Strand=-
  SCN-specific regions: Sequence locations=1-112,134-366,388-645,668 -694,716-718
atgtgttcgtcagaacaccgtactctattggcttttcatttcttactgtcatcgtatacagtatcaacgcaccggtgctttacaaaatcaggtaacattttttgaaaattcaatttaaatttacatttttgaatagcactgaatatcgcgcacaattcaacaagcatttgccatggattaacaaattactttgccaaactaattcaaaccaggtcagtgtgatcacagtacaaccacattgacgatcagagtcaaggacagaatgtgatggaagcaacagaaatattccaatggaattatggcacacagttttaaatttattcaaaaattaatttgttgaattttcctttcacattaattaacagttttaataattccaatttgttcgttttaataataaattcaaaatttaactgggaaaatattaatttgaaatctttgaatcaaaatcgaacaatttttatatacaaacttctcctttctatctgtaaagtaagaatccgaaaaattctttggcagcaacaattcccctatgtacacagttacagaactgggactgaaatggctcagtgcgaaagggactcatgtcatggacgcgggggggggggaagtttgggcaccagaaatttgggcatcaaattaaggattgtaaaacataaaaatatatttttattgtctaaaagttcaaccatctaatttaaaaacatagtaaattaaa

SEQ ID NO: 54127 - DNA, 661 bp, Heterodera glycines
  Genomic contig location: Contig_ID=SeqID_23423; Location=49..709; Strand=-
  SCN-specific regions: Sequence locations=1-249,271-472,512-661
atgcgcctctgtctggcattatttattgccgcttcagcattgtcacttggccgatggattgaagctggaggtaaatcgaattgattaattagatattgggttggcatatatttattatgtcgggtttttattagtgtccagaatctttataagattggctggagaaaaatctgcttcattggtattttaacgcagacatctcttttttaaacggacaataattatgtgctaacctaatactttaaaataacaaaaagcttaaataattatctaagctatttattaacgcaaatttcaagtggtcgaggatgtaaaagactacgtcgatgccttttccgaaataagcgcaccggcagcaaccattggcgagcagctcaggaaaatttcagcccgagtttcaaagctggttcagttaggaggtccggtcggaagcctcgcagcattggctatgcagaaagcccttgaagtaaagttttataaaattctttttaaaaaacaaatattaaatattcagtattacaataataagcataacgtaatatttattttcacttctctaattgctccatctcttttagccggagagcgaggaaatggtcgcgttgaaattgttgcactccaccatggtcaagagattcgatgtattggaccgtcgagttga

SEQ ID NO: 54128 - DNA, 325 bp, Heterodera glycines
  Genomic contig location: Contig_ID=SeqID_23423; Location=1805..2129; Strand=-
  SCN-specific regions: Sequence locations=1-76,109-325
gccggtgccgaactctaggggtagccgcatagcttgttccgagttgatagccgaaattattgtcccgagtgcagctaaaaatttaaattttttgaaactaaacgcataaatttaaacaaacaatggttgccgatgggtgaaaaattgagtcgattatctcaaaatgcgtcaacaccatccaacatctggcgctgtgtcaagccgatatatgttcgagagaagtaaaggaagaacattggcattccaggagaagacggccaagataattgagaaaaactcgatttgtgcatcttcagcgatttcctgagtggtgtgtgaatctaaa

SEQ ID NO: 54129 - DNA, 1375 bp, Heterodera glycines
  Genomic contig location: Contig_ID=SeqID_4346; Location=38..1412; Strand=+
  SCN-specific regions: Sequence locations=1-254,276-551,574-715,766 -791,823-1375
accttctccgactgccacaaaatgtgccgaacaatggcactttgggtttgctggaccccctcattctcaacatggacttgcaccgtccgccctttttccccttcgaccccgactctcatcccctcgggtaattgtgcccactcaataatatgccaaaatcttttatttttttttccagcgaatgtgccgccgaccaatcgaatccacgccaatttacacaatgcgaaggtgggaaaacagaaacgaccgaatgcgagcagaaaattgtgagaaataagcggacattgtgtcaagaaatgacaattccttttaagagggatgcccaacggaaaatcgacgaatgccgaaaaaaccaaatgcacccactaaatgccattttctacacaaaattggcaaatttgtgcgtcattaacctttgtccagcccttcttttaatgccaaatagagacgaaaaaggcaaaaacgaaaaaaataaaaatggaaaagcgaagcttttaagaggggccgaccgttctgtacgagtcgcttgccgctgccgacttttacgaattctccggcggcgattcctcctcccaatgtcccttttttgacaaaagtattggcaaaaagtgccaaaatcagacgaaaaatacatcgaatggcaccgttttgaaaagcatagctgcttcaaggaataataatggtaaaacaatgccaaattgcaacacttggttcgtttcccttcagtttactcctctccctctgactttgtccccctcctttttccgatgttcgacttttttgccgatggtccgtccgcacttttctttttgtttaatttcacaattcaggcccattcacttaccttcagaatttaactgaaaattacgtgcgattgtttggaagggttgtctcattaacgggcacaataattgacgaagactttgacggaattggcgaccaacggcaaaagcagcggaacaaaaagtgcccaaaaacatactgcggcgcaaatgccttttaattcagcaaatccgtcggcaattcgtcgaaaatgccaacgcattttttccgaattctcttccgttgtgaggacgatctttggcatttgaacggaatcaattgcaaatggaccaacgccactcgcgtgctcgccttcgttctgcccaatgttcagagagatttgaattgtttggtcagttgcggtggcttttccctttcgatttgctcttttaaattgccaaagcgcgccgacgaatatcttttggtgaacaccgcgagggtccgcgacatcgaattgcttacggacgtacaattctttgcggaacgaatgtggtacccaacggaggatcagttgcagtggcggacgaacatcagcacggaactgtggcattga

SEQ ID NO: 54130 - DNA, 2261 bp, Heterodera glycines
  Genomic contig location: Contig_ID=SeqID_4347; Location=234..2494; Strand=-
  SCN-specific regions: Sequence locations=1-164,186-1007,1030 -1040,1203-1971,1993-2003,2025-2261
  Gene Ontology: Mol. function=structural molecule activity; Cellular component=collagen type IV; Biological process=negative regulation of cell proliferation
atgtgcccatctggtcccccgggttaccctgggcctccgggagatcgcggagaggacggcctaccggggcaggacggagagcccggcaacccggggctgtcgggcagcacgggcttcctcggaccccagggaatgccgggcgagtcggggaagccgggaacgatcggagagccgggcatgccaggacttccgggagtaattggacagaagggagacaacggagcaccaggtgaaaagagcttgaagatatatgaatgagctctgggaagtttttgagggaaaaaatatggacgggccgggtttgaaccggtgtctctggctttttagacctgtgttctgccaaatgaactaccccccatctttcctttgcttctttccaatttattacgattaattgtcataccgttgaatccattaatctttcgctcggggaagcatcttctcaatctcggactgttaaacaatttagttactaattgttgtttaaggccaaaagggaccaatcggaccggcgggtccgccaggacggcccggaatcgacggaaagccgggactgatcggagtgccggggaacggcggcaacacgggagacggaggactgcggggaccgccaggttttggactgaggggtgggaattatttactaatgaatgggcattaatttaggcacttcgggagaaccgggattggacggagagccagggagagacgcaaagtgagtttggcatttgggagaagggcaccattgactcaataattcactctcccaatttctgtgcagttattgccgctgcccccgtcgcacgggcaaagccacgtttttggcattgtgaagccgagccaagggcagagaatgatgaaggacattttgcactttgtgttactctccgtcaaaaatgttatatgaatgaaagaaataaagcaaattttgagtggttggggagcgcatttggcacgtgaaattgccaaaattggatggcattttattagtggcacttttccacgcatctctgccatgtctctctctccccgccctgctatttcttcgttctcttctcctctgctgctgtctgttctctttcccccgccttttcataaaattcatttttttatttatcccatttttctcttttgatatgccttttcccttttctttccattactttttccttctttccttttttcccctcccttctcttttcatccaaaatcattctccgttagtctgtccaaaagtgccaaacgatgtgccaaagggaagggaaggcgaaatttgctatcggagaacgaacggagaaccgtcatactttttcgaaggaaagaaaattgcaggagagccggacagcaaggtattagttaattggcgaattattagttaattgatggacgaacggacggaaacattcgttgatgaaccaaccaaactggacagatttacaaagcggacaagttcaagcaagggattgggcaggcggaacttgactcagaaaggactttcgcggtgaaagttgtctccacggggacaagcgcacgcgcggttaatttggcaaagccaccgtcgatgattaagcacgaattaaatatgttgaagtggttcaatgatttggaggcgaataaacccgtcgatgagcactcagtggtcaaattattcaagggggaaacggtggaggacaaaagtcggatggtggtggaacacgaaaagctgctcccattgcacgtggagttgagaagagatttctcgatgatttacgtgatggaatttggggacaacactttggacaattatttgaagcaatgggacgaattggcaagggaaaaacaaatgggggaacagcagataaagcaggacgcagaacaactgctggccaagttggcaagcacattgtcaacatttcacagacgtacacactaattaattaataattgcggaaaagcgattctcggcttaccctcgcgtattcggcacattcactcccctcccctccctcaccgctgtttagatgctgcacatttgcatttgaagccgggcaattggatcttcgtcagaggggagaacaaatggaagttgatcgaccttcagtcggccatccccaacttcgagcagtacaaacctttgcaaatgggaaaagaggaacgattcccggaagattttatggagttcgcgtgcaattcgctgaacaacgaaatttgtttgaccaaatttattgcaccagcaaatgaacggccgagcacttatgcgagccctgaacatagcacggcat

SEQ ID NO: 54131 - DNA, 570 bp, Heterodera glycines
  Genomic contig location: Contig_ID=SeqID_4349; Location=62..631; Strand=-
  SCN-specific regions: Sequence locations=1-94,118-392,414-570
atgtcaatccaggatccatcgtccgccgatgtaaaaagccaatcggcgcatttaaatgcgaaaattatgcacaaatcggcaaatgttttggtccaaaaaacattttcaaataaaaatttggaaacagagcaaacagaaagcagagtcaataaaaagtcaaaaaatgagcaaaaacagcgcaaaacggacgaacgacagaaggaaaaagccgaagggaaaagcgaagaaacggaaaaagaaaaagccatcgaaaacgaaaagaaggaaaagccgaaacggacagatcaaacgacacttttggaggtaaaattaagccatggacagaacaaatcacccattaaatgcttgctcaggcaatgccttcctcctccaacgcccctcagaaagtgccggtgccattaattgacagacagcgaacacatacggtaatgacagtggaggaaaatgtacgggccggcatcgttgcctatttggacacaattggaccgtcgaatgagactgggagcagcagaagtaaaaagcctcagtccatcgttaaaccgatgccacaacagcaaagagaagacgggg

SEQ ID NO: 54132 - DNA, 534 bp, Heterodera glycines
  Genomic contig location: Contig_ID=SeqID_4349; Location=945..1478; Strand=-
  SCN-specific regions: Sequence locations=1-141,528-534
atgaccgagatggaccggacgcggtcattggagagaaaagcattgcatggacacgcgacagtgacaagtcgaccctcattaagcactcaaatggaagaggaaatagccgggactacaaatatgataataaatggccaagacggaagggatgaggaaaaaaaggagacaaattggaaagaggaagatggaggagaaagaaggagcgggatgaatcagagggatgaagacgatggaagaataaatgagaaggaagaagacgatggaggaagaaggagggggatgaatagcagggaagaggaagaggaggacggaagaagaaaaaggggcgggatgaatagcatggaagaggaagaggaggacggaagaggaagaaagggcgggatgaatagcagggaagaggacgatggaggaggcaggagcggaattaatgagagggaaaaggaaggggaggacggaagaggaggaaggagggggatgaatagcagggaagaggaagacggaggacggaagaggaagaaagggcgggatgaatag

SEQ ID NO: 54133 - DNA, 934 bp, Heterodera glycines
  Genomic contig location: Contig_ID=SeqID_23424; Location=303..1236; Strand=+
  SCN-specific regions: Sequence locations=1-272,294-565,587-934
atgggtaccaaaatggaaggatgcgatagaaattggtgccgctttgataatgtgagaatgattttttatgtttcgttgatttcggagcgttagttggggtttcagccgagtttattctacaaaatggggggcgggtggaagccgtaaatccgtaaatggaaagccggagttatggggacgcatatccgaaagcggctcaataaaaaagcgacaaaaagtgccgtaataaaggggacagtgaatgcgaattgtttaaattttcaattttctaaaaaggtataaattcatatttttaaattaatttctctttctgtgccagggaggtcacctgtgttcggtttacgtttgtggacaatatggtggaaggacagaatggcatcatgattggagctacttctggcggtagtttcacattcatttatatttctcgttgagattttcttttatttttattttacccatttttgtagcttgtggccggtcctcagtgggtcgtgtcggaggatggcaataccttaggctgggagtgacaaactgcaccaatgtcatttttgcatccttttttaaaatagtatttgcagcagcaatttttggctctggccccccccccccccgaccccaattacgaacgacaaacgacaaatttggcattttgtcaccgaatttgtcattacgacaaacaaaattttgtcgtttatcgtttaaatatgccatttttccgttggtcgtatgtctttgtcgtgtgaattgtcgtccaaatgacaattgacaaaatgctaccgtaaatttgttgtttgtcgtcgtcactttgcttttgggtggtattgggtatgcgttttttgaaaagccgggatccgccgctccagaaaagccgggggattatgggatcggtgtcgttcggaaccccgaccctagtgcaactcattaattttga

SEQ ID NO: 54134 - DNA, 1185 bp, Heterodera glycines
  Genomic contig location: Contig_ID=SeqID_23426; Location=1..1185; Strand=+
  SCN-specific regions: Sequence locations=1-991,1013-1185
gctcaatcgtctgatcctcgcacctcacattgacacgtgcgatgagatcaacgatattatgatggcgaacgtgcctggtcaagcgcgcgaatatttgtcctcggacaaaccgcttgacgagcggccactggacatcgatgaaatcgagttagaagtggcagcgttgaaccgacgcacagactctgggatgcctccccaccgtctgcgactaaaggtcggaagcgtcgttgtcctccttattaacaaaagcgataaggaaggactgatcaacggcactcgcatcgttcttgaagaacttggcgacgatcgtctggtcggtcgcgtcattaacagcaactctgttggtggccaagttaagttcttcatcgaaagaacacgcaatgtctacgaggacaaaacgcctggcggcttaaaatatgagcgtttgcagtttcccatcaaacctgccttcgccatgaccattctcaaaggtcaaggccaaacaatcagcacagtcggaattgaccttgaaagggatgtattttcccacggtcaattgtacactgccttttcaagggcaacggacgggaacaacgtccgagtgtacgctcccagaagggagaccgatgcacaagacagagtcaaagtgctgaatattgttgcaacgaaaatgctcattttgcaataaagcaaacgagttaagtccagcgcgtgcgcactttatgatgtcactccgttctcatctgcacttaaaacggacacatattcaaaaaaagtgctgccagctggactgaaggaggcaggtgggccatgacgtgcgagttagggcacttccggtttccattgcattgaaaaatgcagtgtgtcaaggtgaaaccaagtgcatgtcggctgacgcaaagaccctaacacaaggcctaggtagcgaagctcccaaagcgcgaagcgctttaagcaccaagacacatgtaagcacacacccgctagttatatactactaaagaaacaaggcaactcatttccaaaaacaaaatctccttacggggcgtcgggaggggttcgaaatttcgaccttggggacaactttttgaggcgcatctgggaaaactataggtttttcgctccgagggccaactgagcgccaacggcgctgaaacggctttttcaaaattttttttgaagttgctcggattcaaaattttttta

SEQ ID NO: 54135 - DNA, 508 bp, Heterodera glycines
  Genomic contig location: Contig_ID=SeqID_23427; Location=138..645; Strand=-
  SCN-specific regions: Sequence locations=1-122,153-314,368-508
atgggcggaaacattcgcatcactttcattgacgagtgccaaatttgtagtcaaagtgaattgacaatgagcaaattgatcacaatgagtccacagcaaatttcggtgccaaaaattgcgcaattttcaaaagaattttaaaaattattttaagcaaatgagacttgactccgacgaatcggacatcgcttggtttttgggaagtgtcattcatttgttggctttccaaacttatccgcttgaggaatggcacagtcggaacaaaacattggccaaccaatgccaattggacggcactttcaaaatgccgcaggttttatttaatattttatttaatgtttaattttattaattttgaatatttattcagacttccgaatcattttgtatgtttctgctccaaaacagcgtcaacaaaatgctattttctgctgaaaagctccaaattcctactgattttcctcatggtttcgagaaagagtacgccattcttggccaaataatgatg

SEQ ID NO: 54136 - DNA, 755 bp, Heterodera glycines
  Genomic contig location: Contig_ID=SeqID_23428; Location=861..1615; Strand=-
  SCN-specific regions: Sequence locations=1-63,94-171,193-430,460 -562,599-755
atggaaaaagtcggaagaccgagtgacgattcaccgactgtaattagttgccgcaatcagttctattgtatttcccagtttgtttccctagcgtttttcaatgtaaagtataaaaaagaacaatgccttgaaattcgggaatgaaattaacatataattagctaatggttcgaagaataaatgcatttgaaattttcacttttttcgtcttttaaaaaatttcatccttaacatttaaaaaatttttcagcttcagagatataaactgtggtcggggactttcgtcaacaaatgtcgccaaaagtcggaaaaaatcttaataaaaattaaaaggttaagaaaattgggtatatttaacaacacacagatttcggccgggggtcgttttcgcgcggttgcatatacgtagaaatgggtaggtgtattagagaaattttatctatttttataaatttaaaagtcatttggtgtcatgcgctgcaaatcggaccttcttaggggtgtatttttcgtttttattgcatttttcataacaaattttggcaaaacgccaaaatagttgaaattattatttttttttaaaattttgtaaaaaaaactagaaaatagttgctaataactcgaaaagtagcttaacaacagccgaaaaaacatgtttttcgtgcgtgcattccaagctatgggaagctcaggaaaaaaatagtgaaaaaactataaattggagccctagttattattgataggaattgaataaa

SEQ ID NO: 54137 - DNA, 1701 bp, Heterodera glycines
  Genomic contig location: Contig_ID=SeqID_23429; Location=152..1852; Strand=-
  SCN-specific regions: Sequence locations=1-435,457-499,523-880,902 -960,982-1701
atgggagctgcggccgctgtccaacgttcattcgaaatggagaaattggcgaagcaaactgtcaatgtccaactcgtctggcagagaccagaagtgcgaccggatgaagtgcaaacgaatttgaaaaaggcacaacgcgtctctttcgaatggttgatcaacaacaaatcggcggttgccgatttccttgaggcatgggaggaggacacgccggtcgaagcaaaagttgcgcgtgactcaagagcccaatgctgttcagttggccgagtaattggactgtcagtaaatgaaaccgctccgggtaactttctgatgaacgtgaaaatgtttttgagttacagggctaaaaagggctacgacaggggctgggaagattgggaatccattctcgatgaaagggaatctaatgtgattccaattcctaattacggaggtctccctttcagagaacaggcatttgaactttcagttccgtcggacattgcagaagggcaatatcccgtctcaaaaattttaaaaatattgatgggaatgggcaaagacggagcggaacaacgaccaaccgttaggttgtcaagtaacgaaattgcggtcggtaagttgaacgaggaccagcgaatcactcacggattgtttttggacgacgaatcccgtgtaattttcatgcaggcaccggcaggaacgggaaaaagtgtgtcagtagcggcctgcatcgcaagcgtgctcaaaaaggaccgtgacgctgcaattttggcagtttctcctttgaatgtcgcagtgtgtgagttggtgaaggacaccatggaaagtttgtcagaaaaggtgccaatgttggcacttttctctgggcaaggaaaagggcgttacatggacaggatcaggcccctgggggacaatcttttagttgaagctgtgcaaagggatggaaatgttccttccgctgaaggaaccgagccgaaaaaatggagtgataataaaacatttaagcaatacgtcgatgactttaacacagcaccaagacgggcacgcgaacgaacgaccactgccgcgcttctgaaacagaccaaataccgagtgtacttcatgacattggctcttgctgaggagttggcattggatttgggcaacgtaacttatgtgttggttgatgagtgtgggcaagccacgctttcggcagttttgtcaattctcacacaattccgatcggtaaagaaaatacttctgacaggagataaacagcagttacgggtacacttaccgagtcaaatgacagttattcgtggtaagtttgggtttgagtcaattttggaagtgctggaaacagcaaaaggcatcgatcgcaccgttctctcaaagtgttaccgattgcacagtgccattgtacggtgtttggacgcgggagtttactctccagcaggtgatcggttggtaccaggaagaccggatgttgaaatgtcatcgtttttaaattatatgggcccacgcattgtagccgaaaattgtccgatcattttaatccatcaaaaatcatcgactcaaatggaaagtatctcattttcctctcacaatcccgagcaacgggaaacagctcttggatttttgggaataatccagggaacctttttcgattcaaagtcaggaagccgagcttgtccttgtcatcacgactcgctccgcggctggacgatcatcggaagctga

SEQ ID NO: 54138 - DNA, 145 bp, Heterodera glycines
  misc_feature (126)..(126): n is a, c, g, or t
  Genomic contig location: Contig_ID=SeqID_23429; Location=1904..2048; Strand=+
  SCN-specific regions: Sequence locations=1-145
tttggcaccaattaccaccgtttttccatgtgaacgaatttcatttcctttcagaaaaggagttaccaggggtaaaatgtaattttcacccatccaccattcttatggacttgtgattttggccanaattaaggtaaaggagttg

SEQ ID NO: 54139 - DNA, 469 bp, Heterodera glycines
  Genomic contig location: Contig_ID=SeqID_23431; Location=40..508; Strand=+
  SCN-specific regions: Sequence locations=1-469
  Gene Ontology: Mol. function=ATP-binding cassette (ABC) transporter activity; Cellular component=integral to membrane; Biological process=transport
atggattaccttttggcccggtgcaacggattcgactcggccaccaattgggattggaacgacgcactttcacccggcgaacttcaagtgttgcatgtttttcattgtctatttggctcgttttgttcagcgactttccatcggcagagtgctttaccataagccgagggtcgcttttctcgacgaagccacgagttgtcttggctttgacatggagagcagcctatacaaagtgctaagggacgaaggaattacggtcggacacttttggacgctcaaattcgactcgttcggttttacaattgtttaggttgtctccacgggacagcgttgttcgctgaagcaattccacgagttggaacttaatctgcgaggacggcattggactttggtcgagttggactcggtccggtcgatggtcactgagccgtcgttgggaggagcggcggaggagggcagcagggcatga

SEQ ID NO: 54140 - DNA, 1281 bp, Heterodera glycines
  misc_feature (522)..(522): n is a, c, g, or t
  misc_feature (531)..(531): n is a, c, g, or t
  Genomic contig location: Contig_ID=SeqID_23433; Location=39..1319; Strand=-
  SCN-specific regions: Sequence locations=1-88,139-482,504-1150,1235 -1281
atgcaattggcaatgttctgcgtacatgttaccgcaaccataatattcttgcaattatatttggtaataaaaaactattgttgaacgcatttattttaaaataatttttatattttttaaaaataaaaaataaaaattccaaataaaagcaaacacttttcacatgaatttatattagattgatacaattccgaggtccttaaaaactgaataggtcgctcccaagcacaacaaagtagtgctgttcgagaccgaaaattccccgagactcgagaccgagattttttcaaaaattttcttattcgcttaaaatcagggctcacataaaacgaaaagaaattcaatttgatgccgtcatatatttattttatatcgtcgttggaccacccaattatcacataatttgcagggtttcactgaagcgggcatcgaatgccaacttgacggacactgcaaagataatgccgctcaactccttcgagtacggtgtgctcaaaatgctacagttgcaccttcaaaaanctgctgcanccaagtgtacgcgaacccgtacgccaaatgcccaatcaaaggatggcgtagaaaagggtacaaaggcaatgtgccggtcgaaatcggagtgccatcaaagaaacgtgacgccggtatgagaaacgttaaattagaaaacgcgaaatttaaagtcaaaagtatcattggcaaaaaatggcgaaaaagtgccatttccaacacggcgcatgaataatgttgccatttgtaggataacatataaatccgcgaaaatcaattaagcggtagaaataagaaacaattgaaatgaacgaaaatgatacctttaacctcttttaaggctgttctaagggcaatccgtgtaaagaaggttacaaatgcgtggcatacaaaaagggggacgaccacggcttctgctggcgaggcccacaaggagatggaggcccgtccaatttcgcattggcagttgcgatcgctggcctcgtcattctgctgtgatcggactactgatcagagaacactgatcaatgtgatcacaggccaatcgatcggaaggcaactgtttttttagggacagttcaacctctttttcacattcgggcttttactttatcgtaaattgttaaataacggcttccaatctttttgttttccttctccattttttggtacctttttgtgcttaattttctttttccctttattttttctatcatttttctttaattgtgttggagcaattggcattttcctccaagaaaatgaattaaa

SEQ ID NO: 54141 - DNA, 89 bp, Heterodera glycines
  Genomic contig location: Contig_ID=SeqID_23434; Location=33..121; Strand=-
  SCN-specific regions: Sequence locations=1-89
cactgttcaaatgccattccgatcggtgctggtaaccaacgggatgtgcggcgatcaatggtcattgatcttcttaatgacaatcaaga

SEQ ID NO: 54142 - DNA, 3790 bp, Heterodera glycines
  Genomic contig location: Contig_ID=SeqID_487; Location=1404..5193; Strand=-
  SCN-specific regions: Sequence locations=1-34,57-100,123-1383,1405 -1506,1528-1815,1837-3021,3043-3790
atgtgctctttagcacagggttcttccggcacattaagtcataatgggaagggtgtcgcaatgcaccggtgccccagcgatgattgtgctggtaaagatccccctcagcgggggtctcaaaaagggaatttgaggagtgtgcgatggactcccagcgaggagaaagctgtcttcgagtattggtcacggttggaacagcatgccatgttaaatggtagcgaagcccgggggacctgtgccataactagaagtcagtttctcattcattgggatggcgagagagagtcaagatccttgtcggatggtgtgcccgagtacccaatgaggacggaaagggcgtactatgaaagggtccgactcttgcgacaacgcggatggcaatgggattgtgctaatgaatgcttagtaattggccaatgtgcagagccatgccgtaagccaaacgtggtagcgattaaggctgataagggtatgaagagatcgctggttaagggaaagcttttgtccctgccccatgtaatgggcgaaataaaccaagtgagcgtgcaggttgaggtgcctttgccaagtgtacccgccagcgtgccccaggtggaaggagttgaaagcaaaggttttactgaaacggaaccgtcgaataaaccttccctggaagggaatccggcggaagaaggattaaggaaaccggagcgagtaaacgtacctgttcatgggataatcagtgatagtgaacggaaagacctgaaagaccggttttggagcgcctataaaacggccaagaggtctgtgggttttagaccggctctaaaaatcgaaccgaatagggttaaccgtgcccagtgggaagtactggattcctgcgttgttgaggtgctcaaaaagagggaaacctccaatgggtaccgcggttgcgtcctccggcatttgaacgttgcagtttatgcggcgggatacgtgctggcggaaggcaacaaggaaaggaggcaggtgatcagacgccagtcggcggaatggttgcttcgccaaaagtccgaaatcaacaacatccgtagacacatcgggtggattaccgatgagttaacacggaggaggacgggaaagaacccaacatccagacagttgagtaattttgcatggttgcaaaggcgataccaggttttgggtaaacccgtgagggaaacccgggacttggaagtccaacgagaaagacttgtaagtcgtcttcgattggctcaggaccgaattaactcttccatggatcgtgaagagcgagttcgtaaacgaatgttacccctgcggagaaagttggaagaacctttgggtgactctaaacttgacacaaagcaggcacgaacattttgggccagcctgattggagagcgaaaggaatttggaaaaatcccggagcttgaaaactgggccgaagaagtgaggagcaaagtcaccgatggacaaggtttcgcaagtgaccatgtggatcaaactgtttggaaaaagatactgggtaaggccaggccactgaaggcgcccggaccagatggaatccccaatttactttggaaacggttaccatccgcaaaccaggcgttatttaagtggttaatggggatcaagcggaaacagctcagtgtccccagttggctcacaaaaggaagggtggtcctcctacccaaaggaggtgacccggtagacccggccaactaccgaccaatcgcttgtttgaacacgcagtacaaactagtgactggtatggtgacggcatgggtatcggaacacctgaccacatactctattttgccgattgaacaacgagcgatggtgtctggcacttgggggtgtacccatgctatggtgattgacagagcaattacgtcttatgcagaggccactggactaccgctttatgtaggctttgtggactttgcgaaggctttcgactcagttagtcaaccgtggatcaggtacgctctaaaggtcgctggagttcacaagcgaatccgatgtcttattggaatccttatgaaatgttggagcgtaaggtatgaagtgttcaagagcgggagagtgttaaggagtgcgcctttggcagttaagaacggagtgttacaaggagacacgttgagcccgctgctcttttgtctctcagtagccgttgtttcttctgcagtaggcagcctctttgattttgaggtcaccatacctggacgaggagtgatgcagcagcagaaccacttgttctatatggatgactttaaagggtttgctcctagtgaagcgtccttgactaggatgttagtaacattggagcgaaccgcttcagccctcgggttgaaaatcaataagaggaaatgcgctctggtacacccccgtgaaagagagaacgaggaaactggaagtgatatcccggtccttggtctacgagacacttataaataccttggaatcgaagagagatttggtatcgttttcgaggatgcgtgggaccgagtccgtaccaagatgtttgagagaatgcgcaccttgctatgcacggaacataccttcggggagttgcgtgcggccttcgctagtacgatcgccccagtagcgaggtacctctttctcaatgtaatcgttggtgggcctagttggagtgaaaccctgacgaaagctaaggacatggacctgcgtatccgacgcctcctgtgggaaagaagagataacgagccgggatggcggtttaagcattgtagtgctgaccgcttgtacctccgcgtacagtacggtggacttggcttcgtgtccgtagaggacactttgtctgagtctatcatttactgttgggcttacgtgcaatgtaggcccgagttggagctggctcgtgaactttttggaaccttaaacaggagtgctagaagcggtataaaacagagcattgcgaaaggagcgcgtaaagtgttccgaagttatgcccttctctcgaaaaattccgcccagcgagtatctgaccttgatggggatgcctccccaggattccgagtaggggaaatgatattcatggaaccaactcggggtgccagagcaatcgtaaaaatcctccgtaaggagaatgattcgcgacgcttggctgcctggaaaggtagacctatgggaggtcgggtcgtgtcattgccagagctcgaccaggttcatagctaccactggttgatccgtgcgaggattggcaggcgttcgttccgagactgcattgcagcacaggagggacagttgaaagcgcgggagcttatgtgtccacatataaatgcgaaagcaaagtggtgccgacgatgtggggacggtcgtgttgaaaccgagcagcatatccttagtggttgtgcttggtcacggactggaactatgttagatcgacataacggtgttgtacggcaagtacacacggctttatgcaggaaatatggactgcccgtttcttctcatgtcgttcctttgcatgcggtaatcgagaatgaacatgccaaaatcctgtacgatgtcgcgttgcatacttcgcctgctggcgtcctccctagggaggatgggagtacgagttatacgggtctgcgtagcaccaggcccgatatggtaatattcgataaaaaagcacgtacgatccttattgtggaaatttcggtgccatggagagagaacctggttaaacaggagctcataaagtggcggaaatatgccataaattctatgatcgaaccattggaactagcggaagctgaaataccgggacctaacctgaaacatgcgttaggccttgcgtacg

SEQ ID NO: 54143 - DNA, 2971 bp, Heterodera glycines
  Genomic contig location: Contig_ID=SeqID_487; Location=4197..7167; Strand=+
  SCN-specific regions: Sequence locations=1-875,898-941,964-1316,1338 -2011,2033-2206,2230-2269,2333-2346,2376-2412,2440-2656,2689 -2697,2741-2971
gtctgatcacctgcctcctttccttgttgccttccgccagcacgtatcccgccgcataaactgcaacgttcaaatgccggaggacgcaaccgcggtacccattggaggtttccctctttttgagcacctcaacaacgcaggaatccagtacttcccactgggcacggttaaccctattcggttcgatttttagagccggtctaaaacccacagacctcttggccgttttataggcgctccaaaaccggtctttcaggtctttccgttcactatcactgattatcccatgaacaggtacgtttactcgctccggtttccttaatccttcttccgccggattcccttccagggaaggtttattcgacggttccgtttcagtaaaacctttgctttcaactccttccacctggggcacgctggcgggtacacttggcaaaggcacctcaacctgcacgctcacttggtttatttcgcccattacatggggcagggacaaaagctttcccttaaccagcgatctcttcatacccttatcagccttaatcgctaccacgtttggcttacggcatggctctgcacattggccaattactaagcattcattagcacaatcccattgccatccgcgttgtcgcaagagtcggaccctttcatagtacgccctttccgtcctcattgggtactcgggcacaccatccgacaaggatcttgactctctctcgccatcccaatgaatgagaaactgacttctagttatggcacaggtcccccgggcttcgctaccatttaacatggcatgctgttccaaccgtgaccaatactcgaagacagctttctcctcgctgggagtccatcgcacactcctcaaattccctttttgagacccccgctgagggggatctttaccagcacaatcatcgctggggcaccggtgcattgcgacacccttcccattatgacttaatgtgccggaagaaccctgtgctaaagagcacattttgggataatttctcgcaggcacagacatagcaatatgacttgaaagctcaggtatatgttgtaaaaaactttttctcatatttatctgtgcagtacgacccaaaagcgttcaaccaataatgtaataacagctcctcacgagctatctccgcgcagaccccgaccagatacccaaaggctcattacaagttcaacctggttaggagaaacctgggcagaacgacagctttataaggcagagtgcttatccgacacatcattccagaggtaccaccccaaccaccccttatctgacgagcaaagcactcgccagaccagctccactagcccaggctggcactagtaggaactgttcctccggaactacggcgtcatcagaactctccgccaaccatcatccacatcccaagtcgcccgggggcaccaggtctatctttacctgcataaaacatgcctactaacgtatacatgagtaggtattaggaaaggagttaagctttggagaaatcgaagaaataatgcacgataatttatcgcaacaactggaaaaagagatcaatatgatcaattgctgagatcatcaagatctattccggtttgttggacgaatggcgccgcaccttcttcccagacggaggggctcccccctccttttgcgcggcagacggcccatcagcgtccagctcaatggtttcggcccctttggcaatgccatcggtttcgtcccctttttgctttttgccgccgtcctccgtacctggaagtcaaagtattgcttcgccgtcaatcatgctattatctctaacccgtccccgctttctctctcttctcccgctgcttttggcgtttcagagacttcttcgctgcctcattggcaccagccctaactggcccgcgcggctgcgtgccgccacgagccgtcaagccgtccatgaacagcttgatgtccctgagaactccctcaaaagtcgcaccttcgaaatggcaaacgaatgtggtcatatttctcttgaggaaaaagcaggttaagaaatgaaaatgaacactgtatagatatcatcgggatatacccgtatgaggtcagagaaaacacagggtccgcttcacgtattctttggacccccccccctccagtgctagccaacaccggaaggggctcggattagcgcaacccgtgcagcacctagggactttcgcgacctgtaggccaactcctaccaggctccccggaggttccgagtatcgccacacgtgcgcgtcggtagttagccgacgaggcatttggctaccttaagagagtcatagttactcccgccgtttacccgcgcttaatcaagtttccttggcttaacattcagagcactgggcagaaatcagacacggtcaacgtccacaaggaccatccgtctcctctgttttaattagacagtcggattccccgagttcgtgccagttctaaactggtcgttcagcgccaaccgaagtgcataccctgacgagcatacacgcagctgaagcgctccacaagcagctctcaccactagtccacgcaccatccccgaaagaacagcacacagccacgggcaaaagccgcctgtttcacgcaacagcccggctgacccgacctttagagccaattcttttcccgaagttacgaatctaatttgccgacttcccttacctacattattctatcgactagaggctgttcaccttggagacctgctgcggatatcggtacgatcaggcaggagattcaaatagcttccctcgcattttcaagggccgtgtggagcgcacgagacaccacaggaaccgcggtgctttacgggcgcaacatccctatctcaggctgagccacttccaggcacgcacaccctaaaccagaaaagagaactctggctcggactccacacgacgtctgcgagttcatttgcgttaccgcgcaaaacagctcttgcgaaccgtcatt

SEQ ID NO: 54144 - DNA, 331 bp, Heterodera glycines
  Genomic contig location: Contig_ID=SeqID_4350; Location=1316..1646; Strand=-
  SCN-specific regions: Sequence locations=1-331
atgttcgccgggggaaagttcggtggagccatcgcaaagggacgaaagttcgctgtcaaggaagagaacaaaactcggaaaagtcgcctctcattcgctttacctggtcaagtctctgtactcgtcgaggactctgtcgacactttcgaaaggggcgccggtgcatttgtcgtgccattcggtgtgagcggcgccaatgaatcgcagggaaagacgcgcgacgcgaacacttccctttgtgctgatggcgacatgtcccttttgagcgaaaagaaaactcaattcacttttggacaattcaaaaaaatattttaaatccatgaaaattaaa

SEQ ID NO: 54145 - DNA, 477 bp, Heterodera glycines
  Genomic contig location: Contig_ID=SeqID_4350; Location=704..1180; Strand=-
  SCN-specific regions: Sequence locations=1-87,124-150,172-182,204-477
cgtttgggcccccgtttttgggccccggggtcgtttgggcccccgtttttgggccccggggtcgtttgggccccaacccaaaaattgaaaaatgtgcttttttaaaaattaagattctaaaaactacgcctgagggaaccctcgccacttggtataagttaggtttaattaacattcgctcattttttacaattttacttattccaaatcctattattttttaatagttaaccaatttgatgtacattctgatttggacatttttcagaaatggctaaccaaattgcaaccaaaaaacaaaaagtaaaattgtcttacgaaggccacctttacaccttcgctaaaatgagttctgatgggatgacaaaattttggagatgcgagttcaaaaaatcaatttcacattattttggagtttctccggggaatttctcgcaactatcgaatgaacccgtgaatttctgttaatttttacat

SEQ ID NO: 54146 - DNA, 133 bp, Heterodera glycines
  Genomic contig location: Contig_ID=SeqID_4350; Location=1726..1858; Strand=+
  SCN-specific regions: Sequence locations=1-111
atggattccgtgtcgaccattgccaaagacggacacggcgtggtcaaatacttttgcgttgcgtcgttggatttgcccgacgacgggggagacaacgaaatcgttgcgggtgcagcacagaacaaccagcagg

SEQ ID NO: 54147 - DNA, 741 bp, Heterodera glycines
  Genomic contig location: Contig_ID=SeqID_4353; Location=352..1092; Strand=+
  SCN-specific regions: Sequence locations=1-24,53-247,270-283,312-741
  Gene Ontology: Cellular component=AP-1 adaptor complex; Biological process=locomotory behavior
gaaacagaggaaaggctgttgaattggaggatgtgaagttccatcagtgcgtccgtctgtcccgtttcgaaagcgaacgcacaatcagctttattccgcctgacggtgaatttgagctgatgagttaccgtctctccgctacaataaaaccgttgatttgggtcgaggtccaattggagaagtacgcacattctcgtgtggaatatatcgtgaaggtgctgataatgtcattaagattgggtcggcgcaattttttgaaaaattctatttccttcatattgtctatttttagttttaaattatataatatagagaaaagactgaaaaacttttcctaattaagggtttggcaaaaatcatacatttatctaggatttgaagtcgttcggcaaatctgataccatattaatttattggtttaaaataccccacaaaagtcattcgctaaaaaatgcatgaaaagagtggatgttaaaaaaagtgggctaaaaataaattatataaaacacattcaatactagtcgaaatggccttaatggttttatattgtcttccattaaattttaggcgaagtcccaatttaaacgacaatctatcgcgaatcacgtggagataattgtgccggtacaaaacgacgcggattctcccaaattcaaaagcaccgtcggatcggcccgttacgcaccggagatcagtgcatttgtttggaccatacggagttttcctggtaccaatgaatga

SEQ ID NO: 54148 - DNA, 856 bp, Heterodera glycines
  Genomic contig location: Contig_ID=SeqID_23436; Location=317..1172; Strand=-
  SCN-specific regions: Sequence locations=1-159,181-223,245-270,292-856
atggcaaacgctcatttacgccgtttttcctctccaacaactgcagactttgctgctcatttgctttgtccaattcattgggtatggtctaaccgaggccttgttttccccaaaagttgcaagaaaaaagtgcaaagcttgacaagtttttacaaattcttggctggccaatttttaaaattctgtcattttatccgacattttccctcccaattttttcagaatttccaccattttcaacatcgtcccaattgttctcgcctatgtgtccttcgccatgatgctgttcttcacactgaaaatgttccggcacaacaattccctgcttcagcaaggagcggtcttggagagagtgatcaatttggttcatcatgagccatcgtctcaaaacgacaaccaacaaatcgcgccttcggcgtcctcgtcatcgtcaggcactgaaaatgctccgcaaaatgatcaattgttgctaattacgggaggagaaatgccaagccatggcagtgacagtggaagtgccacagcgggacaagtgccaagccatggcagtgaaagtgccatcgctgaagaagggccaagccatgccgttggaaacgacagtgccagcaatgactccgcagcggattcctcctttctcatggacaccttctctccgttcgtcaattttctcatcgcgttggcactgtttctgttctccgtcggtgctgccggcaaagttgtgccgaattcgctgtttttctttgtcatttcactgttggtgtccgcgttgtgcttcattggtgccaccgatggtggtgcccgtgaatgttacgcttatgctttgatggcgctggtcgccaatttcgtttcgtggtaa

SEQ ID NO: 54149 - DNA, 61 bp, Heterodera glycines
  Genomic contig location: Contig_ID=SeqID_23437; Location=538..598; Strand=+
  SCN-specific regions: Sequence locations=1-61
gccaataaacacgaatgagcgaacggtgaaggatccaaatgattatttggagaaaatttga

SEQ ID NO: 54150 - DNA, 411 bp, Heterodera glycines
  Genomic contig location: Contig_ID=SeqID_23438; Location=297..707; Strand=+
  SCN-specific regions: Sequence locations=1-151,175-175,197-254,276-411
atggcatacgaaaattctatgaagaaaacccaaattggatggaacacgttgcggctaccatcaacccgatcaccaaatacaccggcggggtccgtaaagcaattgcagacccgggttgggtgctagagaatagtatagagagaattgaatttgccattttaaattgtaatttttgtaaggaagttatctttaaaatgaaaaccttttcagatttattggctcataattgagcagtccgtttcaatataattagctaaaaattttcagaaatttttggacaacatcttctccaaaaaacacctcccgaagaaaacgaagaaattacaagtgagttggttgattatatatgtagtaattcatgcagtcctgatggagaaggagagtagatgagagagagagaagaggaaagaa

SEQ ID NO: 54151 - DNA, 214 bp, Heterodera glycines
  Genomic contig location: Contig_ID=SeqID_23440; Location=276..489; Strand=+
  SCN-specific regions: Sequence locations=1-214
atttagaaacgggcgcaagcgcccgtctgaggccgcgaagcggccttaatagcccaacaaatttataaacgggcgcgaagcgcccgtctgaggtctcgaagctgccttaatagcccaacaaatttagaaacgggcgcgaagcgcccgtataagcccaacaaaattaaaaaaacgggcgcgaagcgcccgttcgaggccgcgaagtggcctaaaa

SEQ ID NO: 54152 - DNA, 111 bp, Heterodera glycines
  Genomic contig location: Contig_ID=SeqID_23443; Location=301..411; Strand=+
  SCN-specific regions: Sequence locations=1-3,92-111
gacgtctccgttccaagtactaagaaggcccaacgttgcttaacttgccagatcggacgggatggcgtgctttcaacgtggtatggtcgtaagcgaaaggacagcaattaa

SEQ ID NO: 54153 - DNA, 88 bp, Heterodera glycines
  Genomic contig location: Contig_ID=SeqID_23444; Location=311..398; Strand=+
  SCN-specific regions: Sequence locations=1-3
gacgtctccgttccaagtactaagaaggcccaacgttgcttaacttgccagatcggacgggatggcgtgctttcaacgtggtatggtc

SEQ ID NO: 54154 - DNA, 620 bp, Heterodera glycines
  Genomic contig location: Contig_ID=SeqID_23445; Location=205..824; Strand=+
  SCN-specific regions: Sequence locations=1-68,142-183,242-433,455-620
  Gene Ontology: Mol. function=protein phosphatase inhibitor activity; Cellular component=cytoplasm; Biological process=G1/S transition of mitotic cell cycle
atggacacggacgacggaatgcgaaggtcgtcgacggacagaggcgggcggaagagaggcggcgacgcggaagacgaggaagaggagggcgaaggacgactggtggtggcggaggaggacgacgacgaggaggagaagaagcacagaagacgcatggaacggtgggaccgcgtggacgattgggacgatgacgatgacgacgacgaggaggaagcggacgacgacgaggaggacgaggacggcagccccaacggcgaagtgccgcccccgccccccggcacgctcagctaccgacgcttcgggcaggaggtggaaagggggaggagagagaattggggaccatcaccgttatgcttttcccccattcattccagaacgttttggttgagcgtgagacgcacacaccgccgactttgtggacactttgtccggaacagagagaatggggaggcaacgggtatccatctggcagtgacgcgggaaaagtgccaacggattctgacgagaaggcgcaacgggaggacgaagatggctcaactgattgggaacgcgcgggcaacaagaagcggtccggtatggccatcatgcaactcaggggatggcctgagccggacgaggcg

SEQ ID NO: 54155 - DNA, 414 bp, Heterodera glycines
  Genomic contig location: Contig_ID=SeqID_23447; Location=396..809; Strand=+
  SCN-specific regions: Sequence locations=1-354,376-414
atgctgaaaaagttgccaaaacccttccttattgtctacgatgacctcatgggcgacattgacgcgaagaagttggctgatctgtacaccaagaagtcccaccacaacaacttttcggtgatattcctcacccaaaacctgtttgacaaggcaatgagagtgccaaggtccaatgcgcagtacatctttctgatgcgtgcgcccagcgatatgctgagcattcgtaatttggccagccaaatgtttcctcgcgagcaagggtttctgatggacgcgtacaagcaggcttgtgccgatccgtacgggtatctgttggtgacactacacgcaaacacagacaacctcttacgactgaggacaaacattttcccagacgacgaagaaaagattgtctttgtacccaaaaatggttaa

SEQ ID NO: 54156 - DNA, 1619 bp, Heterodera glycines
  Genomic contig location: Contig_ID=SeqID_23448; Location=744..2362; Strand=+
  SCN-specific regions: Sequence locations=1-262,317-681,704-1364,1388 -1619
atgaaatattttgttttcggtatttttgctcggcttttttactccttttcctttccgtcaatttcaaatgcaaatgcttcttcatcaatgtcggtaagtttgctgcttctcacttcccaagttctgtagggtgccgtgtcattagttagtcaaaaaccattcccacaggggaaattggcaccaaattttggaatcataataagagttaaatatgaatcaccaataaggacagctaatgccggttaaggacaaaagcacagagtaataattaaacaaattgttaatttttattttaaatttaaattgattttataatgttcaatcggtgggcgaaagggttagttgttcatgtttagaaattactggggtttaatgtatgaagagacctggtgggactcgcggaatttccgagttttttttttggttcgaagttcctccaaaatgtaaaattcaaaaaccggaaaagcttattcggcacactaatttgtaagcaattgtttttcacaaattcgcagattgacgacaatgcttttctcgcctttctgaaggggtggaaaagctttgacaaattttacaccgaagaagtgctgcttttgggccagaaaaaagaagtgttggcccaaaagtttgaagtcctcctcgccgcgcttcattcgttgcgatgggattggaaatgccatcggattaaaaatgaaaaggaaaagtgcaaaaagtatcgcaacttcgcgcactcattgtacgactatctgttccgtgtgtatgcggtttttcccgcggtgaagccaattttcatgcttaaaaagcaaaagtttgtgaagatcggcacattggccgagttggtgaacagtttggaccgaattcggaaattttttttcgatacggaattcgccagaagcttcgagttcaaattgaagaagctgttcatggtgtatttcaagccaaagctgaaaaaagagctgttggaaaacgggaaaaactcgccaatttccccaatacccgccggtttgaaagtgccaaagttcataaattttgatcgcaaattaaaagcaatgcatattgatcagcaatttgcggcatttgttaaggaacagccgaattcggcatctaattcgggcccacttttcaccctagtggtaaatgacccatatggcttcatacagcaaaagttggcacaaaattacgaaacagcttttggagccgtgtattatttgagaatgaattggcactgtgccaaaattggcaagaaatttgacgaatttgggcagcttaagtgccaagaatatcgaaaatatttggacattttgtgtgaatatttattccgtttgttctccggtattcccgcaatgaagccgatttttaagctgaaaaagcaagaaaatgaagaaatttatgcaagtttaattgatgtcattgagaatttgggggaaattatgaaattctttttcaattcgcaatttggccgggggggaaaattcaaatttgagacatttcttgcgaagcattacgagccaattttgttgaatatggatgaagttggggattacgtttcaattggacaattgggcgacaattcacacgcaaaatttggcaaaaaattcgaatttcaaatgaaaaacatt

SEQ ID NO: 54157 - DNA, 1041 bp, Heterodera glycines
  Genomic contig location: Contig_ID=SeqID_23449; Location=171..1211; Strand=+
  SCN-specific regions: Sequence locations=1-46,68-249,271-382,404-1041
gctaatagagcatctaaagagctttcgaatgatacaacaatgttggatttggttggcaaagaaaaaagttatagtccaaaaacatgtgttcgtacgaaaacggcctggcgcctacaatttgtatataaaacagaataaatgttaaacgctgataaaaaagtaatagacagggcccggatttttaagttttcaccaaaaacaaaatctcaagactggatataggtatcgggctgaaattttgcatacgtatgcaacctgggacggggcatctgggaaaaataaggattttccggtccggttgctaactgagtaccaggggcttatttcacacttttgcttgcgtttcttcaaataaaataaaaaaacaaaaaaaaccaaattattttttagatttttaggttaaaattagaccaatatttttacaaaataaaagtaaaagatttttttaagttaaagtgttgactaaaatacaaaaaaaattccaggcctctacctataaaactcttctaatcactgttgtaactcttctaatctctgtaaggccaacaaaatttgaaaaacgggcgcgaagcgcccgactgaggccgcaaagcggcctaacaagctaaaaaacgggcgcgaagcgcccgttttgagcctcgatgtggactaaaaacccctaataatttttgaaaaattcaaaaaaatctctccaaccaattcgatcaatttgaatcgcttcacagcctaggtagcgaagctcaagaagcgcgaaggatataggtagcgggctgaaattttgcatacgtatgcaccctgggacggggcattcgggaaaaatacggattttccggtccggttgccaactgagtaccaggggcttatttcacacttttgcttgcgtttgaaggcccataacttttttcggattttaagttgaagtgttgactaaaatacaaaaaaaaatttcagacctctacctataataggaagggctgcagaaattggcaacttttcagtaccaactttgtccaattcagtccccgtcgaataactcattaa

SEQ ID NO: 54158 - DNA, 673 bp, Heterodera glycines
  Genomic contig location: Contig_ID=SeqID_23451; Location=2102..2774; Strand=-
  SCN-specific regions: Sequence locations=1-397,420-447,471-481,505-673
atgccaatgggacatgccaaaggggagagaatgtgccaaagaaaaaaggccaatgggaaaatgccaatgggacatgccaaaggggagagaatgtgccaaagaaaaaaggccaatgggaaaatgccaatgggacatgccaaaggggagagaatgtgccaaagaaaaaaggccaatgggaaaatgccaatgggacatgccaaaggggagagaatgtgccaaagaaaaaaggacaatgggaaaatgccaatgggacatgccaaaggggagagaatgtgccaaagaaaaaaggccaatgggaaaatgccaatgggacatgccaaaggggagagaatgtgccaaagaaaaaaggccaatgggaaaatgccaatgggacatgccaaaggggagagaatgtgccaaagaaaaaaggccactgggaaaatgccaagaagtaaaataatcaatgggaaaatggcaaagggaaacaaaagtaaaaaaaccaaagagaggaagtgaatgaaaaaagatttattaaaagatatttattaaaaactgataataactgataacgagcggaatcaggaacggcttaatctgttggcacgaacgaggacaatgccaatgacgccaccgttcggcggcatgcgacggccacaacatttgcaaacagttcgtgcctaattaagacaataaa

SEQ ID NO: 54159 - DNA, 469 bp, Heterodera glycines
  Genomic contig location: Contig_ID=SeqID_23452; Location=163..631; Strand=+
  SCN-specific regions: Sequence locations=1-95,117-355,379-469
atggatcgtcgagattctcgaagaaggagaatgagagagaaaagagaagagggaaaacagagagaacgagcagagacgagagattgttattttgtagaggaagatggacaagaaagtgaaagaatgagattcttaaagtattttggctcgagactctcctaccgacatgaagattattaagaaatttcggctcattgacaggaaattttttttagaattccgtttttaattattgggcctcaaaatcccgatttaaaaacgcattcgttcattgtcaatgtgaactccacggtacttttccgttatggggtcgcactttcaaattttaaaaagttaactataggagcgaatttttaggttttaacttattttctgaaattttccatttacaaatcatttggcagataatcatacgaattttaatacaaaaattggaaatgtatctcatttgttaattaacaatcaatga

SEQ ID NO: 54160 - DNA, 1843 bp, Heterodera glycines
  Genomic contig location: Contig_ID=SeqID_23454; Location=370..2212; Strand=+
  SCN-specific regions: Sequence locations=1-626,649-1637,1659-1843
atgcagcaggcattggacaacatcgacgaaagcaacgacaccgccggatttgggacttctcatcttcgatgtgccattgtccaagtgcaatcatccatggctgtcgcaatgctgaagcgattcaccaagaattgcccttggtttttcggcatttctaacggaactccgacagggagtgatcgccgtctccgattgggcgacgaagtcgtcattgtcaacttcgcctggaaaagtggctacgaagtcctgtggcatctcgaccaggacggcacttctcctccatggctcaatgccggaaacatcaacatccaagcaacggcaatcaaagccaacatcgccaatccgacgaacatcgttcccaaaatcgggattgtgcttaatgtcaaacgccgtggaatgcgcaaaacgaacgtcatccaaagcctaacggttgtggcacccggcatgaaagttgcacaaagcttaccaggctgggctcttggtgagaaggattggtttagaaccgggcaagctgtgcttgtcgaaacggttgaattaatgagacctaatttgtggaaagtcaatcaaatttatgcactgccgctcaattgcccgtttggccaagtgaatgatcggaaagcctaccatccttttgtggctgttggcattgatcaatccccaattttgcacaaatttccattcagaagaggggattgggatgccaccattgcgcaaggcgaacaagcaattgccgcggcagtcacagcatgtttggacaagctggaggaggacatcctgcggtttaccatcactgccgaacctcaagtggaatatggagcggaagccgacactgccataatcaccattcgacatcgcttagacaacaagcaggaaatggtcgacatgtcaaaaatgtggactgaagaccagccaatccatgtgcgtgtggcagccaaaggggccaaaccatgtgccaccggcttcatcatgaatgttgaacgacaggaatcggaaacgggactcagcattgtcgccaaactcttcctagcgtaccaagaagccaagaactacgattgtgaggaggcatgggaccgaataatggatggggaattgaccgaaattgagcctttgcattctaggaaaatcctaatgcaaagggccgaaaaattttcagttaatttattcactgaaatggcgaaaaacacaacgacgggactcggcacaattatgtccattctaatggcacgccaaggggaacgaacgcctccacaaaattcatgggatgagctattcgtagctaaacaaccagcattaaatgatttaattggaggacagcgagagacggctaggctaatgcttgattcagtcccccgcgtcgtgttcatgcaggcaccacccggcacaggcaaaacaaaagtgtctgttgacataatcgccgcccatctgcgcaccaatccggacgcacatgtgctttttgtggccccgctgaacgttgccgttgtgaaagcagtcgaagagatggccaaaacgatggaacgaatgggatggcgagaggacatgttggccttattttcaggatccggcaaaaagaaatacatgctggagctgaacaaaattggccctcatttgttggctgcagcgttgcgcgcaccccaattgtttgaagagctgaaggatgatcagaaacgcacagtgctccgctacatcaaagcctgtgagacgtcgccaagaactgcgaacgagggaaaagctgcgcaaatccttttgagcaaggaaaagcgacggatcatcttctgcactctttcattggctgaacagattggcacaatctttgatgaaaccgacatgatcatcgtggacgaga

SEQ ID NO: 54161 - DNA, 702 bp, Heterodera glycines
  Genomic contig location: Contig_ID=SeqID_23456; Location=743..1444; Strand=+
  SCN-specific regions: Sequence locations=1-166,193-229,257-312,358 -493,516-583,605-661,688-702
atggtaaaatgggggtccggcggtgccgataggcgccgccgggaaaatttttaagtattacaaccctattgataatgcaattgcgaaaatagcgattacttctcatcagaatattcataattggaactaaacttgactattttttctaaattttggtttaatgagcatattataaattattttaaaaaaaaacagatttaacaaaagcttttgtcttaatcatagtataaatttttgaaataaaatgttttaaaattacgaatccatccaaatcaggacaatttcaggaaaaaaggacaaattcacaaaaggaaattaatatattttttttttaaataataattgataaaaatatttcgtaccctttcccaaataaatggaagaaaatgcggcaaaaatgagaggaagaacaattcactgacaattgcaacggatgtcagcaaattattctaaagaaattctaataatattttagtttttcaagaaatcactttattaattttagcatttttgttgtggacgccattttacgattggaccgataaaaaacgacgaaaaaaacgaaatggcactgattgtatttaaaatggcacaaaatggcgcgccatccgaggtacaattggacggaaatgccaagaatgcagccgaaaatttcacattctaataattaaaaaattaatattattagggccaagatgcaaa

SEQ ID NO: 54162 - DNA, 1302 bp, Heterodera glycines
  misc_feature (26)..(26): n is a, c, g, or t
  misc_feature (77)..(77): n is a, c, g, or t
  Genomic contig location: Contig_ID=SeqID_4355; Location=1..1302; Strand=-
  SCN-specific regions: Sequence locations=1-739,848-1302
ccctccgccaatggcatttcatcgtntaattcctcacagattgctcaccattcccgatgcaaaatacctgttgaccncaactgtgaacaaaagtttggaggtgcctaattgcctggctttgttcatttcctgcttttctctcccccttaggtccccggctgtccgtcgttgccccaccgattggtgggcactttctgttgctgctctgctctcccctctttaagtagtcgattgtcccttccccttttccgatggccatttgtgacatttccgccgaccccggcggttccatcgaatttatgaccgaatgcaccaccatcgacaaaccctttgtcatttacgacgcggacacaaacaaatgccatgagaagtgagtcaaaagcggcttctctcttctaattgccatttgacttagcttcgatgcttcttccggctgtctcatctgttccgttgataatatgcccgcccaactccccgtcgaggccactgaacagtttggctcgttgctgctcccttatatgatggatttggtgccaaaaatgcattttcttaaacacctcccccattcctttaagctaaattgtaacactgatcagccgttcgcttcgctgcaatgtcgcgacgaaatcaaacgggcgataatcacttcagatgggcaattaacacccggctacaaatacattgacgagcttagattggagcagaggtgagaagggaaaaaaggagtgtgagaaagataagagagaaagagggagagaggagagagagagtgggcggagagaagagagagagaggagggggagagagagagaaagagtgagaaaaggagagagagtgaggagagagaaggaaaggggacagactaatcactaaaccaattaaatcacaaacttccactgtgtttagacggtctgcgcacaaatcgcgtgttgtggctgttagttcaaagcgtgtgctgcttcttggcgccggaatggtctcttttctttgcatcaacaaactcaatactctcgaccatcgtttcccttttttctcccaatttgacctcattaaggtgtccgaccccttggccaaatattacgcctcgcgatcgaatgtccaattgaccgtggccagcgattcgtcaaaggacggccagcgattggcttcgcttggcagtaacattgagtcggtggtggtggacgtgaacaaagagccggaagtgatcaattcgctcatttcgtccgtttttcctcctgccatttcatccaagaaaatcttccattttaaagggaccacgaattgtgcatttcgctgctcccc

SEQ ID NO: 54163 - DNA, 464 bp, Heterodera glycines
  Genomic contig location: Contig_ID=SeqID_4357; Location=137..600; Strand=-
  SCN-specific regions: Sequence locations=1-384,406-464
atggcagagctttttaggcccttagatgaatggatggtctccactttgccgagtcgaccaggattatacattctcttcggattattttctgaggagcaacagcttcgttggctgggaaggagtctttttgagtaccccgaaccgcctaacatcaccaatttgtcgtccaatggcacttattccggcagttccgtcttcaagacatgtggagctgagaaattgcgatggacgacacttggcctcgattacgattggactagcaaagattattcgatggaagaaaaagcactgccgatggaaattaaacaaatttccaaattggtgatcgatggtgcgttttggttgtcgtttctgcacattgagcgattgttgagttcagtgcttggttcgttccccctcgtgccggatgctgcgattgtcaattactatccgaagaatgcctccatttctcctcacgcggacac

SEQ ID NO: 54164 - DNA, 337 bp, Heterodera glycines
  Genomic contig location: Contig_ID=SeqID_4357; Location=3549..3885; Strand=+
  SCN-specific regions: Sequence locations=1-337
atggatttgttagaaatcattgcccagaaaagaaaacagattgaggatattgcaatcgaacatggggtaacattattagcattttgatctcccaattaataatggttctcagagtggtgcgaaaatgatcagacattctgatctgtttaagaaagagaaggacgcttatttggagcgacaaaaacagctgggaaaggaacagcacctttctgtcaagggtttaaacaccgaggaacttttggacgcaaagttttcattgaccggctcggattcgatgccgcgtcccgaagttgtgcgtcttgagggcccgagggcagcccattcggctttttggtga

SEQ ID NO: 54165 - DNA, 733 bp, Heterodera glycines
  Genomic contig location: Contig_ID=SeqID_23460; Location=33..765; Strand=-
  SCN-specific regions: Sequence locations=1-177,216-733
atgaatttggctttgaatccagaagaaggcgatgatcctgcttatgggcagattttcatcgtagatactgagcatgcaatgagagcaatgaggcatgccaatgtaggtattgaacctcaattgctgagaactgcgtatgaagtgattagaaatgtgaatccgtttgctgaagcatacatgatgatgaaagaagaagaagacgaagaagttgagagagccagaactgagaacagagagccagccgagatcaagcttttgtttgagaccggaaggcaattggacagacgtttggggtacaatgtacctcgagcgaatgaagttgctgcagtttatgtacctggggctgacggtgaagtacctaatgccaagattgtggtgagagaacgtggaaaggaattgaagattttgaagagtacagattcaatggtgactccaatgacttacccgctgttttatccgcgtggtacgcttggttgggaccctgaaatgaagcatagaaatagtaacagaagagtaacgagattgcaatatgtgtgctacacagtcgcaattagagaaagagagtttaacccgattttgtatggtggaaagctctttcaacagtattgtgttgatgaatatgttaagattgaaggagatagaatgaattggataaagagtaatcagaaaaagattttggctgatgcatataagaatgttgataatatgttaataagaagagcacaagaaagag

SEQ ID NO: 54166 - DNA, 315 bp, Heterodera glycines
  Genomic contig location: Contig_ID=SeqID_23463; Location=187..501; Strand=+
  SCN-specific regions: Sequence locations=1-315
cgcttattctggtacacgtcagaataattccgctcattctggtacacgtcagaataattccgcttattcttgcacgcgtcagaataattccgcttattctggtacatcagaatgattccgcttattctggtacacgtcagaataattccgcttattctggtacatcagaataattccgcttattcttgcacgcgtcagaaccgctattctggtacatcagaataattccgcttattctggtacatcagaataattccgcttattcttgcacgcgtcagaataattccgcttattctggtacacgtcagaataatt

SEQ ID NO: 54167 - DNA, 49 bp, Heterodera glycines
  Genomic contig location: Contig_ID=SeqID_23464; Location=362..410; Strand=-
  SCN-specific regions: Sequence locations=1-49
ggaagctactccagaaggattcggtctccccataaatctgggcgcatcg

SEQ ID NO: 54168 - DNA, 386 bp, Heterodera glycines
  Genomic contig location: Contig_ID=SeqID_4358; Location=1102..1487; Strand=+
  SCN-specific regions: Sequence locations=1-150,172-174,215-386
atggctttgaataggctcccggacagtggacattccgacagtggacaatcggacaatccgacagaggtggacaatcggacagtgggtaatccgacggtaaaatgcacaaaaagattaagaaaatgccatcgccgaagtgaaccgattgggcaaaggtatagattattggtcccgaaaattattttttaaataaagtttaagaaaattatttttaggggtaatctgaggcgccgagcacgaatccggccttattttggctcagtctcgaatcccgaacccggactcgaacaaaagttcgagaattcaatttttcgtacttcgcagttttagttcaaaacccggctaggtatatacgtggaatcaaacaggatcttattaatacgtca

SEQ ID NO: 54169 - DNA, 2173 bp, Heterodera glycines
  Genomic contig location: Contig_ID=SeqID_4359; Location=1845..4017; Strand=+
  SCN-specific regions: Sequence locations=1-8,31-89,111-253,276 -435,457-506,528-720,742-1397,1419-1574,1596-1701,1723-1994,2018 -2056,2094-2102,2124-2173
atgaattgtttatttttaatattattttttgctttttgtccactctttcgcattgccttcttttcccaactatcatcatcagctgaggtttgttggtgttcttttggactgtgttcaaatcttaatttgaaaatgcctcattttaagccccgttctttaagctaattaaatgcgcacataatgagttaagaattcaaccgaaaatctgtgacagtaaaaggagcccggaatttaaaaaaatcgggatcgggctttgggattggtggattcgggccgggactgaaatccagattttgccggaatttcaatctcgaaccgggatacaagcccgattttgttgggatcacgatcctggtcattttctcaaaaaaaagcctgggttgagacccggaaaaataccgcgggatctcgatccctcccggctctaatattaacgggcaaaatttaaagaaaaatgatattgtaagccaattttttcatcccaaagcccaacaatccacttttttggggctgtacttggccacaatcgcatttaaattcaaccaattgaaaaattccaaaacgcatgaccaatgaatgaattttggcattggtcagtaatctaagccaatgaaccttttagtttttttagtgtttatatttcaaaattttgtgcagattgacaacgacgcgcttgtagcttttgtgaaagggccctccaattttgtgcagttttgcgccgccaaaggtgtggccaacaatgaaagcaaagggcttttggcccgagtttatggcacacaccttggcatgctgtaccacatgagactgaattggcactgtgccagaacgaacaattcgatacacagaatgctgtacaagagaaaatgcgaatactttcgcaaaagtgtggatattttgtacgaatatttgtcgagggttcacaacggaggaaacgcggaagtgacgaggccaattttcaaggccgaatccacttctattcagctgacatttgttgatgtcgtggagtgtttggccacaatttccaatttttatttttgtgatcaaaaaatgacaaataattacgaaataatgaaagaaatggccaagttcagtcagttcaaattggaaaatgaggagcagcaattggattttaagagcggaaaaagtgccaaacaaaaaaacaaaaggctgaaaacagatggaaaggcaaatggaatagaatttgagcaaaaaatggaaaaaatgttcaggaagataataatagagaatgctaaattggcaaatggaagctcatcatcggcattttcatcgtcgacatttccatcatctgcgtttccgttaccgatttccatgtgcaccgtacctatttatgatgccgctttgcgcgtgccaatatatgacatgagcgatgctgtaagtttctcgaaaaaacaaatattcgggttagggctgccattcgacaaaattactcggaaatgcttccggaaaaatgcgtcagcaatattaatttccataccaattcaggattagttttcaaattataaaactactgtatctctttttaaattcactgactcattttccggtcaagtttggaaaaataaagaattacagaagtagccaaaccagattgaatttttgaaattggtgcaggaaaatgccaaaagatttaaatggttgttatttcgtgccatttttgataaaaatctcaacacttgcagattgaagaagaattatttcttaaatttgtgaacggaagtgccgatttttccgcacattttgctgctgtgccattagatgaaattaaaaagtacgaaactcatcttggtctactgtatgcgatgaaaacaaattggcgttgtgccaatgccaaaaataaaattgacaacagctgcaccaaagatcgccgatacattgacattttgtatgaatatttgttcatgattcgctatggaattaagtctgtgaagccgatgttcgagactcttgtagggcaacggtaatattatgtttaaaaaagcaggaagtaaaagggaaacccgaaaaacggtaattaaccctctttagtcattcgtcctaaattatttttaaaattttttcgaaaataatttaaaccgctaaacatttaccccaattttaggaggtttttgcatttcagtccccttaaatataaattaattggtaatcagttgga

SEQ ID NO: 54170 - DNA, 77 bp, Heterodera glycines
  Genomic contig location: Contig_ID=SeqID_23467; Location=277..353; Strand=-
  SCN-specific regions: Sequence locations=1-77
atggtcatttcgtttctctaccaaaacccgtcttcctatgacgccgctgaagagataacgaacatgacatgggcaca

SEQ ID NO: 54171 - DNA, 740 bp, Heterodera glycines
  Genomic contig location: Contig_ID=SeqID_23472; Location=63..802; Strand=+
  SCN-specific regions: Sequence locations=1-123,146-234,274-434,457 -542,566-603,625-740
atgaaggtgtcatacgtgaaaagtttggacatttttcttggcgtctgctttttcattgtgttcgcctcgttgttggaatatgcaactgttggctttctgatgaaacgccgacggcaaaaaagttcgtccacctcctcgtcggtgatgccacgctcatccaccgtttgttttcgtgaattggaggacggcacgctgaaaatgttggcaccaatgcatcataatcaccatcaagtcaataattaattaatttcttattatttttataaattttatggattagggatggtaaattgacccattttggaattcatttgtatggcaattattaaaactatgatacttaaatgtgtcgggattattcttgggcccaaagacataatcccgaattcccatataagtaatttgagagacggccaagcactaggcctcgagtcttcatttccatgccaggccggaaacattttcaaaaattttttgaaatttacaattcgcagtttttgccaaaaaattttcaaaaacccaactaaattttttctgcggcgttttttttataaatttttttaatgcttgagttttttattaataatattttgacgataaaccaatgtttcaaatccccaaaaatgtaatccgagagacggccaaaattttggcatcgaatcttccagacctggtcaggccggaagtgtttttttgaaaattaaagtcacattttttgccaaaattatctgaaaatccaa

SEQ ID NO: 54172 - DNA, 1318 bp, Heterodera glycines; identical to SEQ ID NO: 23473
  Genomic contig location: Contig_ID=SeqID_23473; Location=1..1318; Strand=+
  SCN-specific regions: Sequence locations=1-56,78-294,321-566,598 -684,706-1318
  Gene Ontology: Mol. function=protein methyltransferase activity; Biological process=histone methylation

SEQ ID NO: 54173 - DNA, 669 bp, Heterodera glycines
  Genomic contig location: Contig_ID=SeqID_23476; Location=209..877; Strand=-
  SCN-specific regions: Sequence locations=1-114,151-315,377-539,589 -618,641-644,667-669
atgaatgactcgcgaataattcgtggcagaaaatttaattgctcattaacatggcttttggatcactacaaactttcagacaaatacgcaattaaaaagaaaattaaggtatccatttttaaaatttgaaatttaattatttttaaatttcatgtcaaataccctggccatccaaaatttgtgttcgtcacagccgccaatgaaaaatattacccttttcttcggacactaattgcaaatttaaaagacaaatttggatgtaaacagaaataattgcttatgatttgggaacagtgtcaaaaaacaaagaatgggtaaaataatatattataattgtaaaattaataatttatttaaatatatttgtatatttaaagttaaacaacaattttccgaaccaacccggattcgaacaaaaagtcgaaaattttcaatttcagtaaaattcgagctattccacaaaacttgatgaggcggggggggggggcggtaccatccatcggtactatttattatattacctttttaaattcaaatgcaaatatttcttaattataaataattaattaaataatattattataattaggtaggggttttctctgaagctttcttttaatgagaatgaactcaaaaagatgaatttaattagcaaaactaatgaataaa

SEQ ID NO: 54174 - DNA, 131 bp, Heterodera glycines
  Genomic contig location: Contig_ID=SeqID_23477; Location=405..535; Strand=+
  SCN-specific regions: Sequence locations=1-60,83-131
atgtcctccgtccgctccatcagtagcaccgctcgtgctggcaatgtgctcgtgctgctcgatttgtatgcctcggggtttgcctcttcaaacacttcgccaactattccgatgctcacttcccgaacgat

SEQ ID NO: 54175 - DNA, 1699 bp, Heterodera glycines
  Genomic contig location: Contig_ID=SeqID_4360; Location=37..1735; Strand=+
  SCN-specific regions: Sequence locations=1-149,171-222,251-492,526 -755,782-1038,1065-1124,1146-1699
  Gene Ontology: Mol. function=ubiquitin-protein ligase activity; Cellular component=proteasome complex (sensu Eukarya); Biological process=ubiquitin-dependent protein catabolism
ttcctcctatcaagggcacccttttcattcatttttcgagttttcatccggttcaaaaaccggttttttggcatttccgcaactggagacctactttctcgtgcataactcgtcgagacgaatcgattggtatatcattggtgccattttttaatgggaccttgactatagtatatccaagtctattttaggggtttccgagtcggtgaacttattttccggatttttatgaaatttaatttatttttttctgcacattttgtgggtcagcgaaatttcttcattaggacgtcattttttgtcactagaaatcactattttggcgtttcatcacttaaaatatgtagtttaaattcactattttggcaattttgtcactattttttcactttttcgacattttttgaaaaatttgggctcccggacatttcgaaaatgaccgtttcgccaatgaccgtttcgacaataccttttcgacaatgccgtttcgacaataaaattaaatatatttttttaaataaaattcaaatttctgcaaaattatatggacggtgcggatttgggatcaatataaaaaagtttttttttcgtttttttcaaaatagcattatgagaatggctttagtttgtcaattttcggcgcaaattgcttgtttttttaaattaaaaattgaaacattgttttacacctaaatagttgataatgaattagaagcttttaggtaatagtaaagtttatcccccccccctttttcaaaaaaaaattaaaatttttaaaaatgcttaaaaacaggttttagggggttttcggggtcgctaatcacgaatccgacatccatttcgaccaattccgaaccccggacccgaattcgaacaaaaaatcaaaatttcatttttcaccaaaatgcatatttattgcacaaaatcgatccaaatgcatatgcgcataaaatatgccttaaaaactgcaaaaatggcttttaaccctaaaaaaatgccaaaaattgtgtaaaaattctgaattgactttaaaagcttcaaagaggagggaaaagaaggaatgacttttatagtacgatgcagcggggaaggggaaaaaattacaattgcccaaatgccaaatgttttttctcctttataaggggtgcttttctcatcggactgattattttttctttgaattaacaatctttgcattactaaattgcttaatttgtctcttcgttgctcaatcctctgttccaaaattccattttgtttttcatttttgaccagcatattgctacccatgcactccgtcgattgtcaaattcatcaacgacatttaccatccgaacgttggagaaagcggcgacatttgtttggacgtctgaagcagatgtgggctccggcgttgaccatttcgaaaggtgagagtggacaaaacgccgacaaaatatcgacaaaacaaaacgaccgccataaccagactttttggaaaagtgtcgatattttgtcgtgtgaaatgggatttttcgaattcggtagtgccgttttaatctttatccccccccccatttcagtgctgctctccatctcttcgcttctctgtgacccgaatccggactgtgcgctgcgacaggacattgcgattatgtaccgcgacaaccgtgaggagtacaaccgaaatgcccgtgaatggacgaagaagtacgcgatg

SEQ ID NO: 54176 - DNA, 679 bp, Heterodera glycines
  Genomic contig location: Contig_ID=SeqID_4361; Location=109..787; Strand=+
  SCN-specific regions: Sequence locations=1-15,37-481,503-679
atgtcactgcttcgtttttcccaacttttttggagcgcattggtctcgcttgctcttctgttctatggcatcatggaaatgctgcgctctatcgaagaatataaagtgagcgagcgcaacacgtggcccacatcaattcaacccgacaaaatcgtgaccaaaattgcttttcagttgaaatccgattgattttttggatcaaattgagatttaagttttgtagtgttgaggttctgtgttcacgagttgtcaaaatatgttttgtctgcgtcgcttaatttgtttcttttcaagatcggcatctattcgtatgccttcgcttctatcttctgctgggattgctctgttgtgtactcatccaaattgctgctccattggacggacttttggacttgcgtcaacttccaagcggatcacacaaatgtgccgttgatcactttggtgagtttgttttgttgtcacatttaccatttgattcctacatttttcaaaattttaaacacttttaaaggtgctcagcattgtcttgttgtgttcgtccgtcttcgagattattcttcacaaattcgtgctgaatgatgtcgacacggaatgtgccaatatgatctttcatcagcaccagaagaagaacggaagtgccatcgaatgaacttaagcagagacgagtagaacgatgcca

SEQ ID NO: 54177 - DNA, 492 bp, Heterodera glycines
  Genomic contig location: Contig_ID=SeqID_23479; Location=33..524; Strand=+
  SCN-specific regions: Sequence locations=1-492
atgcacctgcatgccttccagccggccaacacattttttgccgaaaattctgtggagttgcgaaggaatccaagcgatacgattgttgcagggccgagttgtgcacttgccggttttgtggcgcttatttctttggcaattggccgttcacccgaacgctttggtctgacggggtgcttcgagccaaacggaattattagccaagttggcggcatggaaaagaagctaatgaggctcgtccattctggaatcaataatgtattggttccgaatgacaattataagaagcaaatgccatccgagatgcccacgatgccggccatgacttgggtcccatccctcacattgacttttgttgtgcatatcaatgagctatggcatagtttgtttcctcttttcttggatgctcaatgaaatatcaattttaatttgttagattattttattttttttcgatacttctccacattttgtgttttgtcaaaatggtga

SEQ ID NO: 54178 - DNA, 54 bp, Heterodera glycines
  Genomic contig location: Contig_ID=SeqID_23480; Location=625..678; Strand=+
  SCN-specific regions: Sequence locations=1-54
atggcaagcaatcaaaagattctgttctttgtgagaatggccaagacgtttgtc

SEQ ID NO: 54179 - DNA, 159 bp, Heterodera glycines
  Genomic contig location: Contig_ID=SeqID_23482; Location=272..430; Strand=-
  SCN-specific regions: Sequence locations=26-159
tttttaaattttttaaaatttttttgaatttctaaatttcccggttggtcctggttcccggtcccgaagaaaaatcgaggtcccggtcccggcttctcaggtctcggcaagtcccggtcccggttttgccctaaattcccggtcccgcttcactctagt

SEQ ID NO: 54180 - DNA, 665 bp, Heterodera glycines
  Genomic contig location: Contig_ID=SeqID_23483; Location=136..800; Strand=+
  SCN-specific regions: Sequence locations=1-207,231-267,289-411,433 -583,612-665
atgatgaatatattaatgatacctgattttaaaggaccagaacacgtccattgtgggaaatgtggcttcgacttttatttctacaatgtcaagtggcaagactgtctggtggatgcggggatgggcccaggacagtgttggttaggagaggataatatagtaattttttatttttgatggagtggattttgattttaagaaatttgaaataatttaaaataagcataacttttcccggcaaagattgggcgcaaacgggcctaggttttcttttttccaacagtaggtagtgcttgacacttagcaatatttaggaatttagataaatatttatttcccaactcaaaataatgttttaaatgcttacagccgcccggggcgctaggcaaatacaatgaaaaattgctttccgagatggacaaagtggaaaaaatattggatgatccagaacgcctacttgaccaaatagtcggaatcgttgaagatgaagatacaattccgttaggagcagaagtaagctaaatctggatattttaattgtgtaggaccgcatttgtagtgcagaattgtaagaaaaatcttgaaaataattttttaatgttttattattaggattttttgcttatttcgatatgtggaaaattttttggaaatagtaaaactaa

SEQ ID NO: 54181 - DNA, 580 bp, Heterodera glycines
  Genomic contig location: Contig_ID=SeqID_23486; Location=716..1295; Strand=-
  SCN-specific regions: Sequence locations=1-56,251-411,462-473,495-580
atgagctgtaagtgaaaaaacgtcctcatggattttgcgatgaccgagaattttggaaatttataatacaataaaaaataataatttttgattaaaaacaaaattatttgttctaagaaacagaaagaaatgaattaatttatcttaaaattatagattttatcatattttccttttctcttacaatatgaaattaattattttttcatatttttaaataattaaataatattgaattaaataaatttttgccaattcttaaaatacaaaactaagacaatgttagttagcactaaatttaaaaatactgccaatttcaataaaatgaaaacatttttttaaatttaggctaacattttcttttggtttttcgggacggattattttcacgaagaatggacaaattattggtaatataaaaataaaaatgaaataatataatatttatttttaaatttttagatacatccgatttgttcatttcttccttttcttccattgctgatcatttgtttccatgctttactttgaatagcatcggcaccacaatttggtttttttagacaaatctgttaataaa

SEQ ID NO: 54182 - DNA, 890 bp, Heterodera glycines
  Genomic contig location: Contig_ID=SeqID_23488; Location=715..1604; Strand=+
  SCN-specific regions: Sequence locations=1-58,80-80,146-191,214 -258,280-456,479-577,607-628,669-740,821-890
atgtcaatttcgaccaattcaataaattgtggagatgattttacaccagcagaaaacaggggtaaaggaaatgggagaaaaatttaaattttgaatatgaattaaattaaattattctaaattaaagatttaatttatttaaatttcagaagtgaatggcgatgcaattagtttggaaaatgatggacaatttgatggaaacagtgaaacgatcactgatcaacaacaacagcttaaggtgggcggaagaaaagctaacagaagaaagaattggagaaaaattgaattaatgtgagacaaaagcgattttgttaatttaaattcaggaatttcatgaaaagtttgccaaattggaaacggaattgaaaatggccaaattggaaacggaattgaaaatggccaaattggaactggaaaatgtgagtttgctataaaaatttgagtaaattataagtgccaaaattttctaattatttttagaaggcactaaagttaaagcaccaggaattggtaggcgaacagaaggcattgaaggaaaaagtgatcaaaattgaacagaaaaacggtaggtaaaatgaaaataaataaagaaaaatatatttttaacaggatcattttttacgaaaagaattataaaaatgtttaaatttagattttaaaattaaaatgtcatcattcacgacttcttcatcggccgacgaattttctcctctccaacgtaaatttttttcttaaaatgcataattaaaatacaataataataaacatttttcaataattaaatttgctaaaataaatttttttttttaaattaatttttcattttcagcaatttttccaaatctgagcacatcggaggaaatgagtgttctgattgcccgaatttctga

SEQ ID NO: 54183 - DNA, 1239 bp, Heterodera glycines
  Genomic contig location: Contig_ID=SeqID_4363; Location=24..1262; Strand=+
  SCN-specific regions: Sequence locations=1-524,548-569,594-629,651 -926,949-957,1005-1239
atgggcattttcacctccccttttgtggcccaacttcggcacaaaagcgggtcgcccattgccgaatgttacgaagtgcgcattttgttgtcatcgcttatggcacggattaacttgttggagcgaagtttatacgaatacaacgacaatttgccagctccaacacgaaaagcgtgcttagagaaaatagtgagagcgaaaaacgaattttacgcaaagatcgccgaaggaaatttgtcgcatttgagaaaaacgttttgcgtaatgtaccagtttgccaaatttttggagaaaagtgttgccgtggggcgtttgggggaggcaattgagcgatgggaggcgacggaatgccaaaatgaaaatgtcgtcaaagagacaattttggcacatcgggcgcagaagaaacgcactatttttgatattataatatcagctgtaaaaaaggaggaagtgatgagacaactcagagaaatcaggggatgctacacaaggataagcagatatttggaggaccagagaatgttcaagaagctgctgaaggaggcggacttttatgagcagagaggtaaatttattatttagaagcaattcaaagcgattaagggactaattgccataaaacaatgccaaaaatgtgtaattattaaagccctgaattttaggttttacctattttttacggataatacttgatgagagaagcacgaaaatcatattttctccgaacaatttttgaattagattgactttttagcatccaaaaacacttaaaacggggatcagcacttttttagcattttcggtctttatcacctattttggcctttttccagaaatttcataccaaaaatgcaataaaaacgtaaaatgcacccctaagaatcggtcccagaaatttcagaaaaatacgccccgaagaaccgatcaagaaattttcaattacaaccctaagtatcgaaaaaattttttttttaaatatctccaaaatttattatttattttttcttgacaagttgcaattgttcagacgaaatttttgcaccttttttgcacctattttagtacctatttcagtatttttggcacataaaaatcccagctctagtcattatctaaattcgcaaaacttagaaattttgggccgtttttatttctcaacatttgtcttctgtgtgggtgcattagattaagatagcttttaacattttgattactctgatagggttttgctatataata

SEQ ID NO: 54184 - DNA, 1520 bp, Heterodera glycines
  Genomic contig location: Contig_ID=SeqID_4364; Location=245..1764; Strand=+
  SCN-specific regions: Sequence locations=1-163,191-798,966-992,1059 -1177,1297-1520
  Gene Ontology: Mol. function=myosin light chain kinase activity; Cellular component=neurofilament; Biological process=embryogenesis and morphogenesis
atgccaatggcactttcggaaacgcaagagaaatcgtggcattgttttgaaaattggatccaaaatttgcatttcgatgtgctaaagcaaatgctcaataagcagactatattcttcgacaacattaaaagatgtatacaattctctgagttttacagaatcatggacttttatttaatttttcctgttcttaggctgtttattctaattagttataattagggtaggtcgggaccgggaccaaaacacggacaactgagtatcgaagtcccggttttgaccagttttgaccggaccgggaaattcccggttttttcccggttttcccagccaaaaagtcccggtttttcaaccgaaagcccggtcgaggttttgcccaaaattcccagtcccgacctaccctagataattaatgccataattaattgagcacccaaatttcagtttttgaatccaagccaaaagaacatacggataaattgatgcttttcctacacaacaaacaaaacgtggagaacattttacgccttttgggcattgattttgaagccaatggcagcagcgacggagatccgacggaacgaacaccgggggcggaagacgacgattggccaagtacggacagtccaatgggaagcaccgcttcgcccgtggtaagtccatcgacagaaagaaaaaaggccaagcggaagaaggcaaaacgaagcaaaaaccaacgcaaaacgtcaattgttgagcatgaaattgacgaagaaatgtttttgtcaagtgaaacgcccaaaaatgggacggaaagccaaaagaagcaaagtgaggaggaggaaaagccatcagaacaagaagaagacgaagcagtaattgaagcagcggaaattgaagaattaatcggggaggaatcatcaaaagatgaagcagcaaatgggggaaaagcacaagaaaaagatgaagcgaaaattgaggaagaacctacagcagaaagggcaccagacaaggaagaagatgaagaagaagaagcagtaaatgaggaaaacggaccaaaagaagacgaggaggaagaaacagtggaaaccggagaattaattagggaggaaccatcaaaagaggaagcagtaaaaggggcaaaagcacctgccaagcatgaagcgaaaaatggggaagaacctacaggaagtgcaccagacgaggaagaagaagaagaagaagcagtacatgaggaaaaagcaataaaagaggaaaaagaatctgaagaagaagaagcagcagtaattgaggaaaaaggagcaaaagaagaagaagcggtaaaagaagcattggaaggggaaaaattaacgggggataagaaggcaccaaaagataaagtggatattggaaaaaaagcatttgaaggtaaagcagtaattgtgaaggaaccaatggaaaaggaaccgctgaaaaatgaagcagaaaaagcggaaaatgaaaaaatgccggaacattcattagcaattccatcagttcagaaagcggaaagagagatggat

SEQ ID NO: 54185 - DNA, 2526 bp, Heterodera glycines
  Genomic contig location: Contig_ID=SeqID_4365; Location=58..2583; Strand=+
  SCN-specific regions: Sequence locations=1-133,156-492,540-578,607 -887,931-1027,1097-1263,1307-1461,1483-1745,1767-1892,1914-1956,1978 -2048,2071-2228,2250-2256,2290-2526
atggcaaaagaaagtgtcactgtgccgggagaggatgcttctgtgcgtgccattgtccatctgctcgaccttggcatttacgcgaacgagatttggcaccgattgaacgctattagacttgttgagcaaatatggccagaacttggcattttgcagtcggaagtcgctaaaattgagggccaatgggccaaaattaagggcatcaaattgtcattgaaaagccaatggacggaattggagaaatatttgcatcaaatgctaaagcaacttttggtgctaatggacaaaaagaaattccctggcattaattatgatggtgttgctaatgataatgagggagaattgttgcgcgaaatccgtctgctgaaggatgaaatgcatttgcgtaatttggcattttcactcgccgaaagcaaaagcgcacaaacaatttggcacagtttgtgcccagctcaatccgcatcgtttttgtcgttgctctttagccgtacgttttaaaatgaatttctttaaataaatattttaaaaattatttatttcgaaaaaacactcatttttaatgagagaattattttcagttttttaaatttgaattttattttttaagatttgttcagaaagcatttgcatcaaagagtgaattttgcgatgaaagaaaataatcagcagaaaattggtaaattcataaaactatttatgaaaataatctaacaattcagatgttaaactttattatgaattccgaaacaataaaaatttgaaaagattcgttccatttaaaatgtccgccaattttgcgacgaaaaaattgaaccaaatttcggagttatggcaacacatggcttttggggaggacagatttaacgaattggacatttacaatttggtatttttaattttaaataaattgcaaaatgaattatttatttagaaaaatgaaattgcaaagggaaataattatctgatttttgatgtaaatcaaaaagccatggttgaaaatataatcagagaaatggatgaacttctcaaaaattgggtaaatatttaataaatttgttgattttttaaaacttgatttttagtcatcaaaaataaattgccatttctccgacgaatggctgtttagacccaaagaagaagcgaaactcagtgccatttgcataatgccatttgaatttgacatttcgtcctttttgggcacttatttttcgagtaattcgtcagtttgccatgaccaatcgctgttctgtcgactgtccaaagtaaataatttattttttcaaataaattttaaattctattttttcaatttccagaaggaaaatctattggcactccaaagaattcaaaaagattatttcaactccgtgccacaaattcatttcacttacaaaactctgcctgtaaccattatggccattttggtaccaaaccttggccaagaagtgccaaatgggtcattggatgtccaaaaaatcaaaacaatcgcacaaaaatttggcgatgaaatcgaaaaattgatcagagctgatcatctttttgacgaaggccaatttcgaatcagccaaagagtgaacgaccaaacaatggagcagttggccaattcaattgttcacgcaggtaaaagggcggacaatcaaaatgaagagataattaggtaattaactgagtgttaagtgccaaaagaagcggccaaaattatgcaccaatgggtaatgttcgatcagttaaaagacctgctgttgaaggaccgacaaaaagcaatgaacctgagggaatctgtgaaaactcatttggccatgataaaggcatttgcaagtgcgaaaaatgccaaataaagtttaaaacccaatttttgaaattttagactttacaactcatgcaaaaattcattggtttttattggacaaattggacacaacacaaaaagaagcagccagcactgtgcttaaccgcaacattaataatcataataatttgttcattaattttgcgtttcttttggcttatttggaacaatgggccaaatgtaagaccattttatttggcaatgaaaatttaatgccaaatttcagctaatcacattaatggcgagcatatcggctttttgaactttaacattttggttgtaatggtaacgaaaattgtgctcgcccactcaaatgccgcactgccgatattaatcgaaaaattcttcatcacatattcaacatggcataattatatttaaatagaatctctcaaaaataaaatgcgattaattaatactagttaattaactaattaattgcaggccctggccactgccggttcaattgacagaaatttgtgtccacagaaagggcgaatttctgagttggatgccgggcagagaatggttcacaaaaaggcaacattcgcccaaaaagatgctcaaggcgatccatgccgaattggcaatggccatcattacgccgacattccctgaacgaaatttggcacaaaacgcaaatatttccgctttaaaatgcatccaaaatcaaatga

SEQ ID NO: 54186 - DNA, 548 bp, Heterodera glycines
  Genomic contig location: Contig_ID=SeqID_4365; Location=3761..4308; Strand=+
  SCN-specific regions: Sequence locations=1-208,230-296,330-548
atgttggattttgatgacaaagaaaaaagttatagccaaaaacatgctgggcccaaatgtgccggcccaactgaggtaaaccgttgtataagaagatctaaaaaagaggagtaatcgttgtcgcaaatgcgcaagtttagactaaattcagcggtcaaattttagcgtgtatcgcaacttgtctaggaatcgaaaacttttgggtgtttgaagaaaatgaaatatgaaattgaaaaaatttatcaaaatcggagaaagttcggaatcgaataataatttgttcattttttgatctttttccaaaaccaataaaattttaagcatttttgcaattatggcttattaaagttgtctcatcagagacagagttggcaagacccagttgacccttatcgtccgtctcctgggactttctgagaaaaacaaacttttttcgcgcatcgcggattcaatttgccccggtcgtgtcccacccatggtacggacaagggatttatttgctcctcgttttctcgcattcttaccttttttgggcttctcgtcgagca

SEQ ID NO: 54187 - DNA, 177 bp, Heterodera glycines
  Genomic contig location: Contig_ID=SeqID_23490; Location=471..647; Strand=-
  SCN-specific regions: Sequence locations=1-177
atgcgggaccgggaaccccgtaaaaaccccgcgtgagtcccgatcccgtcgggctctagcaaaaacaataacatttcagcatttttgggcgtcaagcgttttctcaagacatttatgatcaatcccgccgctgaaaaaagacgttcgctttcggcaaaatgcttaaaagataataaa

SEQ ID NO: 54188 - DNA, 626 bp, Heterodera glycines
  Genomic contig location: Contig_ID=SeqID_23492; Location=205..830; Strand=+
  SCN-specific regions: Sequence locations=1-21,43-265,299-440,462-626
atggcagagaaaagtatgagagcagcagagaaaacaatttttgaaagtccgtgcttacagccggaggggatgagaaggaatgtgattaatgaattggagagccaagaggagcgagagcgaaggaagcgtttcgccacccggactcctccgagtggccaagcatttgcaaatacggtttgggcggaaaaagattggaaaaaggatgatgagggggaaaaggatgaaaaagaagagcctgtcttcaccaaaataataaaaattcaacggaagttaaaagaagcaaatgaagaattaaaaatgctggcaaaagatgttgaaagattggtcagcgcagaaaaaagcattgccgaaaaggaaaagaaatgggacggttttccgacaaatgtcaacgaatttggggaagcagggacgtccaacagatggagataacacgatgacggaagatggcgcggaggtcgcggaaaccgcgggcgctggacgacaaatgcacgggcacgaggacgacaatggcaaacgaacgagtgggatgtgcgcggacaccagcaaacggagacagaacaaccgagaaacgaaagaggactcacaccatgggaattcacaaaaatggcgggatatggcccgggata

SEQ ID NO: 54189 - DNA, 1136 bp, Heterodera glycines
  Genomic contig location: Contig_ID=SeqID_23493; Location=289..1424; Strand=-
  SCN-specific regions: Sequence locations=1-124,152-367,431-783,808 -809,831-880,925-984,1006-1045,1067-1100,1128-1136
atgttctttttgatgtcgtttgggatcaatggaattggcctctactattggtacttctttttcgatgacacaattaaaggctcataatttatgttatgtgcataaaatgttgataattttgtacaaattaaaaaatatatataattttaatgattcggatttatttttccagtacatatcccaattacccttatattttattcggcaaactttaattttatttctattataccattcataaattcgtccaacctgttaaaatcattcagaaattttaacagcagtagttaaatgaaaattcgtgttaattatatttggataagcctatgaatggcggctctataatcatgtaaattaaaaaagcaagaaaaataatttaattttttacaaaattttttagaaaaaactttctaagttttttttttatttacatgattacagatgaaattttgtaaaatttaattgattttgacaaaatttatttttttaacctctctagatgaatgtatgaaaagaaccgatggaaaaattcatatgttttaaatagcctaaaacatattcacattcaagcttcaacgccaccaacaatttttaacattggaaatcattttttggtcggcgcttttccctttgcatttgccccgatgctttgccaagcttaagcttgatctaatcttcaatttaatttaatttttctacctgataacctccagcgcttggttgaacaatgtcatcactcccgttaattcatctattttggcgccaattataaacatggccaaaacagagaaagcaaaaagaaaatggcgatttttgaagaatgaaaataatttagaggattgaattagaactcgatttttaacaaaccaaattataatggttttttaataattaaattaggttgtatttaaaaaaaaatttaatggctttttgtttgtcctaacgactatttataaagataatttatttaatcacatttgtgcactttctcaagatttgacctttgacatgaatatgtctgaccatgttagcttcatttttattcataatttattaacaaaattcaagacaatttggacataaaaagcgtaaatgatagtgaaatgtatgtttaaaaaatatttatgaaaaataaa

SEQ ID NO: 54190 - DNA, 1358 bp, Heterodera glycines
  misc_feature (27)..(27): n is a, c, g, or t
  Genomic contig location: Contig_ID=SeqID_23494; Location=129..1486; Strand=-
  SCN-specific regions: Sequence locations=1-88,419-493,516-699,814 -821,851-994,1017-1358
  Gene Ontology: Mol. function=structural molecule activity; Cellular component=microtubule associated complex; Biological process=N -linked glycosylation
atgggcgaagtgcgtttcctacgtccnaaatattacgcggccgcgctcaaacagcgcgaggaggcggaagcggcagccaaaaaggccaaggaggaggcggaagcggaggcaaagaaggccgaggcggaagcaaaggaagcggagaagaaggaagcagaggcggaagcggtggaaaagaaggaagaggaaggagaggtggataaggaggaagtggaggcaaagaaggaggcggaagaggacaaaaaggaagcggaagaggtcaaaaaggaggaagcagcggaagtgaagaaggaggcggaagaggacaaaaaggaagcggaagaggtcaaaaaggaggaagcagcggaagtgaagaaggaggcggaagaggacaaaaaagaggtggaacaagacaaaaaggaggcggagaaagacgaagctgtaaagagtgaactgtaaacagttctgatggatattgtgatgtctagggagggagccatcattagcccctaaatttgtttgttttccgaaactttcttttctgtcttctctcttttttttctggcgctaaaatggctcatggacaattatttatttgttgcaaattcagtcacagtacggtgcatgcactacagtacaccacacccatactatacgccggcaggcaccatcagtttctctctctctctctcaaccaaaattgtttttttgtccaacaaatttttgtgtatttttttgtatcatctttttctctctctcttttttttcttgtaaaatgtaaatttcggtgtttctcctttccttcctttctttgctttctctctctctttatttatctgtgtcaaaacatcaacaacaaaaaagaaaatgttttccatagaaatcatccactgtttttttcttgttattgaccattttgttttattttcttttttctattgtttaaattatttgtttgggctttctcaaaacaaatgggcatttgtgctgcactcacaactttttatgtgtcaatttgttgttgttgtcgtcatcataatgatggacaacacaaaaacaaatatcgcaacttttttctccctcttttttttgttgctttacccatggaattaaacaaattttcatgtgtttatttattgtttaattcttgtttaaggttttttgtccaactatcttttagaattgtcacaattttcctttgaaactgatctttctggacatcataccatggacaacggacaaaccggtgaacaacaagcagtgcatttttatttccaatctaatacccataagattccatgtatcattcgagaggaatgcatcctaatatggacactgactgaggaaaaaggacggagagaggccccctccaaaataaa

SEQ ID NO: 54191 - DNA, 659 bp, Heterodera glycines
  Genomic contig location: Contig_ID=SeqID_23497; Location=56..714; Strand=+
  SCN-specific regions: Sequence locations=1-659
aacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaac

SEQ ID NO: 54192 - DNA, 268 bp, Heterodera glycines
  Genomic contig location: Contig_ID=SeqID_23499; Location=112..379; Strand=-
  SCN-specific regions: Sequence locations=1-268
atgcatgttgattttgatcctctacaagtagattggtccacattctcgtccgagtatgtgcaatttggtggatacaacatttatcgggggttgccctatcagcgtggagcgggagttggcgcagtgttcagaagtcttatgagatatttgctgccgattggaaagcaaattggctcagcaattggacgtcagggaatggaaagcggaaatcaagtactcaccaatgtgctagagggaaaagacctcaaagagtctctcgttagtgaga

SEQ ID NO: 54193 - DNA, 861 bp, Heterodera glycines
  Genomic contig location: Contig_ID=SeqID_23499; Location=876..1736; Strand=-
  SCN-specific regions: Sequence locations=1-564,586-729,751-861
atgcttttgataaacaaggctcggcgatgggccagagaagagtacattaagcgaaagactaaagaaaaacggggcgtccgtgacgaagagctgctcctacaggccatgttgacagatactggaacattggttgacctcaacaacgtggcccaaggccttctggcacgcgaaaagagtgctgcaacgagtaatgtaccgttgagaatgtcagctgatgataccaattcgtaccaagaaaaattggatgagtacttttcgaaattaagtgacaaaaatttgaacattcttgatgaattgggcatgacaaaattgaacgccgaaatcaaaaatttgaccgaagaggaacgtgtgatccttgaagccacaaaggaaatggggacggaagcatggattcaggcgtaccgtgagatacgtcttgtttgccaatttaactatgacgtcaatagaaatcgttttgttctgaacaccgacccacggtacgttaaaaaggttcaagtctcgcctcaacttgcctacattctcggtttcaacaacacggagtttattcaatctgaaaacgaggcaaaattcatgccggacatgagcggtggtgtgtcatcattccacgtttacacgccggatcttattgaaccaatgatgattggagatgtgacggccccagtgttgcgcatagtgaccatacgcggaaaccccgaccaagtagttgaagaacaattttttgccatacagtatcataaacttttattaaaggagttttctgaaattctgattgagatacgtaccaatagcggcatcttgatgccattccaatacggaacatgtacattaacattacactttagaaaaatgtcctatttttaa

SEQ ID NO: 54194 - DNA, 923 bp, Heterodera glycines
  Genomic contig location: Contig_ID=SeqID_4369; Location=4..926; Strand=-
  SCN-specific regions: Sequence locations=1-459,483-923
atgcttcttaccacgccaatttcattgtcgtcaagtgacgacgactgtcttctgatgtttgtccgttgtccaattgcgcgagacaaaagcaaatggacaaaatgggaaaaggaagcgattggctggcacatttgtgatcagcggaacataattgacagtgcaatttatggtgaggacgaaatcggagatgggtaagcgaatgatttttcaaaaaattcaattttattgtgttcaatttttaggcttctcgacgcaactcccggcccaagtgatcagcagcagaagtgaatgaatgaattgatgcaagtgatcggtcttattgaattgaagagttgaaaaatgaattttaaggttatgacgtgatcataaaatgttctttttgttgcaatgataaatttacttgtgtttttattatttattagggtaaaattcaacaatttctttgaaaccaagattagttgtaagaaattttaagcatttatctattgcagttcttacgaccataaaaaaaagacacgaccataacttttttttttgcaactttagggcgaagcatccaaattaaacattcttagtatcattcgatagccctaagaatcctctattagcctgcaaaatttcgaaaccacccctctttttcatgttttccgctatccctgaaaattcttttccaaattggtcagatatttagttttttagaggatttaattctaaattttttcggaatttcaaaaatcgccacgcgaaaacgaccctgaccgacaaattacagcattacaaaatttcaaatcatcaactgatttattcattttgctaagctaatttaaaatccaacgaaatctgtcttattaaatttgcctcaacaaatgtcagaccgccgaaaagaagcggaggaaaaaatggcaaaagcaatgtaaaataaa

SEQ ID NO: 54195 - DNA, 568 bp, Heterodera glycines
  Genomic contig location: Contig_ID=SeqID_4369; Location=1321..1888; Strand=+
  SCN-specific regions: Sequence locations=1-209,234-344,383-479,509-568
atgatcaaattaattggacagaatgaggcgaaaagttggcgaagaaaagtgatgacattgcggtatagatttcaatgtccatttgcgagtcttgaagtgttcgtcgatgtaaaagtcaaatcggtggctgatcagcgcaattccgaggccaagttgagaaggtgggagcaaatcgaacaccgaaagccaacaatcggcggagatgaaactgaaaaagggggaaaacaaaattcaaattgaaaattggcatttttaattattttacattgctttttccatttttttcctccgcttcttttcggcggtctgacattcaaactcggaaaaatagataaaataggcgcataattttaaaaaattcataaaaaattaagataaaaaagctatgaaacgtttctctaaagaatcagcaaaaaaagctttacccaatacccattaaaaaattatgtgaagtgaaaaaaaatgctaggtggaatgttactttggtaaagaaaaatcaaaataattcaccaaaaacaaccaaattttcagtgataatatcattcgacaatcctagtttatggtatca

SEQ ID NO: 54196 - DNA, 675 bp, Heterodera glycines
  Genomic contig location: Contig_ID=SeqID_4369; Location=1904..2578; Strand=-
  SCN-specific regions: Sequence locations=1-118,141-246,268-654
atggccgaaaccaacccaaaatggaaagaggctaaagaaagagaggccgctgctgaaactatgcggcggatttatgcatcacagcagagagatcattcgccctacatcaccgacagggccaaatttgaagtttttgacaagttggaattccgtgggccttgggatgccgatgtaaattttttatttcaagaaaaaatttacatttgctgccatttaaagatactccgagagttgcataaattagcgtataaaggaagtgaatttgagaacgatgtttgggttggcaagttccgtggagaatatggcgcacttgagccggaggggatgaattttagtggagtgaaaagggataaagtgaaggacggagtggaagaattggtcaaatggatgaacctctgcgatgccactaacatgccaacccaaggatttgctgcacaagcatttctaactttctttagttaaaatggggaggggggtgagagaatttcaagtaactaactcatttataccaatagatccgcctgcacccttatggggacggaaatgggcgcagtggccaattattgattaaccttattcttcgccgtaactcacaaccccccttcattatcaaagaggacttacgcgaaaaaccaaggcctgttcaaggtgggcaaaaaaaaaatttaaaataaa

SEQ ID NO: 54197 - DNA, 1471 bp, Heterodera glycines
  Genomic contig location: Contig_ID=SeqID_4369; Location=3954..5424; Strand=+
  SCN-specific regions: Sequence locations=1-363,408-462,487-578,601 -851,891-1081,1104-1254,1278-1471
atggcaaacggttcggacaaattcagcaaattgccgcagttggccagcccgtcgctgtaccaaatttgcctcagcgttgacgtggacacgtgtaaattcaagggcaacgagatcatccatcttgaggttagttggcactaaaattttggggcaatccttcggaattagtgtcccccggcggtaaaaaaaaattgagacccgaattttgaaaaaagcctggacctgggttccatgttggcctggacctggatttcctggacacgaattcgggttcagaaaaacccaagtttaccgataatggccttgacctgctcgtatttacataaacattgattccatctatgattttgcatcaagcaaatgattttttcaaaaaaaaaaaaaaaattaattttgtaaaatttattggcgttaaaacgtacgttctgaatagtgtagaaatgattagcacattttcttaccttaaaaaattaaagaaaatttttatctctttttttgggcaccaattccgaaggatttacctaccccaccaattttggggcaaatttcactttcctcccccctcaccaacctaatttttccctctctccattttcagattacaaagccaacaaatttcctgacactccacgcgggtgcattggaggtggaaaaggcgtcgctgaagttggaggatgggacgggtgagtgaggtggcggagcaggtctttcaccccagaccctcgaaaaaaaattttttttgaatttttcgggggggggggggacacgaggtttgatgtaaaactttgatttctctcacgtaaattttgaaaaaaaaacattttcaacttttgcctcaattcggggtcagatttaaaaagtgtatggaaattcccaagcgcccccgaaaattttttttttcatattttgcaattttttttttgcacagttttgtcggatttgaagcgcgagttggacaccaaatggacgctgctcacccttcagtggccgaaagaggtcaaaccgcaaaaggccgagttggaatttgcgtacagtggccaattggcgacgaacatgcaaggcttctacaagtgggcgacggggaaaaacaatttaaagaaacagaggggaaaataaataaatattccatttttattctgtttttgaatgtttcctttttaggctggaaaagtttttcatgatttttggaaaattttttgaaaaaaatcgttgaaaaatttttctaaattttttttattggattttactggacattggtttgaatttggatcattttttcctcaaactttatgtaaaaatgctgcgcaattttttaatgtaattttctgatgcaaaacaatcattttaattgttttgtaattttttttccttcccatttcacaggtcgacgtacaaagacagtgcgggcaacgaaaagattttggcgtccactcaatttgaggttgttgtccaagcgttaaaaatgccaata

SEQ ID NO: 54198 - DNA, 152 bp, Heterodera glycines
  Genomic contig location: Contig_ID=SeqID_23500; Location=372..523; Strand=+
  SCN-specific regions: Sequence locations=1-152
atgttgccattattctggcaagagatcaataccaatggaaaagtatttagggagttagagtaagtaagtaaaaattgtcattttataggtacgtatttttgatggctgatttaaagaaaaataaaagagatacagagccagagaaatagtga

SEQ ID NO: 54199 - DNA, 1272 bp, Heterodera glycines
  Genomic contig location: Contig_ID=SeqID_23501; Location=432..1703; Strand=+
  SCN-specific regions: Sequence locations=1-91,121-151,177-318,340 -429,466-492,518-754,814-918,1222-1272
  Gene Ontology: Mol. function=structural constituent of muscle; Cellular component=cytoskeleton; Biological process=regulation of striated muscle contraction
ggcacggcggagacgcgtgggctcatatcagtggttgaccggcccgaccccccagagggcccgatcacttatccggccacaacaaagtgagaaaaattcaaaaatataaaaatattttttctttagccaattttttcatgacaaatttcagtaattttaaaaaaatatatttttttctggcgtcgttttgcctaaacgtactttcaaaaaaaaatatagttagtttattatcagtccaatcaaaaataattgagaatttatcaggattcacacatcaattcggaatttatggcagggtgcaatatgtttccatcccagaaaaaaataataatttaaatactgcaaattttcctatacgtttttctagtagaatatctaaaaaaaattcttaaacatgtttttttaagaatttttctttgaaattactgtaaaaatctttttgaaataaattcttttgagaaatgataatatttaaaaaatgaaatttcgagcaaatttataaaaatttaaaaaaaatgtgcctgatttttcttttgcaaataattatcaaaaaatgcctacctatgccccttcctctcaggcattccatcacactgtcctggcgcccgccaaaggatgatggtggcgcagaactaagcgcctaccatatcgaattcaaaggattggacgaacgcgactgggaacgtgtgccagatcacgtgacactgccgaactacaccgttcgcaacttggagaaaggcgctcagtaccaggcaaaaattaatttaaaaatttgaaaatttcgtaatttttaattattattttttaatttttctttttacagttccgcgtctttgccgagaatatggttggcatcagtgaaccgctgaatggcgaaccggtgaccgccaaagatccatttggtcggtttttgatgagaattttttgattaaaaatttatatttaaattttttaaagaattaataacacataaaattttaaataataaaaaatgttttttcatccatttcttttaaaacaaatataacaattttattttattgtgatttcaaagattttgataaaatatattttaatattttttcaaatttgaaaattttcattgaaatttaaggttgattttaaaaaaaaggatcaaaattagcaaataaaaaaattatgtctacaatttttaaatatttcgaaaatttatttttatttatttattatattaaaaaaattgcgttttctaggcccacccggtccaccttccaccccggaagtgacagcata

SEQ ID NO: 54200 - DNA, 549 bp, Heterodera glycines
  Genomic contig location: Contig_ID=SeqID_23504; Location=1237..1785; Strand=-
  SCN-specific regions: Sequence locations=1-173,197-223,245-447,525-549
atgatcgtaagagcaaaaagttctattccacagagaaatacaaacttcaaattttataaattaattgaaaataaagtgagactgcccacgaagagcacattaaaataatcatgttgaatatatacattcaattacagtggcaataattaacattaacatgaagtaataaaatttatttaaacattttaagtataattcctctgtaattaattttatagcactcaaaagatatactttattttttatacaaattaagaaacgtgcaagaagtgcgattgtagaattaatttataataatgtaattaagaaacttttttcaaattcaaaatgagataaaaagaatgggtccacaagcaaataacagcattgattgttgccgcagaagcaagtaaataggatgtgcaacttcaacttattaaatccgatctttgcgacaacagcatttagaaattttatttctatgatataattaataattttattaatatcattgtattttagaattaattatctaatttttataacttgaacgcccgtttagcaaataaa

SEQ ID NO: 54201 - DNA, 1155 bp, Heterodera glycines
  Genomic contig location: Contig_ID=SeqID_23506; Location=64..1218; Strand=+
  SCN-specific regions: Sequence locations=1-224,246-1155
attacgccttttgactggttttttgactgggtccgcctctacagaaactccctcaacaatgacactttgtttcttttttcaaaactatttttcaacgcattggtgtcgcttggctgtctgtgcattgtcatcatggaaatgttacgctctgtggaagaatatgaagtgagtgagcgcaacgcgtggccaccacagcaaattcaacttgataaaatcgcgtccaaaaaattgcttttaaattgaaatccgttcggatttttttgatcaaattgagagattattacatagtttttttgttccttttgtcgcgttaattttcagtgttcgcacgtgttgtaacaaattgtgtcgcataatttgttttgaattttttaagtcctcgggcattttactggccttcgcttctgtcttgttttggggtcactctgttgcgttctcattcaatttgctgttcttttggtcgcacttttggacttgcttcaacttccgtgcggatcgcacaattgtgccgtttgacactttggtgagttttgtttttgtttttattggcatttaaattttcgcgcatatcccttcttttaaggtgctcagcattgtcatggtgtgtttgtacgtcttcgagcttttctacagaattcgcgatatcgccacgtatgccatcgaagaggatgatgatgatatatgagataaattggattatgcattttcttggtaaattgttgttattccattgcatttctgttgtacccgtatgcataaaaatttgatttggtgacctgctttgagtggtgttataaaaaaaaccaaaaatgtcaaaccaatttgggatgtttttgcccgtgaaatttggtccatttttgcgacaaccattcgccaacagttcatttccagagcggtatttctagagacattggccatttggacaatttcgtcgtctcatttcaccgacaaatctctccaatcattcaattgaaggctgtcgcccaattgtccctttccgcgacgtacgattgactggcgagggctgatggaaaatttcgtcaaaaaaaatacagtcaggtgtaaaactaggtaggtaggtatgtcaaaaaatctgaaatttttgtcgattcgacctcgattttggcgtttcgtcccataaaaacgaatcgagta

SEQ ID NO: 54202 - DNA, 626 bp, Heterodera glycines
  Genomic contig location: Contig_ID=SeqID_23507; Location=129..754; Strand=+
  SCN-specific regions: Sequence locations=1-344,372-463,533-538,561 -570,592-626
gccgagcaccggtttattagccgatgcttttcaggatgatatttatcaatttttcatcggtggagtttacagcatttcatttggttgcatttgctgttatgtgaccatttttttgattgtcaggcttaaaaaaagcggtaaattcattggcatttgtcttaaagtgcctaatttaaatacactatacatttgttacagtaacccagcaaacaaatacccgactgttacgttctttggtcatcattttgtccataaacattggcggctatttgggcactttgatcatgagtcagcttattggaaccattggccaagtgtatttgtgagtttttttttctttttttccaaaatttaaacccccaaaggtccccaattggagtttggcaatttactttttgtgcttacattcttttaaatgttgttgccggatcaaatgctattgttctttttttaaacaggtccaaatttaatttattaaaatatttaattgctgatttaatttaatttaaaaaatttattttttttcatttaaaacttttcattaaaatattttttaagcacagaatatcgtcaattgtttaaaaaggaattgcgtgcagtgaaagatcatttctttaaaaggaatg

SEQ ID NO: 54203 - DNA, 457 bp, Heterodera glycines
  Genomic contig location: Contig_ID=SeqID_4370; Location=3700..4156; Strand=-
  SCN-specific regions: Sequence locations=1-457
gtgtatagggcaaaataccatcggtggtcgaatgctaaatcgtccatacgaatgggtctttggcatgattcaaagagggtctaataaggtccggtttttccctgtgcccgatcggtctgcagacactcttctgcccattatcgctgaaaatattgaggtgggaagcacgatagtatctgatgggtgggcggcatacggagggattaataacatgcagcagcaatacaaccacgaatggataaatcatcaaatttacttcgtagatcccgccaaccctcaaatacatacacagggaattgaggctacctggagggctttaaagcaaagccttaaacatttacatgggactacacccgaacttttacctacttatttgtttcagtacgcatttcgtcgttatcacgaaaacaaaaaaatatttcagcatattttggaagaaatgcgccataactaccct

SEQ ID NO: 54204 - DNA, 766 bp, Heterodera glycines
  Genomic contig location: Contig_ID=SeqID_23510; Location=84..849; Strand=+
  SCN-specific regions: Sequence locations=1-766
ctttatctgcggtgattgttggcttttggtgttcgattttcttgcgccttctcagctgggccttggaattgcactgatcaatcgccgctttgaccgtatcgtcgacgaacacttcaagacacgcaaatggaaattgggcaaaatgcgaatttgccacaaaattggaaagaatggcaccaagcaaatgcaaattgtcaattccgatggaaatccattgccaattttgcaaaatccgctgccgaacaaagtcgtcggattccgaggcattacaatcgcgtaaaaatggattagattggaaatgttttatccacattttctgcttttcagttacatcgatcaaaatgtcatcgcatttctccgccattttcaccgttttttcgccgtttgttcaacggatttgtacgttatcactgaaaatgttcgcatttcggaatttattttgttcgacatttggccaacgcttcgcgatgccattcatgtgattaatgtgacttccatcgtttttcgccgtttgcgccaattggtcccgtcacttctcaacgattgtccatcccttcgcggtgtctctttctgtggcggcagtttgcccgaatttccgcccgatgacagtgccaatgcgtcggatggccaagcggtgaccaaatggctgttctcgcctcgtccggatggtctgccgaagtttctcagatactctttgaatccaccggtgattcaatggtcgtcaacgatgaaacagattagagcggtgattatgctgcatatttaa

SEQ ID NO: 54205 - DNA, 1195 bp, Heterodera glycines
  Genomic contig location: Contig_ID=SeqID_23513; Location=582..1776; Strand=+
  SCN-specific regions: Sequence locations=1-245,267-374,396-600,641 -840,865-891,938-980,1004-1108,1130-1195
ggaagacagcagtagtggcaatatcattagcaacagagtaggaggaccaccaccaatgacggcacattgtggtggcaattgtcgaatgctgacaggagagccgaatttgttccgacaaggagcgcatcagcagcagcatggctacggcacttatggttatggcggtggaggaggaacagtgccatcgatacattcggcttgccatccggtatgatcatggcataataatattttaattaagggggtcttcaagggaatatgatggatgtctattagaggaaaaatacggtatctgtccgattttgcagatctgtcataagtcatgcatacattcatgcccttcaagccgatcaccgtcaacaggatcaattgaccagcagaacaacaacaacaattttggcagcgggggtttttctccatcagaatttcatcaccaacagcacaaccaaccgatgccgtcaatggactcattaaaaggcaataataattttaattgcttcccgtccaaatgccgggcaaattgcctgggggcatgttcccgaatttttgatgctcaacaacgccaacagcagcaacaaattcgcgaaaattttggtgtgctatataattaaattattttgaaattatataaaaaaattaagtgccgagcaatggcatcgaaaatgacattgatgttgagccacattaccaagtggaaatgggtggtggtcaaactaaactgagtagcccagaccatggcaataacaacaacgaaaatataatgtccacgggcaggaatgtgtgccaatgttcgccatcagcggcaaacgtatgcgaatgccaagagtaagtgacaaatggccaataaactttgaaaacaaaatattacttagtgagatatgcatttgaaaaagatatttattgaaaaatatttcaaagaaataattaaaagaaattatgattttcttagaaaaaggcctggttggtctaaaatttcgggtttttcttatatttccttttcataaacccacatttcttgcccagaccctgctacccaatttgtgtcgacacgtgcgagtccaactgtcttcaacagcaaatgcagcaatcgcctgcaaatcagcgtgcacaatgtgcccagttttgtcacttggagtgccaacatgactgtgccatggaacaacaacaacagcaacgagtaccagcacgaaaagcg

SEQ ID NO: 54206 - DNA, 683 bp, Heterodera glycines
  Genomic contig location: Contig_ID=SeqID_23514; Location=495..1177; Strand=+
  SCN-specific regions: Sequence locations=1-10,32-491,513-683
atgttcggccgaaattatggtaaggaaaacaagcataaagcatacggtaatgaaagggaagcatacggtaatggaagggtaagggaaagaagcatacggcattggaagggaaaacaagcataaagcatacggtaatgaaagggaagcatacggtaatggaagggtaagagaaagaagcatacggcattggaagggaaaagaagcataaagtatacggtaatggaaggaattcgaactttgaaatgttttcaaatcattcgctaattacccaacaaaaatgttacagaacaaagacaaagaccgcatttgtgtgcagagagtgggcgaagtgaattcggagaccgaatttgtagagaagtcaatgggaccaattcgggtggacaaatgcacggggcaagaagagaatgagccgacaaagggaggcaaaaagccccggagggacaaaccgaggacagaaagacagccgagacgcttttggaaatcgtagtcaaacggacggacggacggacaaagaaaaatgggacaaagtgccgacagacaaaactgagagagaaaagagagagagagagataagagataaagcggagagaatgccaaagcgatgtgagaatgatgtacaatgtacataatgaaatgatagctattcactcgttgaccattgacaaatgtgtgctaattgtaga

SEQ ID NO: 54207 - DNA, 287 bp, Heterodera glycines
  Genomic contig location: Contig_ID=SeqID_23517; Location=47..333; Strand=+
  SCN-specific regions: Sequence locations=1-287
atggtgccaagccccgtggtggtgcccgatgttgaggcggatgcattcaggacgatgttgggcttcatttacacggacgatttgagtgggatggacggcgacaatttgttcgacgttctttacgcgggtaaaactttatttttgggttttcccgttcaatttaacccccaattttagctaaaaagtacaacattgtcggcctggtcaacgcctgcttggacttccccatcccttcgctgcccaacgttttcttcgcctttgcccaggcgcgttttctcgaagaaaag

SEQ ID NO: 54208 - DNA, 1683 bp, Heterodera glycines
  misc_feature (490)..(490): n is a, c, g, or t
  Genomic contig location: Contig_ID=SeqID_23519; Location=339..2021; Strand=+
  SCN-specific regions: Sequence locations=1-115,169-235,279-334,417 -444,473-551,574-634,656-777,834-886,911-1049,1090-1186,1266 -1513,1546-1549,1571-1614,1637-1661
atggctccgtctcctaaattttttgacaggtttcacggaattggtacgcatatgatggtgtttaacgatcatctttcaatattttattcatttacagggttaaatatcttttctctttattttattttttaaataatcattttttagtttcaaaattattttaattaaccaaaatgaacagaaatttgaaagttgaaaatctactgtcatttggccataaagtgatgattcattgaaaaattaaataatttatttaatttattattttaataaaatttgtaggttatttttaaatgatcttaattaagcatatcattgtcaatgtctgaacctgttattttttatttataaacataattatttttattttttcactaattcatttaaaatatttatttttttactttcatttgtttttgtgtgtgattttaatgttctaaagaataaaatttttattctttattttctgttgtgaaaaatatactcctanattcaattatttactgttattatatgcttatttctcgttgtttgcgttaccaattattcttcttaattctttatattttatattactgattgttttttcagcatttcacgaacattaatttaccgctgaatttcgacgccttgaatcaatttttatggaaattttatttttattgcatgtaaaaggttttatgattatgttttctaaatattcgaattttttaaatttttactagaaacgctatttttaatatattgattaattgagacagtttgcttttatgtgtcatataaataattaattaaaagtaatgaattttatctgatataattattatatatttctgcttaactttttaccttaatgtcatttttaggttacaggttcttatttgcatccatattttattattattagaataaatgaaacagataaatgtgccgaggaatacatgacatatgtggatggctatacggaatccaaactgttgttataaatgttaaattgtgcaggttttggcgagatatttatttctttgtagttgaatattattattgggttttttaaatttttttatttagatttaaattaaaataaaagtttttgaaaatttgtcgtttttgatttgtttttctcgcctgaatccatttcttaaatttgatttcttacaccgaatgcttataaacaacattaaacaataataaaattgttatattcaattatgtaattgtatttgtacttttttaatttataaaattatatttctttttaaattcatgaaattcgcaaattattctttttccatatcacatttaaacgaatattgtattaaaaacataaaattcatttagaaaattattcacatttatgtagaaatttaaggttaacttgtttactttcttgttaaaatatttctatactctcgctctcggccgcaaacgccgtggcaagagatgtgataaacctacccgacatcttcgattctggatcggcttttaaagttaaattgtgtttctttctgtgtttatatattattattattattaaaatttattctctataatattttcaggaaacaaatcaaatatttggtatgtcaattatgaagaaattggcagcactttttcagattattgttttatcttggggatgataataatttcggattccgcataaatctaattaaatagaga

SEQ ID NO: 54209 - DNA, 913 bp, Heterodera glycines
  Genomic contig location: Contig_ID=SeqID_4375; Location=823..1735; Strand=+
  SCN-specific regions: Sequence locations=1-58,86-97,119-147,178 -218,255-285,329-380,402-526,555-591,614-652,674-913
atgaaaatgattgtaaaaaaggtaaaaattaaaattcatcataaccttttgttaatggttaattattttttataaattataattacatgttcattcttcttttattatttttaaataggaataagaaagaaaaatataatttgcttaattgccttttaataaaaaaggtttaaaaaatctccataacaaatttattagtttgctaattcaaattaagcaaaaagtttaaaaagaataaaactaactttataaaataaactcgaagatattgataataattacagcattatatcataattaaaaactaattaaattttaacaaataaatgtgaaaaaaatgaaaaatcaaaaaacaattgtcgaaaatgaactatttatagttattttcgatttacaaattttttctatgttttctctcccccgggggatgttaagcaaaggactctctcctttgcttagtctctcttctgttggctgttcagtcattggtcttcagcgaccgccgcgaccgaacggcgctaatgtattcaattttcccttttccctccttttttcagcagaagcaacagtcagccgatgaaatcgccgtctttgccccctccctctctgttccgccaatctgcatttctccactgcacatccatcgcttcatctctgctcccccactgcttggccttccgccgtcccatctgccgtctcatccgcccccactctctctccatcgcacatcattcacaccacctccgcctggccccacggcttggaccatgccattgaagaacgatggacggaagacatttcacatcgtttaaactgttgcgaccattcgatccgccccctcccccaccgatggacgattttcttttccccgttttcattctattaatttttgcttcgctcatctcaactgaca

SEQ ID NO: 54210 - DNA, 436 bp, Heterodera glycines
  Genomic contig location: Contig_ID=SeqID_4375; Location=5342..5777; Strand=-
  SCN-specific regions: Sequence locations=1-396,418-436
cataaacacaagtctgttgatgtcaagttctactgtctgtgccggttccagccaggctacgccttcaacatgtattgtactaccaatccagaccgccggtttggcccatcttcccaaaaggctcaaaaatggtctgatgtgctcggcccattccgtcgtccgcacgacgaccatctgacaaacatcattaatggtgacgacctctggtaaccgatgccaccagacaacgtccctgagtgagtgcacgagaactagggcacggagcccgttgtcttggaacgtccgtccaattggttccacttcgtcatccccgacgaatgcgatgggagcgttaataataacccttttttctccaacgccatcccaggggcgcctttcctcaacaggaatttgtgaaatgccctttctctcatccttcgattcttcctccttgttt

SEQ ID NO: 54211 - DNA, 1230 bp, Heterodera glycines
  Genomic contig location: Contig_ID=SeqID_4375; Location=3075..4304; Strand=+
  SCN-specific regions: Sequence locations=1-200,222-846,869-1230
atgtcggacatttatgtcgaacgcatagaaacagctaaatatgcaattgagttatatctggacaagccattgcccattcttccgcaaggggtgttaacctctcaacagagacataatttaatttgtgatcaaagggaatggaaagaagttgcggacgaaattcagacgcaagtggacgaaataaaggcagcaagggcattgtacaatcaagaggcttctacgcttcacggcgatgaaaaaactgagtttcaacgccagtatcgtgcatcagtcaacgcaaacgatctgcaaaatttgttgcgaagagcaaatcataaattggccgatacccgcacgctgaaagggaacattgatcgtcttcttcaagatgggcccggaggaacggcacgccgaaacattgccttgccaaaattaagcctaaaggagttcgatggcagtgattgggatgacttttggccattattcgaatcgacaatacatgctgatgctgatttggattacgtacaaaaaatgagttatttggattccctgttgaggggtgaagccaaaaaggtcattcaaggacttttgcccttctccagggataattatgatctctcggtgtccttattaaaggacaagtacgggaagaatgaaaatttgatcagagatttacacaatcagttggcccggctttcaaattcgaagtctcttggcgacgacatgaaacttcaattggaattggaacgagtttgccgacaactcgagcattacaaccaggacttgagttctcctcaaatttatatgagtctggaacagaaattgtccaaaaaggtgttgaccagatatgtagacttaaaaaacgtcaagctgagtgcaatgcctcatggttcggattggtcaaccgacctatttagggatacatttaaagcggctattgagcagcttaaacaaatcaatgacatagttcaaagggctaatcccgaacaaactcaacatacatacaagagagagaaacataagagtgaagtaaaagaatcgaccttaaatctggccgtcatatacaaagatcaagagaaaacagacgatcgccaaccatcggttgctgttaagccaaagccatggcgtggaacttcaacttcatcggaaggatcaagctcacgctcatcctccaaatccagccgatacggaagagccccaggaagaaaagccggttcaccatggcccaatgaaagtcgaagaagagaataa

SEQ ID NO: 54212 - DNA, 4956 bp, Heterodera glycines
  Genomic contig location: Contig_ID=SeqID_4375; Location=4452..9407; Strand=+
  SCN-specific regions: Sequence locations=1-163,185-376,400-909,931 -1639,1661-3436,3458-3681,3703-4243,4266-4676,4698-4956
atgtgctacatttgcctattcaataatcacatggcaagaaattgtccaagaaaacttagaaaatgttttctttgtcaacgtaccggacatcacccagcattatgtgaaaaacggaaactaatggccagaggacaagtcgcaaccaccacgtctaagaagcaagaaaacacatcaaccaatgtgtttgccatacaaagctgcatgaaaaatccaattcagcccttaagaccgattgatttaattttacccaacattggcaaagaaaaattggaaataaacactagatctgttgagaacttagacagtgatcatatttttgagaactccaacactgccaatctagtacaaacctaccaaaaggcaatgaatatggctgaaaaattttggcaaaattggaaagattcctactcattgggtctaagggaacgtcatcaagggaacaaacacacgccaggaaaagcaccaaaacttggggacgaagtgatcatttctgaaccacaaactccaagaaattgttggaaattggggaaaatagaagaaattttatcacaacgaaccgcaagagtcagaatttcggaaaaatcaattattgaacgtgctattaagcacttatatcccttagagttagccgaaaaggccaataattctgactctggcattaaacaacaggaacacagttttgtgaaacaaattcattataattgggcaaagggacctcctcaaaataaggcgcttgttaaggcaaattccccaaatcactacagatgggcaaaacaaccaccgaaaataataaatggtataactaatgtgacatgtatttcagaaatgaacaaagacttcgatgccgtgtctcttgattgtgaagaaatggaaagagatctcgaggacgaaaacaaggaggaagaatcgaaggatgagagaaagggcatttcacaaattcctgttgaggaaaggcgcccctgggatggcgttggagaaaaaagggttattattaacgctcccatcgcattcgtcggggatgacgaagtggaaccaattggacggacgttccaagacaacgggctccgtgccctagttctcgtgcactcactcagggacgttgtctggtggcatcggttaccagaggtcgtcaccattaatgatgtttgtcagatggtcgtcgtgcggacgacggaatgggccgagcacatcagaccatttttgagccttttgggaagatgggccaaaccggcggtctggattggtagtacaatacatgttgaaggcgtagcctggctggaaccggcacagacagtagaacttgacatcaacagacttgtgtttatgggtgctccgcgaatcactcaaaggggaggaagtgcgctgtataagaagcgatgccaacaaccattttctgatgatcgtagttcgggcgcaacaaagtcaaaaaggttccgtcctgttgaggaccaaccatcgcacagcgaatggactcaggaaattcgaccaattcgtcctgttgaggacccaccgtcgcacagcagatgggcgtaggcaattcgaccaatccgtcctgttgaggacttgcagcaacatcagtccagctcaaatccacgtctccaccgccaacagcagtttccggtcaaggccgtttacgatttttggaaattggaaagtatcccgccaattccgccgttcatcaatgacagagcaccattttgccgccgtgtccgggttgaagaaagaggcgaattgctaggattttttaatcagcaattttacttttcgaatttcaacgaagcgtatgaattcgtcatccacggaagaacctaccgatgtgtggagcagtattactgtgcccaaaaagcgttgtatctgaaacgtttcgacgcggcggatgcgattatgctggggacaaacagatatggcaaaagaataagcgcatttgagatgaagaaattcgcaaacatgaacggggaggacgaagtgactgtccaagaatggactgagctcaaaattggcatcatagaagaagcacttaaagccaagttttcggtgcctgatcttaaagatgtgctgttgagcactggatcggccataatttgcgaattatcactcgaccagttttggggggtgggttgtagaccgggactcatttatgacaaatggccaacagcggacatacaacagtggaacggttcgaacacactaggacgattgttgatgcaactcagagatgatttgaaggaggcaacaccaaaaggtacaacacgggctgttcagccaaattatggatggccaaaaaatagggaagaaaattttcaaaatattcctgttgaggaagacgtattcgacttaaaaagtttcaaaaatctcgaaataacaagcacagacgaagctaaaaggggggataaaccaaaagattcgacaaatgccaactcaatcagtgaactattgatgagccacgcagacgaagtggccgagacggaggaaaagacaaatgagaaatttgcattgtcagaaaggatgaaccagtggctcaaatatgcgggcataaattgtcaagtcctagtttttggttcctaattatgtcaattggctcaacacggttcggacttggaccttttcatctacaagttcgaccaaacatcagttcgtcttgctgacgaattgggaaagattcgacaaattttaaggcaaaaatatccgcgaacagagatggaattgagagcgagaggaaacaccccggtattaaaaattaagttggaattccacgttgatttgacaattggacgatcagagaaattgaatggtgtctacaattctgtgtggctggccacgttggtccgaattaatgacctgttcagttccgtctgcttattgattaaagaatggggaacggatatcaaccaaccggaatttggttcattcaatagcctgtccttggttattatggttcaaagttacttcgctgaacaaaagttgttgccaagcctgtttaggctttatcctgatatttacaaagaagacaagatcgtcaaattctacgacgcagaattccatcaaaaattagcagaagatgcgaaggcaaagtgtccgcagtcaacttcatcgttaattgaggtgttaaccaactttttcctttggttggatgatattgacttcgccagagtgaaattgtcagcaaaaagcggtaaaattgataggacagaaggcaatggattgcagtccgttataatcgaagagccttttgatgcaaaatcaaactgcagcagaagcttaacagataaggagttccaaaatttcaagggtctgttaagacgcacaaatacgcatctcagagcaaaagactggtatacagtaaaacgcctgtttaggctaaacccggtaaatgatgtagcgtggtcaatgaccgacgaatcagaagacgattcgttcgataaaattgctgttgagcaaataaatgaatcaatgaaaagatttgcgggaattaagccagacaacgtacgaacaacacataatgtgcgcagaagccaaactgaggaccgagatttcgagagaaacttcggattcccaaaaggtcagtcaagaggcttgagaacatttacaaatagcaaattcacatttgggctattgagcctttttatgttgttgggcgtaaatttatgtcaaaaaccaatgatttgtcacagaaacgtgccatcaagatttgtcaaaattggtctaaacaatagtgcctgttcagggatatctcaaatatttgaaagaggtacaaaaaatttagaacttacattgtatcgtcctgaccaaaaggaatacaccttttgggggcatcaatgtttactccttaaacattcggtccaattttggacgaatttactgaatgatccattcgacatcaaaagtcaagaaatgatgccgatttctgccgaagaatgccaagaaatctccaaaaccaaaaaatgcagattcggaattctagtaggtgactcagacggtaccatgataacagaaaataaactcatttatgagcattcttggtggtcttggggtaaaaagtctgttgagacggttaattgcatagtcaacaatataacaatcattggatatcccggatcccaaagaattgattcgattgtcggagacctccaacattgtcaatatgacgacggcagatgcagtttacacgattctattgtagtttgggatgttgatcggtatcacacatctgcaccatgggcggctcgacacggacattgcgtttttaaaagtttttcaaagaaaaatggaaccatttatcgaataggttggatcagtgacccaccggacttagccctaacatttggggaaaatccgacatttattacttcttgtttaagaagattggtagttagccaacaaggattcgcaatcgaagaaagagaatttgtaaacttcaaccgacaattggacagaactcgccgaaatgttaattttgatgaaccgttggacggcgaagttcgcacatcacaattagatgctcaactcacagcacgttcgatgttcgcagataaagaaatgagaaaagtattgcaggcatattttaaacttatttgtgactccatttttggctcagcatcgagcactgatctgacacatctcaatccgaatttttgattcgtcagctttcggacaaccagcaaatcgaagcagaatggatttcaaaaaacattttggaaatttggccatgttcctcagtatatgagtacggattcgcacaatccaaggataaatgttacaagaaaatctcagtaaaggtgacattagttaggaaagacaagccaattctggcttacttgggcccaaaagccctcataataagtgcagaagctagaaaagttgatcgtcagacagatcgctacaaacatatcgttcttgaaggtcgactttatgagattgatcaagttttaggtattaagactcctgttaaggaaataa

SEQ ID NO: 54213 - DNA, 661 bp, Heterodera glycines
  Genomic contig location: Contig_ID=SeqID_23521; Location=429..1089; Strand=-
  SCN-specific regions: Sequence locations=1-313,344-533,571-661
atgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtcgtgctctgaagggcgtgggagggggggggggcgaaggcccaccacgaggccgcgaagaggccgagtgagtaccttcggtgcaggaaaattattaaattttaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaatttttcgaaaatctgagtctttcgtttttatttatttgcaaaattaattcataaatattttttcagaaagggttctgaaacgcaccaaattttatttacatgttagtttaggcactctgatgctttttctatcaataatggaggtgaataaa

SEQ ID NO: 54214 - DNA, 217 bp, Heterodera glycines
  Genomic contig location: Contig_ID=SeqID_23522; Location=167..383; Strand=+
  SCN-specific regions: Sequence locations=1-144,166-217
atggccgcgccaaagtgggcggttcccgttttttgggtcggtgtttaaataaattagccagccactcacagttaaattaataaattgtaatttcttatgtttttagttttcatttttgacatttattttaaacactaaacacaatgagtacaagcacatcgagctcatcattcgacgacagctcttcagaccaatgtaacggcaaaatggcatcgta

SEQ ID NO: 54215 - DNA, 1471 bp, Heterodera glycines
  Genomic contig location: Contig_ID=SeqID_23524; Location=1..1471; Strand=-
  SCN-specific regions: Sequence locations=1-164,186-252,278-314,336 -634,671-1339,1378-1471
aaatatacgtcgttacaatagtatgttcgcctgtgcatcaattagttgttttcggtttaaatttcaaagtcctggcccgccatgctataaaatacaaggacaaatataccataaatttaatcagaacgctatgccaaaagataatgaaattcctacaaacggacagttatattttattgattctgaagaagctatagatattcgttctgaaaattataaaaaatgccgctctgaaataattgagtttcttgaaacttttttaagaaaaataaacccttttgcacagtcctttttaatgatgaaagaggtttataaaaaagaagaaaataactgtaaagaaaatgggttaaaaattccaaaaattatgataaaaggcggtacagtattccaaggtgtaatgaggttggagcaattgtagtttgtgatgccaatgatgaaattccgccagcgagaatagtggtttacccgaaaggtgaaaaacaattaaaaaatatttatccgttagacaaatgtgtagaccaaatgtgttatcctttattatatccaataagaagcgaagggtttaatgtaaacatcaaaaatttaactgggaaaaaaatttctttgtgtgactataccaaattttattgttttttcgggaaaatgtaaattttttccctcatttttacgcaaaaaactttcaacaatggttggtggatcaagctgctaaaatcgaatgggatcgcttagaatatataaggacgcatcagatggaattgtgtagcagtaattgtttaaatgttgaagatcttcttaagaatagagcttctaaaacaggcgcataaattaaaaaaaggtaattctaccgtctacttttacaggagggccaaggagtgtgcatgaaattttatggatgctttagctatagtcaacgaaacaggcaaacctgatttgtttatcacgttcacatgtaattctaatgattacgatattttaaaatgccttttgccgaatcaaactccatctgatagacctgatttagtttcacgtgtatttcatttaaagaaaaatcattttttagatttaatttttaacaaacaaatttttggtgaagtgataggagattgttgggttatagagtaccaaaaaagaggtttaccgcacttaatttgttaataaccctacacccaaaaaataaatggcatacaattaatgatatagataattttatatctgctgaaattcctgatgaaaaaaaggatcccgaacattataaaataataacaaattgtatgatgcatggaccgtgtaatgaaaaatcgccatgttggaatgaaaaaaaaagaaaatgcaacaagaaatttccaaaaccttttactgaaaatacaaaaattactgaagatggttatcccctttataaacggccagataatggccgctgtgtatacaaaaaagggaaaatgcttaccaatcagtttgtagttccttataa

SEQ ID NO: 54216 - DNA, 1277 bp, Heterodera glycines
  misc_feature (913)..(913): n is a, c, g, or t
  misc_feature (929)..(929): n is a, c, g, or t
  Genomic contig location: Contig_ID=SeqID_23528; Location=478..1754; Strand=-
  SCN-specific regions: Sequence locations=1-534,556-792,814-821,847 -1277
caattaggacaatcgtttaactatacttcttttgcactttgctttcgttcacccgaacatattgtgctggtctcccaccgtgacgtcattgtccacgtcaacgaattgttgggtggcacttgggccgtcgtcgacaccgctaccgtaaacaaatatgtacagtatgagaatgggaatgtccaacagaaggaggatgacgatattctgagcaaattggttattgagcacacgggagttcacgtgcgctataaatatcaagtgaatccccatcagccaggggtaggcgcggattatgtattaatatcacggtcatccaaatttcttacaccacaaaaaatcagaaacgtatgggaaaaaaagtgatccgtgattgccacatcttactgtaagttcaagttagaacttttgcctagtcgaaataaacacataaatctccttttctttcttatttaaagcaattgctacaataaaaaagaaaaaaaaaatttgaaaaaattttgtccaaaaatgtggacccaaaccttactagtaccgtaaaaaagttattttttaatataaagtcacactaaaaatttgtctggcgaataattgtgaatttcttgtttggagtattaaacacgggccccgccgggattttgccgggacccaggccccggtttttttggacaaaccaccgggaccgggagtcccggtcccggggccccgcccgggtccattttccaagtcccggccccggtcatttgggtcggaaaaacgggactaaatttcaccagtgaaaccgccccaaatttgaaaaatttaataattatttttggcgaaacgtcttttatttaaaattttgaagatggaatttgggattttctacgatttaaacggttaaaaagatcataaaatccacaatatgtatacaggntctttgggttctagtncggttttatgcgtcccatgccagattatgcgtcccatgaatgaccatccccagagtatttgctcttttcttgcatttataaaatctcgaggcttttatctttcgcttggtaccaagaatatgggtattgaaaaagtaagaaaaaagttatggcctaagaaactggggatggtcattcatgggacgcataaaaccgactagaaccgaaaatagtgctaatattagacatttttttctttagaaggcaaacaattacatcggtgaagcaaaacgattgttggcaactgttgagccgtttttgagtccaattcaccgcagacagatggtcattagtaagttgattatgtga

SEQ ID NO: 54217 - DNA, 991 bp, Heterodera glycines
  Genomic contig location: Contig_ID=SeqID_4377; Location=254..1244; Strand=-
  SCN-specific regions: Sequence locations=1-88,116-211,235-386,408 -429,453-477,535-575,597-743,765-991
atgtccatttttaaaaatggatttgtatctaaaatatggcgcggccaaagctgctaccattcgcatttggtcgctgtgccgctgatgggagacggacagacagacagacacggtgattgtcggttagagaaacggggcataaaaatgaaagtttttttttatgttttccggtgtgaaaaatggggggggggtggttatacgatgtgtgggtatgtgtatgtatacatacacacaataagtcgaggaggaaatggagccataaaaccaaagtttttgagagagagagaaacaggcagaaaaacggggacaacggctggaggagagatgagcaaagagaggcagccctccgttatcgcttctcctgtgattgttgtgtgaactgctgctgctcaattagaaccacaaaatttttaaacacagaaaaatttgtggcggaaaatggaaaaaatggagggtggataaagacaacggacaaatgagagaaagagagagggctgagacatggaaagaaagacgagagagagagagagagagcgggtgacagacggagaaacgaaaagtcaacggttttactgaaaggggggagagatgagaatttggggtcggggtcggtttagtacgggccgttttagtacgagcgcaagtttttggctataacttttttctttgccaacaagatccaacatttttagtatcgttcgatagccctaagtgtcctctattaatctgaaaaattgcgaaaaattttgttaagcttcaaaaaagttatggccagaaaaactcaaaaaaccagattttcaaacttttttggctcaaactttttttaaacttaataaaattttttgaaattttgcaggctaatagagcatccgaagggctctcgaatgatatcaagaaagttggattagcgtatttggcgtaaatttttgcgcgttaattcaaaagaaacgctgatcactgccttttttggagaccaattaacattaataaa

SEQ ID NO: 54218 - DNA, 107 bp, Heterodera glycines
  Genomic contig location: Contig_ID=SeqID_4377; Location=23..129; Strand=+
  SCN-specific regions: Sequence locations=1-107
agaaggttgttgagaagttggtgaaacatgtgacactgctaaatgcacttcatgatcgaggcgtcgacaacaaccaagagaatacaagcgattacccaaatttttga

SEQ ID NO: 54219 - DNA, 2708 bp, Heterodera glycines
  Genomic contig location: Contig_ID=SeqID_4378; Location=944..3651; Strand=+
  SCN-specific regions: Sequence locations=1-89,111-721,743-1056,1078 -1638,1660-1870,1892-1950,1987-2036,2059-2062,2123-2177,2199 -2271,2302-2317,2339-2496,2534-2550,2593-2649,2679-2683,2705-2708
  Gene Ontology: Mol. function=glucosidase activity; Cellular component= cell wall (sensu Fungi); Biological process=cell organization and biogenesis
atgagcagttcgagctccgttttgcaagacttgctcagagatcacagttccgaaattggcaattggagtgaaattgtcaacaaccatcaggttattttttcatttaattgttttttgaatataccttttggatatgccaagtaacgacattcctcaacttaccacaaacacaaatttggatcaaatattgtaaataagcaattatactggaaaattggaaattgcttggaccaaattatgctttatgtttatcgaagctgaaaattaggttttcgagtccgccaatttcatacaatatacacagattttgctaaaaattctggatgactgaattttcggttaaacttcgaactttgctccatccctttctaatcaacgaattcattgacaaatgtcatcaatttttctactgtttttcgatgtaattttgttggccatccaaaattttccgctttttaggatgagagttcgaaacctgagccatttaccaacattgaccacaacggaccattctacatttttgtgcccaatttaacgcttgactatgccgtggacagtgtgaacatggaagtctacaaaatgtttggtggacataaaaatgtatgcaatttagatagtgaaaacggtacttttaccgtttagtgaagatgttttatcgcatccatttttatccgcaaaatttctcaaaattgatttttcgcggattcgattccttttatattatttgaaattgcaaaaaatggcccattttcagcgcgtttcagatactctaaattgaaccgattcagcaaaaagattatccatttcaaaaacaaaaaatagaacaattttactattttaaacgccatttttgccgatttctccatttattgcatcattacaattattactagtagtcaagcaagaaaaacaaaatgatatcattagtctgtctctccaaatttgtcccccaatttttcagcttttcgctgtctacgcctatcggttggcgaagaaagtgtcgcaatcattcatgctgatggcacgggacttcgaaagctgtgttcaagtgttgaagatggaggagaaggtaaattcaatggaaaaaagcgaatggtcgaacgaatggaaggcactcacacaaatagagcccgaacagtacaatcgatacttatactttttacgcactttttcgaaaaccagaattcgctttacagcttttcccacggccctagtctctgggtcttgaatgaattttggaaaatgatgcaaaagacctagagttctgttaaaaaccaagaattttgtctggaattctgtccgggtctcaggaccgtcacaggatttcggctttgggaaatacggggtgatgacgaccttttttcccatttttatgcggcgcgctttttcaataattttttggggaatagtgggtttttgcatggacacacccattaagattgtcaatagcagcagcaaagaggttgtccgtcttgagtacgtgttgccgtccgtcgccccgccaaaaacgtttcattacaccactgaacagttggacaaccagttgcagtgctacaaaaatattcacccagcggaaggtgggattttttagtttatacgttttgcggaatttccatcgggttactgtattagaaccagcttgtgtattgtattctgtatggaaaaattggtgtgtaatgtatagcccaagtccggtgctacttaaaaagtgttgtccactccaaactaaaaactaaaggggggggggggctctcttggtttgcagaatgtttgtgataataaatcgtgaaagctttttcccatggattttcggggttgttgatcacaaatatgacatcaattttgactaattcctagcccgaacttgaacaaaagtcatgaaaattcaagtttctcgattatccgcttaatttacgtcggggattcagaatttgttgaatatggtaatacaactaattttatttccagaaaagccaaagaagagcccattcggcgatgcaaagccgatcaacaccaccaagaagttgttgagtgtggaggagaagctgcgcgaggagtccatcgccgccgctgctgctgccgccgctgccgttgcagcggccgctgcctctgccgccgctgcgtccgcctccggcacttcgtctgccacaactatgtcatttgttgcaaccgcaacgcctgccgctgctgcttccggcacttcggttccggtcgctgcttccgactccggtacttcgtccacaacaaatgcttcgttggttcccgccgcaacgcctgccgctgctgctcctgctgcttccggcacttcggttgcggcacaaccggcccgcggcggtggcgcaatttctgcttcccgaagttccactgcaagcgcgcctgctgttgccgccgcagcacgttctgcaatgtcgtccgtctctcgaagttcatcgtccgcaactgcgtctgttgctgccgccgcaacctccgcaacttccttctccagcggcacgccgtctgttggtgctgccactgttgctgctcctgctgttgccccggtgtatacagcgcacagcaacaaccacaacaataacatcaacagcagcaccaacaccattggccatggccatggagcggtggcgtcggcggctgcggcgaagaagccaaagggcaacaacaagaagaagaagaagtctttctcaaaaaatgtaattataaaaataatttga

SEQ ID NO: 54220 - DNA, 1263 bp, Heterodera glycines
  Genomic contig location: Contig_ID=SeqID_4379; Location=130..1392; Strand=-
  SCN-specific regions: Sequence locations=1-89,123-1105,1127-1263
atgaccacggaaacacacacgccgaggaagaagaagccaacggcacttccaacggcactttttcagtcaccgtctctcacccgtaagtttgggagaatatggaattaaatgccatgtttttggatataaaatggaaaaaaaaatttttttttcttacttttccgagcatcaactcttggcgtaacagttagtaatgtgtgagagctaaggttttcattagagcccagacgggatcagaattccgccgggatcccggcttatttttcaaaaaaaatcgtaaccccgacatttcgacgtttttaaattcccagactcaagtttctatgtcgaaaattgctacctctggaatttcttgtacctgttgattttctgtttgtttatcgttgactgcgcaattctttttttttctttttgtttttttttgtaatttcttaatcacttccctttttcctgaagggatttgcgattggaaaggattgctgctgatttgctgctgcgtttggtcatcgttcccgggtgcgttatgcttttggcattttgaagaaaattcattttttacgcttttgcggcattattttttgttttgtttttttctgatttcttttttttgtgccattttcaccacaattttggcactttcacagaaagcgtattcaattttcaccacaacggcaaccaacaaagaatcggacgaagcaaaagggcgacgaatgtttgacttttgaggacttcaaagtggcgaatgacgacaggggatggatccgagtgattgaggggggcggagtcaggaagaatggacaacgcaaggtggaaaacaattattaatattagctaattataatgtacaaaaaaacaccaaaaaaataatctcaaattcgtattcggatcattttgagcaggaaaaaggcatttacaggcacgcggattcgaaccgccctcgctgggtggtatggtggtgtctatctatgctcgagggctctgtgggtcctcatgggttcgaatccgcgcgcctacaaacaattttttttttgtgtcaacaccaaaacctaattgtaagacacgaaatttcgaatagggagttgatgaatgaatctgcgtgaaacaattatcattatattctaaaaaacaaactttccttaatttttaccaaaattttggttgaatatgccaatttcaggcaaccaggacagagcattggttgaagtttagtcgggaattgttcacatatgccatcattggtgagcaatttgtaaattaattaaa

SEQ ID NO: 54221 - DNA, 441 bp, Heterodera glycines
  Genomic contig location: Contig_ID=SeqID_23532; Location=725..1165; Strand=+
  SCN-specific regions: Sequence locations=1-441
atggcgacaggcgtggcgacaaatcagcaagggatgctacccttcccatcacgcaatttgcggagtgtatccatcccggtacggacagcgcgggacagaatcgagagagcatccgggactctcgccgctcgaattgcggaggctcgagaagtgatcgaccaagaccttaccgaaggggaggcaggctaccaagcagcgcgacttttggccatggagagaggactcaaggaggcaactcaaatcttccaaggacatttcgagattggaatggcagcagcgggagcagaacccgcaggtcaccaggacttcttctacgacatactgacgacgccactgccggcagcaacgaaacaattgcagttgcgaacccatccaacaccagctgaactgcttcaaatcgcggatgagcacatcggagacttaacgggcactcgaggatga

SEQ ID NO: 54222 - DNA, 363 bp, Heterodera glycines
  Genomic contig location: Contig_ID=SeqID_23534; Location=1358..1720; Strand=+
  SCN-specific regions: Sequence locations=1-73,97-183,222-363
atgaacagagctgcattaattttcttgaggtattaattgtacctgagtgtacctctcttccctcaaattagctgcttttttaaaaaatccaaaaagtggggacttgtaataccaaacgtttttacggatacgctcactacgttccgcgccccgaaattaaaaaaaacaacacttattatttcctattaaaaaaatttcaaaaattcattaataattaaaaagtatcaccgaaatcaaatcatatctttttgcaggttggtgaagcaattgcgtgagaatgtgctcaaatccatcgactttgaggagatggccggcgatgtgaacaaacggcgactcatccaaaagtcggtgttcatcgaatag

SEQ ID NO: 54223 - DNA, 64 bp, Heterodera glycines
  Genomic contig location: Contig_ID=SeqID_23539; Location=34..97; Strand=-
  SCN-specific regions: Sequence locations=1-64
atgaactcgcagacgtcgtgtggagtccgagcgctggtgcgaagaagcggaactcagtcggccg

SEQ ID NO: 54224 - DNA, 1487 bp, Heterodera glycines
  Genomic contig location: Contig_ID=SeqID_488; Location=611..2097; Strand=-
  SCN-specific regions: Sequence locations=1-403,429-714,736-821,843 -1197,1220-1359,1382-1487
atgtccattgaaggggatgacgttcgcgggtgggaaggacagacgatgttctacatggacggcacctacacactcccccaattcaaaacaaaattggccacccttttgggcgggagggcggcggagatcatgttcaccgggaccagcgttgggcatgtgcaggatgagcaagagtggctgcgtttggcagatcacgtgaatacaattaaaacacattccaatttgagtccagggtcggaattaggcaaacctatggtcagatgtggaccaggaacctcgagattttacgggtagtgatataaaagttgaatagggaccacaattctgcaccgttgctcactactgcattagcatcatgtctattatgaaagaaaatggcatatagttatgagcaatgaaaggcaaataaaaatttttttttaatttttgggagtttttaaatatttgcgccaaaaagccatttttaacgtgcgccaaaaagcacagcaccgcaaattgatgcagcagttttgccaatgacatattgcaacaacactgtgccaaaatcgaaagggtgaagcttgacattaacatggataatctaaaaaaaattagccggtaattttttatcaaaaaacaagttagaaaaacatagaagttccaacttttaattcgtaaatttggattttaaaccaaattcacatcaaacgacatataaagtacgcacttaattgaaaagtcatgaaattttaaaatttcgtctattcgaccacaatttaggcgtttggggcccgaaatgaatttaaaaagtcgtatttttactgcccaatttgaccctttctaaaaaattaaagctatttaaaaaatacgaatcgggtttcttctattctactgagtcagaatctatgaaccgaattattgtaaacactgatgaagttttctttttatggacatgcccccaaaaaaaatgttccgtcgcgagttatcgaggtatagttgaaatgccaattttgttttgttcattttttgtattgtcatgccacccccgtcctggctgggactgacccggttaggtggtcgattggcacatgagttacagcaaagacaaatcgatatttcgggttttcgtaaacgttccgctttgattttctaaaaaaatgagtgtagtgactttttgtgtccacaacaccgaaaaagtccgaattgaggttatgacgaaattttttaaaattttgtagattaatatagaaaccaaaagaactaatcgaatgttaccaaaaacatggttgataatgagaagagttgttagcaacgacgccgagacggtcggcgccgaaattagcgattttcattcttttttgggttcactaaaattctgagtgcatgtttgttattttagtaataaaatgtgattttaagcattctcggtccgccaacagttgtgtcacttgatgggcaccagcagcgtggacgggcttccgtctctttgcggagtcaagttctgaacg

SEQ ID NO: 54225 - DNA, 73 bp, Heterodera glycines
  Genomic contig location: Contig_ID=SeqID_489; Location=586..658; Strand=+
  SCN-specific regions: Sequence locations=1-73
tgaaggtcaacgaactgagaaacgtgttggagaagcgcggcatggacaagactggcatcaaagccaatctgat

SEQ ID NO: 54226 - DNA, 2298 bp, Heterodera glycines
  Genomic contig location: Contig_ID=SeqID_489; Location=1939..4236; Strand=+
  SCN-specific regions: Sequence locations=1-150,178-295,317-583,605 -1480,1502-1847,1869-1877,1899-2043,2069-2177,2200-2298
  Gene Ontology: Mol. function=double-stranded DNA binding; Cellular component=nucleus; Biological process=establishment and/or maintenance of chromatin architecture
atggacaaacaaaatgcaaccgatggcgaccaacagcaacagaatgttgcaccagttgatggtcaacaggcaaacgacgaaaccaccacaacagtagccgatgttggacaacaacaaaagcaacccatggtaaccggaaacgaacaatgacatttccctctcccccaatccaaaaaatgatatatttaacctgattattacgataatcgtctgtttgcatggcctgtttgggccaccgagaagttgccaagacggtgatgttgttggcttttatgtgaaaaaagcgaattggttcgcaataaataaacgggggacacattttgcacaacagaccaacaattgtactacaggaaacgataaccaaccacggtgatggtggtgatggtattgatcatcggaatgctcatgacgagacgaccgtccagccggtcaccgacccaattacgactggccaaaccggagatggtggcagtgacaaaaataacggccatggaaatggtggtgaccatcaaatggaccatgatgagccggacatcatcatcgagacgcccaagaaggcgatcaagactgagtgtgttgaagatgttgtgctgatcggccacaccgcttctgcgtcagccgtcggcagtgccgggcgtggtgcaggcaatggacacaaagccgcagagagaagtgatgaaagtgactgcaactgccgcaacaacaccgtcttcggcaaattgtgctgcgccatcaacagcagtttccaacaccgatcagcaaccgaaagcgccttcagcggtggtggcaaatggtgggacggcaccggaaaccgctggttcagctacggcgacaaaagttctatcagtggcgacaacgaacgcaaacaccgccgtgacgaacgccccgccgttgttgacgtcgtcctccgctggttcaactggtgatgacgtgatactgctcaacagcgaccaacagcagcaacgccagggcaaaattggcaaggagaaggacgctgttgctgcccagccgagcgatgattccgccggtgggaagaagcagtcggctgccacaccgacgggaacgacgagcggcacatcgacggcacaactggtggacgggaacaatttgtcgtcaagcctgtggatccgcaacattaccaccacgacgaaagcggcagacctcaaagtacatataggcacattccacttgattttttaagcctccatcggcttttaatcatgaaaaaattaggaataacgactcacaccccccagggttcaaaaattcgatcatttttcatgtcccaaaaaaaaaaaatttcgattgctaatgccagctaagtgttctggttcctttaaactccttggaaaaaattggcgtatcaaaaaaaaaacagtttctcgcataaaactgctctctgtacaacttttgtgctgatgccatgccccatctgtgttccacaccaaatggatggatgatgatgagatggttcatcaacaaaaacactgtttttaaggcgctgttctcaaagcacggcaaagtaatcacggcgaagattttcaccaccaaaaacaaacagtcgcccacctgttttggctacgtgacgctggccgatgcggagacggccaatgtgtgtgcacagaagctgaaccgctccaacttcaaggggcgcatcatcaacgtggaaaaggcaaacgcacacgcacaattattattagtcttatcctctccacccatcgaccgatcaaacattgctaattatactggtcactctgatcaagcatggtgacagaaattttttgactgattcttgtgttcacgagacttaatggctcgtgggttttcatggccaaaaatacgattaaattaagttggttttaaaatttcgtcatccctttttaatttaattggtgcttgctcattaattcccttttacgaatttggtgtgtgacaacagcgtcgtcggtctaccccttcccttcccaacactcttactcaccacatcgtctataaaaaaaaattgttgtaggccgaccgctccaacctgtcgcaaattggcacgcaacagcagcagcaacaacagccggcggcggcgagtgacggcagcggcgccaaaacggggacggcaaagagcggaggttcgagcaaagcggctggcgggtcgtcggatggcggcaaagggagcggcgctgaaccttccgcctcgtcctcctcctcaaagaaagtgcgtccgcggatcactgccgcgaccgcatcgcccacgcaacggcagcaccgcaacaacaacactaacagcgccaaaactgcccgccgcgg

SEQ ID NO: 54227 - DNA, 2954 bp, Heterodera glycines
  Genomic contig location: Contig_ID=SeqID_491; Location=1172..4125; Strand=+
  SCN-specific regions: Sequence locations=1-151,173-284,314-672,695 -750,773-873,902-972,995-1299,1330-1810,1835-1851,1873-2798,2821-2954
atgctttctcccttctcctacgatccgttctatcgccgttcgttgtggcctatggccactcatgttggcaacgtcctttcgcccttccgccagttggagcgtgaactcgaccacttcttcgaggggatgcagcccatggtgggcttttactaatcaaaattctttaaattttagcttttttgttttttagcttcgtgaccatgtcgctcagctgaacgtctcggacaagggcgacctcacttacaaagtgagtgggcacagaaatttaccgaattccatggctaattttcaattttttccttaaaattttcaggtcgatgtcagcggcttccgccccgaggagatcaacgtggaggtgattggtaatgagatcatcgtcaacggggaacaccgcgagcagaacgacagtgagttttgccattgttcgaataaatttcctccattttgtggccatgtttcgcgttttcagatccatatttttgcaaatcctcatattggggttattttgcgtcccaaaatatcacgcactgtccttgagttttcaaaaaaccaaaagcgtaccttttcgggttagggcctttggttggggggggggggggtttgtcctggtatgttccgaacctgtgattggtttaaatacagtttttcatgtctgaccaaatgctgttttctctgtgtttcattgcccccctccacctcaggcgaatcggtccaccgtcagctctcgcgccgcgtgctcatcccggagggcatccaaaaggagagcatcaagtgcgagctggacggcggtcgtttgttcatctgcggaatgaaaacggctggcgaaggcggacgtaccattcccattgaaatgaagaagaaggcggccgtggaccagcagaaggaggaggagaagcagcagtagaaaaggacggcggaagtgaagacggactgactgtcggtcgaccgaatgatccattgacattgatctttttattttgatacttttgcaaagtgatctataaattatttttccttcaattaagcgtttctaattaaggggatggtttttttcacgggaattagtcccaatgaattcataatggacatcgctttgaagaaatttcgttttaccaaaataatttaagatggcagaaattttggaattgtgcagtccaaaatgccaaataacagttctgaaaaagaaatccggcaaaaagagagagccacccataatctgatcactgatcaactgtctaaataataactaatcgttttcatatgaaaagctcgacaaaatcaacacattcggattgcttgcacactgttttgtttgtttttgcacagaattaaataatgacgaaacagaaaaatggagcagcgagattggctagagattcatatcaatttaataattaatcatatgaaaagtgttgttgttttgtgtctctttatttaattgtccttttttgtacgtttccatcgtttcgttcacttttctttgtccgttcatggcacacagcaaactccgatcaccacactgatcagcaagtcaatcatcagtcacagttccgtcatccgctcgtcatttaatgccgtagtgccattattggcgccaaactggagcgtcctggtcggcaccagtcaattccatgaaattttcaggtcgatgtcagcggcttccgccccgaggagatcaacgtggaggtgattggtaatgaaatcatcgtcaatggggaacatcgcgagcagaacgacagtgagttttgccattgttcgagtaattttatcggggttttggattttggtgagacaaatgtcagggcttgagtgttaatggattcatttaaatgcttttcggaaccatatttagccaatttaggcttacatttagcgaatcagagaaatatcgagaaacttcttttaatttggaaaatttatgtccgtatttcggtaatactggggtttgttccccccctttttttggcaaaaatttcaaatttttaaaagtcacgtaaaacattttttctggggttttcggggtcgctgatcacgaatccggcatccatttcgcccaattccgaaccccgaactcaaattcgaacaaaaagtcgaaaatttatttttcatcaaaattcaatttatttcaccaaatctattcaaatgcacgaaatcaacaacggaaagaatagattgacaattattcacaaggatagatttcaattctgagtgtaagaaccagtcgcggggtctataaaattctgtgaatgattcacagtaaaatgttgataaccctggggcagcattgagatggaattgtagccccgcccaatgaatgaccatttcgtgcatttgaatagatttggtgcaataaattgaattttgatgaaaaataaattttcgactttttgttcgaatttgagttcggggttcggaattgggcgaaatggatgccggattcgtgatcagcgaccccgaaaaccccagaaaaaatgttttacgtgacttttaaaaatttgaaatttttgccaaaaaagggggggaacaaaccccagtattaccgaaaatcagttttattggcttgtttatttaaatatttccagcgaaaacaaacttcattctgaatgctcaacggaacggtggaagcggcggtcactgccgcggtggccgacgattggacactttgcatgttgttgaagctttgtaacccaaagtaaattcccttgaagctgtgtaacccaaagtaaattcccctgtgcttaacggacaaatggagagttaacaatcttcataaataacaaagtgaagaaaagtgaacgagggaggaaggaaggaggagtatttatgcaaaaatatgaggggtcaacaatgaatgagtggagcgggaaaataacaaaaacataatgccacacatattcaaatgatgtctcccggacattaaccttcgtaaataggtgcaaattgagacaaaaaaa

SEQ ID NO: 54228 - DNA, 158 bp, Heterodera glycines
  Genomic contig location: Contig_ID=SeqID_491; Location=3761..3918; Strand=-
  SCN-specific regions: Sequence locations=1-158
gtccgttaagcacaggggaatttactttgggttacacagcttcaagggaatttactttgggttacaaagcttcaacaacatgcaaagtgtccaatcgtcggccaccgcggcagtgaccgccgcttccaccgttccgttgagcattcagaatgaagttt

SEQ ID NO: 54229 - DNA, 402 bp, Heterodera glycines
  Genomic contig location: Contig_ID=SeqID_493; Location=1203..1604; Strand=-
  SCN-specific regions: Sequence locations=1-402
atgcaccaatttccgaccctatcagtcctttctgtgtttccttttggtaggtcctttttgtcgggatttataacaaaattttagtgttttcagcttcccagtgtcattctgttctgctcagtgatttacgaaaccttctccaactgttctctgcttaaagaaagcgatgccgagaacgcgcaaaagcaaaccgtcgacaaagtctcgaaaatcagcgctattaggggcttaaagaatgacgaattcactatccgtgacttcagaggctaatggaggaagcaattgagaaagtgcaaattttgcgacgtcattttttgaaatgtttgttattgtactgtatatatatatattgtatatcgctgtttcgttcaacaatttcacccagacgggggaaagaataaa

SEQ ID NO: 54230 - DNA, 1132 bp, Heterodera glycines
  Genomic contig location: Contig_ID=SeqID_4380; Location=1533..2664; Strand=+
  SCN-specific regions: Sequence locations=1-45,67-84,106-201,223 -229,261-955,977-1040,1062-1132
atgacttttcagaaggtagttaggaatttttttctgaaaattcggatttttccagaatttctggaataactttttttctttagaatatagaaatcccaaataaatcccataaaattctcccgattttttgcctatttttaaagctttaattcacttaaattgaccggtcctccattgagttatgaattttcaaattttaacccaaatttccaaggaccaaaaaattgccaaaaaataaagaatttttaaaaaattattatgggtttttagtccacatcgaggctcaagacgagcgcttcgcgcccgttttttagcttattaggccgtttcgcggcctcagtcgggcgcttcgcgcccgtttctaaattttgttgaacttggacgggcgcttcgcgcccgtatttaaatgttgttgagctcatacgaggtacaaaaattgttggaagatgtgttggaagaggtacaacagtgattagaagaggtgcaacagtgattagaagaggtgcaacagtgattagaagaggtgcaacagtgattagaagaggtacgacagtgattagaagaggtacaacagtgatagaagaggtgcaacagtgataaaagaggtacaaatctgattagaagaggtacaaaagtcattagaagaggtacaaaagtgattagaagaggtacaacggtgattaaaaaggtacaaatgtgattagaagaagtacaaaagtgattaaaagaggtacaacggtgattaaaagaggtacaaaagtgattagaagaggtacaacggtgattaaaaaggtacaaatgtgattagaagaagtaaaaagtgattaaaagaggtacaacggtgattaaaaaggtacaaatgtgattagaagaggtacaacattggtcagaagaggtacaacagtgattaaaagaggtacaaaagtgattaaaagaggtacaacagtgattaaaagatgtacaaaagtgattaaaagacgtacaaaagtgaattaaaagaggtacaatagtgatcagaagaggttcaacagtgattaaaagatgtacaaaagtgattaaaagacgtacaaaagtgattaaaagaggtacaacggtgattaaaagaggtacaaaagtgattagaagaggtaca

SEQ ID NO: 54231 - DNA, 177 bp, Heterodera glycines
  Genomic contig location: Contig_ID=SeqID_23541; Location=146..322; Strand=-
  SCN-specific regions: Sequence locations=1-177
atgaattttatagtcagttttttggatgctaattgtgggcctttaataatttaaattgatgaatataaataatctttacatgctcatcgtgcaggacgaaaacacaaccataattgagaagccgatgagcaaaaatggtaaaagtgtgagcccagcgcggaccacctaaacaataaa

SEQ ID NO: 54232 - DNA, 235 bp, Heterodera glycines
  Genomic contig location: Contig_ID=SeqID_23541; Location=1008..1242; Strand=-
  SCN-specific regions: Sequence locations=1-235
ggtgcaccaatatttgagtaaattgcgccaaaaatgctagtgctcgcctaattctaagcctctgccacgcgttcagcatcaaataagcatcatcgacaccgagcgcaagcaccaaaaagggcgtaacacaaagcagtgacccttttaattgggaaaattttaaaaaaaacgacaaaattaaaattaccgaaacgaaagccgagccaaaacattccgccaagggctgtgcctgttt

SEQ ID NO: 54233 - DNA, 1889 bp, Heterodera glycines; identical to SEQ ID NO: 23541
  misc_feature (9)..(9): n is a, c, g, or t
  Genomic contig location: Contig_ID=SeqID_23541; Location=1..1889; Strand=+
  SCN-specific regions: Sequence locations=1-65,152-330,579-797,819 -872,914-1589,1611-1744,1766-1889

SEQ ID NO: 54234 - DNA, 501 bp, Heterodera glycines
  Genomic contig location: Contig_ID=SeqID_23542; Location=357..857; Strand=-
  SCN-specific regions: Sequence locations=1-7,49-210,232-303,366-501
atgccaaaacaacaccaacaacaacaacaacaagatcaacaacatcaaactgatgtgatcgaacatgatcactgctacgcgcgccccacaaaccagttatggaaattgaaaagacaaaaatacatgttgacatttaaactatgtaaaatgtgtgcacaagagctatacaaccgtaaggacgacataacagagtgtaacgatggaggtgtggacttgaactttcacctgtgcaaacattgtacaatgctcaacatgcgactcagcgatatgaattctgtgcaatttatggcatatcatccacgtaataacaactacaacaacaccaacaaccgcaataaaaacagaaacaataaaaacaacgataatgacgaaaatgacagtcaaaataacttttggtacgataattacggtcctacatactgtagaggtggtccaagaaacaactacatgcaaggaaaacgaaagtgcttggaaagaattgacatggacgacatgaattga

SEQ ID NO: 54235 - DNA, 725 bp, Heterodera glycines
  Genomic contig location: Contig_ID=SeqID_23544; Location=235..959; Strand=-
  SCN-specific regions: Sequence locations=1-15,38-98,135-338,370 -545,567-725
atgtctgcaatgataaagctgaaaaaattccacgaatttacgcagaaaatcatttgcatcggtcgaaattacagggatcatgcattggaattgtatacaattaatttttatttatttatttattttattttttacaggtccaacccggtgccaaaagaaccgctgatttttgctaaaacttcaaatgctttattactttctggtggagaaattaaaatgccgagtggatgttcggagctgcattatgaggtgggttcagttctctactacagttaacgcaatccaatcaatgcccattcacagtttctgcctacattcttgtttgtattgagagcttgaattttatagaatttttttaaaattttaattcgactttttgctcggtgctaaattaaatgttagatataggagcgccatctaacctaaagacgcatttccttttataaaataagtttaaggtggaacttggtgtggtaattggctccccgggcagtcggataaaaaaggaatcggcctttgattacattggcggttattgcattgcattggatatgactgatcgaggaatgcaagacaggcttaaaaaggcggggcatccgtggtttttggcgaaatccttcgacacgtcgtgcccaattggcgaattcatcaacaaaagtgttattcaaaacccccatgacattgaaatttactgtttgggtataatgaaccctataattttttaa

SEQ ID NO: 54236 - DNA, 531 bp, Heterodera glycines
  misc_feature (428)..(428): n is a, c, g, or t
  misc_feature (475)..(475): n is a, c, g, or t
  Genomic contig location: Contig_ID=SeqID_23548; Location=37..567; Strand=-
  SCN-specific regions: Sequence locations=1-113,249-377,401-428,451-531
atgaaaatacgcatattattcattccaattatatttttgatcatcaaaattcatcaaattaaaacggaaaataaaaaactaccgcaaaaatcatttgatgaaatatttggagaaaaatgggaagaaaaagaagaaaaacaacgaaatgaagagaataaaagagaaatcatttcaaaatattataaaataaaagagaaaataaaggaaaaaggaataaaatattcaaaaaaagaatgggataaaataaacacgaaaatagcgaagagtttggggacaaatgataattatattaaaaaatggattaaagaatttggtcttcaaagaaataaatgtcacaaatccaaaagtgatgaacaaaaacttgaaattgttcaaaaatttattgaaatgtcaaatgaatataagcaaaatagaaaatattcaagaanagaatggcaacaaaattatgaagaaattggcaagaaaattggcgtanaccgtgaaacaatccaaaatggaagaaacaatttggcattagcagtaaacgaataa

SEQ ID NO: 54237 - DNA, 151 bp, Heterodera glycines
  Genomic contig location: Contig_ID=SeqID_23548; Location=895..1045; Strand=-
  SCN-specific regions: Sequence locations=1-151
aatttttttttgtggatacttttgtcggattctgaatttgttcaagaattcaaaaaaaattgtgatggtcaatttttgtaatgagtcagaataatttttgccataattactcatgctttaatttaaatggattttaagcaattttatttgt

SEQ ID NO: 54238 - DNA, 167 bp, Heterodera glycines
  Genomic contig location: Contig_ID=SeqID_23550; Location=917..1083; Strand=-
  SCN-specific regions: Sequence locations=1-20,45-167
aattagccaatttataggtaaaattttgaaaaattttatgggaatttaatccaattcttaggggtgtaaaagtcgcgtttcgcgccaaaaagcgaaatgcgaaatgcgaaacgccaaaaaatgcgaataatgcgaaaggcgaaatgcgaaacctaggcacatccctg

SEQ ID NO: 54239 - DNA, 305 bp, Heterodera glycines
  Genomic contig location: Contig_ID=SeqID_23551; Location=334..638; Strand=+
  SCN-specific regions: Sequence locations=1-145,173-186,227-246,269-305
gtgcttccgtctgatcccgaaaatccaccaagttctgataaaattcctggcttatcagttggtgcacacgaattcacgtgccatgtgatcccttattttgatattcagtgatttacgatttgttatttgaaatttatgatggatgaatatatatatatattttttattatttcatttgaaatttttcagcaaaattaaaaatttttacagaatttgacatatttttccattgctaggcaaaatgccaaatttaaatataactttaaaatcaagtacatttgaaaaaatcaagtgcgtacattgaa

SEQ ID NO: 54240 - DNA, 740 bp, Heterodera glycines
  Genomic contig location: Contig_ID=SeqID_4383; Location=476..1215; Strand=+
  SCN-specific regions: Sequence locations=1-66,90-184,224-719
atggcgctggaagcaatggacttggacttgtcaactgacggcaacgacagcgagccatcactggccggtgattttgattttaaaaaattaacaaaaaaaagtttgaaatgggacagaagaaaggcacacatcagccaaccattggccatcctgacaatgagtggcgaaataaatagatttgctcataaattatcataaataaatatttttttaagatttaaaacggccagaaaatatggacatttctttaaaaatcctctattagaatggccctgtttcaaagctaaaattggaattttgcttcatttagtatttttttagcaccaattaaggcattttgacagtattttgcgatttttaagcacttaattgacaaccaaataaataattattcttaatcaattctgttgcagcacgtttgtcgtcagttgagaacaaccagaacaaaattctgcgaattctcgcggaacagaaggaaatgattgggaaattgcttaaggtggaaaaatgttgattaattaaaatttattacgcaaaaatgaattaataattaattccgaaatattataattaattgtgaattttcagattgtggcgggccccagcaaatgaaaaatgccgtgccgcacctaatgatcgcttacagagctttaacacgcttaatcttaacttaattttcatcgtatttttcatttttcttaaagcgataaaatattttaaatgcagagatggcaaaatta

SEQ ID NO: 54241 - DNA, 255 bp, Heterodera glycines
  Genomic contig location: Contig_ID=SeqID_4384; Location=1264..1518; Strand=-
  SCN-specific regions: Sequence locations=1-255
  Gene Ontology: Cellular component=CCR4-NOT core complex; Biological process=reproduction
tattctctttgaacgtttggttgctctccgtcctcacccgtggggcctgttgatcacattcatcgagctgatccgcaaccagcgctacggcttttggaagcacgaatttgtttattgtgccaccgaaattgaacggtcagtgagcatttatttgtttggctcactaattcatccgcttttttcagtttgttcctcagtgttgcaaattcctgcagtgtaagcggaccggaaagccatcactcgaacggaatttaa

SEQ ID NO: 54242 - DNA, 450 bp, Heterodera glycines
  Genomic contig location: Contig_ID=SeqID_4385; Location=163..612; Strand=-
  SCN-specific regions: Sequence locations=1-217,239-299,321-450
  Gene Ontology: Biological process=reproduction
acaagtgctgtttctgctgcagcctcgccgtgtgcccggctttgcctaccattggctggacatcattggccatcgcaatttcatcggccgtctgctctcggagagccaggatttggcgcgtacaagtgccatgtacacccaactgctgctttgtcatctcaagtttttggccccctttttgcgcaatgttcaactgccaaagcccattgcttacatctacaagggcactctgcgtgtgctgttggtgcttttgcacgactttccaggttttacccagtttcaccgccattcatcattcggctttcaatttttaaagaaattctctgcgaatactactacatactttgtgatgtgatcccggccaattgtgtgcagttgcgcaacttggtgctcagcgcttatccgtgcgacatgcgtcttcccgacccgttcaccgagacaatggcccgg

SEQ ID NO: 54243 - DNA, 238 bp, Heterodera glycines
  Genomic contig location: Contig_ID=SeqID_23552; Location=1393..1630; Strand=+
  SCN-specific regions: Sequence locations=1-238
atgatcacctccttttaccgtttttcggtccacggaaaaggaatcaatgtgaccaatcctaattcccaacttggtgaattttcatacaatccagaaatggattcaacatttcaaaattggctcgaccgttatgggcctttcatccaagttgacgggaaggacctccccgatcagatgcaagttcggctcctgctcggcaagctcggatcggaggagtacaaccgctatgcccaaaagg

SEQ ID NO: 54244 - DNA, 709 bp, Heterodera glycines
  Genomic contig location: Contig_ID=SeqID_23554; Location=280..988; Strand=+
  SCN-specific regions: Sequence locations=1-366,388-709
gaaaaggcttaaacatcgctcagacaattttcttggcagcattttattcaaacgtggaattgatcaattttcatcatctccgcttagcgataaaagtgatcgtttttcatacagtagtccatccaatttgtctgatcaccgttcggaagaagcgaaaagcaatgcatctgaaaatgactcgtccatccttagtgaacaaacagagaatgaaatcactccagcagctgactttgattatggacaaccgagcaattcttcagaacatttttcgtacagtgatgaagaaatgtcctacggtagagcgactactggagcccatgacaaaagaacacaaccaaatacagttgaactgagcagaacaccctccgataaagtggttagaaaatttggaaaagtgtccaaactgtcaaatcttggcgaaaagttgcatctatggcatttggaaaaaacattggatatgcgtctttggaagttaaaaatgaaggatgccagtatcgtaagacatttttccggtaaaaagcatgatcaggcttttccatccgattcttcgactggatcaagcatcagcgaccaaaaataaggctttgttgaccacaatgaatgatcaattagccaattactgtatcattaatttgcaaaattaggagaatagatttatttgcttattttcttgtaaaactatttctatgactggtttaaattcgtaaaa

SEQ ID NO: 54245 - DNA, 541 bp, Heterodera glycines
  Genomic contig location: Contig_ID=SeqID_23556; Location=270..810; Strand=-
  SCN-specific regions: Sequence locations=1-298,320-413,436-541
atggttctcgtcagcgaattttgtgcccaatttctctcctgcccgacaaagtcacttcgcgatcgactgaaccacccagaggaccgagtccgagttttgcagcaattgattgggaaaaaggtccagacaacatacaaggatcggaatggaatgcgcaaatctttcctcgttggtggaatgactgaacgaggcgcggcatttgaacccgcatatggacgtctgcgtaagccgttcaacattaacgtggcagcgcatttttatgctcgtcaccgtgtcaaattgcactacccctatgtgccatgcatcattgaaggctttacgcgtggtgaggaccgttattatccgatggaactgcttgaaattgtcgacgacaaaaagggagggcgattatttggtcgattgttcactgaaattgaggagcaggaggaggaggacaccaaaagtgaagcttcacattcttccaactcttcctatttacaatttaacggtaaaggctgcaaatggtatgaaagcattgacgaaattaccaacactgggcgtg

SEQ ID NO: 54246 - DNA, 327 bp, Heterodera glycines
  Genomic contig location: Contig_ID=SeqID_23559; Location=21..347; Strand=-
  SCN-specific regions: Sequence locations=1-64,86-96,120-120,148 -248,296-327
atgaccaagcactcggccattgtttcctcctgcgaaacgccgccttcgtccggcgcccaaacgccgacagcagcgacagacccacaaaatcaagctgtaccagaaacagttgcagcagaggaacaaacccagcagcagcagcaacctaaacggaagagttcgttgaattcgatggtcgcctcggcactcgccgacgcaccggcgactctcgcctcactgtttaatgtgccgagttcatcgtccattgaattggcagcacaaaacagtgaacaacagcagcggcagcagcagcaaaataatgaacggaaaagcggagaacaagcgccg

SEQ ID NO: 54247 - DNA, 793 bp, Heterodera glycines
  Genomic contig location: Contig_ID=SeqID_23561; Location=126..918; Strand=+
  SCN-specific regions: Sequence locations=1-8,31-93,115-125,155 -311,345-426,458-548,570-591,620-793
atgtccgccatgtttaagcaaaacaaaagcatggagagggtgcgtttcgcacaactgccgaactggttcccaaagagcttcgggcacgagggggtcgtccaaagtgttgatgaaaatctgaaaacaattttatttattttaataaaaaaatttagtgaccaaccataggaatctttatgtctttaatgcgtggaaggcagcttatatgggaatagtaatccgaaactgaagcaaagttgtgcacccgacgactgtaaaattcgtcaagccaaagaagcgaagtcgacgaccagattttctgaaaagataactaactgtagctgttttttaaacaaaaaattggtaaaagacaattcgttaaagccactcatataaccttaaaatgtattttaagttttaaacttacaaatggagataaaaccaatgttttttatactaattttaaataatttaattacagacccaaaagacctcgaaaccccataaaaagtagttttacacgaatttttgaaaatttttattcttttgaagaatggggtgaataaaccaaactattaccaaattttctaattttttttctttctacgtttgaaaatattttttaaaataaaaatttttagttttcaggacaacaaaatccatctcaacccacccgagtgattgcttactcgttcatccaccaatcccgacttcacatggggcagaacaaccattgcgtaattccgtcgaagtaatcgtttaacactttcagtgattatgtaattgtacaaacgtcgcccgccttgccaatcga

SEQ ID NO: 54248 - DNA, 1123 bp, Heterodera glycines
  Genomic contig location: Contig_ID=SeqID_23561; Location=45..1167; Strand=-
  SCN-specific regions: Sequence locations=1-232,254-423,452-473,495 -585,617-698,732-888,918-928,950-1012,1035-1123
gtggaaatggtgaaatggaagcgatgttccgagttcttgccaagttgtacccgcgaacttatttcattggcattggcttcagtatgggtgccaatgtgctgactaactgtttggcttctggactcgatccttctatttcttcgcgcattcttctcggcatttccgtttgccaaggctattgcgcttcggagtgctttgagtcgtttttttcacctttaattttcccttttagtgcttcttcccttttattcgattggcaaggcgggcgacgtttgtacaattacataatcactgaaagtgttaaacgattacttcgacggaattacgcaatggttgttctgccccatgtgaagtcgggattggtggatgaacgagtaagcaatcactcgggtgggttgagatggattttgttgtcctgaaaactaaaaatttttattttaaaaaatattttcaaacgtagaaagaaaaaaaattagaaaatttggtaatagtttggtttattcaccccattcttcaaaagaataaaaattttcaaaaattcgtgtaaaactactttttatggggtttcgaggtcttttgggtctgtaattaaattatttaaaattagtataaaaaacattggttttatctccatttgtaagtttaaaacttaaaatacattttaaggttatatgagtggctttaacgaattgtcttttaccaattttttgtttaaaaaacagctacagttagttatcttttcagaaaatctggtcgtcgacttcgcttctttggcttgacgaattttacagtcgtcgggtgcacaactttgcttcagtttcggattactattcccatataagctgccttccacgcattaaagacataaagattcctatggttggtcactaaatttttttattaaaataaataaaattgttttcagattttcatcaacactttggacgaccccctcgtgcccgaagctctttgggaaccagttcggcagttgtgcgaaacgcaccctctccatgcttttgttttgcttaaacatggcggacatttgggctttctcgagggcaattctctgaggcctcgctcgataacttggcttgaccgtttcatcctccaagttgctgcggca

SEQ ID NO: 54249 - DNA, 363 bp, Heterodera glycines
  Genomic contig location: Contig_ID=SeqID_23562; Location=713..1075; Strand=-
  SCN-specific regions: Sequence locations=1-205,227-363
cttattttatgcttttgcttttcttctcttaattacccgattagtgataaaaaaattgactgaaaaaattcacgtctcattcaacaacatcgaataaaatttgtcgcacaaagcctgacaatctaggcagaacgagccgtaataatgcatatcagtgcctccgaatctcgaatcccgacattttatgtaggtatccaccgtgcgctgaaatgggaccaaaggagccacaaatgcgcaaactgttgttgggatttgcagttctgggtgccaagctaaccaagaaaatgccgcgttgtcattttttggaaattgattaaaataattaaatgttttatatcattcgtataaatactagcatggcta

SEQ ID NO: 54250 - DNA, 3030 bp, Heterodera glycines
  Genomic contig location: Contig_ID=SeqID_4386; Location=2713..5742; Strand=+
  SCN-specific regions: Sequence locations=1-5,27-261,283-320,372 -725,768-913,938-960,982-1036,1058-1325,1347-1545,1611-1697,1720 -2156,2193-2615,2637-2776,2798-2800,2823-3030
atggtaatttttaaaaatttacttcaatttatttaatgaatttgaccaaaattttctaaaacatttttaaatccaatgcgaacaaaaattaacttttcgagttttcatggtgatccattttatgataacaaaaattcacaaaaacaagaaaaaataaatgttgttatttaagccaaatacaccagagaaagttggccaaaaacaatcggaaacgcagtcgaaaaaggagccgaaaaatgcgaaaccgacggaaaaatcgacacagtaagaaaactttacaaaaggaacaaatacgacacagaacggacacacctttaaacaatattttaataaaatttaaataaaaattcaaaaaaaaaaaacaaaaaattctttcgtgtttttaatacggccaaaaagtcgtcgtacaaatgaacattaaaagtgatttaatcaaaattaatttgattaattaacattttttgtattacatttgtccaaacaggttgcaaatgctgatctccaacgaaaagctgttgacggtgatgatgaaatatgtggagatgaagctgaaggacatgtccaagcagtacaaggagttccatgaaagggtaagcacagggacaccattagcatgggaattctcatcaattatcattcattacattttttggcaacgaagaagctggcgctactttaaagtggcgaatagggatcagatttatacggatgataattccaaaagttaaaaaatatatttaggaaataacaaatatttgtgaaatattggaacagccaaaatatttatgaaaatattgagtaagaattgaaacatttgcagtgctaaaaaatgaatgtttataaataagccaataattattcactggttgaagttgcaataagcacttttctatgatatgcctttttagaattgataaaatttaaaaatttaattttagacattaatagggattaatttagactaaatgttttctttcatttaaaggtgaaacaatggaaagatgacgtgcaattcataaaagcggcattcggagaggataaacaaatgtacaaaaagtacatggaaatggcggtcacttggccagagaaaaagtcgaaagggacaccggaaaaagtcccaaaatcgttgaagcagacccatctggacaatttggcacaaatggccaacaaatttgaggagttccgtcaggtggttaagcagtggcctgactcgggctgcttcatgacattcccgctggagaagaacgttttcaacaaggtgagaattgccagattttattgagttttaatttaaaaacatctatgaagagcagacaattgtaaagaaattacctttaaaattttttactgacaagtccaaaaatcaatccacaaaaggttttcctgttcgaccacgcgctgacgctgaaggaagatgatctgcagaaggaattggccacgggactttacactcacgcggaattccgcaaagaatcgccggctgatttcttcaacaacccggactggtcacagaagaaattggaggatgccgaaaaggatgacgatgaggatgaggatgatgacaaggaggaggaggaagaagaagaggacgatgatgatgaagaaggtgacgtgagaatggcgaccaacgcattgttggaggtactgcttgggagggacggacttgtggatttggacatgggaggagagtggtgttaatggagcaaaccaaaacaagtttaatggccagaaaaagtcagcagttgggatggagctgagaattaagaaaggatttggcagggcgtatcttttggctttgagtgcgtgtggtttaaggacaaaagcgatacgcaaatttcatattgaacctctttttaaaatagtgcttcattctcctaaaaaagctacgtaccatttaaattaaatccgaaagtttctcttatttcttaggcacttttgaaaggccgtgatggattcgggaaggaggcaacgctgaatctgcgcaatttgccaaaatgggacgggaagccgaatcagagcaaaagcatgtggcaaatggcgaagaaaattgtgcggaatctgatcaaatttgttaaatggcctttacgtattttttgggaatatagcaacaaattgacgagaaaggtgagagagagagtaggttctgttacaaatacaatttattcttaatattttatgaataataaataatacgtcagtattcagtgttaaactacagtaagatccttttcaaattactgtattattctgtaattcccacaggtgcgaaacgcaatgaaaagtaaggaagaaaaagaaaaaatgagaaaaaagctggaggaggtgaaaaaggatggcatgctttacaaaatttaccaaatgttggacaactcaaaaaacaaggcggaaaattttgatgaaaaagcgaagaaaaacatggaaaaggaggggatgaagccggacgagccgaccattgaccactcggcacacgaacagctgacagacaaagacaaacagcagcacccgttcactttcctgcagggtgaatgatttggggggggagggtaattatgctccaaattgggtaaatagtgaactataatgccataatgagcattaatgaggtaattgaagatcatactaattgatagaaagaggatgagagattgtggagcttaattagcacaaaacaaataacattgaatgcttacttgattgtcactattggaatgatgtattgaagggtaattaaaaaatcacaataattgggatttggtggtgcttttaggggtaaatgagtaaaatttaaattttgatcatcaaatatatgtatattagagaccggacaagagggtcggtcggtcggtttcagttaaaaaccgaaaaaaaaaccgaaaccgaaaaaaaccgaaaaactcaaaaatttgtcggtcggtcggtttcggttaaaaacccgaaaaaaaccgaaccgaaaaaaaccgaagaaaaattttcggtataccgtttcggtttcggtttttttgaatttttttatcttttcccaaaaaaaca

SEQ ID NO: 54251 - DNA, 409 bp, Heterodera glycines
  Genomic contig location: Contig_ID=SeqID_23563; Location=1..409; Strand=-
  SCN-specific regions: Sequence locations=1-409
  Gene Ontology: Mol. function=DNA-directed RNA polymerase activity; Cellular component=DNA-directed RNA polymerase I complex; Biological process=growth
gacggggcatgggacgtgagcaaatattgtgatgacatttcactgcgaatggtcagccaaagtgaagacgcactcgacttggagttcgacctggtcaacgtggaagcgcccattgccaatgctttgagacgcgttttaatatcggaggttggcgagacgaatttggggcattgaccggggattcgattttcaggtgccgagcatggccatcgagaaggtgttcctctaccagaacacttcttgcattcaagtcattaaattgttccgtttttcttagtttggctgaattcacaggacgaagtgctttgccaccgactcggtctcatcccaatttatgccgatgctcgccaattcactttccctccaccgccaaattcgtccgcaactcagcaaataaacacagacattt

SEQ ID NO: 54252 - DNA, 320 bp, Heterodera glycines
  Genomic contig location: Contig_ID=SeqID_23564; Location=80..399; Strand=+
  SCN-specific regions: Sequence locations=1-105,127-320
tgccaaaaaataattgtatttttcaaaaactgccaaattaactgttgaaaagtttcaacaattgttgtgaaacaatcaaaaataataaatgtattaacaaattttaaaatccattaaatccttttccattcctttcactcggccattttcctcgctaccaaaatgtacattccgtccaattcataaaacaattcgttgtccaattggtctctgttttgttccggggttttcccctttcatttcgaattgtgccgacctttctaaaatcagtccggcaccccgcaaacattccatcatcagttttcgactgacgaaaaggc

SEQ ID NO: 54253 - DNA, 1416 bp, Heterodera glycines
  misc_feature (645)..(645): n is a, c, g, or t
  Genomic contig location: Contig_ID=SeqID_23564; Location=217..1632; Strand=-
  SCN-specific regions: Sequence locations=1-563,586-695,717-834,856 -1416
ttccacgagcatttcgacaccgatgcctatctgaaagtggcaaatgccttccttggtcacttttatcgccccgtcaattaggacttttacgcgcgtgtggacgacgcggccatgcaaatggttctgttccatctgcccaacatcgtcgcccgcctcggctccctcccttcgctgctcgacttcggctcgggccccaccattcacgtggcggtgtgctttcgccacacggccgaagaggtgaaaatgggcgagggaaaagcaatgctttgaaacggggaatgaagcagtacaacgaccgacagatttatctggcggattatctgccccaaaaccgtgacgaattgtgccaatggctgagcggacaaagcaaattcgattggagcaccgtaatgagggtaaaagcatcaaagggggggggggggcggcagtccaaccgcggacattttcagataatcgctgctcgtgaggcggtcccattgagcgaaataaggcaaatggagcagaaagcgagggaaaaggtgcgcgagaagtcattttgcaaaagaccgtccaaagggtgtcgattaattgccctaatttgttcttttgtccatcctcccttttgcctccccaaggttttgggttgggcactaattttgcgttggnaggtggcccccccgttaatccccccgccctcccttgaatatgcccccccttcccctctcccctttccttcagattcgtgccgttctcttctgcgactgccattcctttccctccgtgcaaatcccccgacaaaatccgacgcgacaaaactttttcggaatttcccaccgatggacagtaagaaatctaatattttttatttcattcaattctcccacaggccatcacaacattcttcaccttgaagtactgctgcttgagcagctacgaatacgcatggcaattaatcatttgagtgcccatttgcgcccgacggagtgctaataatgggcggagtgttggaggaaacgtaaaaaaaggggggcggggcgggcaaaagccatttgacaattcggtggaagtccaaaagtcaaatggcaaaaggttaactaactgatcaaacattgattgtgatcggagcaataattttaattggttttacaatttatttttgctttcttttcgagtttttggccttctccgattaaatatttgaacttttccaatgctttttcagttggtgtgcttttggtggccgacagttcaaatgccttttcgtcagtcgaaaactgatgatggaatgtttgcggggtgccggactgattttagaaaggtcggcacaattcgaaatgaaaggggaaaaccccggaacaaaacagagaccaattggacaacgaattgttttatgaattggacggaatgtacattttggtagcgaggaaaatggccgag

SEQ ID NO: 54254 - DNA, 863 bp, Heterodera glycines
  Genomic contig location: Contig_ID=SeqID_23565; Location=52..914; Strand=+
  SCN-specific regions: Sequence locations=1-73,96-188,220-382,406 -443,465-828,850-863
atgccagagggagggtatgagagagctgaaaatcagagtaaaatagcggtgaaatattttgagtggcttgcccaaagaaaaggagtaaaagtgcggcatgcgtgtaacggaggggaagtagaatttggtgggctgaaagtggactgtgcgattggggcagagaaaaaaataattgagtttcaggtaaaagtaaaaatattttctttttaaacaatacttaaggggtgtgcatttcacgggtgtccgagatgttttttaccttggactatagcgccaaacggacggacaatagaagagaatcaaagtagaaccgaaattcgcatggaaattttgagggaaaagtgcaaaaatttttcaatcggagaagtttgggtagaataaaacatttagaaatatttattaattgttagttttaggagtgtgacgtgaaagaggaattgaagaaaaataaggagatgaaaaaattctttgaaagtgtgccggacaagggaccgatcaatccgagggatgcttatgccgggggaagaacgatgccattttgtttgtacgcaaaggctaccgaagaaatggagatctcaatgtttgacatcattagtttgtacccctttgttaattatggtaaaaatctgcataatttttgttaaagtttcctttcgcttaagacaccccataccccgtcggggtcccgaaaattatagtgagcaggaatttcaatgtgaattggacagtgctcgatgacgtgccctatgatggacttttgaaagtaaaagcgatcccaccgaaaaatcttttgtaccccctcctccccatgcacatcaataagataaggtcccaggggccggggtccagacccctgaacctga

SEQ ID NO: 54255 - DNA, 902 bp, Heterodera glycines
  Genomic contig location: Contig_ID=SeqID_23566; Location=1018..1919; Strand=-
  SCN-specific regions: Sequence locations=1-240,262-902
atgagtcattcttttagcagcacagagcgcgaccaaatggcacaacaaacaacgggcgaagaaatgaacaaaatgaagcaacaaatgaaggaatcgtatgaggagttgaagcgttgggatgaagcggagcgggtgacggacaacataatcccggaagatcgtgtaatgacaaatggcactaggcgtgagcgggtgtaagcccttatataagccctcgtgagggagtgtaagctcgttatataagcatggggtggaagtgaaatagaagctcgcgagggagtgctatatgagatttgggggatccctgtcctggatctcaggatcaattgtttggttctcgcaatcagtatgcgctcgggagtctcgggtcccgagcagtctatctaagcctcagggccagttgggtacttcaattatttgcaacattcacaaagagccggccacaagtactcacacgcataaagatcaagaccagatattcggtaatgactcattggtccgattcctgaatcaatttttccttttgggtcgtaatccgaggatctgatctggagtcttaaagagccagtctcaaaattattctggattttgtagtattatctgctcgaaagtaaagtctcgggtggtgggtggtacatttactccttctaaagttcgggcaaatttgtgttgttccgaaaagtaaaaaatcactgcccaattttcaggggctcatgagagacgaaaaagcttacgagaagataaggatggaagaaggaaatgaaggctgatggaagcgggctgtaaagattttcaaaatgatctgaccagtgatcagagatgtctcctattttctaaaatggttaagtattttcatccttaggatgtaccgtatgactcacaaattggggtatctgattaaa

SEQ ID NO: 54256 - DNA, 959 bp, Heterodera glycines
  Genomic contig location: Contig_ID=SeqID_23566; Location=548..1506; Strand=+
  SCN-specific regions: Sequence locations=1-159,192-296,343-959
atgaaagaatttatggaggcgtgccaagtgttgggacaatatgccaacattgacctgaacgaaagaagcattcaaaacattgcggaaagcatcgatttcaacaaggacggattcattgacctgaacgaattgctggaggcatttcgactcgtcgacatcggaaaattgtgaaaatttggggaaaaatttccggatttttgtttcactgaaccttatcaaacctgatttgctcattttataaccatgatattcaacgattcacaaaatgcattcatatgtattattttaaaccgatgtaaatatttatattaaaaatattaatttttaatattttgtaattttcgggaaaggtggcaggtttttgccattttcgcgggaattaagttgactaccttattcaaacagctagttttttgatttggcattgattcgaaaacggcatttaatcgggataaaagccaattgttaattttaatcagataccccaatttgtgagtcatacggtacatcctaaggatgaaaatacttaaccattttagaaaataggagacatctctgatcactggtcagatcattttgaaaatctttacagcccgcttccatcagccttcatttccttcttccatccttatcttctcgtaagctttttcgtctctcatgagcccctgaaaattgggcagtgattttttacttttcggaacaacacaaatttgcccgaactttagaaggagtaaatgtaccacccaccacccgagactttactttcgagcagataatactacaaaatccagaataattttgagactggctctttaagactccagatcagatcctcggattacgacccaaaaggaaaaattgattcaggaatcggaccaatgagtcattaccgaatatctggtcttgatctttatgcgtgtgagtacttgtggccggctctttgtgaatgttgcaaataa

SEQ ID NO: 54257 - DNA, 886 bp, Heterodera glycines
  Genomic contig location: Contig_ID=SeqID_23567; Location=118..1003; Strand=+
  SCN-specific regions: Sequence locations=1-277,301-397,421-601,635 -679,702-862,885-886
actcaacccaacagcattccaatcactggcactcaacccaccagcatttcaatcactgggactcaacccaacagcattccaatcactgggactcaattctcctgcatttcaatcactggcactcaacccaccagcatttcaatcactgggactcaacccaccaacatttcaatcactggcactcaattctcctgcatttcaatcactggcactcaattctcctgcatttcaatcactggcactcaattctcctgcatttcaatcactggcactcaacccaccagcattccaatcactggcactcaattctcctgcattccaatcactgggactcaacccaccagcatttcaatcactggcactcaattctcctgcatttcaatcactgggactcaacccaccagcattccaatcactggcactcaattctcctgcatttcaatcactggcactcaacccaccagcattaaaaccgacagcggctcgaccgcttagcggcctcgcactcttcttttggcattttcttatggcataacagttcttccttgtttcttgactttttcttacgcacaacatttttcttctatacaaatttttcaaacaaattctcattcattcatttaaaatttcattaccatttacataagcaaaacaatatctttcatatcaaaaccaaatcaatttataacacaaacaacaaagaaagaaaaagaaacatttttaagactgttttttacataaaatgacaaaagaaaaaaatgtaaaacaaaaacatttcatttttcaaagcatttatacaacacaacacaatgttaatattataggattttcttagtgaacaaactaaggggtgtcctctttcttttgttaaatattttatacaata

SEQ ID NO: 54258 - DNA, 1724 bp, Heterodera glycines; identical to SEQ ID NO: 23568
  Genomic contig location: Contig_ID=SeqID_23568; Location=1..1724; Strand=+
  SCN-specific regions: Sequence locations=1-176,207-289,311-459,495 -630,680-750,772-783,805-1724

SEQ ID NO: 54259 - DNA, 173 bp, Heterodera glycines
  Genomic contig location: Contig_ID=SeqID_23570; Location=140..312; Strand=-
  SCN-specific regions: Sequence locations=1-173
atggcctctcctactgagaatttggaagatgaatcatgggttgaataccattattctgaatcagaagttgaagagcttgacgaattcagtcttctgcacagtcaaatggtgccaaaccgagtggtgccgtgctgcgtgaattgtgccgaaattatggtcagatcagatcacat

SEQ ID NO: 54260 - DNA, 1008 bp, Heterodera glycines
  misc_feature (951)..(951): n is a, c, g, or t
  Genomic contig location: Contig_ID=SeqID_23571; Location=21..1028; Strand=-
  SCN-specific regions: Sequence locations=1-228,250-373,396-827,850 -1008
atgaatgttgttgaattctccccgatggaaacacatgcaaattcggcacatataatctatcgagtcacacttctgcctcaatcatccacacttgtcgaattgtcaatgaccaatggacaagaagacaaagaagtcactgtaataggaagaaatgatttggatgagcaactaagaattgagcctactttaacatctagcaaaaacggacaaatcgctgtgccgatcacaaacttttcgtcaattccaattacactggaagcgaatgaaagtgtcgcattggtcgagcatgtcgatgaatggcacgaattggaacattcgtttttccctccgttcttcgtcagcagcgtcacacatgaaaatgaaaacatacgcactgaacaaatcaaagaaatcttacgaactcgtattggcatgtctcagcaacacgaagcggacaaattggaacgtttaataattggtttcgaacaaatttttgcactcgatgacagcgaactgacacaaactgaaataactcagcatttcattaacaccggcgatgcctcaccaattcgaggccggatgcgtccactgccatttgcacatcgtgaaaaagtttcaatgatgcttcaagattatttgagcagaggattgattcggccgtcaaaatcgccatgggcaagccccattgtccttgtcccgaaacgtgatggaagcttaagattttgcgttgattaccgaggaattaattcggtcacagtgaaagacgcatacccgttgccgaacattgattacattcttctcgcattgggaggaaaaaaatacttctcaaccctcgacttcctttcgggatattggcaaattaaaatggacgagaagtccattgaaaaaacagcgttcgtcacagaatttggactgcatgaattcacggtgcttccgtttggactttgtaatgctgtagcaacttaccagcgnatcatgtctcgtctttttgaagatctgatcaatgatttttgtcttcgtttatcttga

SEQ ID NO: 54261 - DNA, 439 bp, Heterodera glycines
  Genomic contig location: Contig_ID=SeqID_23572; Location=688..1126; Strand=-
  SCN-specific regions: Sequence locations=1-1,24-161,191-326,356-439
aaaatctataaaaaatttaaaaatgagaattcatgcgagattttctggaaataagcttaatagggcctagttaagctgtaaaaaaaaatttggggcgatttgaaagagaatagaaagaaccaggttcgatgaagttttggtaagccaaaaaaaatccaaacatttaaaaatctataaaaaatttaaaaatgagaattcatgcgagattttctggaaataagcttaatagggccttgttaagctgtaaaaaaaatttggggcgatttgaaagagaatagaaagagccaggttcgatgaagttttggtaagccaaaaaaaatccaaacatttaaaaatctataaaaaatttaaaaatgagaattcatgcgagattttctggaaataagcttaatagggcctagttaagctgtaaaaaaaatttggggcgatttgaaagaga

SEQ ID NO: 54262 - DNA, 1756 bp, Heterodera glycines
  Genomic contig location: Contig_ID=SeqID_4387; Location=3158..4913; Strand=+
  SCN-specific regions: Sequence locations=1-287,309-743,765-1020,1043 -1144,1166-1756
atggtgagccagtgacaaaggcttggtcatatactgtaggtagagatttacccaaatttagaaatttttaaactagcttttggaaaacactgttatctagtaacataaaaaatagggacttttacagtgtgttgcaaaaaaagtataaggacagattaaaagtgagcaaattcctaacaaaaaccaacctgaaactgataaaacaagctaagataaataacaaaaaaacaaatgtttttattatttctattgatttcgcgggcagaaaattgcagcttttccttgtcctttattttccttatatttttgcaacacaatgtacctaatgggatatcgttttataattttggattatattaaacaattttgatattgtatcataaattaagaccgcaatcacttaaacggtaaaaattggtgagaaacagagcaaatttcataccatggaaaacgggtacattgacgtgacatctatcgaagaacaacaggaatatgcggaaactgagcatcaaaatacaaggtaatgtcaaacagcgacaaacgaaaaagttttatagtacacatgtgaacagcattcttttttgttgtatttagtgcgttttgatcgtgttgcaaaaggtttttgactttttgttcgattccgggttcggaatccgagatccataacgcgaaagcccctagaaacatatctacgacttttgaaaacaaaaaaaacattcaaaaaaggtgtaccatctaaattagatatttcccataattcacagctctcatctcaatggcggtccgtccgacgttccaaattgacccgcgaagtggcgatcgatcggattttggatgaacgcggcaaaaagggtgcaacggaacatcagtaccttgtcaagtggaagagtgtcaagcagtgctgggtcaacgcggacgaactgaagaaattcccgtcacttacggatgcgtttaaggttctcttttttggcactttgagacgcgaacaattgaagacattggttccctctctgtttaaaattttaaataactcatataaaacgccttccctggtgttttaattgtctttgatcacgaatctgacatacatttcgaccaattccgaaccttggaccaagctctaacaaaaattcggatacaaaattttcacattttacttttgtggataatgttttattttgtgccatccattttcagaagaagaggggcaacatactcaatttcgaggaagaggaatttgacgagatcatcagcaatggcaccagcaagcgcgacaacagtccgtacaccgaccacgactacgcaggcacgcgccaattggcgacggcgaagggagcgaccggcaaacaccaacggcagaagggcggcggagggacggcgaaagagccgaaaaagaaaacggcacttgtcagtgggaccgattcgggggtccgttcatcggcacggccgcaccgtccgaccaaacgttttggtgggcgataattatttggacaaatttgatacattttcacttacagacagacaatgaatgaattttaaggattgagtttatttggtcgttttttcagtagaggaaacaaacgaatcattcattcgtgggacttcgaaagtgcgccgaacatcgccacgcaaacatggcaagaaatcgactgcggagggaggaagcgaaggggaagaatcggaggatgacgggaaggagtacagcgtggaaaaagtgttgaagaagcgtgtgaagggtggaaaaatggaatacttt

SEQ ID NO: 54263 - DNA, 1417 bp, Heterodera glycines
  Genomic contig location: Contig_ID=SeqID_4387; Location=1..1417; Strand=-
  SCN-specific regions: Sequence locations=1-72,97-775,797-1076,1098 -1234,1257-1417
ggcggtatgggacgtatagtagaaatagacgagtcgaaattttttcggtaaaatttgttgtttgagaacatgttgtggtttgttggtaattttctgcgtcattggttgcctctattcgtcgtagatttgctgtgagatcattaattcgtcgtgtggagtattgttgttgtttttgttgctgttttaattcgttgccttttgatcagttggatttgacgtgttttgtcaacgtttcatttgtgaattcaaaaacgcacttaagggccaaatataacagaggaagaatgttgcaacgccaatatgattgggtgtttgggatgttggagagaggcacaaacaaagtgcgttttttcccggtcgcggaacgtgatgccgctacgctcttgccgttaattgctcaaaacattgaaccgggaacattgattgtgtctgatggctgggccgcttacggagggattcaaaacatgcagcagcaatacgatcaccactgggtgaatcaccgtgttttctttgtagacccccaagaccggcaagtgcatacgcaaggcattgaggcaacttggggtgcactgaagacttctctccgacacttacgtggttcaaatgaggaaatgctgccgacatatttgtatcagtacatgttcagaagataccacgcaaacgacaaaattttcattgatccatccaaattggaattcgccgccatctgcaggtgcctcggaaccgtccactgatttgaatgagggagtgtttgcaggtgcgcgtaattaaatcgtaaagaaaaaagatggaatatttttgaacaggtgaacaatcagcacaatacagagcaggccatgtttatcgtcaaaagcatttacaagaagaacttggcaaaagattttgtcagaggcatttggaaaattccggtgagttttctttaaatcaatgttttgttgatctgaatgttaaaatcgcttagttacacgagaagccgggtatcgacactgtgaacacattgctggagctgctcgaaggaatgatgaccaaaaacagcgaaagcgcgcaccaagacaacgatgaggaaaacagggaaaacatggaacgagtgatcagtttgtttggaaataggcgtctaccggcagccaacattgacgcacccattgcttcgactccccaagaagaccagtcgaaccaactcttgtccttggtattttgcttcatttctcgttacgttccgcaactaatatttgctttggttttaggctgggtatggtccggttgcgcctcgtgagtcatcgaccgaagatcgctcgcttccctgcttcgtcgacagaatggcggaatggtgtcgatccgtggaagggcaaacgatgttcgtcatgggcgccattgtctctgcacatctcaccgctgaactgagcgccatgcctgaagc

SEQ ID NO: 54264 - DNA, 921 bp, Heterodera glycines
  misc_feature (33)..(33): n is a, c, g, or t
  misc_feature (46)..(47): n is a, c, g, or t
  misc_feature (54)..(54): n is a, c, g, or t
  misc_feature (74)..(74): n is a, c, g, or t
  misc_feature (86)..(86): n is a, c, g, or t
  misc_feature (96)..(96): n is a, c, g, or t
  misc_feature (98)..(98): n is a, c, g, or t
  misc_feature (105)..(105): n is a, c, g, or t
  misc_feature (118)..(118): n is a, c, g, or t
  misc_feature (121)..(123): n is a, c, g, or t
  misc_feature (125)..(125): n is a, c, g, or t
  misc_feature (129)..(129): n is a, c, g, or t
  misc_feature (139)..(139): n is a, c, g, or t
  misc_feature (149)..(149): n is a, c, g, or t
  misc_feature (161)..(162): n is a, c, g, or t
  misc_feature (164)..(164): n is a, c, g, or t
  misc_feature (166)..(166): n is a, c, g, or t
  misc_feature (172)..(174): n is a, c, g, or t
  misc_feature (183)..(183): n is a, c, g, or t
  misc_feature (189)..(190): n is a, c, g, or t
  misc_feature (195)..(195): n is a, c, g, or t
  misc_feature (200)..(202): n is a, c, g, or t
  misc_feature (208)..(208): n is a, c, g, or t
  misc_feature (211)..(213): n is a, c, g, or t
  misc_feature (218)..(218): n is a, c, g, or t
  misc_feature (228)..(228): n is a, c, g, or t
  misc_feature (232)..(232): n is a, c, g, or t
  misc_feature (234)..(234): n is a, c, g, or t
  misc_feature (243)..(243): n is a, c, g, or t
  misc_feature (252)..(253): n is a, c, g, or t
  misc_feature (264)..(264): n is a, c, g, or t
  misc_feature (271)..(272): n is a, c, g, or t
  misc_feature (280)..(281): n is a, c, g, or t
  misc_feature (289)..(290): n is a, c, g, or t
  misc_feature (298)..(298): n is a, c, g, or t
  misc_feature (337)..(338): n is a, c, g, or t
  misc_feature (391)..(391): n is a, c, g, or t
  misc_feature (398)..(398): n is a, c, g, or t
  misc_feature (407)..(407): n is a, c, g, or t
  misc_feature (409)..(410): n is a, c, g, or t
  misc_feature (442)..(442): n is a, c, g, or t
  misc_feature (449)..(449): n is a, c, g, or t
  misc_feature (453)..(453): n is a, c, g, or t
  misc_feature (460)..(460): n is a, c, g, or t
  misc_feature (468)..(468): n is a, c, g, or t
  misc_feature (471)..(471): n is a, c, g, or t
  misc_feature (484)..(486): n is a, c, g, or t
  misc_feature (492)..(493): n is a, c, g, or t
  Genomic contig location: Contig_ID=SeqID_4388; Location=21..941; Strand=+
  SCN-specific regions: Sequence locations=1-281,414-602,624-745,767 -885,910-921
  Gene Ontology: Cellular component=integral to membrane; Biological process=embryogenesis and morphogenesis
atggcaagaaatcgatccttcgaggtaggaagngaaggggaagaannggaggangaccctttggaggacagcgnggaaaaagaggncaagaagcgngngaagggnggaaaaagggaanacnnngngagnggggcgacangaaaaggggngaaaaacagaanncncnaaaagnnnaacaaaaanaggcannacganagacnnnaaggcncgnnnaaggncaaaggggcngggnangacgacggnaggaacacnngggaaccgcgngagagcnngaaacacnnggaagggnncaagcagnacgagaaggcgcaacaaaaggcggcggagaaaaacaagnnggaagccgaagagacggaggaggacgaagaagaggaagacgaggacaacgaanacaaagnggagaaagngnnggacagacgcgagaagggcggcagaggggagnacagagngagncggacgnaaggcaanggnggaaaagcaccannngcaaannagaacaaagggaagggctatgacgacagttggaactcgtgggagccgagcaaaagcgggaagcattttgaggtcgtcaaacagtacgagaaggagtggaaacagcaacaccagcaggagaaacagcagccggtgtctgcaaagcgttcgcttcgtttgtcggtgggtcacaaattgcaaagcgacgaaaactgcacaaaggctgtttggtgtattaagcgcaccgaacaaacaccgacctcaaagggcactactccgtcctcatccgtcagtgtgtcgaccaagcgcattcgcgtggtggtccgaaaggagcaggacgacggaccggcgcacgtggaacagaccgagatggacgctgtctcggtggagaccaaagagttggcgcccaagacgccctccaaaaagaaaaagaaacgctcacgctattga

SEQ ID NO: 54265 - DNA, 986 bp, Heterodera glycines
  Genomic contig location: Contig_ID=SeqID_4388; Location=1357..2342; Strand=+
  SCN-specific regions: Sequence locations=1-1,23-375,397-493,516 -545,567-622,644-866,890-924,946-986
atgacttttgattttgaaaagagaggtgacaacgccgacgatgaggacagctctgccgatgaatgttcttcaagcactggtagcggtacaccaaacagcgaatattcggttgggcatggcgagcggcaattatgccgaatttgcatttgttggttgtgatcccttattttttcaattgttttttttaccacaaattgggtgccattgctataaaggatttaattcgaacccttctcccccatgcatgttttttcaaacaatttgtattcattaaaaggtggatgagataatcgggcacagaattgaaaatgggacggacaaatggagggtccgatggaaagggtgggcgccgaagtacgacacgtgggagccgcgtgagaatttctccaattctatgcatcttctggacaaatttgaagccgaacgacttgccgaacaatgcaaagagaatgtgagttgctctgaacgtaagcattctcattaaatagtggaaattattttatttattcattttgcgtttctccgttaatgcctattattattctctaattgtgcattttaaaatatgggcggtgcttttgaattttgcataaagtttactgtttttaaaggctctctttttaaattgttattcggttaaaatcgccatttttctttccttttttttctttattgattattgccttttttctgtccctccgttactgtttttgttgtatcctttttcatcctttcaggaggctgttgcaacccatccaatgtccaataataataatcagtcggattatgtccaaaagttgcgtccccatcgttcgctgtgccttcctccgacttccgccgctgtgccatcggccggcagaaaaggaccaaagaagaaaggaagtgccaaacgaacgacggcggcaaaaactcccgtttcaattccacttttggaggccaaggcgatgctgcacacgtcgagagtccgagtttttattcttgtgtaa

SEQ ID NO: 54266 - DNA, 1861 bp, Heterodera glycines
  Genomic contig location: Contig_ID=SeqID_23574; Location=1..1861; Strand=-
  SCN-specific regions: Sequence locations=1-298,322-371,394-698,738 -885,907-1342,1364-1403,1427-1475,1497-1646,1668-1719,1741-1861
  Gene Ontology: Mol. function=valine-tRNA ligase activity; Cellular component=intracellular; Biological process=translational elongation
tgcaaaaactttggcagggcacgcgcttcgttctcagtcggcttgggcccgactttattcccagcgatacgtttgaggtaaaaacggacaaagtgttggaaaaacaaatgccaacttttcccaatattctaattaatgccaattcttaaaataagtccaatttctgggttcaccaaagaagttggtctaattgtaagataactgatttttgtgttattttttggcaataaaacatgtctaaatggaataaaagacaaaaaagccgattagggcatccactcgttgattatttattttattgcaaaatgtttttgtttgttttaagccttccactttggcacttaatttggccgaccggtggcttctctcccgactgtcccattgtgtttctgaatgcgatgtcggcttccgcacttacaacttccggcagctgacctccgccattcaccacttttggatccacgaattctgcgacatttatttggagtcggtgaagagtatttttgtcgtcaacaatgccaacaaaaagggggcggacgcaattgcggaagagcgaagccaaaacggcaccgatgaagtgacaacgcaaaaggtaattacacaaacaattcattagattattatctatggtacactacatttccaagagcaggtcatcccacctctaaaatttaaaaaaactttcagtaaagtctaagaattttttaaagatattaaaagaaaaaaatttaaattttcggcgactttttggaaaatttttttgaaaaacaaacgtcatgaaattttgaataaaaaatctaaaaaatatgcaattttcttgtaatttttcttataaaattttaagcttttttgttgaaaattttttttattaaaaaggagtttggcttatattttcattttcattcacatcgaaagttttccttgggtgacttattcctgtgtttaaatttgtttatggatttggcttatcccccccccccaaaggctgttacgactgctcggcatgtgctccatttggcggtggacagtgccctccgtctgttggcccccattatgccgttcattgcggaagagctttggcagcggttgcccgcccggccgtccgaacgtgcggagagcgtttgcgtggcgcactacccacagccggcggaggtatcataaaaatgctctctcgccatggaattgtttgataaatttcatttttcaatgatttgaatttaaaaaaatgcaattgtgtcccctgttcagtttccgttccatgacaaagaagccgaggccaactatgaggtattgcgcgaaaaagtgatcgccaaagcaaattgaaccgaaaaaattgttaatgtgaaatttgtttgaaaatattgtcaatttgaccccagaattcattcattgcatgcctatcaaattgaatattgttgttttgttgaccttacattattcttattccgttcgtattcacctttttgtgaacaattggatgaaaaaagcattttatttgttccgacttaaaagcgtaaaatcaagggttaaatataaaaccaattgaattatttaaaattatttcttttccacttcttttttattattcaattttttcggatggatgttcgacaaagttatggccaattggtttcaacgcttggccacaaaagttttttgttaggtggccaaaatgtggcggataaatgttgcgaaggcaccggaaaacaacaaaagttcgataattttgaggaagagagcttcgaaaagttgggacaaatccgagatgcgctgaacagtgttaaagtaagggcgtggcgagggaccaggtaaatttttgatcataggttattgcttaaggggtggcaccaattcaattaat

SEQ ID NO: 54267 - DNA, 765 bp, Heterodera glycines
  Genomic contig location: Contig_ID=SeqID_23577; Location=1049..1813; Strand=+
  SCN-specific regions: Sequence locations=1-237,261-452,483-604,735-765
  Gene Ontology: Mol. function=structural constituent of cuticle; Cellular component=extracellular; Biological process=cuticle biosynthesis (sensu Nematoda)
atgcaagagacgcaaataattgtcggagtggcctctctgtgctccattttggccatcctcgccaccgttgttgtggtgccatcgctgtactcggagatcaatgagatcgccaccaaagtgcacgacggtgttcaggtgggaacaaaatgctaacaaacaggtgctaattttgaatttgctccaggctttccgcgtggacactgactcggcctggaccgacctgatggacttacaaatcacagtcacgccgccgtccaagccgcgtcagaacccgttcagctccatcttccgccagaagcgtcagttgcccggccactgccaatgcgcgggtgtgcaacagccgaactgcccgcccggcccaccgggaccggccgggtcgccgggacagcctggccagcctggacagcccggaggacctggacagcccggagtaccaggacaacaaggcgagcaatattagatttaaaaaaataaataaattacaaatgttttttaggtccgccttgccctgtctatacgcccccgtgccaacactgtcccgcgggaccccccggacagcccggaagccaaggaccgcaaggccgccccggagcacctggtcagcctggacaacctggacgcaacagcggacaaggcccgcctggacctcccggaccccagggaggagctggccaacctggtcgccctggaggacctggccaacccggacagcccggagcaccaggagttatcacgtaagaatgatcactgagctaaccaacttaa

SEQ ID NO: 54268 - DNA, 1262 bp, Heterodera glycines
  Genomic contig location: Contig_ID=SeqID_23578; Location=152..1413; Strand=+
  SCN-specific regions: Sequence locations=1-37,210-275,298-1006,1028 -1262
  Gene Ontology: Mol. function=microtubule binding; Cellular component =nucleus; Biological process=mitosis
tggatcaaaaagcaaagatttccattccaatgacgtcgagaaagcgagagcatgcagaaggggaacaagagatagaggaaggaaagagtgtgttgagtggagagagtgttagtgatggagaggagggcagaaacggagaagagacgaatgaaaaagaggcggatgaaagagaaagagagcgggacagaaaggaaaagaggccgagaaaggaatgggtggtggccggtgttcccaaaaattgttcggatttgtacgtggtggggattccatacgatttggaggatgaggcgctcaaggagtactttgagcagtttggaagcgttgaattgtcagaggtcagtgagtggatgagcaagggaagagaaggggcgagaaaagaaattcacgggagggaacctccgggggaaaagcggaaagggaaagacgggagaaagtccgtggtgataagacaagtgtgcagtgtatggaaagtgcgacggtcagtcagagattagaaaacgaaaaccacagtcaatcgcttaacaccgaaccattggggcggcctttttttacaatttctcttccgcaaatttcacatttcccataactttcaacaaaaaaaaaaacttttgcagataaagcgggacaaaagcggactgtcgcgtggcttcgctttcgttcggatggcccagtacgatgaccaagtgaaagttctgtccaagcctgtccatgtcatcgggggacgcgaatgtcacacgcgcatttcttccacagacaaagtgattggacttacaatatttcttttgttttcttcggtatttttgtgattaaccaactaactaacatagtttcttggtctatttggtaccatgaaatattcagaaatggggagagattggatttagtcggttggactcaaaaaatatgggcaaattaatatttgttttaacatttttcaagttcaggctgtcgacccctacgtgaatcgctctctgtcggtaaaaacgtttcattttattgttttgttagaaaaattgagtcaaagaaaagtttccaaatttgaaattgtcgctgattgtgtcatttcttaaggccaaccctcgcgttttcgttggaaatttggaaagtgacatcggcaaagaccgtcttcgcgagttctttttggagcacattcgtcgtttggacaaaacagcggacatcgtcgacctttactacccgaaaccattccgaaactttgcctttctcacgctcacttcgtcatttgctgcgaaagaattggtcag

SEQ ID NO: 54269 - DNA, 225 bp, Heterodera glycines
  Genomic contig location: Contig_ID=SeqID_23582; Location=292..516; Strand=-
  SCN-specific regions: Sequence locations=1-141,180-225
atgttcttgcagtgcattattcgttgctcctttataaaagaaaagataatattgttaaactatgcaataatttattttaagattctattgatgcaaatttagtgtgttgttttttctaaagatagtttcctttgttctttgtaaataaaaaatatagctttttataaaatatttttatagttgggagtcaatagcaattaaatatgtttaatttgtttaaataaa

SEQ ID NO: 54270 - DNA, 90 bp, Heterodera glycines
  Genomic contig location: Contig_ID=SeqID_23582; Location=2132..2221; Strand=-
  SCN-specific regions: Sequence locations=1-90
acttcaaagggctgcgccctcccatagacacgggctcgtgcgggaaacacccgcaaccaacccgcaaccttttggtactatatactactc

SEQ ID NO: 54271 - DNA, 656 bp, Heterodera glycines
  Genomic contig location: Contig_ID=SeqID_4390; Location=209..864; Strand=+
  SCN-specific regions: Sequence locations=1-328,354-552,574-656
ggagtgtcctttcttcactgtgaactatgccaaattttggaaccatcggcagaagcacaagcgcgcgaaccggttcacctgcaagcactgttccttctcctccggctcggtgcaatgctatgcggagcacatggaactgcatggggacacgggcacaaccgctacgatcacttccatcatcaaccaaaacattggcaacaacagcaatgttgcaactgaatttggcatgatgccagaggcattggtggccatgccgaaacatgcaacatcgacggtgacagcaacaaccgcaacatcttcgtcaggaattcgatcatcgccggaagcggcaagcagcggcagcagcagcttggacggtgccgaaacgttgtccgaaaaaaaattgtctatcatgccgacgaaaattgtccatgaaaagagcgatgatgaggaaatggaaatgacgacgacggcgtcgatttcccaagctgttgctgcttcgctcgttgatgaagcggtgcattttcttgtttttgtttctgatagttaaatgcggggttgagcctcgagctccccgatcaccgacatttttgggcctgctcaccgatcttcgtcctcactgacggtccccgattcccgagaatttcttccggggctaattttcgaaagtatttgaa

SEQ ID NO: 54272 - DNA, 2074 bp, Heterodera glycines
  Genomic contig location: Contig_ID=SeqID_4390; Location=1748..3821; Strand=+
  SCN-specific regions: Sequence locations=1-167,189-264,326-413,436 -440,482-735,761-986,1014-1080,1102-1175,1220-1290,1314-1326,1349 -1514,1597-1733,1780-2074
atggaaatgcatcggaacagtgaatgccgtccgttcacttgtgcactgtgcagcttcggctgcttttccgccgattcattgcacgcgcatttggcactccacgcgtccgcaacaacgctggaaggaggcggcagcggcacttataataatgagagcatacagcagcgaatggacccgccgccggacacgcaaacttctgctgctggcggtccaattactgatggtgggctgaagggggggggggggggggtcggtttataagtcattttttatagatttttttttctaattattttttttattatgattttttaaattttaatttgtggcttgtgacaaaaaagaaatcaattacctattttatagattttctagaaaaattgaaacagtaatattatagttttatgtgggttagaagctctttttcttcttttttacacaattttaaaatgaatttttttaaatgtttatatattttttactagaaaaaaaaactgaaccctaaaaatttagaaaacaaaaaaattttcagaaggggcagggagggtacgatgctggggtggaacttttgtgcatccccatccctccctctacaatatcccaaactacagtatgttaataataatatttctgttgattttgtcttttttcaaaattttgtcaccattttttgaaatgacatttatttttatttcttctggattattcagctccattttctgctgtgctcaataacgctgctgctgcagctgctccatcagtgccaacaacagtctccacggtgtcttcatcgttatacgcttgttctcaatgcaattttaaatgtatgagttaattcatacatatgcaaattaaatgccatggtctcccgtgtcaactactgatcacaggcccataaacagaacaaaaattcggagcagtaatccgaagaattttttttttttttttgcacttcgggccaaaaaaatgatttgtcattcggggtcaaattaaaaaaatatttataataaattggggtccggcgatgcaaaattcaacgcttatttgttaggttctgctgacaccccttgtgttcgttcgtgtatgtgttttatttacattttaggcgctgaattggaaccatttctggcgcatcgcaaggaacatgttcaggtagtggtgataatatgtaattgttatttttttcttgatttaatttagttaattatttttttatttagcaaatacataaattccctttacagctgattcaacagcgtctaatgacaatcatcaaacgtgcagcagtgatggaaaattgttgttttgggaatggagcgacaacgataaaaatggacaaaatgccaaaggcaaacggtgccgggaatggacgaacggttgacaaacagcattactgtacccgttgctcatttcgttgtgagtttttttttgtataattaagcaccgtcgattggctgagattcacttactccttggaaatttggcattgtgataacatttttttaaaaaatcgctaaaaatttttattttttttaattttctaagaaaaatttgtactaaaatttttttttaagttaaaaaaaattttaatttattcccggctgtgtttcggcgactgtgattttgattaattatccaaacaggtgaaaaaaacactatactgtaatttgtcattacagggtcaaaatctaaatttaaggctgtttgttttgtcttataaaaaggacattaagatattttaaatttatttctttctttttttctttttatttattttaaggaaagtttttttaaattcaatttttttcacaatttatatttgattagaaagaattgcataataaatttcgtaaaaactttttaacttgaacaaaaaaaaatgggaagcgtattgaattaatgtcctgagttcaaagtgaattaatgttctgaatttcaaaattgagatccatttataactgctcatttctattggactgttcgttcacaggtgacagtgttcaagcattcacacgtcactgggaacaccatcgcattgacaacagtcggcctggcattttccagtgcagcgcat

SEQ ID NO: 54273 - DNA, 1387 bp, Heterodera glycines
  Genomic contig location: Contig_ID=SeqID_4391; Location=63..1449; Strand=+
  SCN-specific regions: Sequence locations=1-251,298-313,335-664,710 -781,804-953,975-1387
atggacgaacggttgacaaacagcattactgtacccgttgctcatttcgttgtgagttttttttttgtataattaagcaccgtcgattggctgagattcacttactccttggaaatttggcattgtgataacatttttttaaaaaatcgctaaaaatttttagaaattttacactatactgtaatttgtcattacagggtcaaaatctaaatttaaggctgtttgttttgtcttataaaaaggacattaagatattttaaatttatttctttctttttttctttttatttattttaaggaaagtttttttaaattcaattttttcacaatttatatttgattagaaagaattgcataataaatttcgtaaaaactttttaacttgaacaaaaaaaaaatgggaagcgtattgaattaatgtcctgagttcaaagtgaattaatgttctgaatttcaaaattgagatccatttataactgctcatttctattggactgttcgttcacaggtgacagtgttcaagcattcacacgtcactgggaacaccatcgcattgacaacagtcggcctggcattttccagtgcagcgcatgtgactacagttcagacacgcgcaatgtggtgctgttccataaacacaaccatcatttggtcagagtttttgaaaaaaaaaaaaatttgtttatactatttataaaacataaaaaatgtgtataattggacgaaaaactcgtcaaggggcaaattgtgctgccccgactcggactaatgttttttaaccaaataaattaatttatttttttgtcaaagtggaacaaatttgttatcattcaattaatcattaaggtttctctattttcttgtaaaatttcggaaaatttatcatgttccaaaaaaaaagttatggatgaaaaaattttgatataatttttgtcatgacttttttgaaatatggtatataaaatttcatgatttgcctataaatagagaaccctaaggactattgatgataccaagaatgtttaatttgtttgagttttttaccgtataattaattgcaggacattcctctgacatcgctgtgcaaaaacattgaacttgttaaagaacaacagaaacgacaatctgttgctgatgatgatgttgaaaaacaatgattgagtggccttattaatcaaatgatgcatgatgatgagcgagggattttgacttttatctgatccagttttttatcgataattcattcattatctcatcaggaaaatgatggcctaatttttcccgatcatccccccgggtatattccattcttttttttgaacacacacttttatttatacactcacttgctatttatattttttcattcttcagaaaaaaaagttta

SEQ ID NO: 54274 - DNA, 831 bp, Heterodera glycines
  Genomic contig location: Contig_ID=SeqID_4391; Location=4356..5186; Strand=-
  SCN-specific regions: Sequence locations=1-417,441-573,600-831
atttcacagatttcccgtgctgcccgggcagtcagcaagtggtttctgtgatgtccaaatacattggcactttctctgctgccggtgaggacgcgtctacagtatgttcaatggcgaaaagtactgtggatgggttaaaaagttatttgtcctcacgcggcggatgccccagcggaggagaagcacaaattgtggacgaaatcgatcggcagctgaggagtaattaatcgtcaaattataggaaaaaacccgttttatggaaaataattaaaagaataatttttgcgggaaatttttatgagaaaatacttaatttaaaatgcgcaaattaccttattaagcctttatgaaaatgaagatcacttatgaggacgagtgtccgtacaatttgggctttgcccgtgccatgttcgacttggccgctgctgctgctggccatgcgggcaccggcacagaatggcacagtttgaaaagtcaatttgagcaggaaagccaagcaatcaaagcaattagccaagcactgaacattgaagttacggatgtgcattttggacacccaagcaaaggcaaaccaaataattttaaataaatatttatttgaaaacttaaaagattattttcaaggaaattccgcgcaccaaaatgtgccgagtccgagccatgtgattgccaaccctggccaacaaagttcggttggccatggaaaggaagacgaaccgttgtcatccgatttcgacttttgaggaaatagaaaaaaggaattaattagaaggaaaattcatagtacagaaaacattttgttgattatttatgaagaatatttatttgttt

SEQ ID NO: 54275 - DNA, 747 bp, Heterodera glycines
  Genomic contig location: Contig_ID=SeqID_23584; Location=417..1163; Strand=+
  SCN-specific regions: Sequence locations=1-411,443-747
atgaacactgcgatctcaaaattatttgaattgaggcctgacccatacgataattcgcaaagaaaatacttgcgtctttgtttggtaagtccatcggttttatttaccaattaggtatcatccttctacaatacattcagtttttgaacgtggaaaatgcatcagacttagcggatcttgtaaaagttatggatattgcattgattcgcgcagaactcgtaattcatcatactttcaaattggactgttaatttatattatttacaggtacttgagccttttatactccttgtagcagcgaatcgtgcactttttcaagccgctcacaatcaactttcaactcgtacgtgaattcgtccaaaattgctataaaaaatgtctcgagggtaatagtttagatggtgccacaccttttttaaataaatttttatagtttataaaagtcgtaaaaacacatttctagggtgttttcggggatgccgatcccgaaaatgacaccttcgagtgattttttttcattttttaggttcactgtctgctgaactgatttactgtctttcgcccaatcgtaatattcgcgagtcgttggccacttttggcattgctggcacaacccgtgctctgttggttgcaatatttgatgatgccaaagggaagaaaatgcgtgaagccgccaaacatatcaaaggcacaccggtgacattagaaaaattgagggaaaacgctgacgaggcactaatcagacag

SEQ ID NO: 54276 - DNA, 238 bp, Heterodera glycines
  Genomic contig location: Contig_ID=SeqID_23585; Location=331..568; Strand=+
  SCN-specific regions: Sequence locations=1-46,114-238
atgcaattaaggtgagaaaaaaatggaaaaaagaattccagctggacggatttgaaccatcgacctaaggatgtcttcaaccactacagtcctccgctctaccaactgagctacagctggcacacttacccacttattattattctttttattccattaattctgtccccacaagtcaaaaataataccagaaggaagtaaactagagaaattttgattctaaaaagaacaaatttaa

SEQ ID NO: 54277 - DNA, 262 bp, Heterodera glycines
  Genomic contig location: Contig_ID=SeqID_23586; Location=922..1183; Strand=-
  SCN-specific regions: Sequence locations=1-62,241-262
  Gene Ontology: Mol. function=structural constituent of cytoskeleton; Cellular component=intermediate filament; Biological process =epidermal differentiation
atgtggaagaaggtaagtttaaaaaaatgagttgtaaaagaaggaagcggacaatgtccgaagaggaggggaaaagggggtaggaggaggaggaggaggaggaggaggaggaggaggaggaggaggaggaggaggaggaggaggaggaggaggaggaggaggaggaggaggaggaggaggaagagaaggaggtggaggaggtagagcaggaggaggaggaagagcaggaggaggagaaggtggagcagcaaaaggggggtga

SEQ ID NO: 54278 - DNA, 517 bp, Heterodera glycines
  Genomic contig location: Contig_ID=SeqID_23587; Location=376..892; Strand=-
  SCN-specific regions: Sequence locations=1-239,262-449,478-517
atgatgaatgaacctgaatggaccacggcagttgcccgttttggcatcgatggcaccggtgccggcggtatgatgccaactgcgatgggagcgcccaatttacggaatggttgcggaccgcagccgcttccgcgccgcttgttcagtccgtcgaggaaagccagtgccacataccaccaccagcatcaccacaatcaattgatggcattggcaccaccggcatcggcacagctaccagccgccgctgctgctactgctgccatctgtcccattgggggcgagtcgagtgccgccgacacctcccattacaccacgtcaaactcgtcatccagcggtgcacagtccgctgttgactgcaagcgaacccggggcggttgcggtgggactgctgctaccgcgactacggtcggctgtcctactgtaattgaccggctggcacccgcgaacggtgcatcttctgctggtgctgctgctgcacagcaaccacctgccgtgccgccaccatccgttaacacaa

SEQ ID NO: 54279 - DNA, 1272 bp, Heterodera glycines
  Genomic contig location: Contig_ID=SeqID_23591; Location=667..1938; Strand=+
  SCN-specific regions: Sequence locations=1-480,502-559,721-921,956 -1272
atggtctacacaactcattacacatttgttgccttcaacaactgtgtgccaaagtgagtgaaatgccggaaaaggttttgtccggtttagtgtttcaatttatcccgaatcccaaaaaattttgttcatgaggtcgtaatttcaatcaacaattgatcaacccatcctctacaggattttacaggatcctgccctggatattgtatctggaaaatttttgtgtccgggattcaaaattctcgggcgcttgtttcgacggcacttttctttccccgccgattggcacttctatttactcccaactcacccagaaattggtcctatggttggtgcgtatttctgatctctcatgcccatctgtccctggttggccactcatcctccatttggctgtccgtcatgttggcactgatccgctacattacgcttcgtcgccggggcaaagctggcggtgtacaggtgcgtgccgtctttggttgtgactgatatttttgcatatttgacattctgatcaatagtagattgatcatccgtttgcctccctctctctaaatctatttctctgcctcttctctctccgtctctgtgtctgtctccctctctcattttatttctctgactcttttctctacatctcttttctttgtctctgtctctctctcgctctctcttctgtttctctctctctcactctctctcttttctctctccctctctctcatcggttctcacttactcagaccactgatgaatgcggcaatcaccattcagatcggtgttcaacactcgtacattgcgatcgcttcagtcgtcattttcgtctcgctgatgaatgggcccaactttttgacctataaaatttcggaacaaacgctggacatgacctgtggcgatttggtggttgatcagtacaggtttgccaaatgatcacccaaaaaatgacccaaaagatcatatacattaaggaatcacacggcctatgtgcccggcgtggccgatgttgcacttgaggtgggcgaggaattggatgggaaaatatggttaatcagagcagttgacactgatcagatcgacaggaacagaaatgttaagatgcttcgaaaaagcactagatcccgaatgattgggagggatcaaaagatatactaattgaacagtttaccggaaaaattctgaacagcatcagctataaaccaagctgatgggagcggaatgaattagactgatttgaatatgattagacgaagggagattggaagaggctggggataa

SEQ ID NO: 54280 - DNA, 726 bp, Heterodera glycines
  Genomic contig location: Contig_ID=SeqID_23592; Location=56..781; Strand=-
  SCN-specific regions: Sequence locations=1-125,147-225,247-637,683-726
atgtattgcttacaatggctgatgcctgttcttctgataccaaagcagattgttcatcccacttttctttttgaccaggctatgttcctctggttctacattatcggattcgtacttgagcggaggttcattttcaattttaattcataaaaatttccgctggaatttcacccattttggaaagtcttattaggtgttgttaaaatcagaggttccaattttaacataagtttccacatttgaagctgctgaaacgatttttttttattgttaaggccctgctatatttgtctcctcctattcgctttgactgttttcgcaatttgctacagtgacgaggaacgctgtgtgctgtggccaatttgtgagacggtcttaaatggcgaaatgtgcagaactgcatatgaaagggatcagcgatgaatgaccttaaatgaataaccattcccaaatatttttagtccgattggcgatttttttgatttcataaatgggaaaccaaatgcctagagatcgacattttgaaaaaagcctggacctggatttccatgttggacctggatccaggcctggacctggattttttgaactcattttaaaatcaaaaaagggtgaaaaatcaattgcttataacctctaaaatatctaattataaatataatgtgtttttaaattatttaatctggttttaaaacttggaaaaacatcgggcacttgaaaaataaa

SEQ ID NO: 54281 - DNA, 1870 bp, Heterodera glycines
  Genomic contig location: Contig_ID=SeqID_4392; Location=1132..3001; Strand=-
  SCN-specific regions: Sequence locations=1-164,211-353,375-631,699 -1223,1253-1574,1634-1761,1797-1870
  Gene Ontology: Mol. function=aspartic-type endopeptidase activity; Cellular component=lysosome; Biological process=induction of non -apoptotic programmed cell death
atggaagacccaacaacgccaatttcatgccaaaatgcgacaaaatttaacagcgaagtttcaaccacttaccgtaatacgaatcagccattttcgattgtgtacggtttcggattttcagccggaacaattggccaagatgtggtaaaggtgtgtttaaatggaaaaaataacaaattacttttaaattttcaaatttaattaaattttgtaactggaattttttttaggtatttttgggtttcaagttctaagtttgtgagatattgtgcgaaaaattaatgagcatatgtaggggggattggcgagtgattggtttccccatggcaaattacccaaaatccctaaaattatattctaataataaaattcaaatttctcagcttggcttggcctccgattcatctgcgttcaccttggccaacatttattttggccaaactgttcagaaggacactcaacaaacgggtttcagtggcatttttggcctaagttacagcgcttcgggcaataatgttcctccggtgttggtccaagcccacagaaagggtgcgctcaaaatgccattgtattcaatttatttggccactgaagggaatgtgcattggaagccagggggaggtgaacaatgttaattaattaattataatataaattaataacgttaaatgaattattattaccaaaaaaattaatttgcctatttataatatatctaatcattccatattataagtgttattagtaatttaaaaatagtttataaaaagatcgcacaattgcaaatttaattttgcaagaaaagttttcacattgggcgatgcggacaaaaaacactgtggtgaaattgtcaattggattgacattattccaaacaactacggacattggaagttcgaaatcgatgtgattctttaagcaaatttttaattgaaattcaatgaaattaattacccaattaaggaaattaaattggacagcaatgttataattaatgggggccaaagtgcagcaattgtcgacaccggaacttcacttttgcttggcccacgggaggaggtcaccaaaatttataaccattacgacgcaaatttgtctgaccactcaattccgtgtgatcagaatgttggcccgatcagttttctgatcaatggacataaatacgaagtgacaaaggtgggaaatttgacagaatttgttaattaataattaaaaaggagacaaaaataatttataaagtgttttatttaaagcaagattttacagaacataatataaattaattcaaaagttatttatattgagtcagttctcagcctcggtaaattctaacacttcctgacatttcggcgaccttaaataatccaatcccgtgatatgtccaacccaaaagttaatgatttctctttttttttttttgctttttcccaacctcagaatttaagccccccccccctcctccccgtattgatccggaaaaagtctgagtgggggaaccttgacacaacttttttttcgtttcggctggtatacgattcataaatatacgccaaaacctggctataaatttgttgaaaatttaatttcactaaaattttaattcattatttaatattttttaattttttaaattcttttaggaaactctcatccttaagcgagggaaagacaacaataaatgtatttttgctctttccgactttgggactgcaacgaatttgtgggttttaggtgacccattttgtcggaaattttgccaagtaaataaataattaacaaaataaataaaataatttcgtcttttttagatccatgacatcgaaaagctgcgagttgcgtttcctgaagcaaaaaagaagcattaaataaa

SEQ ID NO: 54282 - DNA, 127 bp, Heterodera glycines
  Genomic contig location: Contig_ID=SeqID_4392; Location=3201..3327; Strand=-
  SCN-specific regions: Sequence locations=1-13,36-127
atgcaacggtgtttgacttcaaagatattgaatatgttatacaaatatcaattggtaaattcattgatttaacaaaaacatatataaaaacgcataatttcagtctttggcatttttgcatttgtag

SEQ ID NO: 54283 - DNA, 1360 bp, Heterodera glycines
  Genomic contig location: Contig_ID=SeqID_4394; Location=711..2070; Strand=-
  SCN-specific regions: Sequence locations=1-62,119-135,160-293,315 -320,342-379,401-599,621-786,813-922,944-945,971-1000,1022-1192,1214 -1360
atgtcatcatccatcgcttcgccagatacatttttgcgttcagaaactgatcaaagtaatggaaaaattttaaaaaaattacgaaaaaagaaaataattattaaaaataaaataaattcaaaatctaacttttatcagcaccagcagcatcagcagcagaagaagtgggcaaatacgaagtgttcagttggcacggaaatttgagtgatcaattgtcagctgaactgttcgtcactgatcagcagctgctgaaggtgggccatttttgaatggacaaatgatcaaaccgcggcgggaggggaggggaggccaaaaacagagaaagatttatggaaaatttagttcaaaatttccattcgtttttaaaggttttccaatgatataaaattaaaaggagaaagggccgacctattcctcgaacaatttgatggcattttgccaaaaccattcaattatgaaatgaacacaaattacaaattatttattgggctgtaattatttgttatatttaaggaatgccgagaaaaacttgcgaagtccgaattgaaggaaacgaaattgctgtggaataacggtgaactgaatgctgaaaatgtgagcaaaataaaaattaaatttcagaggacgaagtggctaaaacagagaaaatttcacttttttaaatttagagggctctcaaagcagagttggaaaagcagaaactgatgacggaacacattgaattgaaggcaaaagtcttcaatatggagcaggaaaagcagcaatttgagaaaaaatacggtagggaaaattttaaaaataattataaatttccagtaccgtaccccgagccttactgttaaaataagcatttcaaaaataattccttaaaaattcatattgtagtttctgtggatgtgttcaattcattggcggaacgcatcaaacaattggaaaatcagcagcaggagaagagagaggaggacagaaatggtaaaattgaaaaaacggaccgtaaatttcaaaatttcttctaaattaacattcagctgaccgtttaccaaaatgcaattaaatttcagtttctgttggccaattgttggagaaatttttggcaggggaaaagcagcaaaaacagcagaaaaaggacaacgctcagcagagattggatggaaaatgttctgtggtggacaaaaacaatgtcgcgggtgggcacaaaaataattgaaaatgtttaaacaaactcactaattaagcggttaataaaacaatatttaaatttcatttattttgagaaattaagaaacaaggattagatccatttgagttgttgtatgctgttaaaagatattatagtaaaaaaaatttgtaaaaaaataaa

SEQ ID NO: 54284 - DNA, 148 bp, Heterodera glycines
  Genomic contig location: Contig_ID=SeqID_23593; Location=1..148; Strand=+
  SCN-specific regions: Sequence locations=1-148
ttttaatagttaaccaatttgatgtacattctgatttggacatttttcagaaatggctaacccaattgcaaccaaaaaacaaaaagtaaaattgtcttacgaaggccacctttacaccttcgctaaaatgagttctgatgggatgaca

SEQ ID NO: 54285 - DNA, 817 bp, Heterodera glycines
  Genomic contig location: Contig_ID=SeqID_23594; Location=441..1257; Strand=+
  SCN-specific regions: Sequence locations=1-189,211-286,315-573,629 -745,767-817
atggccacttcgttgtttgtcaagcgaatgatggctaactcgtgctgttttggccttttgctgctctacgtgatgttcggtgggcttctgctgctgcgttttgagcgtggccaatcggagcgggcgaaagacgaattaatacggcgcaaaacggaatgcattcggcactttttgcgctaccaaaggcacttttttaataaaattaaattagcatttgcaatttttattgcaataaatattgtcttaaagtcaaagaagctgctgggcagtttcttaaattagccacgggatataaaaaatagaaaaagaaataattaaattggcttaaatttcagcgatggcattttcaatggccaagacagaagtaacgaatcagcagcaaatgcgccgactctcatctcagcagcggaacgtatcactgagcattgtctgttcggaatcgtcgacccggcggagggccggcggcgccaaacatggaacttccgaaatgccatcctctacggctttggcattctgacaacactcggtgagtgcgaaactggcgaatctgcggttaacacggcgaattgttcgtaattaaatttaaaaaaaaaaacaaaaattaaattgaatttgatttttaaaatatccttcagtggataaatgtagaatatgagaatgccaaaacttatcggtcatcaagtaaattagataaaaatggccttattaagagagaatttgtgccaaaggagggaggcacaatttgagataaaattaattcaaatattaattattctccttaaaaatattggccatttatttgctcgacagacaaaaa

SEQ ID NO: 54286 - DNA, 1208 bp, Heterodera glycines
  Genomic contig location: Contig_ID=SeqID_23595; Location=101..1308; Strand=+
  SCN-specific regions: Sequence locations=1-69,91-251,273-329,351 -384,412-606,630-636,659-1086,1119-1208
atgggttggtaccccaacatggcctggcggctttggctccgttcgtggcgcaaaattgggacgccatgccaccacaaccgcaacaacaaatggcaatggcgagcgtttgcgcagccgttcctgccgccgatgggaatgccgccgccgatgggatttcccccgccggttccgttcgtccccctgttcgccaatccgccgctaccaatgccgtacccaccaccaccgattctgcaggtacttaagtcattcgcaaaatgctaaaatttcagaattacagaaaaaaaggaatttttctgggggggggggggggaatatgcatttcttgtaaataaaaaacttaaattttttcagcaatttagagacaaatggggttctttttgggcaaataatacttttttcaaatatttttaagccgattccaattcctccggctcgtccgctgtatggggctttcaacgcaccacaaatgagaccgccaccgttgatcaacatgccgtttgctccggtgagtttatatttttacgaacctaaattttgatataaaacattattactgtgtttattgtgaacaatcatttcgtgaaaaaataaaacattccgttacctgcaaatacaaaggaaaaacatatttgcggtaaaaaataaataaagaaatttactaatttaggttcgaaattttgtaatatatgtaaaacaaaacattcaaaatcagagggttgttatattaagaagattatcattccgaaaaatctgccacgttatcgtatcataagctacgacacagagtgttcagtatgtaaaataataaacaaaaaattatcttaacaaatttagacggataatttaatagaaaatgggaaaaatgaggggatttttgaacataaagtcgtttttttatcggctcgtattacatgttcggattgcgatggggaaaacaaggactgtgatatttgcgggccaaagggaattagacaccacacatggtgtacggttgacaactgtgaacccgtcttcgagtttttaaaatgggtgctatcgtttaaacattttgaaaccatttgttatgctcatttcgccggtaaaatcaaaaaattaaaaatttttataataaaattttagggcgttacgatgcgcactttattttgcacgcattaaccgaaatgggatatatacctgaaataattatttcagatctaaaaatttatcaa

SEQ ID NO: 54287 - DNA, 709 bp, Heterodera glycines
  Genomic contig location: Contig_ID=SeqID_23596; Location=1065..1773; Strand=+
  SCN-specific regions: Sequence locations=1-28,87-196,227-270,299 -610,693-709
atgatgatgaaaagggaaaaagtgaagcttaataaaagttatgtattttgtaaaataaatttattaatttttaaaaatattttaaacttccaaaaccaacttcgataccaaaacacccaaagcgcacaaaatttcacgacacggatgacgaagaagcattgggggtggacccaagaaaaggatcatatttatatggtaaaaattcaattaatatttaaatatttaagaaattggtttagaccaatgtttagacaattgaaaattgggttgtaaaaatttaaatttaaaatatttttaagctaaccgtggcaaattacgaaaacgcaaacgcccattagaaggagaagcattcacagagagagaacagagaaagtgggaccaattccatgagagattgtcattggacaggaaaatagcacgggaagagagaaaaagacggcgaaatgaacggcgacaggggggaataaaagaaatgagcgaaggtgaaatagaatggggcagagaagacatagactgggaagggatggatagagagagcataaacatggaaatggcaaaagatgaaaacagacggagaaatagcgagaaggagcgaaactatcacaatggcagagaaaaagagaggtggaatgagaaaaggaaaagccacagccgagaaaagcagagcaatgatgagaagaaaagacgaagaggcagaaaaagacattga

SEQ ID NO: 54288 - DNA, 94 bp, Heterodera glycines
  Genomic contig location: Contig_ID=SeqID_23596; Location=136..229; Strand=+
  SCN-specific regions: Sequence locations=1-94
aattaccgtatatgctctaattatagcccggtctctattaatcccgcagtctccaattatcccccagtctacgaggtgttttgaaagataatcc

SEQ ID NO: 54289 - DNA, 1721 bp, Heterodera glycines
  Genomic contig location: Contig_ID=SeqID_23598; Location=185..1905; Strand=+
  SCN-specific regions: Sequence locations=1-293,321-1294,1316 -1393,1418-1721
atggcatttctttcgccacgtttcaacgcgttggtcgacaaacatttcgatggccaaagtgatttgacaatttggaatgaaatagcaattaaaaagatcggaacacaagcaaaattgtctgtagaggagagcaatgccgaatttccactgcccgaccatccgatgcacaacaaaattcgctttgctaaactttggattgagtacctaattcaaaatcaaacattatttgacaataaaagcattcaattttcagttacattgaccattccgtcgtcacatttcttcgttccaaccaacaaatttttgacaaaggcaccaacttggatttggatttggatgttgaggccaaagatgtccaaccaatttgggatgttttttctcgtgaaatttggcccatttttgcgacaaacatccgccatatgtcattttccgatactgatcatctggacaattttcgtcgccgcacttcgccaacaattcttaccgaactcaaccaattgatttcaatctattccgatgctttgttgcccgatgcaattgctgatgatggaccaaatgcaactgctggccaagcgctgtccaaatggttgcacactccgacaaaagatggacagccaaagcaattgatttgctgtgataatttagaaccgccaaatatcaaatggattaccaatttcaaagatgtattgtggcaattttccaataaaattattgcaattaattgccattgtcctttcatttcccattttataggcatttctccgtgccaaaacttcttctgccagctacatcattcggtttgaggattttgaaccaacagaaaatgggtcatttgaattggtgaatgaacggaccaacgaaatgctgactttggagaaagaaaaaaacgatgatgaaaacatggagaaagacgacgaagatgaagaatatgctactgaggattggctgttgaagcgatgccaaattgggaagacaattcaatgggaggacgaaaattttgaaaatttgaacagtgtcagctttacgctttgtggaacttcctgcgttgggtgagtggcaacagcttttgtttttcttgatgccgtcacatttaaattgcccttaatttaggccattgtctgcaccaaaagcgagccaaatggacgcaaaaagtcagctgaaaatgaatcccgggcccagtggacagcggaagaaaaagtgagagaattatttggaaatgacaatgattgatcattaggaatggaaattctcggataattgcccattatatttgttgatttcttcgtttgtatacatttaatttgtttgattttttgattcactaaattagggttcgaaccccgtgggcggggatgggttttcgcgggggtttgctttgaattagcagcaaaaaatctcacaaaaaattaatttttatgaatgatgtgtttggctccaccttcctttagtcgatgtatcgcctcaattcaattcattttggcataaaaaatgaccaaatttagttgttttaactaatttctaaagaaaaaatagggttttttgggggccggcggtgccgataggcgccgacggtggaaaattttaagaatatattaattttgctaaaaattagccaaattttcagaaatttccctattttagatgaaaataaagcactaccccaaataagaacatttcttagaaattagaaggtatagaaaccctgtattaatcagaaaaaa

SEQ ID NO: 54290 - DNA, 681 bp, Heterodera glycines
  Genomic contig location: Contig_ID=SeqID_23599; Location=376..1056; Strand=-
  SCN-specific regions: Sequence locations=42-91,113-134,156-643,673-681
atgaaagaaaaagggagaaaagggaaaagtcatcaaaatgggcagagccaacggaagaacgaatgcgaaacattcagaaaaaatgtgccgattttttatgagtttttgtttaggatttatgtcgaaggtcagaaagctattttaattttaaaaagataaacccaaaattccttttacagctgttgacccaacagtgacccaaaaaaggcccgcggaaatgccgaaatttcaactcggcacgcaaaatggcacaactctaatcgaagtattggacaatctgtgtgacattggaacattatgttttggcaaaacgaacgtcgtggaaaaagaccaaaacaaattggacgaattgtccaacaaatcaaagaagccgaagaaatgggacaaattaaaaaatggaaaaacaattggacaaaaaaaggcggaaaaggtcaaacaaaaggaaattcaaaagaaatttgacgaaatgatgagggaaaaggcagcggaagcgatggaaacgataaattcggcgggggaaggcattggccagaagaaaacacttttgcgatggctatggccttaaaaggggtgccgagctggttttttgttagcagtacatatgcttttggtatgaatttttgttctgttttatgtttatgggaatattaaaattttattttttgattaaatgcgaataaa

SEQ ID NO: 54291 - DNA, 648 bp, Heterodera glycines
  misc_feature (16)..(16): n is a, c, g, or t
  Genomic contig location: Contig_ID=SeqID_23599; Location=55..702; Strand=+
  SCN-specific regions: Sequence locations=1-17,40-105,127-189,219 -330,360-648
ataaataagggcaatntcagaataaatgtaaaaaaattgctacaaatttctggaaaaaaaatttttctcattcagtacaaaagtctatgattcttaagttatagctaataaaaacatataattatttgttaacataaacaaatagcgatttcaaaaaattaataattattctgttctgagatttatttgtttgtttttcatgaaaaattttcaaatttatgtaaagcaacaaatttatttcgatatggcgccaaaaacgaataaaacgataatttaaaattgtataagtttaaaagcaaattattttaccgatgaatttaatttattcgcatttaatcaaaaaataaaattttaatattcccataaacataaaacagaacaaaaattcataccaaaagcatatgtactgctaacaaaaaaccagctcggcaccccttttaaggccatagccatcgcaaaagtgttttcttctggccaatgccttcccccgccgaatttatcgtttccatcgcttccgctgccttttccctcatcatttcgtcaaatttcttttgaatttccttttgtttgaccttttccgcctttttttgtccaattgtttttccattttttaatttgtcccatttcttcggcttctttgatttgttg

SEQ ID NO: 54292 - DNA, 1044 bp, Heterodera glycines
  Genomic contig location: Contig_ID=SeqID_23600; Location=479..1522; Strand=+
  SCN-specific regions: Sequence locations=1-93,115-584,608-922,944 -996,1020-1044
atgagtgagcatgaaattttgtcaaaatgggatttccaagtcccaaattgggcacagagtaaaggttagtcaacacgaaaactcttcatccattaaagaattttatttttcattctctcatctttaaacggactcattaattggatttattttaatttatttccatcaatgacttttcatatttttgcctttctccttaatttccatttttttaacttatttattttcaccgtcgcccatgctttttacaatatataattgtcatgtatttgcgctaattgcttcaaattgtcctccacgttacagcgtaaaagtgtctataccacaccctaattgccttaatgtctataccacaccctaattgccttaatcaccactaaccttttgtatacatatcatattaactaacacacaccgatcgtcacacgcattacctaccgtacatcgccgcctctacagtttgacacacacattcattgttttgcatcatattattgtgtactgtagtcgccgctcacacgctttgcgcgaaatgtgctgtggtgtgccgttgtgatgtatcgaaaccctttacaaaacagcagcagctccagcggtggcaacaacagaaaacagaacagcagcagcactgagcacggcgattggtccaggaatttgtatgtgttcgtgtccaatcattgcccaatcatcgacccctaattaatgttcactcatgccgtgggaaaatgaatttattattttttctattagcatttttgctttttgccgtatttgtccataccacgagacaaacagtgagactttttttgtcgttttgttttttgccatttgccatattcgtctgtgccatggggcgcaatcaatgggactatttggcattttgtttttgttttttttgccatatattttgccctcccctccctctgacattaaattttgttttcttctgagttgttatggggcttataatcgctgcgtaacttttcattagttcttttaaattaaacaaaaatatttttacacaaaagcaaatgccattaaaaa

SEQ ID NO: 54293 - DNA, 581 bp, Heterodera glycines
  Genomic contig location: Contig_ID=SeqID_23601; Location=96..676; Strand=-
  SCN-specific regions: Sequence locations=1-188,211-404,437-581
atgttggtttttttctccatttttctctgttttttctcctcttatcattttggacaagtgccgtcgttgtcgaaaatttgcctttcaaggagcacccgacgaaccaatccgtcattattggtacgttttttatttaactatatattaggaatcccattaactccatttttatggacaaaatcttatatttttcatgcccatttgtcccaggctctgatctgttactgcgctgctcaattgcccaccacggcgaaaattttaagttccatgtgcagtggaggacaaaccgaggcattattctgaacaaaaaacagtactccaatcatattcccggatattcaggcagatacaggcaagtttattgtgattatggaaactgtttttgttaatgatggtggtatcacacttttttctaaaaaagtgtttttatgtgtattcgaagtcgccaagcagaaataaattaatcctcaaattcgagtccaggattcggaatcccatctgcactattatattaaatttttgaatttgcgtataatttaaacagagcaaaaaatgagcgtgaaaatggtctaattaataaa

SEQ ID NO: 54294 - DNA, 2073 bp, Heterodera glycines
  Genomic contig location: Contig_ID=SeqID_4395; Location=1094..3166; Strand=+
  SCN-specific regions: Sequence locations=1-292,324-326,348-536,558 -695,758-912,935-983,1008-1041,1063-1237,1259-2073
atgtgctcaattggtgatccggcacaccagccagagactaattcaatgtcgaatatattagctttactaacatattgtgctgaattcacatgttatgcattgatttggctgatcaagcatttccgtaatggacaacaccacggacagtcatttgcgggttgatgaaattaattacccctaatgaaattttaattgctttgttaattggctcatttagaatcggaaatgaacaaacgtttaatgatatcgctgagtgttattatgtcaaccagtctcatctgctttattggcgtaataatattaatttatattgtaaaatttttggttaaatatttttgctaataaaaacccttaatttaataattatcagaattcttctttgcgaaaataaaaaaattatttgtatttatctccaaaatacaaatgattgaataatataatcgagttacattcttttatatgaattttggattttttgtttgttggttttatttctggtactttgctcactattacattcaatgttactgtatattacagttcccatttaagacttctgtgttctttaatggcataatgccattgctcagcttaaacatttttacaattgaatacattgtttggcccatttgcaatggtctttttttgatggcatattccagctgtactcctgtgcttttcctgtgcaggtggggtttataattaattaattcccaatttaaaaaataattaaattaattaattttttcatattttagcactgaataccgcaaagcatttcgcaaatatgtttgcagaacagaacatggattaactgttgttgtgccattgcataatatgcctgcttaaaaactttgtttttttttcattttgcataattaattcggactcgatgacgtcatttcatttaatttttataatcaatgatcaacaggatttgataaaatatatttttcgcgaaatatggccagaaaatatggactaaaaaatataattgaaaaaatatagacattttttcccaaattagaggtgatatttcttcctttcagtattccagctgtttttgtcctaatggccaataaagctgaagcaacttattcccgagtccttgaggtgcacaattgtttttgctctattgacaaattcagcattctgctattttttataggttttgaatgcacgtataggagttggaccaacttctgttatgttagacttcgaaatgggttactattaatttttaacgtatatttattaaacatttagccgccaaaaatgcatatacaactatttttggagaaaacctacaaattcgtttttgcttgttccacttaggacaagaaattaatcgtagattgaagaccgggaaacttagccactattacacaacaaataatgaatacaaaatcttggttcggagtttggctgcgctctcttttctggaggaaattcgagttgtgccagctttttacttgcttcgacaacgagcgaatgagctcggcatacaagttgttccaaatgcaggacaaccagtcgcaatattcgattactttggacggtattgttaaaataaattggattgtttattcattgactcttctgtagtcactatgtggctggtcacgatggaagacctccactgtttcctgttcatacctggaatcaccatgatagtgttcttcaggacttggggcgcacaaataacgcccaagaagggttccatttggctttaagaatgcaatttaacagtgtgcatccgccattatcgaagtgaaaatcgcgtttaatcagcttaatattttaattatcagagttatcactgttctgaagaaagaagagcgaatcgcagccgataagctgcggcagtatgagttggacccaactcaagggataagaattcgagaacggaagaaaacataccgtgaaaatgatttggctatcagaaatttggttgaaggctttgatgccattgagaacccaaacgaagatgagattcttgctcatctcagatcgttgcaatacagacttatgcgcaatgattttgagaattgggacgacccaaatggtgattaa

SEQ ID NO: 54295 - DNA, 402 bp, Heterodera glycines
  Genomic contig location: Contig_ID=SeqID_4395; Location=3416..3817; Strand=-
  SCN-specific regions: Sequence locations=1-372
atgtccgatctctatctaaaactcgcctctttttcgtctccgtccccaccaaaaagtgcacatccgcataatcaccagtgctcagaatccgtggtgcgacttttggggatttgtaacttggggacccgacatttggggacccgacttttggggatcccgacatttggggacccgactttcccgacatttggggacccgacttttggggatcccgacatttggggacccgacatttggggacccgacttttggggatcccgacatttggggacccgacatttggggaccgaacgacatttgagcaaaagacacttaagaaaaccacggacatttggcaacccgacatttagggacccgacatttggggatttcaataaaacaaaaaaaaatttaaaaatttaa

SEQ ID NO: 54296 - DNA, 314 bp, Heterodera glycines
  Genomic contig location: Contig_ID=SeqID_4396; Location=324..637; Strand=-
  SCN-specific regions: Sequence locations=1-314
atggcaattgcgtctgattataaaaagttgcatgcgaagtcgactaaatgccaaaagattaagtgtgtccaaattttgtaaacgcatttaattgtccgttttaggctgtcaaaaatggaacagaaattattcggtcagaagccagtggaaatcatcggaaaaacccaacacaatggcattgtttggtatattgtacagttggagaagaaaaacgccattctgctgaaccatgactttgtgatcaagaaatatccacaattgttgctgaaaagttacggcttgtaatttataagttatcctatataggtaataaa

SEQ ID NO: 54297 - DNA, 599 bp, Heterodera glycines
  Genomic contig location: Contig_ID=SeqID_4396; Location=805..1403; Strand=-
  SCN-specific regions: Sequence locations=1-94,217-233,260-291,313 -324,356-551,577-599
  Gene Ontology: Mol. function=satellite DNA binding; Cellular component=chromosome, pericentric region; Biological process =centromere/kinetochore complex maturation
atggtcggacagccgagaaaagagcgaaaacaaattatcgaacaattgaagaacaacagcgattttgacgaacagttgggcaaagtgaaagtgcggcggaagaaaagtgaagggcaaaatgaagacaaagaggaggaagtaaagccaaaaaaggaggaggaagaagacgaagttggaagacggaaaacgaaagacggcggaaggggaggacggggacaaacgtcgtcatcatctgatgaggaggacggagaggaaacggatgacaacgaactcaaggaggaggagtcgtcagaaggggacggaggagagggggacagtccgccgacagcgaagaggaggaagagggaattggtgagttcaatttgtattactatttaaaagagtacgcccttaggttggagggggagggcggtgtttgggtatgaccttctgatttagtcccaaattgtaaatattccttgcaaaatttgattttcaacattaagctgcatgtgaggaatgtcgaatgttcgtcgtccgatgaaaacgacaccgaagaggacagtgacacggacattgaaatcaaagaggaagaagaagactcggaagacggggaatga

SEQ ID NO: 54298 - DNA, 266 bp, Heterodera glycines
  Genomic contig location: Contig_ID=SeqID_4396; Location=1963..2228; Strand=-
  SCN-specific regions: Sequence locations=1-113,150-266
cgtccgttgccatcaaaagtctgtcgcttcttttctggcacaaatcttccgccaatttgcttcttcgtgcacttgccactgtttctggtttcgcttgggctctctacggtatcttttcccccttaatttaccatttaatttatcatttttcagcttcaactttgtttttggccggctccgaaccaccgaaccgacggtttctgttctattatccgcttgtgctgttttactttgtcttttcttggcttgtcatttcttttgcgtaa

SEQ ID NO: 54299 - DNA, 186 bp, Heterodera glycines
  Genomic contig location: Contig_ID=SeqID_4397; Location=196..381; Strand=-
  SCN-specific regions: Sequence locations=1-186
ttggaaaaggagatccaggcgaaagaagccgcttctaaaagggacaatgtgacggacacaaaagtgcagcccgacttaaaagggaacattggcagcggaacttcggcacaaacaaaacggaagagcaatgtggtgggattggaggaggacttcgacacgttggacgagccaatttgggaaacaatt

SEQ ID NO: 54300 - DNA, 783 bp, Heterodera glycines
  Genomic contig location: Contig_ID=SeqID_23604; Location=1006..1788; Strand=-
  SCN-specific regions: Sequence locations=1-219,241-425,447-598,620-783
ggaccaatcggaatcacagttccacgacatggcacttattaaggcaaagtgttggcggacaattttaaaattgtcaacaaatattttttatttgaatcaagttcagctttctcgcccaatggcgcgggttcagccaatttgtattcactgtgccaaagttgataggtttcgcaatggcactgcttatgtcatgggctgggggcaggagacaagcgaagcttttttcattaatatttaaaattgggggatggaaaaaggttggggttcggagaaggtgtgcacgagtaagccaaaaaaaattgccggtatgcgaaactcaggcggcgtcaaagcgtgcacaggtgaacaaggggtgcgccggcgcaccccccccccccccctcgttcgtcgtaaggggcggctgtaaaggagggggtcgtaacgaatggggaaaatttcaaaatttgaacaatttccttagcccggcggcgcctatcgacaccgccggaccgccccacccctttcccaaaaagttttttgaaaaaaggcaccgcaaaaaaagatcgtcgtcggagaaaattgggcgccttcgtacacgaaaaattggtcctggcgcaaaattctaaaaattttattattatcagatttaatccaaaatatggcccaatttttggattgaatcaaattaaaaatatatggataattttcgtctgctgtaattaaagtttattgtgtcaatgagtttagatgattgtgtgggcttaacgaggcctgccaaaatgttaaatggtcgcccagtgaaaa

SEQ ID NO: 54301 - DNA, 381 bp, Heterodera glycines
  Genomic contig location: Contig_ID=SeqID_23605; Location=503..883; Strand=-
  SCN-specific regions: Sequence locations=1-204,247-263,285-381
atgatacagggattcttaggtcttaacgatgtcaaaagtaaaaactgattacgtattcatgatcagcggccgaaataacccctaaagacatattttttgaagatttttggtgaaaaaatttttcaactcaaaaatcctatgctcacccctttggtccataatcccaaaatcggttttatttttgtaacaattcgtaagaaagtgataaaaatgtaaaataaaatttatattataaagaaaaaaattgcggatttttgtagtattttaattttcaaaaatttcttttcagaagggggttatgaatttttttctgaaaaatcgaaaattttcagaaattctggaataacttgttttctttttaagatagaaatcccaaataaa

SEQ ID NO: 54302 - DNA, 521 bp, Heterodera glycines
  Genomic contig location: Contig_ID=SeqID_23605; Location=938..1458; Strand=-
  SCN-specific regions: Sequence locations=1-319,346-352,374-385,471-521
atggtgattagaagaggtacaaaagtgattagaacaggtgcaaaagtgattagaagaggtgcaacagtgattagaagaggtacaacagagattagaagaggtacaacagagattagaagaggtacaaactgtgattaggagaggtacaatggtgattagaagaggtacaaaagtgattagaacaggtgaaaaagtgattagaagaggtacaactgtgattgattagaagagctacaactgtgattagaagaggtgtaacagtgattagaagaggtacaacagtgattagaagaggtacaacagagataagaagaggttcaacatggtttaaaattatataaataaggaaaagttttttattaaagaataaaaatcgaatgcattgaatatttaagaaatttgaaatgatattattttttacagataaaaaataataatgaaattatttattaaaaaaaatttaaaatttacaaccaatcttcaaattaattaaaagcattgaaaaataactcaaaaataaa

SEQ ID NO: 54303 - DNA, 246 bp, Heterodera glycines
  Genomic contig location: Contig_ID=SeqID_23606; Location=138..383; Strand=-
  SCN-specific regions: Sequence locations=1-172,194-246
atgtggggaccacctgcttttgcgctgaacgggcgaacgattggggagagaaaggggaggacggacagagttttggtcattggaatattcaaaaggaaacgaaattcaatcagtaaaaaaacgaacgaagaaaaggacggaaaagccattgcaaccgaagcaaaacaaagcattgaattggatgtgcttacagccatttattcacaaaagagatcggatagaaataaggaaataaaatcaaaggca

SEQ ID NO: 54304 - DNA, 201 bp, Heterodera glycines
  misc_feature (45)..(45): n is a, c, g, or t
  Genomic contig location: Contig_ID=SeqID_23606; Location=1..201; Strand=+
  SCN-specific regions: Sequence locations=1-201
cggttgagtttcgagcacgtgctgaaacaccattggatcatcgcncattgcaataagaacaacgacggccgactcgtccaccgcgtccagcgaatgttggtgattggagaagcgaacaaatgggggacagcactcactgcctttgattttatttccttatttctatccgatctcttttgtgaataaatggctgtaagcaca

SEQ ID NO: 54305 - DNA, 142 bp, Heterodera glycines
  Genomic contig location: Contig_ID=SeqID_23606; Location=385..526; Strand=+
  SCN-specific regions: Sequence locations=1-142
atgaagcgagccaagggtttggacataatcccggacgactttgtgaacattgatgggctgcccgtggacatgcgctacgtgcacccgcccggacgccctcacggtgctcagatgcgcatttggagtccgcatcaatcgccag

SEQ ID NO: 54306 - DNA, 285 bp, Heterodera glycines
  Genomic contig location: Contig_ID=SeqID_23607; Location=11..295; Strand=-
  SCN-specific regions: Sequence locations=1-74,254-285
  Gene Ontology: Mol. function=protein binding; Cellular component =axoneme; Biological process=N-linked glycosylation
atgaaagaggaacagaaagtggaagaggaagacgaacataaagtggatgagaaagtggaagaggaacagaaagtggaagaggaacagaaaggggaacaggaagaggaacagaaagaggaagtggaagaggaacagaaagtggaagagaaacagaacgtggaagagaaagtggaagaggaacagaaagtggaagaggagcagaaagtggaagaggaacagaaagcggaagagaaagtggaagagaaacagaaagtggaagaggagcagaaagtgaagagaaagtga

SEQ ID NO: 54307 - DNA, 288 bp, Heterodera glycines
  Genomic contig location: Contig_ID=SeqID_23608; Location=58..345; Strand=-
  SCN-specific regions: Sequence locations=1-139,163-192,214-288
atgcccaaagagaagaaattggaagtacaaaattggagacaatttaggacacaaaacggaaaaaagaaattaaagggaggtgagctgcgaatgccgacaggggagagagaatggtgcggaaagcgtgaattttgcaaggcttgtattacagtaatatttttaggtgatgggccaaatttcagaatattctccaaaatttaaaatttataaatacagtaaaaaatagtgggaggtgaaatccgtgtttgatgctgtactcaaattaataaccattacagcgataataaa

SEQ ID NO: 54308 - DNA, 168 bp, Heterodera glycines
  Genomic contig location: Contig_ID=SeqID_23610; Location=129..296; Strand=-
  SCN-specific regions: Sequence locations=1-21,49-168
atggaggattactgtttcgacgcaacggcagcagcagcggcggagcagtctcggcgtcaatcgggagcggcatcggaccttgtgcaaggagacggcctgtcaagcggcttcctggacgcgatcatcacgaaggtcaaccgctcgcctcctcatcgcttcacggatgag

SEQ ID NO: 54309 - DNA, 1378 bp, Heterodera glycines
  misc_feature (1367)..(1367): n is a, c, g, or t
  Genomic contig location: Contig_ID=SeqID_23610; Location=547..1924; Strand=+
  SCN-specific regions: Sequence locations=1-57,83-408,430-432,454 -916,939-1378
atgcggaagatcgtctacttcaaactgttgcaaattgtgctcagtttggccttcgtgtggcaacttctttcccttcaccaattctgcggcacttttgtctctccaaaggtgttgcttttgctgttgacaatttatttgaatttaatttattgttccatgcttttcaggccttcctccatgacatctcaggtggccattgcaaacgcttcacgttcatcggaaaggactcaaagacgggcgaattcggcgcagtgttcgacgagcgcaagtggcacaaccaactgttcatgagcagcaccaatggccaaccaatcgaggaacagcaactgaaattcatggacgaattggccgagaaattgccccccgctggacgccactgtattccgataaccgtaagcaaaagctaatcacaacaaatacatgcaaaaataatcccattttgttctttcagctctcgccttttttctggactgagaaagacagaaatgtgctcgactacgttatggaccttttttccggccaactgctcatcgcaatgtgctcgcttctcacccttggcgtcggcttgttcagaatggcacgctctgcggcagaatatgaagtgagttcgacggatgggtggacacagcacatcagcccgacaaaaacgcgaccaaattgcttttcagttgaaatccgagcgattttttggtcaaattgtgatcatttttgcttttgcgcgatcaaattgcttttcagttgaaatttgtgatcagtttagcttttgcgcgaccaaattgcttttcagttgtaattcgatggattttttgatcaaattgtgatcatttttgttttgcgcgatcaaattgcttttcagttgaaatttgtgatcagttttgcttttgcgcgaccaaattacttttcagttgtaattcgatggattttttggtcaaattgtgatcatttttgcttttgcgcgatcaaattgcttttcagttgaaatttgtgatcagtttagcttttgcgcgaccaaattacttttcagttgtaattcgatggattttttgatcaaattgtgatcatttttgttttgcgcgatcaaattgcttttcagttgaaatttgtgatcagttttgcttttgcgcgaccaaattacttttcagttgtaattcgatggattttttgatcaaattgtgatcatttttgttttgcgcgatcaaattgcttttcagttgaaatttgtgatcagtttagcttttgcgcgaccaaattacttttcagttgtaattcgatggattttttgatcaaattgtgatcatttttgttttgcgcgatcaaattgcttttcagttgaaatttgtgatcagttttgcttttgcgcgaccaanattacttttca

SEQ ID NO: 54310 - DNA, 3432 bp, Heterodera glycines
  Genomic contig location: Contig_ID=SeqID_4398; Location=1096..4527; Strand=-
  SCN-specific regions: Sequence locations=1-63,86-700,723-836,858 -898,941-1049,1095-1118,1183-1188,1236-1263,1285-1327,1351-1387,1409 -1469,1491-1883,1905-2284,2306-2712,2734-3432
  Gene Ontology: Mol. function=pyruvate carboxylase activity; Cellular component=cytosol; Biological process=TCA intermediate metabolism
atggtcgcgaacagaggcgaaatcgctacgcgagtgtttcgagcattgaccgaattgaacaaaacttcagtggccattttctcagaacaagtccgtaccattgaacaacaattggtgttataagacatttagttctttaggacaaacgttcgatccacgtttacaaggctgacgaggcgtatttagtcgggacgggtgggtgtcttgcctcaacctttcattacaaatcaaaaacctatttgcctttcagggcttccgcctgttgctgcttatctgaacatcgaacagattgtcgacacggccgttcgaaacgatgtggaggccattcacccgggctacgggtgtgtcagtggactgttatgatcatcggtccacactttgaatatttttagtttcctgtcggagcgtgccgatttcgcacaggcgtgtaaagacaacggcatcgttttcatcggtccaacgccggaagttatgcgcagaatgggagacaaagttcggaggagcgccttcaaaatatacttaccgccctttttaggtcgccgctcgtcaggcagccatcgaagcgggagttaatgtgagttattcaaaccgaatatttagtactttttcatcattattgccctgtttaaggtcgtccctggtacgccaggtccggtgacaactgttgcagaagtcaaacagtttgtgcaacagtacggatgcccggtcattgtaaaggcggcgtacggtggcggagggcgaggaatgcgcaaaatcgaaaaagaggaagaggtaagcaaatggaggaaccaacgccatttttggtcggcggaatggggagcgggtcactgtaataatttggcattttaaattatttactgtgaccgtctttcgaagatcattcgttttcacagattgaagatgcgttcaaccgcgccttttccgaagctttggccgcgttcggtgatggttcgctgtttgtcgagaagtacaacttcctttattcggctatggcaataacaaataagcatgtttgatgtttcagattcgtggaaagacctcggcatatcgaagtgcaaataattggggaccattacggaaatttggtgcatttgtacgagagggactgttctgtgcagcgacggcatcagaaggtcgttgaactggcaccggcacctgttttggatccggcaatacgtcagcgaatgttggacgatgctttgaaattgacacgccatgttgggtaccaaaacgttggtcagtgtagcgaatgaatctgatcacgaaatgattctgtaaaatcataaaaatttaaggaactgtcgagtttttgctggacactaaggggaatcattacttcatggaagtgaatgcacgtcttcaggtggagcacaccgtcacgggtgcgtttttcaattggaaaataatttaattacatttcattgaacgctttcagaagagatcaccggcgtagatttggtatatttactatttattacatattttcttttcgattatgttttacttttcgtttaggtccaatctcaaattcgcattgctgagggaaagtctctcgaggacatcaatcttcgtcaggactcgattcatgtcaatggggcggcaattcagtgccgtgttacgacggaggacccggcacgggggtttcagcctgacagtgggagggtgagtgactgatcgctgggtaaaaaagcaatattggttgctttgttcacaaacagatcgaagtgtttcgcagtggcgagggaatgggcattcgcttggacggtgcctcggccttcgccggctcagtcatttctccccattacgattctctgcttgttaaggttggcgacaatccgagagattgttttaattcatttttcgaaaggttatcgcacgggcaggagaccatcaccaggcttcggccaagctgatccgtgcattgaaagtgacccaacaactttttataatattagtttaaataatccatcctttggacaactttgattcaggagtttcgcattcggggcgtaaagacgaacattccgttcctcgttaatgtgctggaacagcccgcattccgcactggcgttgtggacacgtatttcatcgacgaacatcccgaactgttcagcttcaaaccgagtcaaaacagggcacagaagctgctgttttatttgggacagttgaaggtcaacggttctcttactccattggtcaccgaaatgaagccgaaaaatgtccaaccgactgtccctgtcgttccggcgggtaacggaaataaaatttctttgtccaatttcattttatttctctcattcaggtttgcatgatcaaccgcctgttggcattcgcgacattttggtgaaaaaaggacccgaagcatttgcgaaggctttgcgagcgaacaaagggtgcatgatcacggacacgaccttccgagatgcacaccaaaggtctgttcctaaatttgattttttcgacgcgagtgggtgcgagaaaatgaggtgcaagtccttgctgacttttcctttcctttagtctgttggccacccgcgtccgcacttacgacatggcgaaaattgctccgtttgtgtctcacaaatttgcgaatttgttctctatggaaatgtggggcggtatgaaccaatagcatttaactcacttaaatatttaattcgcttttcaggtgctacctttgacgtcgccatgcaatttctccacgaatgtccttgggagcggttggagttgctgcgcaagttgattcccaacattcctttccaaatgctttttcggggtgccaatgcggttggatactcgtcatacccggacaatgtgctcgacaagtgagttcatatattgctaggtggcttttaccctctgacatatatgcagattttgtgaattgtctgtcaagagcgggatggacgtgttcagagtgttcgattccctcaactacgtgccgaatatggtggttggcatggaggccgttgggaaggcgggaggggttgtcgaggctgccatttcgtacaccggcgatgtatccgacccgaacgcacaacgctacaatttggaatactatctgaacctggccaaacagcttgtgaatgcgaatgcgcacattctgtcgattaaagttcggatgggcagcaattttccaattgacacgttttcatttttgaggacatggccggtgtgctgaagcccgaagcggccaaacttctcatcactgcacttcgtgaccaacacccggatgttccgattcacgtgcacacacatgacacttctggtgcaggtgtggccagcatgatcgaatgtgcccgtgcgggtgcggacgcgatagacgcggctatcgactcgatgagcggaatgacttctcagccttcgatgggtgcaattgtggcttcgttgcagcggacaccgcactccaccggttctcaaatgcttatttga

SEQ ID NO: 54311 - DNA, 362 bp, Heterodera glycines
  Genomic contig location: Contig_ID=SeqID_4398; Location=5651..6012; Strand=-
  SCN-specific regions: Sequence locations=1-362
atggattcggacacggaggaagacctcgacacattgcaacgattcgacttttattatgaggttggacaggtccgtcctgtccttttaagcacaaatattgcaccaattcagcagacgctgaggtcaaacagagccttcgtttccgacctctcttccgaagaagacgacgaattggccaactttgtagtacattcagttgtgcgtttttaaaactgatgattgaatggacttttgaatgaatccgtcttcaggaatccgaagaggacgccaacgatcacgagtctttcttctcagaaatcaccagcggtctctactcaccgtcgccaatgcattcgcccgactcgcaatctgacgacaactga

SEQ ID NO: 54312 - DNA, 590 bp, Heterodera glycines
  Genomic contig location: Contig_ID=SeqID_4399; Location=1003..1592; Strand=-
  SCN-specific regions: Sequence locations=1-101,131-217,240-392,414-590
atgaacacggagattaaaccactgattgtgaaaatgtgcgaagaccctgagtttgacgttcgctatttcgctgaagaaacaaaaataggtaaataatagacaccgcattttttaaaaaagcaatttgccaattttcagaacttggaatggcagcttgatggtttagctgtttgaacctgagaaagttttgatggatggaatgcttctcattaaccgatcttaaatattttttagaatttaacaacaatcgtgtgtgtgtgtgaatcgaaatttcatttcggtctgtctgttttatgtattaaattctgtcgtttgagtattcgataatttccaattctgtccatttctatcgatgttaagaaattcgagattccaccgacaaaaaattctttttctgtttgatttcatctttttgattgctaaaaagtgctctgctttctcattaattgactgatcagaattgatgaattggcgcctattaaactaatcaagccaaattcttctccagtaaaaatggctaactcggccttatcaaaattcaattgttttgcacagactgcggaaggactgatttacgaaagggaaataaa

SEQ ID NO: 54313 - DNA, 236 bp, Heterodera glycines
  Genomic contig location: Contig_ID=SeqID_4399; Location=315..550; Strand=-
  SCN-specific regions: Sequence locations=1-236
atgcaaataaacgagcaaattaagccctccgatgacaatgtaattgctgcagcctcggaggaccaaaatgtgtatttgttcgatttgcgagggaatgagggcgacggattgtgcaccaaactgcgccaggaagggacagccttttgtgccgtttggaacccgcaaaaccataacatagtggcagtgtgcaacaaaaagacggggctgttggtgtacgacctgaggatgagcaacaa

SEQ ID NO: 54314 - DNA, 84 bp, Heterodera glycines
  Genomic contig location: Contig_ID=SeqID_23615; Location=24..107; Strand=+
  SCN-specific regions: Sequence locations=1-84
cttggttggatggatagagcacatatgggttcttaagaaaaatggttttattttctgccaaatgagcacgagtgccgagttatg

SEQ ID NO: 54315 - DNA, 936 bp, Heterodera glycines
  Genomic contig location: Contig_ID=SeqID_23616; Location=44..979; Strand=-
  SCN-specific regions: Sequence locations=1-571,593-613,636-722,745-936
atgattgcattaagaactgatattgaccaaaaagctagaattcttttcggattagcgattgatcaggctttccgatcagtccttgtgggttcattcattcattcacgaagacaaattttatgctatattacatgtaatgcaattaagaattatccaaaatttgcctataatgggttaagtaataactgctgatcagcgaatcaggtcgctgactggttaaaaatgcggaaaaatatttgtttaaatttgatcaaatgatcagtataatcagtcctcgaaaattgaatcatgaactgatcgcaactctggaataatatttgtccaggctaaatcatttgatcggtcctcaaaaattaaatgaatccaatcatacactgatcgtaatgcttggctgagcagcagatcaagctgactgtacaaatccgggaacaagatatacacacagatatctgatcaacagatctgtgcgcgatttattgcgctaccgaaaatgggttcaggcaataacgctgatcactgacagaatttccggaattaaatgcattcccgtttgatcagatcagagccgagcaacacaaagagagattattaatatgtgaattggtgaggggaagagaaatgaataatttcccaaaatgatccggaatgcttcgacgtatgatcagataaatttgtaatgatcaccgggtccgatcagtgtccgggcgcccgccgccgcgtccattcattcattaaattaattaattcattcactaattaatgcctcctcccgccgccccttcagggcatattccattcattaatttatttatggttgtgaaaatttctcaaatggctgattggattttggagatttggatttggggatttggatgggataaaagcaatttgtgctcaagacgtgaaattgtgcagcacagagattggttctgctga

SEQ ID NO: 54316 - DNA, 1304 bp, Heterodera glycines
  misc_feature (81)..(81): n is a, c, g, or t
  Genomic contig location: Contig_ID=SeqID_23617; Location=1..1304; Strand=-
  SCN-specific regions: Sequence locations=1-160,183-286,308-320,343 -556,578-658,690-879,910-1304
gtccctttttttgtcttttctgttttttgtccctcccattgccaaattgtccaccctttctcttttcgcttaggttggctnttgtcgtctccttcagttgtattatgttctgcgacttcacgtcgaggatgccagtcgaaaaatgtccgtgccaaaagcgccgccgtctcccgccgcttcgctggccgacgccggcagtgccgccctcgaaatggactttccgcttacaatcgctactgtaccctttcgtccagggcattcgcaactgtacagcgtgggatacggtagaaaaacaacaaaaaacacggctaaaattcaatttttcaagatttttgcgttgatcacgtggaaacgggcaaatacatttcgccagagtttcggcttggtcaagtttgggacggacgaacagaaggagagaaagactttgttgacgacgtggtgctgtacagacctgtgtacgtaaaagtgttggacagaacgccaaactcggcttcaggcaaacaaaaagaggtgtttaaggcattggaaatgccgcagaaattccgtccttctgactaattttaatttttagggccttcccccgcaaaatggtgccaatgccaaaaaagaaatgaacaataatctgctcctgtcgaattttccacacattgaaaatggcaattaaaaataacaaaaaaaaaataaaatttgatggggccgaagatggcattttgaaagtgcaaatgccatttagctggcatactgtagtcgtactgtggagggtactgtctttttgctttttctccgcttcttttggcgttgtctttaaatttccatcgatttattctttcaccactccaaagaataatttcttttatttgttcttatcaaaatcactcaatgcttcttttattattattattttgctaattttttttcgtctaaattaataaaaaaaaaagttcaaaaatcgctccgttcgattgttggcgatgtgttcgtccgttaacaaaaacaaaatgggccgttggggtgccacttcgtacattattagcaacatcgtcggctccggccttttcattacgcccacttccattctcaaccacacacaatcagtcgattggcattatgtcactgtgccataattttcgtttcaaatttgtaggttggcctttcgctcatagtttgggctctttctgccgcaattgccattttgggtgccttttgttacatcgaattgggcacaagcattcgtcggtcgggtggcgattttgcctatctgtgccacgtcaaatggttcaaaataaagataattaaagcactaa

SEQ ID NO: 54317 - DNA, 716 bp, Heterodera glycines
  Genomic contig location: Contig_ID=SeqID_23621; Location=832..1547; Strand=+
  SCN-specific regions: Sequence locations=1-328,350-716
atgcctttcttctccccctcctccgccgtctttttgctgccctttcaatttcttttggttgtcctcggcgctgttttcgtcgtcctcagccaatgctgtggttgttcgaagaaggaaaaggccagttttcaacctccttccccacaacgagtaaaaggacgaaattctattcatttttagccaacttaattttatcacaattcggaaaatctgacttacattttcgcgttttcaattcaaaaaaaacaatcgtgataacaaaaaacaaattagccatatcaatgcaattaatcactttcaaaaaagatcacttttccagaacactggagcgccgccgccacaaccaccaacatttctttcaccagctccacaaattactgctgctggacctgggactgggcctcaattcgttccaagtgagtagtgtttgattaacagacaagtaataatgtgttccctttctcattttcagtgaatgaccctaaatatgagacgcttaactccttggatccgaacatttttttgaagagtgcgtcagcaaaaccgccacaaaaaccgccgcaggcaacgaatggaccgaaacccgtgccagtgccaggtaaaaaataattgtgaattcctttgacttagctaattgttttaccacctattcagcaaatgatcctaaatatgagacgctcaacgctttggatccgaacatttttgtgaagaaatag

SEQ ID NO: 54318 - DNA, 138 bp, Heterodera glycines
  Genomic contig location: Contig_ID=SeqID_23621; Location=98..235; Strand=-
  SCN-specific regions: Sequence locations=1-138
tgaacattttttccaattgcaaaatgaattgggcctggagaatgtcagcatttgcttggtggtgttcgccgacaattctaacaacacttggcgggtgcaggccatccccgtttcagacgtgagctcttttgacaacag

SEQ ID NO: 54319 - DNA, 1030 bp, Heterodera glycines
  Genomic contig location: Contig_ID=SeqID_23622; Location=221..1250; Strand=+
  SCN-specific regions: Sequence locations=1-55,80-335,358-395,429 -875,908-939,961-999,1025-1030
atgacgtcatcatgcaaagtaaaaagactccgccccttttcttgttggtcacgcccattggtttttgttttgctttgctaagaatacgactccgccttttttgcttttagtttcttttgtccagccccattttttttgctatttaatcacagtttttctacataaaaaaatcattcgtccatttaaaaaaattccatccacattcgttttttctgttcttcctgcaatgaattctcttaaacgctttcaactcccggagcaagggacacgacagcaagaggagttggattcagttgaaccgaaacacatcagcgatgtggtcaacttcaattcggccggcgttttttatgttttgggaaaagtgacaaatatgcagtaccgtgtttacaaagtccaaattaaattaattaattaaattattaatttttctgtttttaggcatgcccattccgttccaaggggctcatttgtcgccgaaaattgtccgatgataacatgtgtgaggcttgcggccaaaaagcgattgctcccatccacacggtgtttgttcgtcttctgctgcaggatgttgaacaagcagacattgctcaacgtgtcaccatgttttcgagtgttgctgaagagtttttgggaatgaaagctgctgaattgctcgccaaggagaaggagccggaaagccttgcgaaacacttggacgatttgattgctgtgaagataattgcgaaagtcaacattaaggttgttttttttttttttgcaatttattacatatttgacaaaccacaacataggcgaacagtcagacttacactggatttgattggattgtcaatttgttcaagaagtgccctggaaaaaatgacagtgatgtgccaaaagaaaaagatgatgatgatgacgttgatgagattgctaccaaaaaaacaaagaaaaattgagagatagatagatagatagataacggattcattttgttgtgagcttcaaaaaaaaaaggatttaatgtgtcctttacttttttaaaaatcca

SEQ ID NO: 54320 - DNA, 2751 bp, Heterodera glycines
  Genomic contig location: Contig_ID=SeqID_4400; Location=335..3085; Strand=+
  SCN-specific regions: Sequence locations=1-174,200-436,459-1003,1025 -1128,1151-1403,1425-1584,1606-1625,1647-1749,1771-1808,1830-2751
atggataatatattggcgaataaaaaagtgctaacatttttgcgtattgcaaatgaactttgtggtgttgggaaagaggccgcttttgttgtttcgatggcttgcgctggtggacacattttacgtgatttggcgcttattccggtgagtggtgacggtaattatatgactggtaattttgagaagaaattaaaattttttgtaaaaatagactagaaaatcttggtggaatattgtcaatgcaatacaattcgatgcaaaaaattgaatggacgcataaactgtacttgagccgttacagacccgagtccttggaacaacacttttgttcgctgtcagtcactctttaaattacaggagaatctgctgaagttgcttcgtgagcctggagatgatctcgagttcgcttatcggctctatcagctcacattcaacaaaaagggaaagaaattattaaacaaactttgtcacaacagccctgtcaaaattggcaatatcatgcaaattgctgaaatggcatccgaattggcaaccaattacagttccaactgctcctacattgaacatcgtcgtattgatgaggattgccgagcatttcgacccgttgatttggtttgaactttaacaataatgatgtgtgtttagctagttgtaaaagctttcagcgtaacgtcaacaaatttggttttttggtaatttcggcactttcatatgctttttgccaggccttcgatgaaaatatttgcaatttttacgacatttacggagatgggaaaggctttttctacaaccctttgctcggttgtacagttacggtacggtcatcttttatttaactatctgtttttttgtctatttttagctttgtgacaatagtttcgctcgacaaactgataaatggccaaaaataaaccaaagtcgcattgtttcgtatagattctcgaagaccaccgaagacaaaaacggaatgttggaggcattttttgtctgtcgtcttccgatttcgctcattcatcaatacccaatcactgaagtttgttttagaaatgctcactttgtaaagtgaaattgagaaatgctatattgatgtagtttagctcacttacctattgttagaaaactcaataagttttggggggcatacaaatatgctgatcacgaattaatattagtcccggttctataactgttttgaagttgtcagaccctaacaataagaatggtagcgattacttctctcaccgagaggtattaaatgaagaaaatctgagttaaccttattcttcaattttaccaatgctgatgactattaaacataacagctcaatcaattcaaaatcaacattggcccaatggttgctgagaaattgctgtcctctgactttgttaacaatctttgcgagggggaccttgccagcttccaggggtacaacccggccaccggccttttgtccatcgcctgttccgcacgttccgcactcaaattgcgtcaactcaccgacgggacggtgaatagtctgtttgaactgctgaacacaatggacaaattgcgatggttcgacgaagaatcgggtgctttggtaggaaatctttcccttactttttccgtgattaatcactgactattttcagatttcctttggtcctggctttcaaatttctcaactgaatgcaaatccatctgagagggagaaggacacaatcgtcgtttcgtacatcgactccttcgaacactttgagcctatggttcaccaattgactgagttttctttgcagttctgcgagagtcgagtatttagctaacatttgtttctatttacaattggtttctttgtcatcttttgcagaactgtaagcctttgctcttcaccgattgtaagtctcgtcgctgcttcgtcactttgctcgctccgtccatcatcaacgacctcaagtcgtccattgactcacttttgcaattttttccgggtgtttcggttgaggtgtgttttgcactgtttgtatcattcgttggcttttgactttttttagaccaggcctggcaatatttctgaatattttgctggttataatgccattaggtcaagtggaagcgttttcgacaactcttcttatccgaccgattgctgtgcgatttgttttggcaccatcgatggccaatttattcgcctttccctttgtggtcatgtttactgtgacgattgtttcatcggactgctcaaaaacgccatccaatttcccgtcagttgtcaatccggatgtttgtatcagattctgttcgaggacattgcggttagtcatttgctctgacgtacaatacggatgccatttaactgttttctcaatttgtccatgattaattgtaaacacaatctttcagttgattttttcgcggaactttcgcggcgttgacgaaattcagcaatttttgacgccggtgttccgtctttctttgcactctttccttctcgcgcaccgtgaccaattcgtgcgctgtcagtcggagggctgccattgtttgatgccattgtcgaagggaacggcgaatggagccgttggcagtccgatgatttgcttcggttgcaaaatgaaacgctgcacattgtgcggggaggcagtccaccaggaaatcacttgccaagaggtaattggagcagcaacggcggattcatctacctaaaaatgtaatgccatttagcgacaagaacaaaagttcagcatcgaacatccggacctctctgcatggaaaaa

SEQ ID NO: 54321 - DNA, 917 bp, Heterodera glycines
  Genomic contig location: Contig_ID=SeqID_4400; Location=1946..2862; Strand=-
  SCN-specific regions: Sequence locations=1-699,721-758,780-882,904-917
atggcatcaaacaatggcagccctccgactgacagcgcacgaattggtcacggtgcgcgagaaggaaagagtgcaaagaaagacggaacaccggcgtcaaaaattgctgaatttcgtcaacgccgcgaaagttccgcgaaaaaatcaactgaaagattgtgtttacaattaatcatggacaaattgagaaaacagttaaatggcatccgtattgtacgtcagagcaaatgactaaccgcaatgtcctcgaacagaatctgatacaaacatccggattgacaactgacgggaaattggatggcgtttttgagcagtccgatgaaacaatcgtcacagtaaacatgaccacaaagggaaaggcgaataaattggccatcgatggtgccaaaacaaatcgcacagcaatcggtcggataagaagagttgtcgaaaacgcttccacttgacctaatggcattataaccagcaaaatattcagaaatattgccaggcctggtctaaaaaaagtcaaaagccaacgaatgatacaaacagtgcaaaacacacctcaaccgaaacacccggaaaaaattgcaaaagtgagtcaatggacgacttgaggtcgttgatgatggacggagcgagcaaagtgacgaagcagcgacgagacttacaatcggtgaagagcaaaggcttacagttctgcaaaagatgacaaagaaaccaattgtaaatagaaacaaatgttagctaaatactcgactctcgcagaactgcaaagaaaactcagtcaattggtgaaccataggctcaaagtgttcgaaggagtcgatgtacgaaacgacgattgtgtccttctccctctcagatggatttgcattcagttgagaaatttgaaagccaggaccaaaggaaatctgaaaatagtcagtgattaa

SEQ ID NO: 54322 - DNA, 616 bp, Heterodera glycines
  Genomic contig location: Contig_ID=SeqID_4401; Location=47..662; Strand=+
  SCN-specific regions: Sequence locations=1-326,348-365,388-418,441 -528,550-616
atgaacgtcgaagtggcaccggacggccatatggtgacggacccattctacgcacaggcaatgatggtgatcgacgcgttcagtgtgtacggactaagggaggacgacgaagagacgggcgacgacgcggagcgagaagacgacaatccgttgcacaaatatcgtgacaattggacggcgatgttcaaccgattcaaaaaggtgctaatcatacctgtccatggggggggggggggtaagagaagagaagcaggaaggggataggcgtcactagggaaaattttgaaattttgagtacaatattttaaattttcgatgttgagccagttttttaaaagaaataaggattttaggagcccgccgagaaaaaattttttgagtttatgaaatttctaatgaacattagcccaaattttcagaaatttccctctttttcccctatgtctaggattttgatgggcacgtacgacgcgacaattgaattcgaattgaaatacgaagaaatggagggagtgaaagtgattcgcaatttcattatttatttattgccgttgatttcctttttcatcacaaatttttgctccattttcaatttctgttatgaacaaataccaga

SEQ ID NO: 54323 - DNA, 1788 bp, Heterodera glycines
  Genomic contig location: Contig_ID=SeqID_4401; Location=1446..3233; Strand=+
  SCN-specific regions: Sequence locations=1-1142,1166-1788
  Gene Ontology: Mol. function=calcium-release channel activity; Cellular component=integral to plasma membrane; Biological process =calcium ion transport
atggccgacaaagaagaaagtgccggaggggaacaggacgacgtgtcctttctgagaacggtgaggacaaattctgaatttaattttaaatggacagtcgccaaattaaaactgatcagtgaattgtgatttgtgtttgaagtattaataaataagctgtggggccgtttggccggggggggggcttttcccctttcccccgagggtccgcccgcgccaaagcaacaaaagcacttccgctcactgaagaggctcttcgcccacccaaaacaaacagaagaggaagttgagttaagaatgtgtcttttgggggcatttgtgcagcaattttcggatcattcggtcgttcggtcggcggcgttttgacattttgccaatgagtcgattttttcttctgaccgatagcagtaagtgtggtgaggaaattgatgagacaattgatgatcagcaccatcagcagtttctctcaaaggtctctctctccattggaattaaaactttttccctttggaaatgcctttctttttcctccatgccattgttttacatttacctcccccctctccctctcgcccagggtgacatcgtctgtttgacctgcttggtatccaacagtcaacgggatggggcgggtgccgagtcggaaagggtttgcctttcctctgagggtttcggcaaccgaatgtgcgcgttggaaaatgtgtcggatagagacttccctccggacattgcctcgtgcatgctctacatcgacaacgctctgtcaatgcgagctttgcaggagatgatgaatgcggagagcggcgaaatcaaagggactggtggcaccggagggcacaaaacacttttgtacgggcacgcggtacaactgaagcatgtccaaagtgaaagtaattgcggcaagacatggctgctgggatttggggtcaatgtcgatgttaattgccaaattgttcattagtaattaccggtgctaatgatttccctgcgcttttactcttgactcttttctttgcccctttttatgattgccctttcccaagtgttcttggcctgcttgtcctcgtgttcctccaatgataaattggctttcgacgtcggtgttcaggagaccaacgcgggagagtcctcctggtggacggtatttaaagccttttttgtgctgccacttattcagccacaaaatcagattcatccggccagcaaacagcgatcggaaggagagaaagtgcgcgcgggggacgacgtcattctcgttagtgtggcaacggagcgatatttggtcagttggcacggcacaataaagcaaaaggcggaccaccgaagggtctccaaatcgctgttcccaccccaccccaaatcatcgtttgtgaatgccgatggcatccatatttaagcacatgacttccatgggtggcgagcagtggggggcgctgccaaccgccgtttaccattctcattttatggtaattgcttcttttcatcaaactctgtggaacgtcacttcggtcagctcgggaagtgttcgtattcgaaacatgggtaagggaaaagggcacagaataaggacaatcgggcgaagaagggcacggggggggggggaagcggcacattttgacgacgaaccgaaaggacggcatatttttaagcaaaaggatgtcactccttttgggggaatgaagtaaaggatttggtggttgtttaggctctttgttcggcaacgacgtcgtccgactgttccacggcaacgacgagtgtttgaccattccggagaatggagcgaatatc

SEQ ID NO: 54324 - DNA, 2386 bp, Heterodera glycines; identical to SEQ ID NO: 4402
  Genomic contig location: Contig_ID=SeqID_4402; Location=1..2386; Strand=+
  SCN-specific regions: Sequence locations=1-11,33-1485,1510-1628,1650 -2386
  Gene Ontology: Mol. function=ryanodine-sensitive calcium-release channel activity; Cellular component=integral to membrane; Biological process=calcium ion transport

SEQ ID NO: 54325 - DNA, 748 bp, Heterodera glycines
  Genomic contig location: Contig_ID=SeqID_23626; Location=70..817; Strand=+
  SCN-specific regions: Sequence locations=1-43,70-156,203-377,420 -479,572-585,660-669,691-707,729-748
  Gene Ontology: Mol. function=poly(A) binding; Cellular component =nucleoplasm; Biological process=regulation of transcription from Pol II promoter
cgaaagaatgaagagcaaccggaagatgatcagcagggaaatacggaggaaggaggaggagaaaacggtagatcagcagacggaagaacaaatggagcacaaacggaggaacaaagacaaccagagaatcagggagagcacgaaaatggtaagcggaaatttaaaattaaattttaaaaatttaaattttaaagaaatttatccggaaaatccattttcaataaatgaaaatgatgacaaagaaaataatgatgaacaaagaagtaaagaaaaaggaatagaagaagcattaagagaggagaaaagggaaaaacaaaacaatggaatggagttttacccggaagaagttgtgataggcgagcagaataaggaacaaaatgctaatgagagtgataatgataatgataatgataatgatgcttcacaaaaagagtcagttgaaagagacaatggggacccgagagatcaggcagacacatggggagatgaaggagaacaagttggaaaagaagcagaaacagtaaaagataatgggaaaggagaggaggaaaagaaacgggaaaagagagaaacaaatagtatgttagaaagggagaaagaaaggagtgagagagaaaagaaaagagcagaggaagaaaaagagaaaacagagaaagaaaacataattgagggaaagaaagcggaagatgagaaaaaaagtgcagcaggaaatgaaggcctgttcagaatgtttcctgaacagcagata

SEQ ID NO: 54326 - DNA, 809 bp, Heterodera glycines
  Genomic contig location: Contig_ID=SeqID_23627; Location=303..1111; Strand=-
  SCN-specific regions: Sequence locations=1-163,195-241,264-687,714-809
atgcctggggaggggatcagcaaaagtgcgagaaaaaacggctggcagattgatcagtgacgaaaaacgcaaatgtggtgtcagaggctctcggtcggttaaaaaatgaccaatggtcgacatttcttacactaattgtataaattatggtgtaaaaagcgtgaaattgaaataatttaaattgttaagaaccaaaaaattatttgggataaacaacaaaaaaaaaatgataattcgttcaaaaataagaaatttcacaactaattaagacggttagatagcctcggagcccaatgaaaaaaacgaaattgactcccccctggtccacttgaaaatatgaattgacccccccccccctttccatctcaatgatcaatgtcccgagatgagagaatttgggatttttcgggatttgaaaccattctcgagagagagctaaagaaaatcgcatctcaagcaaccaaaacataaactcttaggaaaacgagaaacatcgtcctcaacccaacaatttggagcccaaattcatgggtttacatggaaatttgttgggtggttctgttctgtgctgatcgatttgtgcgcgaaatgcaaaatgcgtaacttaaataaataatttttttggagacggtggacaacaaatccgaagacaatttgcgcagggaattggaggagaagcgagcggagagcgcaagaagaaaaagaagaagccattcattattcattgtgcaacatcagcagcagaaaatgggaaaaaattgcaggattaaaagcattttatgaacaatttttgtttgaaaaacaataaa

SEQ ID NO: 54327 - DNA, 814 bp, Heterodera glycines
  Genomic contig location: Contig_ID=SeqID_23628; Location=273..1086; Strand=+
  SCN-specific regions: Sequence locations=1-775,797-814
atggaagaaaattatcgaaatacattaaataggatagaaaaactgcgcagaatttgtaaaaaattttgtatcttggaagtttgggtatgttattcatggtctgaaaattcgtatagcattttttaggagtgcgaagttcgagaacaattgaaaaaaaataaagaaatgaaaaatttttttgaaaatattccggatcgggggtatgttacaaatgaatcggtgaataatatttaatttttagacctattaatccgagagatgcgtatgtagggggtaggacgatgccttttgcactttacgccgaagcgacagaaaaacaagtcatttcaatgtttgacatagtgagcttgtatccttatgtgaattttgtgacaccgtatccggtagggatacccaaagtcattaaaaagttaaatccaaatgttatttggaaggatccgggtgatataccttatgatggacttttgaaagttaaagtcataccgccgaaaaagttgcggtaccctttattgccttttcatgccgtaggttatttatttttatgcaaaattgatttaatgtttaggatggttttttactttttccgacttgtggagagtgtgcacgtaagtctaaacaggattttgttagggtagaatgtttcaagaagtacagacactcagcagaaggacgggaattagttggggttttcacttctattgtactccgaaaagcgttagaactcggctacaaaataacgaaattttatcgagcataccattatgagaattttgacacaaatcttttcaaaaattatgtaagaatgttttgaaaa

SEQ ID NO: 54328 - DNA, 610 bp, Heterodera glycines
  Genomic contig location: Contig_ID=SeqID_23630; Location=334..943; Strand=+
  SCN-specific regions: Sequence locations=1-268,298-610
atgctttttgtccttctccgttttctgctgctctgttcactgtctatgccaattttggccatccgtaatttcactttttcaaaagtgaatgaccgcagccaattgccccaccgaatgcgccgaatggtccgcgtggaatgggacgggagcacgtgagtgttttgaaccgtactcaatgcgcaatagcacgatggattgacacccgaacattcagcactgtccaatacggtcgcacatcgcctcagtcgctgaacctttactttgcgctgcccgcggcgccgcgaccccccggcgccgtcccgtcgcccgtcactttcactgtgaccattgacagtttggacgcgtgcacttgcgtaacgcaaagtgtctacgacaacatgtccatactttctgttcaattccggaagttggcttttgaattttcagtttggccttcgcttggaatcggcgatttgccgatagaattttgcccgaggaagtcgtttatttgacgtggaacctttggcaaagcggcaacagctcagcggacaatgacggccgttccgtttatttttcggccacggattttaacggattcggaaatggttgattgattttgtttgtcatttca

SEQ ID NO: 54329 - DNA, 357 bp, Heterodera glycines
  Genomic contig location: Contig_ID=SeqID_23632; Location=89..445; Strand=-
  SCN-specific regions: Sequence locations=1-14,40-112,134-294,316-357
atgccaattgaaccatttgaattggaaaacaaagtgacaaatgaaaagctgacattgaaacagagcaaagaatacaatttggttaattggctgttgcaacggtacccaattggggagacggcgacggcgccagttaagtggaaaaaacgtgaaaattcgggtgctaatttgaactatatcagatttgatccgcggtatggcaataatgcgtgtgccaatttgaacattgtccgatttgatttgggtggaaatcattggattgggtgagccaacaaaagcaattttcaattgtcgaaaaatgaaaataattttaggccattgtcgccgccagcagtggtagaagaagaattggattaa

SEQ ID NO: 54330 - DNA, 356 bp, Heterodera glycines
  Genomic contig location: Contig_ID=SeqID_4403; Location=819..1174; Strand=-
  SCN-specific regions: Sequence locations=1-177,219-356
atgaccaatttcaacattattggcatcagggttgccgcgggttacccgaaacccgacatttttctcgacccgaaacccgacccgatgattttggtcgggtttcgggtcgaaataagcactggtaagaaaggggttttggtgaaaattaggtggataaggaaattgatggagaaggagaaatttttgaaaaaaaattaaattattattttacatttaaagtgttcgttcttatggttgtgtggtttattggctataccttctgcctttctttatttttcgctagtgttcaattccccactgggatagaatattttatattttcttcaaattctttcaattgaaattaaattaataaa

SEQ ID NO: 54331 - DNA, 1894 bp, Heterodera glycines
  Genomic contig location: Contig_ID=SeqID_4404; Location=1181..3074; Strand=+
  SCN-specific regions: Sequence locations=1-1046,1068-1735,1757 -1840,1870-1894
atgctgtacggtagaaaatttacgctgctgaccgaccacaagccccttttggccatttttggatcgaagaaaggcattccgatctatgccgccagccgacttcaacgttgggcgttaatactctccaattatgaatttgacataaaatatgtcaacacaaattcgtttggaaacgccgacgtcctgtcgcgactgattgcaaactacccacggcccaacgaagacattctgatcgccaacatttgcgaaaagacagaatgctacgtcaacttcgtttttcaggccaaagttgagcaattgccgatcacggccaaagaaattgctgatcagacgaaaacggacgaagtccttcaacaaatcagtaaattcaccaacaaaggatggccacaaaaatgcgaagacactgatctgatgccattttatccaaaaagagaccaaataaccgaaatcgatggttgtctcacttatggcgaccgtgtaatcattccaacgacacttcgcagacaaattctgaaatcccttcattttgcccatccaggaattgttcggatgaaggccattgccaaaaaccatgtttattggccagggatcaacagcgaaattgagcgcactgtccgccaatgcgacgactgtcaaatggccgcgaaaaacccaacaaaggcacaaattcagccttggaaagcggcagacgaagtttttgagcgcatccatctcgactttgcgggcccatgcgaagacggccaaacgtatctcgttgtcgtcgacgcctattcaaactggccggaagtttgggagatgagttgtgcaacaagcgaaaagaccgtcgctatgctaaaatcgttcgtccatcgaatgggaattccccgagaaattgtgtccgacaacggaacacaattccgatcagcggaattcgccaacttctgcaaggaattcgacattcgtcacacgttcacgccgccatatcacccgatgtcaaatggggcggccgaacgattcgtcgacatcttcaagagggccatgaaaaagtgccgaaaagaaggcaaagattggatccaaaaagcacttttggcctacaggacaacgccaagtgcagtgctcgacggacattcaccagatgaattattccttggacgccggatgcgaaccaaaatatcattggtccatcccgccaatcagaaaattccgaaagtggatttgaaaaattttggaaattttcaacaagattaccgtcaaaatatgaaaaggcaattcaacaagaaaaacggcaccaaaaccatcactttccgaaatggagagccaatgttcatttggaacttgaagggcaataaggcaaattggttgcctgcgaccataattgagagagttggcaactctccgacttatcgaaccgatgttccgacacttcatcgcgcagtctaccgccatgccaaccaaattcgccgccgtttcccagtggacttggagacgccagaaattggccaaagaaatggacacattttggccggggaccaaacgaatcgggcccccgttaaggagattcaaaaagccaaatctccagttggccaatgtcaaaatgcgcagcgaaaatcagcacgcgccaagagggcacctcagcgactggacatggatccatcaaagccgaagtacgacctcgtccggccatgaatctcgcgcaggagggacttttctcaagaagggaggtgttggataaggaacacacatattattgattgtatttccctttctctccctctctattgtctctccctctgcccccttgaccagccccataaatatgtctccttttccctcactccgggcattctcccattcattccaccatttcattattttatttatttattccctgctgtcctccatatttatttgttta

SEQ ID NO: 54332 - DNA, 1324 bp, Heterodera glycines
  Genomic contig location: Contig_ID=SeqID_4405; Location=2030..3353; Strand=+
  SCN-specific regions: Sequence locations=1-141,170-207,249-403,425 -464,499-737,759-1046,1068-1073,1133-1247,1269-1285,1307-1324
atgaatgacccaccacggatgattattgcccatgggccgaacagatggtgtactgtaagaaagtcgagaaattctacaaaagcaaacagcagggcgaaggcgagcaactggtttttctggaaaatacacaaaattcaattcataaatttaaaaaaatttatttatttttgagaatttcgcatttttttcgtgcttgaaattggcgactttgcagtccttgaagaaatagaaattgtattttaaaaatattaaagtccttaaaaattcagagaatttgtactctaaaaacatttaaaaagccgtaaataaagaaagtttgtacttgagaaatctttttgtttccattaatttcccacttttgccctatttttgcgtttttttggtctttgaaaaatattgaagtccttaaaacaaagataatttggtgcgtgaaaaacactgaggtccttgaatacagataatcaagtacttgaaaattttttgaatttccattaaattgccattttccccatttttcagcttttcttctgttttttttttgctgaccaggtaaagcattgtgcgcgcaaagtgcagcttctcgtcgctgtccaaattggtcaaataaatggcgggccacagaaatgccaaaatatgcacagcaatggcaatggcggccaacaccaaaatcagaattttgaccacgccgaggcccgagccaccgccgacgttggacagctcggagacgaggttgccggacagccaaagcagcagcagccactccaccgagttcggcaccaccgaagtggtctaacgacagggagacggaaattaaacggaaattcataaaaatttgcaaaaaatggagctccaaggggtaaggtggaattcggcaccaccgaaatgaccaaacagagagacggaaaattagtaaaaaaaatttgacaaataacgtagggaggggcggaattcggcaccaatgaaaggcaaaaatagaaaaaataggaaaaaattcagaggatgagaaacgtcaggagttaagaaaaatggaatctaattatagtgaaaatttaaatgaacaaaaataattagcgtaaaaaagaaattaaattaaattaaatatttttatacaaaaatattatatattttttaagcttacttcataaattttgtgcgttatattcagcacgacaatggtcaacagaatggtgaaatacacatgagaaacgatgtggcaaacaaatttgataattggggcacgacctgagaaaagaaaattggggaaaaagtaattaaaaggagaggcaattaattaattaaaattaatccatttttaatgggttta

SEQ ID NO: 54333 - DNA, 2569 bp, Heterodera glycines
  Genomic contig location: Contig_ID=SeqID_4405; Location=19..2587; Strand=-
  SCN-specific regions: Sequence locations=1-60,95-134,156-310,352 -389,418-562,586-819,844-895,917-1043,1152-1539,1586-1607,1630 -1638,1660-1989,2015-2207,2300-2569
atgctttacctggtcagcaaaaaaaaaacagaagaaaagctgaaaaatggggaaaatggcaatttaatggaaattcaaaaaattttcaagtacttgattatctgtattcaaggacctcagtgtttttcacgcaccaaattatctttgttttaaggacttcaatatttttcaaagaccaaaaaaacgcaaaaatagggcaaaagtgggaaattaatggaaacaaaaagatttctcaagtacaaactttctttatttacggctttttaaatgtttttagagtacaaattctctgaatttttaaggactttaatatttttaaaatacaatttctatttcttcaaggactgcaaagtcgccaatttcaagcacgaaaaaaatgcgaaattctcaaaaataaataaatttttttaaatttatgaattgaattttgtgtattttccagaaaaaccagttgctcgccttcgccctgctgtttgcttttgtagaatttctcgactttcttacagtacaccatctgttcggcccatgggcaataatcatccgtggtgggtcattcattttgttttattttattttttataaatacagtaaccaattttttccccaataataatttcttgaaataaaataatgacaatttaatctcattttttattttttttgccaattcccacaaccattggcaataatttttgacaaaaaattcggcataactactcaagaatcactgtcgccctattggtttttttctcaatttttgcagtaaaatttgtaaaatttcatggcaattaaaaccgaaatgtcatcattttagttacgaaataaaaaaaaaaataaaatatacttttgaaatgttgcatacactcaattcaatgctgtttagacctgatgtacgacctgacccgttttctggtcattcttttgctttttgttgccggctttaccctccacgtcacctccatttttcaagtaatatacctaattaattagcttaagccaccaaaatttttgcagagaccaccccgtatccatttcccatccggaaaaaaaatttaatttttttaatttagaaatttttcaagttttataagaaaatttcaggaaaaaataatttcgaaataaaaattttttaaagattatttctttaaatagaacccccgtgggctctatttttcaacctccctcaaaagtgcggcttctttattttttgggggggggggggcactaatttaggggcgggctatattttaggaatacggtattgaatttcaatttgttttaagcccgcctaccaaccggtggacgaggacagtgccgaactgatgcgtttggcatcgcccagccaaaccttggaaatgctgtttttctcgctgtttggcctcgtcgagccggacagcatgtgaaaaatttgaaatttttttgaagttttttttctaattttaacacaggcccccgctccatttggtgcccgattttgcaaaaattgtgctcaagttcttgttcggcatttacatgatggtcacattgattgtgagtgcgaattttatttattatttttaaattatccaatattttttaattaaatcacaaaaacttttttttctcttttaatattttatgccattttaaaccagggaaatgaaaacatttgctgaaaataaaacctaaaatttagtaccaaaataaaatataacgcaaaaatcataaaatttgtaaaaaaatattttttgtatcagttagacaatttctatcttttattaataatttggcataaattgtgatcataaagaaaaaataattttagtgcctgggcttggatcggccaaactcaattccaagtatagacatgtccagttccaaggacataacggtgaaaatccgtaaaatccaaggacgcgtaaaaatttatcaaaagcaattaaaacttgagaatttttcaatatggtttaattaacttctaattgtatgacttatgcaattgtgcccatcaattaaaaaaataataattaaatttgaaaattgtgaaataatttgatttgtcccgcaggtgttgatcaatttgctgatcgcaatgatgagcgacacctatcagcgcattcaggcccaatctgacaaggaatggaagttcgggcgtgccattctgatcagacaaatgaacaaacggtcggcaacgccgtcgcccataaatatgctgacaaaatgtaaagaaattaattttttttaacgttaaataataataaaattaatatatatttaaattaaaaatttttaataaattttaataaataatgaaaaatttgctcatttgaaattgtcattttctcgttaatctttcagtttacattgtactcaaagtggcatggcgcaataaacgtaaagaaattcggacatttcgccaaattatgcgaacatttaaaattaaattttacagttcgtttctgtacccaaaaggcacagcaagacctacggtatgaggagaacattgacgcatttacaatggacgggcagcaggggaggcaaagtccgacatttaaggggggaggcgcgaccggggacgagaaggagcctg

SEQ ID NO: 54334 - DNA, 613 bp, Heterodera glycines
  Genomic contig location: Contig_ID=SeqID_23635; Location=528..1140; Strand=+
  SCN-specific regions: Sequence locations=1-138,168-613
cggtacagcaaagaattggagtccgaaatggaattggaactgaaacagcgtgaccagaaaatctcggagctcgaatcggtgaagcatcgactgagcaccgccttggaacaactgaaggttggaaagagaaaggaaagcattaaattttaaatttattctttttatttggtcgacggaattaattcttcatcatttcaaaataatttaaattatcgaataataaaggaacataagttttttggtactttcctattatgatgccacacccaaaaatttcaaaaaatcaacaaaagcgcgcgctgcaaaccctgagaagctggtcaattagacgaaattttatcttaattgttgcatttatgcctccgatctagtgttacgtgcgccttgtttgtgcgtccttttttaattttttggatgtggcctcaaacaggaaataccgtttttttaatcaaacctttattcagaccaaaagtgaaaaggaccgacacgagcatcgcacaacggaggaacagttgcgaacgcgactgctcaattcggacggacagtgcacggaattgcgccacaaattgcgcgctgtggaacaacaaaatgacaatttggagcggagggaaag

SEQ ID NO: 54335 - DNA, 660 bp, Heterodera glycines
  Genomic contig location: Contig_ID=SeqID_23636; Location=74..733; Strand=+
  SCN-specific regions: Sequence locations=1-660
gttttcggggcagtccccccgaaccgatgcgcccagatttatggggagaccgaatccttcgggaatagcttccctatagcctgtactttaattctgcgttggatttttgctccccataattgtttgagtcccccaaacggacacttgaaaaaatcgatttttttgttttcggggcagtccccctgaaccgatgcgcccagatttatggggagaccgaatccttccggaatagcttccctatagcctgtactttaattctgcgttggatttttgctccccataattgtttgagtaccccaaacggacacttgaaaaaatcgattttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgtt

SEQ ID NO: 54336 - DNA, 330 bp, Heterodera glycines
  Genomic contig location: Contig_ID=SeqID_23640; Location=267..596; Strand=-
  SCN-specific regions: Sequence locations=1-2,24-330
atgttaaagaaaattcaaaaattaagggataaaaaaggtatgcgcatagatctgctttattgacctcttattaggagaaaaattgcattaaattggaataatgtaaaaatcagtcaccttttagcaaatattagggggatcaattagttaaaaaaacaacaaaaaattcaaaaatgaagagataaaagaagtaggcgcgcgcgcacctatctaccgggagcttaattgctatttttagatgaaaagttgaaaaaagaatcgccaatcactccctccgcactgaaggctcaatttctgggatatgaaattcaaaggcagtccttgaaataa

SEQ ID NO: 54337 - DNA, 179 bp, Heterodera glycines
  Genomic contig location: Contig_ID=SeqID_23641; Location=740..918; Strand=-
  SCN-specific regions: Sequence locations=1-179
atgaccagcttcgccaagtttgacatcagtggccctgacgtggttccattgctgcaaaagctctgttctgctaacattgaccgtgcggtcggaacgtgggactttttgatttctgatttttgcttatgagatactgtttttagcacaatttacaccggaatgcataatgaacagggcgg

SEQ ID NO: 54338 - DNA, 587 bp, Heterodera glycines
  Genomic contig location: Contig_ID=SeqID_494; Location=1792..2378; Strand=+
  SCN-specific regions: Sequence locations=1-98,120-284,307-587
atgcaatggttcccagcagcggttcggaaaagcgcaaggaattttgcaatttgcttgcagttcccaagtgacgtggtacattttgaaatttaaaacggaaataattaataaaaataaatggcaaaaagtgagagagaaacggcaaagaaaaaatccacaaatgacgaactgcgatgaacgacggactgtcaattggagaaataagcacattttgcacctgcacacatcattacatatttcacaaaattgcactattataaatcacaattttgcacaaaatcaaatttaaattaattaagcaaatccaaacacaaacaattgcacacagcacttattaaagcattctctacaattgtcgacaaatcaagcagtttcaaacaaaagtgtgccaagtaaaagcaaagccgaaaggaaaaaaaggacaaaagaaagagagttaaaaaagggagaaaaagtgactttggaaagtgaaaaagttaacgttaacagcagaaataaaaagcaaaaaatggcggatgttgatgatttggaagtgaaatttgaggccttaaaatgaaaagtgaatgacttggaagataaattgacaa

SEQ ID NO: 54339 - DNA, 906 bp, Heterodera glycines
  Genomic contig location: Contig_ID=SeqID_494; Location=2471..3376; Strand=+
  SCN-specific regions: Sequence locations=1-254,276-613,635-906
atggcaactgccagcaattggcatgccacggactgcgtccgaatgtttccattatttctcgagggagaagccaaagagatttttcttaatattccgcctaataaaaagaaaacatggcgagatttaacaaatgccatggcggaccagacaaaaaaaattgacggtccaatgtggccaaaaaaattgttggccagagcaaaaatgggccacgaaagtataacagaatatgccaataaaatacgtgagttggtggaacaggcctcccccgacccaaattacacgagcgaggcccgagaatgcgagagtgtccattattttttaaatggactcccgattttcctaaaaaggaaattattttttatgaaaaaaccaaaaacgcttgttgaggcaatttccatggcaaaagaagttaaccaagcaagggaagaacttgcaaatgatgaaaagggagatgaaattaaacagcaaataaatgagataagggagcaaattaatgttatttcgagtcaaaataatggaaaaaacgaaaatcaaagagaatttgttaacaattcgtggcgtaacaattttggaaacggaaattcttggaatcgtgggagagaaaataattacagaggagggcagagagcacggaattttaataaattttatacgagaaacacaaatattggtccgagaaattcaaattttgtaccgcttaaccaaaacaattggaacagaaattggaatgaaaatggaggaaataatgatcgaaattggaacggaagattccaacgaaatttggaaatagccgaggaaatacgagaagaagaggaaatgacagacaaaagtacagtatcaatatggtgggaaatgaagaagaaaccccctcaacatcgttcagacgttcacctaccccggtattaa

SEQ ID NO: 54340 - DNA, 516 bp, Heterodera glycines
  Genomic contig location: Contig_ID=SeqID_494; Location=3753..4268; Strand=+
  SCN-specific regions: Sequence locations=1-38,60-209,231-516
atggcggcagtaacaaaaacggtgccaactccaaaagttgaaaccccacctttttcaaaaagctggataaaattgaaacagactgagcagaaatacataataaaaagagtgaatgttgggaaaattggtacaaccataattccggttaccaaaacaactaaaactgtgaaaaatgccccaacaacaacggtcaaaactccgttaatgatttttactacaacaaaacccaaacaggaaaaaacacccaagaatatttcgaattccgtttttgagaatgaaaagtcaaagcagggaaataagacaaaaacagagacaaaggcgaaaaaggaagaaaaacaccccaaaacggtaaaaattggtaaagaattaaacgaaaaaacaatgcctaaggaggaaaaagttccaaaaattgtgaccaaaaacataaccacaacagaaacacctaaaatgaccacaataaaaacaatttcaaccacaactcccaaaccaaaagtgaatgaaatggaaatgaagtga

SEQ ID NO: 54341 - DNA, 386 bp, Heterodera glycines
  Genomic contig location: Contig_ID=SeqID_495; Location=1265..1650; Strand=+
  SCN-specific regions: Sequence locations=1-161,183-255,277-386
atgaagtggaatagggaagggagggagaacgaccaattggattgtggcaaagccaagccaaatgatgtgctgacaatgagagcagtgccaaaggtgccctcgaaacagcgtcaatttatattgattttcttccaaggcacaaagagagaaaaaaaaataatgagagacagagagataacaaaagttatgactttttatttacataattttcttttattttacatgagtagggagcgaatttttaggtttttaattatttttctgctgctttaatttaatgagaaatgcacaatttcaaaaaattttcgttttagtgcaactattcttcactaggaattcactattttggagcatacgaaattttatctgacaactctacaaattga

SEQ ID NO: 54342 - DNA, 1470 bp, Heterodera glycines
  Genomic contig location: Contig_ID=SeqID_4407; Location=339..1808; Strand=-
  SCN-specific regions: Sequence locations=1-53,76-109,143-450,472 -544,571-1394,1416-1470
  Gene Ontology: Mol. function=magnesium ion binding; Biological process=phenylalanine catabolism
atggtaaaagcagcaccagacgatgatgaatacggacaaatgattcgcaatgactttggtatttttgaagatttaccccatatttcatccatattcattgacttttttagctgcagctgaattttgctccaatttcgtcgaccattcatcgccaaaatttgacatttccgaacattccaacgaaaaacaaatggccaattttatgccttccgttgacactgacagcggagcgctcaaagaaagcctgggcctcagccatggtaattgttgtagttatttattgctttttcatttttcgctgttttttgcaacaatgcctttttgtgtttagccatgttgtccatgtttatgaacactttgcgtgatgataacgtctctgccataaatgatatgacaaacgatgacaagttcaacaacaacaatatcgctattccatcaattccgccgtggtcagccaaaaagaggcaatgctcttccagccgcgttacaacagcgccgtcaaaaagcgatgccatcacggcatcgtccaatttgatcccaaccggcagcagcagcaataacaacaacaacgatattttaccgacttcgtcgttgtcagtgcttatgcaacagtcgtcggttgcggccagtgcgcaacaacgccaacaacagcagcccatcgtcaaaatgtgccgtgttgagacattttcggccgcgcaccgactgcacaatgacaatttgccggattatttgaaccgcgaggtgttcggcaagtgcaacaacgggaacggacacgggcacaattacacgtggaaagtggtgctgaaagggccggtggaccagcacaccggaatggtcagtcgaatattggacgaaacataaattgggatgtcagcaaattcgaattggatatacatttgtgtttctcgcggatacccaaatttctttttgaatcgggagcagacaattctttctgatttagaaatgaaaattatttttacccttttttgggttttcattttataatccattgcaaaaacgaattctgtttgcatttgcaggtgtacaaccttgccgatttgaaacgagagatgaacgaagtgttggagcaggtcgaccacaaacacttggacaaggacttgccctactttaggttataatcagtcatatttggcatttttttaacaaattacaaatactttaagggacaatggaattgtgagcacaacggaaaatctttcggtgtttttgtacaacgaactctccgccacaatgagttcccccgaacttttgcacaaagtcgttgtctgcgagacggacaaaaactgtttctcatttgccggatattcatcctagacaaatgaaatttatgcgatagtgagaaaggattgattttcaatttaagtgactgttcctacatttaatattatttttccattatacttcaaaagtcacttctttgtaaatattgagatgtttttaaataataaa

SEQ ID NO: 54343 - DNA, 2267 bp, Heterodera glycines
  Genomic contig location: Contig_ID=SeqID_4408; Location=442..2708; Strand=-
  SCN-specific regions: Sequence locations=1-60,85-224,246-474,496 -691,713-984,1006-1297,1320-2038,2067-2267
  Gene Ontology: Mol. function=interleukin-8 receptor binding; Cellular component=nucleus; Biological process=apoptosis
aaaaacatccacgtctattaggggcaccgccaccaccgcacttccccatggtcggatatttggttccaatccaaaaaatagcggactttttgcgagccgatattcgggtaaaaacgaacgttagcttatcgtttttagatttaaatgtttgtatctctgtcaggtgaccattctttttgcggaccttcacgcgttcctcgacaacatgaaaagctccattgaattgcttcaaaaccgcgtgctttactacgaatgtgtgatcaaagcgctgctaaacgcactgaatgtgcccattggcaaattgcattttgtgcgcggacgttcgtatcaattgaccgagtgagtcttatttatctgccattttgatgaccatatttactgcgagaaacaccctttcaaaattaggacttacacaaaggatctgctgcggttttgtggtttagtcagtcttcgagatgcaacacgggctggcgcggaagttgtcaagcaggtgggaaatggagttggattaaatcttcaatttggcaaatgaatttattgtagagacaaagatttccaaatctgtcgggccggtcgagctgacactttcagaagcaaccggtttccgggcccggtctcaaaaaccggatttttcgaaaaattatcagttccggatcctgcaaaaaccgtacccagcccatggcttgttctctaatttacagtgacatctttgccgctattttatcctacaatgaatcatttcttatccaggttgacgaccctctgttgagcggaatcctttaccctctgctgcaagcgttggacgaacagcacctcaaagtggtcggtcaatttgggggcgtggatcagcgcaaaatattcattttgtgcgaggaacagctgctgaagatgaaatttgccaagcgtttccatttgatgaatcccgatggtgcccggcctcaccggctccaaaatgagcaggcattttttaatttaactcagcaatttgaatttcatgaccatttttaaaaatgcttttcatcgtttttctatcattttcagttctgaagagaacaccaaaattgatttgttggattcgcccgagtcggtgagtgccaaaattgattctgccgcgtgtcccaaaatgccgtcaactttgtccaccgatgctaaagaatccggcgttggcgacgaaaatggagttctggcattcttcaagcatgttgttgtgccaattcagtctgaggtactagaataaagtgccaaatatgcattttgtgccaagattggttccgcttgtatagtttcgttctttttgtttctattatgtatttctaatttctaacacatttgcacaggctcaaattgtgatcaatggcaccttttttgactcttttgatgccatacgaaatgcctttgtccgtggcgatctttccgaaagtgccctaaaggaatatttgaagaattttttgaacacaattttatcgtccggtcagtttaagcgtttattttatgctttcctttaacataataataaaaaaaaatccttttttttcttctttagtccaacgcaattgtcgtgacaactcgcattttgaggaaattgttgcaaaagcgtatccgtcctccaaaatcatagcgcagttggagcagtacaaggacgagggcacttcgatggacgatttgtgtttggacagtttggcactggacggagtcaaatgcgtgtcgacaccctttggccaatccctggaggtgtttttgattttttaccatttcgagttaactttttccctttattttctccttaagtttgtcgcttcgtccgttcgtgtttcttcacccgaatttctgttctcctccaacaagtcgtccaccgactttcgtccccttcgagttttgtggcgtttgtctccaaagggtcggctgacacttggccatttgagcgcactgttcactctcaaatggctgtccacttttggccatcacatcacaattttgctctccgatttggacgcttttcttgaccacgcgaagtgtccgtggacggaaatgaaggcaaattcaaattttatttatttcaattcgttaagtgtcaactttttaagagtcgtgcgctacagttcgagaaatggctgagggaaattctgcggtcattgaatatggaaaatgttgagataaaacattcttcggaatacgaattcgacaggtgcaatcattctccatgttccgtcatttgtccctccctaattcttttcagtgacttctccatggaaatgtatcaaatggcc

SEQ ID NO: 54344 - DNA, 60 bp, Heterodera glycines
  Genomic contig location: Contig_ID=SeqID_4409; Location=74..133; Strand=-
  SCN-specific regions: Sequence locations=1-60
atggagttgaatgatgcccaacaaaaacggaaagagcttattgttcgaaatctgcaagaa

SEQ ID NO: 54345 - DNA, 288 bp, Heterodera glycines
  Genomic contig location: Contig_ID=SeqID_4409; Location=488..775; Strand=-
  SCN-specific regions: Sequence locations=1-31,53-288
gatgcatggtttgtcgaagtgctcagtgcacatttgctgaagcacaaggacatttgtccgtttgcgctgtccgattggatggaggacattttggacacggaattcagcctgatttcggacgatggcactttggagcccaccgccaaattgttggttgagttggccgatttgactgtcggaaggggcgcacacaaaggggcggaggcggaagcaaaactcgaggagcatttgcaaagactgcgaacactttccgctaaatctgttcgttttcataggattctaatttag

SEQ ID NO: 54346 - DNA, 772 bp, Heterodera glycines
  Genomic contig location: Contig_ID=SeqID_23648; Location=54..825; Strand=-
  SCN-specific regions: Sequence locations=1-104,126-607,629-772
atgcaacaattcccttcaaatttagctttaaatcaagagattgagtcacccaatgcactgaacaacgacagagacgccgaatatcaggatctgcagagagtcgataaaaatgctagaacagttttgcacagagcagctctggaccagaactacagtctcgtgactcagctgtgtgagcgtgctgaaaaaattggactgggtcattatgttgatactatcgataagttcggaaatacaccactgctatcagcttgtgtggtgcataactaccagacgagtaggtataagcttcagtgtatccaggcactgattcagaataaagctgacccgaacaaaaagaatgatactacgttatggacccccctgacatggtgttctttctacggtgagactgaagctataaaaaagctgctagagaataaagggttcccatacttggtggataatgaaggaaggtttcctttagaccattgtggactgcaggtaaatattgtattaggtatagtttgtctgatgtgatgtgtaggataaacacggcaacagaaagaaagctgcgactgtacttattgaaagtcttgtgcagctgattcagaaatttgatgaaaacccagaaaaattggcttatgaaggttacacagattatcgcagacacttgggatcgcctttattaaggacttctgtactatactgggcgatttattttaagctggatgtggacggctatgtgaagaaattgctggcgatgaatggagtatatcccgaacttccgtaa

SEQ ID NO: 54347 - DNA, 962 bp, Heterodera glycines
  Genomic contig location: Contig_ID=SeqID_23650; Location=107..1068; Strand=+
  SCN-specific regions: Sequence locations=1-386,428-962
cagctgagcccgcaaacccagacaaagaaaatgctaccaatagtaaaaataaccaccaacaaaacatcactactactgccaccgctactttatcatccgagacgccagctgagcaaattttagcagatcaagataatagtattgctgagaaagacgaagcaggtacgccgccgccatcaagtggattaggacagtccggtgatgctgctgctacatcagtgactcaagttgaagatggtcgaaatttacctcaagcagccgcgttgacctccaataacccaaaaattgttgctaaacaatcaacagtagcgacagatagaaggaaagagaaaataattgaaaagctgatcgacgaacaagtggaccgaatggtcgatggaacacatgcacagcagaagatgctacaggaagaaggtaaagacaatgagagtcaacaccgcatttcaacatataaactcatcgaagaagtgctacatggtgagcatggacagctaatgtcgcaacagcgcgaatccaaaatggcagctgaatttgcgtacaatgaaataactcagcgattcggcattagaatgggcccaggagtaatgcacgttgatttgagcaaacagctgtcctatgtgttggggtttgatcacaaaacacgcatttacaacaatcagtcggcaaaatatccacctgatctgtctggtggtgtccgtcagctgtacgtttacgcgcctaaactggtggaggattccatcataggtgaccgcatggcaccgttgctgcgagttgtcaacgtgtcagggacaccagggttggacatgccagaggttatatataccaatgaaatttttcattctctccaaaacaaacgcatttctgaaattaacattgaaattcagacagcatttggacgttacgtaaaatttggttggggaactacagtaatcacattacattttagacaaaaactattttag

SEQ ID NO: 54348 - DNA, 540 bp, Heterodera glycines
  Genomic contig location: Contig_ID=SeqID_23651; Location=316..855; Strand=-
  SCN-specific regions: Sequence locations=1-2,25-51,92-316,338-352,374- 428,455-499,521-540
atgtctggaagtgaaccaatgtctaatgagatcctaaacaagtcagtaataacagttgacagagaagaatggcaaatttttaaaattttatagctaatattatcgggagaagtgccatttttattcggaagttttttcagaagattttgggtctcgatgatgttaaaatttatatccgatataaagcattgatcaatttctataatattacccaagcatgtatagcttgggtcggtttcactattattaaatgaattggcaaataatgtggcaaataattcagatttctcagcactattatgatagcatttattttcataaattagattaggtatttcaaagggattgacattgaatttttgtatatatttataaattgaatttattccttttgaaatagcctttttctcaatttggctatggtatttatttgtttgtatttttatatgtaaagaaatgctatcgtatagtgcttttttggatgggtcagttttagcttgcctgaataatttagccttttctttgatggatgctaataaa

SEQ ID NO: 54349 - DNA, 1064 bp, Heterodera glycines
  Genomic contig location: Contig_ID=SeqID_23651; Location=731..1794; Strand=+
  SCN-specific regions: Sequence locations=1-34,75-101,124-244,266-1064
aataaaaatggcacttctcccgataatattagctataaaattttaaaaatttgccattcttctctgtcaactgttattactgacttgtttaggatctcattagacattggttcacttccagacatctggaaagaatcaattgtttttccgcttttaaaaagggtgacaaaaataatcccgaaaactataggccaatttcattaacctgctcactctgcagggttatggaaagaattttaagcaaaaatatttacaattttctattaaaaaacaaaaaaatttcggaatttcaatttgttttgttagaaataggtctacaacgagtcaactaataacagttgtggaagattggtacgaggcaataataaatgaaaaaaatgttgactgtatttatattgattttcaaaaagcatttgactcagtgccccatgaattacttttatacaaattggaaaaaataggtataaggggcaaacttttgatgtggataaaggactttttgagtaataggacttttcgtgttaaaattggggatgatttatcctccagtaaaaaagttggctctggcgtcccccagggctctctgtccttggacctttattatttttgatttatattaacgatcttcctgatgctttgccatcaggagtgaaaataaaattatatgctgatgatgttaaattgtatatttgttataaagcaagaaccgaaacagaaattatgcataaagcattgcataatttatcagaatgggcaaataaatggcagatcagaatctcaattaaaaaaacttttgtacttcatttggggaataaaaaccccaaagaaatatataaaattgatggaaatataataaatgttgtggatacaattagggatttaggcataaatattgataataaattgcaattttccaatcatgtcacacaaataataaagaatgcatatttacgtatgcgttctttatttcgggttattaaatcaaaatcttctaggatttggattattttgtacaaaaccgggggggggccgttattggaatatgctcctgaggttggaatcca

SEQ ID NO: 54350 - DNA, 631 bp, Heterodera glycines
  Genomic contig location: Contig_ID=SeqID_23653; Location=1182..1812; Strand=+
  SCN-specific regions: Sequence locations=1-162,184-330,353-631
  Gene Ontology: Mol. function=chromatin binding; Cellular component =SWI/SNF complex; Biological process=signal transduction
atgagcggtggcatttatggcggaggtgtgtgccttccttttgcaatttatgttttttgagagtgtccaacatttgttgttcctttttcagatgacgtcggtgcattggtgttcgaccccggctcgcacaggttttgatgggtgatgggtgcgcaaattccgtctttttgtacgccattatatatggcaataattgttaaaaatttgcaaaatctcgactaaaattgcatttaaatgacaatttttccatgtcctcgcctggccatttaaaattcttttcatttcatcccctggaatttcacaaaattcatttctaatactgaacctacaaaattacatgattttccttttttcgattttcgtcatttaaccattatggttttgttcagtttccgcgtcggttacggtggcgaggagttcccccgctttgacattccggcacgggtcggcgtctgtcctcggccttccgccggcactgacgcgtcccaaaccgctgacgccacaattgaagaggtggcctcaggacggggggccaacgccagcaacaaattcgaccattacattggcacaacaaagctgaatgtgccccgggccggcatggaggtgaagccgtacatgcgggagggcatgg

SEQ ID NO: 54351 - DNA, 218 bp, Heterodera glycines
  Genomic contig location: Contig_ID=SeqID_23655; Location=416..633; Strand=+
  SCN-specific regions: Sequence locations=1-218
catttttataatctttcaaatccctcactacgaaatggaagagccaaagcctgcccaaacgtcgtttttcctctggtgatttttggggttctgttgagggattggaattgaccgagcgattgtttaggatgaacgaaaacaggcacagattctatcagccggggatgactcaggcggacgtggcaaaggccgcaggtcgaacaaacggagggaactga

SEQ ID NO: 54352 - DNA, 1347 bp, Heterodera glycines
  Genomic contig location: Contig_ID=SeqID_23656; Location=187..1533; Strand=-
  SCN-specific regions: Sequence locations=1-564,586-1347
  Gene Ontology: Mol. function=ATP binding; Cellular component =cytoplasm; Biological process=protein kinase cascade
atggaaaccgtggaaaatgggcacgacgacacgcggcagcagtcgtaccacacggaacggacactgctcgcctcacagggcgaagaggacgaacggaacggagacgacacactgcagcaggtgggccgaaaaggagcaatgaaaacaacgggtgaccattggaacccacggaatgttgtccctttaggaagagtccaccgtaaatcaccagtcgccaaagaaaaaggcgccaccaaataacgctcgggtggccaggagaccgcgcgatttgcgtggactgttccctcgggcacaccgaccaatttcctcggcaagcgaacagccgaccacccaactgaagtcgaaccgattgttcgcgcgcattgacgagtcctttcggagccgttggcttaaactacgctcaaaatcgacttcgatggtcaacattacaggtcaattcgttgcttcgtaaatgatagttcgtgttttttaggcatttcctcctcgaaggctcctcctttttcccatgggactccgtgggccaatcggcatcacatccatcagccattccagtcccgtccgatgacctgctgcttcggaatggttgtccctttccttatgaaactccaccctttcattgcttttccgaaggtgccaaccccccaagtcacaatgggcgctgttcgttcgttttcccttgccaagtttaattatttcagcattggttcagtgttttgtctccctattgcacaacattccaattcatgtcaattgttgtgcccaatatttccacccggccaaccgtaaacagtttatgatcatcggtgccgagcagggcatttttgcaatggatctcacacacctcaccacggaggaggaagccctctttcaagtatgtctctgtcgaagattaaatttcgattcgccggtttgtcatttcgtccaattgttagcttcatgagcgtcgttgcacttggctttacgttgtcaacgacacactcaccgcactgcagggaaaaacaccgtatctgtacagacatgagatgttgcagctgttccagcaggaattgatcactcagaagttggccaaatcactggacaagttgccgcagaagttgaaaccgaaggcattgatgagcacacttcgaatgccggagacacggtcagttgaatatggagattggcctaccaagatttgcttggtgattggcccaggatcggggaagttgggtgattaccacaaaggtgttaaattattggccaattttgcttgcaaattcatgaattttagcgattgctatcagtgtaacgtggaaaggagcatcaatgacgaaaacctttacctttgttgtgccgttcctcacgctg

SEQ ID NO: 54353 - DNA, 1197 bp, Heterodera glycines
  Genomic contig location: Contig_ID=SeqID_4411; Location=1311..2507; Strand=-
  SCN-specific regions: Sequence locations=1-28,50-592,614-627,671 -698,731-753,775-1147
atgaaaataacccaaaataggaaaaacaaaagtttcaaaccaaaagaatcggatgctgaaggaaagtgtccgggtgatcttctgcgaacattagtaaggcagaactgatggtattgctgtgcgcacagacacgtcgaaacaatgtttttaacgaacggttctcttcttgtaggctacgaatgacctaaattttgagaatgcaatacactcttagcgattttgcgatagaaacttcttgctgttgctcaacttgttcttcacgcgatttattgattagtccgcgcaccatcttgaatagtattaaaaaatgattttggacctaaattggtttgcgatttaaatataaatccatctaattactagggaaatggtcgtttcggcgcccacggttcggcaccaacactagcttttggactataattttttctttgtcaactaaatctaaaattcttagtatcattcgaaagcccttcacatgctttagatttggttgatatcaatcaaaaaaatcattgtcaaaaaactagggctggcgccgaaacaacccctactcttttaatgcagtttataagcttttatatatgattttaagcaataatcttttttcaattttctgataaaaagatgaagttgaaaaatgaaaaatttgtaatcatttaatttaatgaaataaaaattgtatatggaatttgaataccaatttttttaaacatataaattatttttttttggcgaatcgttatttatatttcgaaaataaaaatattaaaacaacgggtcggggtcgttttcgtacggacccaagtttttggctataacttttttctttgtcaaccaaatccaacgatcttgatatcattcgagagttttgaacctttacgagatttttcgaaattttgcaggctaatagaggacacttagggttatcgaaggataccaacaatgttggatttgacgagttgggtgtcgtccgattgaacacaactagagcattacggtaccaggatttttttgcaaaaccgtaatcggactttcctggacctgaatctgggttttcgaccggaatccggaacttaaaaaaatttgagttaaaattagattacgtaagttttgatttgcctggaccgggaccgtgctggcgcgtaagattttttaaaattttatgccataattttttttatttaagtaaaaattaaa

SEQ ID NO: 54354 - DNA, 2781 bp, Heterodera glycines
  Genomic contig location: Contig_ID=SeqID_4411; Location=3301..6081; Strand=+
  SCN-specific regions: Sequence locations=1-546,569-574,596-670,692 -1108,1130-1139,1166-1686,1708-2069,2091-2465,2487-2578,2678 -2749,2778-2781
atgcccggtggaactgctgcagtcgagaacgacgccgaagtgacacaggcgagaaaaggtgttttttgacgggcacacaaagttataaaacttaacgcattccacattgtgtgaatgctgattcactgttctgttccgagaccttggcttcggaacggagtccaaaatttgccgggaatcgaaaccaaaagccgggaatttgccggttatgagagacccccgaacatttaaacagcactaacgcttttcattaataggaaagccgagcccgaagaaacaccgtccgtttcgcaatgttttcaaagctttgggcgacggcgtgtcgaaactgaagttctctacgcgaaagcgcccagaggtttttgagtcctccataaacacacatccaaaatatacgattgatattaatttttggggagcagctcgttttcccctcccagaaatttataaaaaaactgaattttttaaaagaaaatatctcgaaaaaagatatttgaaaacttcaatagcgatttttaaaggtttatgatgaattgctgttttttctaaaaaaaattttaaaaaaattgctgtaaattttttctagaaatttactttaatttttcggggaggcgaaggtattgcaccctaattttggacactggcttaaaggccgctatttgccaatctctcctcccttccctcttctctcatgtgcagaagcagcagcacgggacgacactgtccgggacggatcagcgccgaccgcaattggcaccgactttcgatgcctcgattgccgagcagtcaacgttccaatgggcaacggaaggtcaatcatcgtctacgagtcaatgggcaacggaaaaacaggacgttggacagtacaaagaattgcccaagtttgggcacggcggtgggggcggccaccgccctttctgaatttcgccacgtgataagacaatgccatgaatttgcgctttacattttaaacttcaattaacttatctcattttctgcgtattttaatttcattttattctttattttcatttgcttgttcgcttatgtttttccttgtgtcttatggataaacttaattcttttccttttttacacaattaccgcattttccaataatttattgcctaggctaaaacaaaaatttaaaaaaaaatttttttttcatcacttaaattcttggtccgcgcatgtcctcatttgacagatttgtttgaatggaaatccaagttttaagtatgcccttatttcgaaaaaaaagaattctgcttaatgtaggactttgacctgtattttctggacaaaaatccaggacaagcaaacatggtttatcccatggttcattctgacaatatgtagctgactaagtttttttggttaaaagagacaaaaaaaataaaaatttgtccaagtcatcttcggaattggtgctttttggcaaagcctgtttaacaatttttttttctaaaatctaactccaaagagtgtcatttagaaaattccgaccatccaagtcccaattgcagtgtaatagaatatttaaaacacatgtttattcataagacggatataccaagcagcgagaaaaagcaaaaagctgatgaataaaaaatacgcaaaaagcacataaacaaaggaaatggaaaacagacaaaagaaaattatccaatgagagagactgtcccaaaaagcacccaattaaacccgaaagcactaatttataccataaaaacaatttatggtgtttgtctttggggacagcctctgaaaattgcataaaatggaaaaaaaacaatttgccaaagaaatttaaatgaaatgaaacgaagaggaagaagacttatgcataaaattccggcatttgccaatgttttcatcacattttcaggcaaccgggctcgtcttcttcggcgtgtacacattgccggcgccggcactcggcgagttgggcggccgagtccaagttcattttgtcggcgacacagtgtgagtgagacgagacaaatgggcagatggccaaattcaaagcaaattttaaacgccaaacttttttctaattgttaagataatcttggttcttttgttttgatgaaccaaacgttggcacactaataaaattaagtggaatttttaataatgcttaatttttgaatttttagttaaatttaagtgaatttagtggtctgaacaattttaaattttaatgatgagaagattatgtaaaatttagataagttctgcatttaaagcatgacggagaatttgggccaagaagtcgtaaaacatttttttaccaggtatggctctttttgctctgcccacaccgatggcacagaacggtgtctttcctgcgctattcggcgtccaaagggtacggtaattgaattggtttttactaattgttcgatcaaatcgggtaatcaaagagatattagcgattctgctccagtaattcgaacgtttgcaaatttttgatggtattttttaggttactaagaaaaattggttgataaatgcccccatttgtcggcttttcccctttttagcgttttcttcctccgattaataagggggaaaggagagagagtgcgggaaagagagaaacatgaaaggaaaaagaatgagagaaagcggaaagataaggcgatagagaaagggagagaaagagagagagagacggacgggggtaataccaggggccttatgctcgtctcgcggtttagtaaaccacggttaacgcgttaaccacagtttcatattttgaaatttaaaaataattaa

SEQ ID NO: 54355 - DNA, 1733 bp, Heterodera glycines
  Genomic contig location: Contig_ID=SeqID_23660; Location=1..1733; Strand=-
  SCN-specific regions: Sequence locations=1-494,756-847,956-1078,1146 -1220,1242-1283,1384-1394,1416-1418,1444-1459,1481-1733
  Gene Ontology: Mol. function=protein tyrosine kinase activity; Cellular component=mitochondrial inner membrane; Biological process =transport
ggcttacttactaggatttggttcgaaaaaaaagccataaaataggcacttaaaaaatggaaaaagcttcgaatttagaggcctaaaatgacaaagatcaaaaagcaacaaaattaagtcaaaatcagtacttgagatagctaatttgaaaatcaaatattcttgtcaaaaaaataaaaactatgttttggagatgaatttttgagaaaattttcatttcttagggggtatatttttgaaaatttaactaaatgttttggcgctatgtttggcacaaattcaattgtgtctttttttcaggtggcaccaaagtgacgttgggcagcaacaacaaaaagttggagacggacacttatgcccattttttgtacaaccgggagattgtgtttggtgtcaaatatttggtcaaagtgcgcatcgatgccaaacagttaggacaacttagaaaggtgaattgaaaaaaatacatttttaaaatttgaaattgaaatgccattttttaaatttcattttaaaaaataaaaatttttcaaattgaataacaaataatttttttcattttttatgtttaattattgaaactataatttatacataaaaaaacttttaaaatatttttacttattataaaattaattttattaaaaatataatttgtttgtcataactaaatgaaaataataaattaaaaaaaaagattaatagtgataataaaaaaattttaaattacgaaaaattaaaaatattttaataaacgaagtttatttttattccatctttgagaaaaaaaatctaacaaaatatttttttgaatgattaaaatgattttagtttttatatcttattatatttaattattattaatttataattaaaaaattaataattaattaataattttataaatttaattaattgttataaatttttttaattgtatttaattaatttaatttaaatttttatagcttcgtttcattgaccatgacaatttgaacaaattttatggcatttgcacggacgcgccaattttgtacgcaatttggaagcattgccaaaggggcagtttaaaagtgggaaaattaaatataataaaattaagtcaaaatttttttttaatatcctaaatataaaataaaaataaagaatttgatcgccaaagagcagtatgttggcgatgtgttcgttatggtttcacttatgcgcgacattacaaatgtgggccattttattttctcaaattggtgaaatttaacccccctaattagtgatttaaaagagtgaaattatttatttcagaaataaaaaattaattttcgaacattttaaatttgaatttttagatttaaatttttttttaaatgggtaaaataaaaatttattgctgaattttagtttttaaattaaggtttttgatcatatattgtttaattattttaaaaattccctaatgcatcaaaatagagaaatttcccgaatttagggtttgtctgcgctgcaccaaacgtttgtcggcgcccgatgggtcgctgagttcagaaaattgtctgatcgatgatcggtggcgagtaaaaatcgagtgattttggactgaatttgatcggagagagtcggccgatgccacgggcgagtgagtaatgttgacgagaatgtttttagtattcgattttgaatttcaaaatttgaatttcaaaaattaatttaattatacaattcggaattttgaaaggacc

SEQ ID NO: 54356 - DNA, 939 bp, Heterodera glycines
  Genomic contig location: Contig_ID=SeqID_23661; Location=119..1057; Strand=-
  SCN-specific regions: Sequence locations=1-520,569-618,646-675,697 -788,899-939
atgccgaaaccattcgatttttccggagaaggaaaattttccaggtttgtttcaatctgaaaaattttaattttcactgggagtaagcgaatattaaatgatttaggttcggtcattatgttgattatatggaagaaatccgtaggaaagatgtctctctgtcatatgcatcagtcgacgatattttcaaaaacatgcctgtaaaggcgtattgtgcggtaacaaataattgtcaacattggagtgatgaattcttcaaacgaagtttgagattaaaaattgcttaataaactgagatggattataatgccaatataagccaataatgcgtttgctgttatgaagagggggagggaaggtcccaggattcctgtttttttgaagtagcggaatggttgtttaccgaaagtcaataattaaaaaacaaaaatgtctcagtgttttatctacttgtttgagtcatactgtaggttattaagatgctcatcgacacgatgaattctcgaaagcgccggagagaagtttggacgacatgaagacggtcttctacaggagtttgcacaaaaatgtaaattaattttttttgccgtgtttcactcactcactacaattttacagtttgacgatgttttcgacgagttcgactcccgtccatgtggcgctgtgcgttttactttcatattcctaattgttcatttctatacaattaacaaagattaattttacattataatggcatttttgttttccgtatctctgagtggtcttcgaattcgtttaggcttctctcgcgcaagtgcacagggccaagctgaagtcaagcgacgaatacgtggcagtcaaaatacaacatttgcatgtgaaagaccgcagttttgttgacatggccacgatggaggttcagttcaaacaaatttttgacaatgcgaatagaataaa

SEQ ID NO: 54357 - DNA, 645 bp, Heterodera glycines
  Genomic contig location: Contig_ID=SeqID_23662; Location=396..1040; Strand=+
  SCN-specific regions: Sequence locations=1-167,189-645
  Gene Ontology: Mol. function=potassium:chloride symporter activity; Cellular component=integral to plasma membrane; Biological process =embryogenesis and morphogenesis
ggcagtgtcaacactctcattcaaagcatcggaattggagggttaaggccgaacactctgctcttaagttggcccacgacagaagtgggcaaagacgaagtggccgactcggaatatcgaacattcactggtgaaatgaaaagcgagattgtctaaaaatgaatcagatcaaaatcacattgaatttccgatttaagacaaattgttggctggcgcggttaatggaatggcacttttggtggcgaagggaatacctgaatttccgagcaacgttaaattgagtggctatttggatgtttattggattgtccgagatggcggactgtgtgtgctgataacttttctgctggaacagaacgaagtttggagcagttgcaaaactcgaatcgttgcagtcgctcgtccgcaagaaaacagcgcaaaactgaagaagcaaatccaaaactacctttaccaattgcgaatcgatgccgaaattttggtggggggggggcggggggagtgatcggacggttaattttattcactcattgtcaggtgacaaaactcaatgacccagaactgtcgataaccgcttacgaacggactttgcttatggaggaaaggacgaaaatgctgaaacaaatccaacggcgaggaatgccc

SEQ ID NO: 54358 - DNA, 661 bp, Heterodera glycines
  Genomic contig location: Contig_ID=SeqID_23665; Location=288..948; Strand=+
  SCN-specific regions: Sequence locations=1-52,81-144,166-221,243 -429,451-452,474-553,575-600,638-661
atgccatcgctcattttgtactcacttcctactcttatggtatttttacatctaaaatttttaaattaaatttatttttagttagcaaatttggcaattttctttggccaggctctgttcagttttgttccgcacattttgctcgtttttgcaattattttcttcgaaggaatgctcttcggctcgggctacaccttttttggcaaaatccatagaaaggtcatttttattaattttatttgtgaaagtccgctttagcacaaactgtgggcgtaagagtattttctagagatcgacttggacctgtatataggcccggatttttcctggatccaactccaggtccaggctattttttaggcaacctggattttgttggacctgtgtttttctggattttgtccaggaatccaggtcaaatatgaaaataatgaccaaatatgaaaaacttggatttcctgaacaaaattttagaatttattatttcaagtgatcgatgttttttcaagttttcaaaaaatgattatttagatataaaaacagattttcttttaaaattataaatttttggaggttcctaagaaattaattcattttttcaaacattgttttgcttttaaacaaatttcaaaaatacaggtccagccaggcctggatccag

SEQ ID NO: 54359 - DNA, 653 bp, Heterodera glycines
  Genomic contig location: Contig_ID=SeqID_23666; Location=309..961; Strand=-
  SCN-specific regions: Sequence locations=1-63,85-96,119-142,179 -319,347-653
atgtcggggatcggggtcggggaccggggagctcggggtaggggagcaaccctaatttaaattaaatcttctcattaattacacataaagtgaatgtttttttaataaaaatttttttgatatttcgacttaagattgatgcttttttagagaaaagttttttgaaataaaatttaatgaaaaattcgatcatttcaacttccaaatttgctataaaaaagtaaacgaagaaaattagtgttttttacctgattttgatttgattcgcacaaaactaagttttacatttatatgttaaaataatatcaatccgaaaaacagaccccaaagttttaaatttaaatttcagctcctccaaaatatgttttcatttggagcggtaacaatgagaagaagaacctcgaggttgaccccagagtgatccgtctctccatagaactcagcgaattattccatggtaatttaaaaaatgaacatttaccagagctaattattaaatttattaagccaaagaagatcaaccggacaatgcgcaacaacaaggagaagaggtccaagccaaaaatgatcaatcggtcaatgcaaaacacggaaaacaggtccaaaccaggaaaaagctgcaagagtctttcttcgccaatttaattttctga

SEQ ID NO: 54360 - DNA, 1381 bp, Heterodera glycines
  Genomic contig location: Contig_ID=SeqID_23667; Location=39..1419; Strand=-
  SCN-specific regions: Sequence locations=1-1,23-108,130-259,346 -406,430-452,474-954,976-993,1017-1187,1214-1214,1236-1356,1378-1381
atggccatcccgcagaattctgtgattgtattggacggcaattattgtgccgatgaacagatggagtcagtgagtgccatctattggggcgaagatgcactcaaggtttgtcttgcaaaaagaaatttttgaaaatttgtatttttttaattaatacgttcaacccgccaatgcctttcgccaccaccgaacgatacaaatcccttaatttttcaaaatataacccggaaatgcattaaatagatcatattttggaaagttttatatagtaaatttttctctttaaaaatatcaaaaaaaaaattttttgttttttaaattctgtttgaaaattttttaaaaattgggcggaggcgagaactgttccctaaattttgctttgcttctttcctctccatttgaattaaatttttaagtgcttattgtagtggaagaagggggggggcaagacgaaaaatatttaaaaaaaaattccaccgagacttgtcattcattaatttgattttaaaagtgcagatccagcgtggttcatggttttatgccgactcctttcaaccaatccgtgccgattttgccgacgaaattgaggcgcatcatttgaaaagttttcgggacaacgtcatcccggaaacgccagtgttcagcgacgctgagtcgagcaaaaagccaggcacatgcaaaactatgggataattagcaaacccccccccccccaataatgtacgtttttccagtattattagtatttttaaggtatttgggatgccaaaaaatcaaatttgggaaagttttttttaaattacctttgctaaatattattttttaagttttaaccacattgagatggaatgacaaggaggtcaagtggaattcggttgtggacgttttcattgctggacggaaaggtcgaggtaatgcaaagggggggcgggggggaagttatatcgtggacccgaattttgggagaaactggggaatatgagaggtaaggaaacataactttgtaaaaagaaaatagaatttgtgggacacatttaagccatcaaataattgggagcagctcgtcccccccccccccttcaattttttttaaattctggggcgccccgttttttggttttagacatttcgatttgcccagtttccattggttttttggaatgtaattagtcaatcttttcactatcaattattaattttttttttaatttatgcccctcccctcccccttgacagtgttgcgttgggtgacccgcgcggagggcaacacgccattgcgccgtggtttcaaagaggaggcaaatgcgctggacggaatgccaagtttctctgatctcattttggttgtgcacggtaatttgagcattaaaataataataaa

SEQ ID NO: 54361 - DNA, 912 bp, Heterodera glycines
  Genomic contig location: Contig_ID=SeqID_4412; Location=125..1036; Strand=+
  SCN-specific regions: Sequence locations=1-912
atgttaaaaatacccggtaaacttaaaaagtacccattcttctactcgaaagaactcactgttttagtgaaaagtgctaggtaaataattaattaatttgtcataaaaaaaattcacccgttcaagacaattttcgggcaattcactgttttgacaagcggcttcaacgtcctcaatgcacgggcgacgacttgaaaaacaaaatgatgatgaattcattccatgacaaatttgtcacaaaataatgccaccataccttcttagacatcgttggcacaacagaacgccaggcggaagacgggcaaaaaacgggtcccattgaacacagacaactgtgacaatattgaaacgattaaatgatggtgaatgctttttgaattttaggaaatgtttttaaactttgtatagcatcattaatagggctgggatttttagttttttaactattttttctgcggatttaactcgacgaaaaatgcacaaaaaacacatttttagctcggaaattcttcgttttaacgccactactattcatcactaggaatcactattttgaagctttgccactaaaaaaaaattattttggaagttggccactaaaatcatttttttccactattttgccatttttttgtcactatttagttaattattttggggttttttgccactaaaaatcccagccctaatcattaatcatcattttttttcactgaaaaatactggataatatgcctgtttttctggatgtttttacatttcgggtttggttgaacaaagtaaattgcggtgtttttctttcgagttagaaaaaaaagaagaaagtcttacggccaccattcctacccctcacccgaattgtttttttaaacattcacgtatttgcaaaaatttttttttaaatcgctgaaa

SEQ ID NO: 54362 - DNA, 2109 bp, Heterodera glycines
  Genomic contig location: Contig_ID=SeqID_4413; Location=81..2189; Strand=-
  SCN-specific regions: Sequence locations=1-549,584-1496,1518 -1770,1794-2109
atgtgctccaaatgcgcgcattggccgaccagtggcgcactgctcgcttcccgcactgtgagcaaattcagcggatcaaccaggcgattgtgcagtttgagcgcacatcgaacgccgtgcgcaaaatgttgaaccgcaaaattcgactgaggtctgtccataaactgattttgttccattaatacactgcttgcttgctgataattgatcagccttaaatgcttttttttgtttacagagatcaaacacgctgtcaaaaggcggacacgcgctgggaatatgccgaggtttcttaatcttaccaagaagcgaacaatttcgaattgcaaatgttcaaaaattcataaaaaaaattcatacaaaattttcaaactcatgctagagccaaaaatactttttaaaaatgaccagcaaaaatttatcattaaataaaataacaagaaaaaaaaagttagatggaataagtttttaaaaaatcgaaataaaactcaccatctctcgagcggattcgaacccgtgacaaatgatgattaaaatgtaagcgggaaatggcattaaattatttttgaagtgttaattttgtaagcaaatttgtcatctctctctcctgtacatataacattttttttttgattgttcggttttcattttatgtgtatttatgtctaaatttgtatttttttccaggtgcttcgtcttcgtcaacagttagccgacacactgcttgaggacagagaattggaagatggcattcaggtcggtgccattgaacaaaaatcatggttcagttttgggtccttgtacgtctcgaatcactagcatttttttccaaaaatcctggcctggttcagtttagtccctggaagtctagaaaccctagcattttttttcataaatcatggttcagttttgggtcctggtccttctcagaagccctggtactttatatttggttgacaagatgcggattttctagcccaattttcatgccaattcttcttacacaggacctttgccatcgcgttgagcggtggaagtcgcgcgcaaacgcggcactcgagcggtcatttgccgccgccgctgcacaacaaacagtcaatgagctgtacgcgttggtcacggaggcacgggaggagttcaatgtgaagctggaggccgaagggttggaccgactgaaatcggtgagtttaagcaatgttaaaaatgccattttccaaaaaaatggcacaggaattggcacgctgtcaatggctggttaatgcgcaaacaatttggcgacaaattgaacgatgccataacacagcgggaaatggcattgcaacaaatggggaggatgggaaggaggaacagaaacaatcggtagatgaacaaaaacatcacaaagtgacggaggaggtagaaagggactcaaaaaaggacacgaagacggaggacgacaaaaatgcggaagggattgtggaagaacagtcatcaacaattgatgagggaatggcaccggaagaggagggagaggaagcggagggcgaggatgaacagaagcgggtcgaactgcacgagttggctgtgagttagttgattttaaagcaaaagaccggcggaggcggatcctgtcaatcccccccccctcctcagaaaaccgttgctgacgggctcaaatggtgcacgagttgtacagcagttcagcaactgaatgccaagctggagcactttctcaaccacggaaatgcacttgaccaacgggcggctgactttttggcatttgcacgcaatcaacaacaaaaacatcaacaagcattgccaacaacaactacggcacagtcgtcgtcgtcttcggcgggtggcggttgtgttgcaaatactgctccaacgggcgctgttgttgccgttgttggagttgagttggcgcgacagaaatgggccgaaatcgccgctgcaatgacagcgcaacagaataattgtgatggcaatgatgctgccgggaacggaggaccaccatcatcatcatcatcagcctttggcattgattggatccaatcgccagcaattgaccgttttcgagcggaactgcaggcaatggcaatggaggggcccagggatgggacaaattga

SEQ ID NO: 54363 - DNA, 3365 bp, Heterodera glycines
  misc_feature (1027)..(1027): n is a, c, g, or t
  Genomic contig location: Contig_ID=SeqID_4414; Location=1..3365; Strand=-
  SCN-specific regions: Sequence locations=1-273,303-1493,1515 -1814,1840-1993,2018-2543,2567-2760,2791-2899,2923-3365
  Gene Ontology: Mol. function=protein binding; Cellular component =nucleus; Biological process=transcription from Pol II promoter
ttgtttatttggaataacattttgtcaattttcactgtgttttcttttttgtttcagttataagcaacagtatttcaaccaggagccacgcgtaagttgactgttttttttattttttcttaaatttctgtaccgtttcccattcaggaggtcccaccggaccgcgtggaaagggaattttggcgcaatgtgatcgacattgacaagggtgtccaagtgaagtacggggcggacctgtgagtttttttttgtcttggaattccccaacttatgaaaaaaaagaaaaaaaaaaatttaattttcggaatttctcccaacaattcaggactctagggaatttgtgccttaaaactctaaccaacaatttatttggatgaattggcattttttcaaggagagagtgaattttgggaaattttgacaattcgattaaaaaaaactactaaaattcttgacaaatttctgaccctaatccctatattcaaaccctctcccccggcttttccatccaaaacttttttggatttttctttgaaatcctctttttttacaaatttttctaaatggtttatgtgtatgtatttgcattattgctcgacaaatgcgattttccggggacgggaaaaaccaagaatttcctgacgggaaattgttgccatgccaaacattggtgtaatgccgtatgtattttacaaatgtgctcctctcattcctcccccaatttgttgcgcagcatttcaagcaaagtcggcagcggttttccgcgccgtgaggacgcgtcggtgcgcggtgttgcggcggacgcgcgggagcgccaacagtacgccaaccatccgtggaatttgcacaatttgccgaaggtgcgcgagagtgtgctgtgccacatgaccaccgacatctccggcatgatcatcccatgggtgtacattggcatgctgttctccaccttttgttggcacgtcgaggaccactggtctgtgtctgctgtttggtggctttgtggccaaaaaattgtggcattttttgngatccagaatccggttatgccctcgtctgattccttattgtttttgggcaaaataatttgtctacgccgaattgaaacagttcaaaatgctccaaaaattttagatacagcgaatttctaactgtccccaaaaattatagaattttcgggattccgaatccgtgtacgcccactgattctaattgtaagactgtgtttttgggcatgggcatagtaaatccacatttctacgccgaatttaagcaattgaaaatgctcgggattttctggaatttttttttcatacctttgccaacaatttttattgccaaaaattctatgtctgtttggtggaatctaattatccgccttccacattttatgctgtattccatcaactacaaccattggggggagcgcaaaatttggtacggagtgccgggcgaagaggccgaactgttcgacaaagttgttaaaggtgtgccggaattttccatggaattttgatcataaattttcattttttcaacagaatcggcacctgaattgtttatggagaacaaggatttgcttcatcaaatgatcactcacatgtatttgtttttttaaataaaaattgatcatttttgaagccgtttatgccattattattttttgacagaaatccgcaatttctgatcgaccgtggcctccatgtgtacacgggtaaggagaacataatgccagaaaatgaataaattcaatttttttttgccggattttacgatttcatttctcccaaaaaatccactctctaggaccccgtttgaattaaaattaattatttaatttttgatccccccccccccgcttaaagtgcatcaaaatgcgggcgaatttgtcatcacatttccacgttcgtaccatgccggtttcaacgagggcctcaactgtgcggaggctgtcaattttgcaccgcccgattgggttccgtttttgggattttcgaaaaaaatttttttttttaatttagctaaaaatgggtcgtctctgtttggagaactacgcaaatgtgggtcgtacttgtgtgttctcccatgaggagctggtgatgaagatggtcactgttgcgcacaaactgagcattggttggtggtgctctctcttttttttccagaaaattcccaaaaagtggtaaaataaatccattatcattctcttcaccctcttctccaacccctccagcgatgtgcatggccacgctggacgagctgagttggattgtggcgcgggagaccgactttcggcaccgtctgtccatcgccggtgtgtgtgccaccgctttttgccgcttcgaggacattccggacgacgagcggtcctgtgccgtgtgccgtaccacgctgttctgctccggcctgtgctgtcgccatgacgggcgcatggtgtgcgcgaagcatgtgcagcagttgtgcaccgagtgcagcatggaacagtactgcttgaagtgggtgcttttttggtgccaacattttcaaaatttgcccccccggccattcataaaaattttagaaaaattttccaaggcgagtgcaaaaaacattttaaatggacctccatctctctgctgttttttaaaggttccgctacacattggacgatttggtgccgcttgtccaccgtctcacggagcgcacaaccgctttctttgagtggcgcacgacggtcacgcaactgttgaacgacacgactaagacgcccagcacggaagctgacgacaacaacagcagcagcagcaacaacattgacggcacaactgatggcaaattgatgaaaatggacgcagaagaaacaaacggcgatgaacggcttggaaatgttggcgacaacaacaacaacgacgggggaggaacggaaagcagacagaggaagaaaattggttagcgcaataaatgtagcacaaaatgggttagcaaaaaaaaaaaaaaatttttgtgatcggaaaagggtgcatcagtgatactgtaatttataaagcatggtgtacggtcggtcattggttgagtgtaaactgttatatgtacattacatatgcctaacgttttcccaatttctggagatttataaaaaatttgatgatactttttgaaatggtttttgaaatgctggattgtgaatctcgcattttttcgggagccgaaaaagctgtcaaacaatataccgagattttacagacaacatccaatccgcaacttgtccccccccccagtttttttaaattgcatacttacaagggaacattccgaactgtgactgctcaggtcgctttaaaaccacttttatcgtgtagagcatattcgatttactattgccaattttc

SEQ ID NO: 54364 - DNA, 213 bp, Heterodera glycines
  misc_feature (29)..(29): n is a, c, g, or t
  Genomic contig location: Contig_ID=SeqID_23668; Location=1140..1352; Strand=-
  SCN-specific regions: Sequence locations=1-148,170-188,210-213
atgaatataagcaaaaaggaagaaaatanttcggcaaaagaatggcaccaaaattataccgaaattggcaagaaaattggagtaagttatggaacaattcgaaaatggaagaaacaatttggaatgaatggaggagaaagattaacggagaaagaaaaaatggagaaaatgaaaacatattggcaaataaagcaaaaaagaattgaagattaa

SEQ ID NO: 54365 - DNA, 627 bp, Heterodera glycines
  Genomic contig location: Contig_ID=SeqID_23669; Location=430..1056; Strand=+
  SCN-specific regions: Sequence locations=1-323,345-627
atgcgcgccttcgtctcccactgcggtttgaacagtgtcagtgaggcaatccaatttggagtgccaattttggccattccgctgcttggcgaccaactgtacaatgccattatggcacgtgtaaaaggcattgccgtccaattggacattggccaactcaacggggagggggccgaacagctgctggtcgatggaattgacaaggctaattagcaccagctaattatgtctttaataagtttaattgctttgcaggtactaaacgacccttcttatagccaaaatgtcaaattattgaaacgaaagttcgcttcggccccttttggggccaaggaaaaggtgatccgataggtggaattcgcagccgaattccccgatctgaacgagttgaatttgccgtgggaagaagagctcggcacattggcctattattctgtggacatcattctgtccattgctgcaatgttgggaatatttgcttggattcttttcaaattggcaaaatttttggcaagaaaatatttgatttctgtcggaaagggagggcaaaagatgaaaatgaattaattgattattttgataaaatttttgtttttatttgttatgttcttttttgaaattaaaaaa

SEQ ID NO: 54366 - DNA, 1449 bp, Heterodera glycines
  Genomic contig location: Contig_ID=SeqID_23670; Location=178..1626; Strand=+
  SCN-specific regions: Sequence locations=1-227,249-320,343-409,431 -1001,1023-1280,1302-1449
gacgaacgcatcacagaaaaggaaggagatctatcggtggcatttgacaagcaaatgaatgcctaatttcgtcaatttaaaactgtttaaggtataaagcgtcgttcaatgtttatgcgatgggatggtcaaccaaattggacaagtgaacactcttttcgcttttattttgttttttcattggtttagtcacctcaaatttcgcttggccatcggcagtttcatcgaggaatacaacaacaaagtgtccattgtgcagctgcacgaggaccaaggcgaatttggccatctcggcactttcgaccatccgttcgttcccttccctttccttttatttcttccgtttagttacccctcgacaaaggtaagaactgacaatgagtaggctctatccgtgaagttcctccccatttgtcatcattttctcttttcggtgctgtggatccccgatccaaagtcggcttttcctgatttattagcgaccaccggcgattatttgcgcatttggcgaatcggcggtcacaacggcgcttcgttggaagttcggctggacaatgtttgttagggagttacaaataatcgaaaattgctgaaaatgcctcacagaaccgttcgtctgagtattgcgcgcctctcacttcggccgattggaacgaagtggacgtgtcactgattggaacgtcgagcattgacacgacgtgcaccatttggcagatagaggcatggaaaagggaatttgtagcaaatttaaatgccaaattaaagacagggcaagcagtggcgaacacggaacacgcaatcggagggaatgtgaaggtaacaaacgaacgcaccattgggggagacgaatgaatgtattattctttcttcgcctaacagacccaactcatcgcacatgacaaggaagtgtacgacatcgaagtgagaggggacagagacgacacccctccccaccagggatggcacggaattccgaaaaaattttggacgtcggaatgccatcctttctccccaccacccccaattgtgccttccctttcttagttctctaaactgtcctcgggacgcgacattttcgcatcagccggtgaataatgaaaaagaaacaatccgttaaaatgcaaattgacaggcgctgacggaagcattcgaatgttcggtttgtgttgcgaaaggcgcagcaacaattaattcgcttcttcagatctccgccacatggaatactcaacaattgttttcgaagaaccctccaaaaagcctttgctcagattaggtgggccaaataagaaaaggaagggaataattttaggttttagcatggaacaagcaggaccacaattacttggcaacattcgcccaaaattccaacgaagtctgttttttgttttttatacggtccgaactggactcaatgcttttcagatttacattctcgacattcggatcccg

SEQ ID NO: 54367 - DNA, 704 bp, Heterodera glycines
  Genomic contig location: Contig_ID=SeqID_23671; Location=1263..1966; Strand=+
  SCN-specific regions: Sequence locations=1-125,147-166,199-397,421 -504,527-704
atgttaagctttcgaatgatatcaaaaatgctggatttggatgacattgaaaaaagttatacaaagctttcgtggaaaaacatgttggcgcccaaacgagcgcgcccaaacgcagtggacccggttagaataaacctcaaatttaggggtataaaactgtaaaatgacaaatttttattttaattacaaaactaaaaggcctaggccttataattagggcataaaattatatggatccatatttttttcctggactctgggaggcctgaaacgcacgaaaaacatgtttttagcttggcttgaagcttctaggatggatttctatatccatatttttccatatttcgatatttcaaaaataagcaaaaaagcgaaaatttcgcttttcatcttgatctttcgctaaaatgagtaaattttagctgttcaaggatttttttgctacttcacctacttcccatggacgaatcgagctgaaaacaaaagccgcagagacatgcggttttttgcattatgtaacaaattgtcctctttctgttagaaataaggacacttgggagccctgtctaaatgtgatcatagaaactcacatacttgcaaaaattttgagcttaggggtcgacaaaaccaaagggaggaaccttttggtcgcaattttttttaaatacctaatgcggcgctacttgcaaagcggtcctttttga

SEQ ID NO: 54368 - DNA, 410 bp, Heterodera glycines
  Genomic contig location: Contig_ID=SeqID_23673; Location=360..769; Strand=-
  SCN-specific regions: Sequence locations=1-126,151-334,363-410
atgcaaacagtaaaaggtacacactatattttacccttgattttatgaaatttttttagcttataacttggccaataatagaccaaacaaaaccattttgtgctcattttgaagggaaaattctgaagaatatttcttaattagtcaaaagtttaaaaaattgtttattggcaaaaaaatgaaccatgtgttattttatatgttagagacatggaaatagtgcgtcaaaatgagagaaaaagaaaaaactttgcccagtcgtaaaaatttttccaaagttgcgattttcttgaaattttcataggcccatattttgaccccatctatcgaattctcttttgttttttgaaagtttcttttctaactcgagatcggctcttgcatttttacaagggaaaatccccaataaa

SEQ ID NO: 54369 - DNA, 135 bp, Heterodera glycines
  Genomic contig location: Contig_ID=SeqID_23673; Location=1425..1559; Strand=+
  SCN-specific regions: Sequence locations=1-93,115-135
ctttagatgatcgtgataaatgatgcagcgcaatgttctttttcagcttcaaatttacccagtatttctgagtcaaaaaatctaaaggcccgtgcgaaaaatggggcgaaacaaacaataagcagttttactgag

SEQ ID NO: 54370 - DNA, 1014 bp, Heterodera glycines
  Genomic contig location: Contig_ID=SeqID_23674; Location=339..1352; Strand=+
  SCN-specific regions: Sequence locations=1-313,335-382,405-433,481 -492,514-609,631-818,840-1014
atgccaaaaggcaaaaggacaattccaaatttagaattacatgcaacaatgctatgtgggaaatacataaattttgtgaaaatcgaattcgaaaaggaaattaagattcaaaattgcactatttggtctgattcaaccgacgttcttgattttgtaagaagtgaacgcaaatttgacaaattcattagaaaagggtacaaaatataaaaaagtggcatttaaaacatataaatggtaaaaataacccagctgatttggcgtcaagaggaacatcagtggaagaactacaaaatagtgaaatatggtggaaaggccctaattttctttcagaaagggaaaactcttggcccaaaacaatacgagaatatgacccaacgaatccaccagaaataaaggaaaaacaaaatgttatttttgagataaattcagctattaaggaaaaggatttttgtgaatttgaaaaacatttcaaaagattttcaaaatgggaccgtttaaaaaattcaattgcttacgcactccgggcctttaaaaaggaaaaccaaaagaaggtttcccaaaatatggaaaaaatttcggatatcaaaaataaaaaaaatggaaatgagataacaaaaggaattattaaattaatcaggcctttagaggctaaagaaatccctaaagctgaaaagctgatttttaaattaatccaaacaaattcgtctccaaccaaatctatattaagaaatttggatttgttcaaagatgaggatgatttatggcgcacaaaaggaagaattttaaaaagtggtttaaattataacactattaatccaattttcattccaaataattcatatattgcgactttattgatcagagatgctcatatgaagacaatgcatggcggtcgcgaattggtgaatagcaaattgagagaaaatttggattcctaaagcagaaggaaaatttatgaaatattaaaaagaaaaaacaaagaaaaatgcggaatttgtgcaaaatttgcaaata

SEQ ID NO: 54371 - DNA, 948 bp, Heterodera glycines
  Genomic contig location: Contig_ID=SeqID_23674; Location=1480..2427; Strand=+
  SCN-specific regions: Sequence locations=1-208,230-684,727-912
atgttggggagcaatatttacatgtttaattgtaagagcaattcatttggagttagtttccgacataagtgccgaaaaatttcttttagcatttcggcgattcattaaaagaagaagagtgccgaaattaattatttccgataatggtacaaattttgtattagcaaataaagcactaaaacaaatagtactcgaagaaaatatacaaaataaattatggtcagaaatttatcgtgatccgacggtacaaaatttttcatcaaatttgggaattgattggcaatttaattcgccatatgcgaattggcgcgggggagcttacgagagaatgataggacttgtcaagacacatttaattcggagtttaggaaaacaattattgagctttgaagaattaatgacatatttaatcgaagtcgagaggattgtaaacgaacgccctttaagctatataacccaagatgaagtgattgaaccattaaggccaatcgatatattaaatccgacagatggagaacctttctcactaaaattggatccaacatttgatcggaaagacgtgaatgaatattttgaaaagaaaactaaaagagaagaattatttgaaatttacaaaaaagcaatttttaaaagcgaaattttttggaaggaatggagtgaaaaatacctattatcgttaagagaaaagcacatcaataaaaataaagaaggaaataaatacccaaaaatcggacaagtagtaattgtgagagaccaggataattatccaagatcaatgtggaaattaggaaaaattttcgaaattctttctgataggactgttaaattaaaaataggaaaccgaatggcggaaagacccacaaaattattatatcctttagaaatagaggatgaaggcgaagaataactatgattttatataatttaattaaatatatatatatatta

SEQ ID NO: 54372 - DNA, 553 bp, Heterodera glycines
  Genomic contig location: Contig_ID=SeqID_23676; Location=141..693; Strand=-
  SCN-specific regions: Sequence locations=1-95,127-249,271-297,320 -374,396-532
atgttcacaaaacccgttctgtttagtggtgtttatttgtcgtggttttataacccatatgttggctatacggacgattttggagaaattgtaagaaaaattaattatgtaattaataaattttaacaattacagtactccaacacgatagcttctgcacataattacatcgttattattggtctatccagcatttatttgttgtttcctgtaattctttgttggcaaacctacacaatgtcatcaggccaccaaacacatcagtcatcttgggcagaaaaaatggcaataaacaaatatattttaatgactataatgaggttttttgtttaagcaaaaatgcaaaatttttgaaaaagctaattatcttttcaatcatttattataaatattcagatttttatccaagtgattatcataagtttgttcaattcaattgcctccgtaatttacatctcaatgcaatttgtcagaatcagcaaaatttacatcatcgttggcacttacgcatgggttttttcgagtggttagcatatttattttaaaaaataaa

SEQ ID NO: 54373 - DNA, 296 bp, Heterodera glycines
  Genomic contig location: Contig_ID=SeqID_23676; Location=763..1058; Strand=-
  SCN-specific regions: Sequence locations=1-99,142-296
atgaatgcgttggaaacgggaattcttggcattattggtgccgtttattgtgactatccattgctgatttatacaaccggagcattgggagcaggtatgtaatttttattatttctaattttattatatatttttttaattcagctttgtggtatgccgaaacaagtgtcgaaatgttgctggcaattaacagatgcatggaattattaagaccagagttggcatttgccatttttagtggtcaaatttttatcaatatttttattagacgattagaataattaattaataataaa

SEQ ID NO: 54374 - DNA, 1152 bp, Heterodera glycines
  Genomic contig location: Contig_ID=SeqID_23677; Location=61..1212; Strand=+
  SCN-specific regions: Sequence locations=1-745,767-868,890-1127
cattccaatcactgggactcaattctcctgcatttcaatcactgggactcaattctcctgcatttcaatcactgggactcaacccaacagcattccaatcactgggactcaacccaacagcattccaatcactgggactcaattctcctgcatttcaatcactgggactcaattctcctgcatttcaatcactgggactcaacccaccaacattccaatcactgggactcaattctcctgcatttcaatcactgggactcaattctcctgcatttcaatcactgggactcaattctcctgcatttcaatcactgggactcaattctcctgcatttcaatcactgggactcaacccaacagcattccaatcactgggactcaacccaacagcattccaatcactgggactcaattctcctgcatttcaatcactgggactcaattctcctgcatttcaatcactgggactcaacccaccaacattccaatcactgggactcaattctcctgcatttcaatcactgggactcaattctcctgcatttcaatcactgggactcaacccaccaacattccaatcactgggactcaattctcctgcattccaatcactgggactcaacccataaattcaaattaaaactgacctgtttaaaactttccacctaaatttgatcccgcaagtggcacgtcaatatcccaattgcatataaatattccactcgaacacaggcaaaacatgagttgtagcatttatattgctttttctatccatcaaaggatttttctttcattttttattactatcataacatgctttttattcaaaacaaatatcaaaaaccaaatcagattcttttcatattataagcaaggaaaagtacaaaaaacgtttttaagtaacaaacctttttcattcaagcgaattataatgcatttttttaatcaaacaattctccattatcgtttacataagcaaaacaaaagctttcatatcaaaatcacatcaattaacaaaaaaaaaatttagacaaaaaaataatgataaacacaaattttttcttacacacaaaaacagaaccttcatataccggattttccactcaaacaaacacaaaaatgtgctcattattttattaattattttatata

SEQ ID NO: 54375 - DNA, 1725 bp, Heterodera glycines
  Genomic contig location: Contig_ID=SeqID_4415; Location=1..1725; Strand=+
  SCN-specific regions: Sequence locations=1-119,141-838,860-1614,1636 -1725
  Gene Ontology: Mol. function=saccharopine dehydrogenase (NADP+, L -glutamate forming) activity; Cellular component=cytoplasm; Biological process=lysine biosynthesis, aminoadipic pathway
acgagtgaggagcaaaagtcgatcaaatcaatcatacatttgcatttacctcccacccaaagagtcgaagcggccggaattacagtgatgaacgaagcgggccttgacccgggcattgaccacatgttggccatggtattgctgtgattgatcaaatggcaccacacgaaaccaccgtttaggagtgcatcgacaaaatccacagttacggtggcaaagtgcgttcattcgtcagttttgcgggcggactgcccgccccggaggcgtccgacaacgctttgcgctacaaattttcatggagtccgcgcggtgtgctgctggccataatgaacccggcgcgctatctgttcgattcgcgcgtcgtggacattggcggagggggcgaagtattagacgacctgtacaaaatcgactttatgccgggtttttctctggtcggatacgctaatcgagactcgactaaatacgcggacatttacggagtcagcggagagtgccaaactttgctgcgcggcacactccgatacgaagtcagccaaagcggacaaaagaaagccggaagaaattttataattaaagggttttgtggaggcagtcaaagcattgaaagcgatcggatatttgtccatggagcggaaggactttctgaacccaatgcagggcccagacatggcctggaagcaaatcaccgcttctctgctcaatcagcaagtaatggtccagcagttggcggacattgcaactcaatgggaccaataatatatgtaaaaatgggcaattgagcagtcattccttttcagccggacattttccccgattcgctgatgaattttgtagcggaattgttgggaaaggagaaaaaacgagaactgaaggcattggacgaactcggactggtgagatcgaccacagcaacaaacatcctttgatttattcggccaatttcagttctccgagggaattccggaaagacaaatcacaccgttggacactttggtcggtcagggaaaccacctacgctcattattttaatggtggtttaatgcctcgtttggcaggtgccacacttggctaaagcattggcctatgaacatggcgaaagggatttggtggtgctgaaccacgatatcgaagcacaacttccagcggggacattcgtgagaacgggcgaaaaatgcatcgaaattggacgattccccccccccccccgcaggaacggcatcggatcagtttggtcgcttatggcgaccaaccgaccgaaggcttttcggcaatggcacgcaccgtcggatacacaacggcggttgtgtcgcatatgattttggacggtcagcaaaaagggaaaattaaaagagacgaaaaaacggaagcatttaaggggaaattcagcagcgagggatgcttagacccgtgtcaaaggccgtgtacaggtcataaataaggggctgacggacaaagatttagagaaccaagccataaccagggggcaaattggcaaaccaccgccccccccctttcaaacaaatttaacacatttcggtggtcccaatttatatcacacttaacaaattgtaattgaattcaccttaccttcgcccctcctccagggagtgggaaaacggggaataaaatgggcaaacaccaaaaaataatgcaataattaggcccgcattgcaacgactgaaagaatttgggatcaaggcgacaacaaaagtgagcgtaaag

SEQ ID NO: 54376 - DNA, 258 bp, Heterodera glycines
  Genomic contig location: Contig_ID=SeqID_4416; Location=201..458; Strand=-
  SCN-specific regions: Sequence locations=1-258
  Gene Ontology: Biological process=steroid metabolism
atggtcattaaggcacaagacgactttttggactgtttcggggaccccgcaatcaccgggaagtccaatttgacagatttggccgagaggaagtgcacttggatcacatgcgcactcgtcgacaaattgtccaaaacagcgcccgaaaaactcgctattttccgtgaaaattttggtggaaaaagtgagcaacagctgaaattagcgcgacagattgtgctggaggagcaaattgctcaacaatttgagcattaccag

SEQ ID NO: 54377 - DNA, 777 bp, Heterodera glycines
  Genomic contig location: Contig_ID=SeqID_4418; Location=557..1333; Strand=-
  SCN-specific regions: Sequence locations=1-213,236-255,296-579,641-777
tgctctccgttaataatttggcacaatggtcagtcttctgttatttttgccatttgacctttcccccgttttcggtttgtgtttctaaaacgccgcgttctctccccaaaaaacgacggcaatcgactgagcaaaacaccgacactcctccaaatgaccatcccgaagtaaaaaaggccaaaatcgagtaatttgaattggagtttaaattaatgactgacttttgtttgaagggatctgctaaaaaagttctccaatgggtcggtttcttttccatttttaaattattattttctgtttaatcacccgatcatttaaagagggttcgatcagttttggaatgagtaagtcaaaaaaaagtattcttaaaatattgtaaacattcaagaggattccaaccggaagaggaaccatcgcccgactttgcaattggtgagtctttctgccaattgttgcttgtcttttggaatgggaggggtttgactttttctctgtaattgcctaatctgtcgcacattttatacccaaaattaagggatttcggcaaagagccaagaaaatgcgttttttgcattgcgaaagaagaggaagaagaagaggaagaggacaaagaatgagtggaagagagagaatgagaagacggggggagccgcgaaacaaaaagcaaaacttccagaaaatgttcaatgtgtcaaatatgtatactgacaattctaatttagagcacatcgaacatctattattaattcttaatatcaaatacacgaaaaaacaaaa

SEQ ID NO: 54378 - DNA, 655 bp, Heterodera glycines
  Genomic contig location: Contig_ID=SeqID_23678; Location=1085..1739; Strand=-
  SCN-specific regions: Sequence locations=1-13,35-72,102-420,443 -558,580-655
atgcttgcattgcttaatgcttcattcatattgatttcaattgcgtgtgcgagtaagtgaacaagaagtggtgaatgagcaatgaatgaatgatgaatgacgttgcacaatggtcagtcaatttaagtaactgtggagagaaaaaaagacatgcactatctcatcgtttctatttttttgcaattctcctttttttggcataatgttgcaaataatcaattcaaattatattttccaagaattttcattagctcacttatgtatagggaacggatttttaagcgcgaaaaagtccaaaataagtgcttaaataagggcgaaaaaagcgcgaaataagtgcgaaaataagcatgaaaaaattccaaatgtagaggtgaaatttgttaaaattgctgttttctctatgtaaattagttaaaattaagtcaaacaattttatttactgattgcagttagaaatgaagtacatttagaaattttcaggatttaagggtcgattctcaggggcgtatttttacgaaattttttgggtggattcttaggagtgtattcttgaaaatttttaggtcaattctcaggggtgtatttttccgaaatttttttggccgattcttaggggtgtatttatcatttttattgcatttttgttaataaa

SEQ ID NO: 54379 - DNA, 866 bp, Heterodera glycines
  Genomic contig location: Contig_ID=SeqID_23683; Location=236..1101; Strand=-
  SCN-specific regions: Sequence locations=1-106,139-301,333-443,465 -603,647-832
atgtccaaatcgttggttgaacgaatgaagaatttgttgagcacgggtgaggacgcggatgtttattttttggtgggggacggtgatggaaaagaggcgagtcttcaaattaaaaattaatttattaattaaaaataagtgaaaattttttagattttgtaaattggtcgttttttgattgtgttttttatttcaatccttttaagcttatgccagcacataaactcattttgaggtcagcttccgaggtttttgaggcaatgttccgttttgactcaaaaaacgaaaaaacggaatttggtaaaatattaatgaataaaaaattaatttatggcattgtttcaatttgcgatttgattggttctttttaattaaccttttttcattgcccattttttgattactttactctttcactttcttcatttttcaaccggcctccactaattacactaattaattttcaattagcctctgctaattgtcccgtggaggtccccgatgttgaagcagcagcgttcaaagtgatgttaagcttcatctatacggaagagttgagtgaattggacggagacaatgcaatggcagtgctttacgccggtgaattttatttatagtaattaaattaaataattatttttaattagccaaaaagtacaatatccctggccttgtcaatccgtgtttggatgttcccgtcttcaaattgcgcaatgtttttttggcatatgcacaggcctgcctttttgacttggaggtcaaacttaagcggattttaaatgaatttcttattcaaactagggttccgggtgtcgggtccaaccgggtcttgaaaaatttttataatttttatgtattaaaataaa

SEQ ID NO: 54380 - DNA, 1705 bp, Heterodera glycines
  Genomic contig location: Contig_ID=SeqID_23685; Location=13..1717; Strand=+
  SCN-specific regions: Sequence locations=1-352,375-646,668-758,780 -881,909-937,959-1705
tcaaaatttcattccctccaatttcctttcatcgttttcaaaatgatgtggatgttcttccacactcaaatcaaggacacggttctattcaaatggtggaaagtcgaaactgtcggaagtgagtttttggatgaacgaatgaatgagcgcgttctgtttaaaaggtcttctgatcacttgtttggtcatgtattttggtgccatttgcttcgaagccatcaaatggcttaggcttatgcttgaacaaaagtcgcgtcagccgaactccgccaattccgccggactcaacatgacagaccaaaacaaaacagtgccaatgactaagtgagcaatggaaacggagggcaggattatgcccattccctcccatcagtcgccggtacgccgaatcgctcctctcccgggtccatcttctccagagtgttctgttcacggttcaactgctgctctcctacctgctgatgctctgcttcatgactttctctgtttggattggaatggccatttgtgccggtgctgccaccggtttttggctttttgggaggagagtgccaatgttggcatttgcatcgagcggagcaacggggagcggacagggatatgcgagcaccggccgaacggaactccattaaaagccatgcattcattttccccaattaatttgcatcgaataaacgcatttggccaagtgccccgtcatgtttcctttctgtcgaatgttttgtcactttgtgtcaatcttccgcttatgtttcttcgcttgtatttgcttttgctttcggttatcgttagccatgccaaaaatggacatgaccttccacttccgtaccagtgagttcattctcctccgagaatggcttcctcagagtattttcggtcggtttgccctttcctctctctctccaattcccttctctcccttttgttagcttatctcttttctttgcttgctgtgctcgccctttcggtggcttatgaattgctgcgtgtgttcagagccatccttttccaaatcgctgaaagacgtcagagtgaagaggtcagtaagtcaatcagtcctctgcttttgctttccgataatcggtccaactgatcagtgatcgctttcccagtgttgttcgccggtggcgagtgctgccccatcctccggtgccattaccgcctcctcctcatccgtcgccgcctgcaactgcttgtctccccaactcttttacaatgtcccccaatggtcgtaagtttcccgcgccctcccgtagccaaaaaaatttcgatgggggaataacccaactttttttattttttttgctcttgggccaaaaatatttttccagtattataagtttttcaaaaaaccaattttgccattgaaatggtgtaggtgccgccggggaatttttttcgaattttcaagaaaatctcccattcccatcactttcagcttctcctcccaattggtctcccatttccatctcttccaatctctgctccatttcattcagttttttttgggtttctctctgatgcttgttgccatgacgtgagccatcaaagttaagcattgtccgcttctcccacttcgttcagttacaatgtgcccatctttgtcgccctcctcttgggccattcgatcggttactttctcaccgcccctctctatcgccatggattggctgaagaaaatcggactggcggagattgctgctgt

SEQ ID NO: 54381 - DNA, 3955 bp, Heterodera glycines
  Genomic contig location: Contig_ID=SeqID_4419; Location=99..4053; Strand=-
  SCN-specific regions: Sequence locations=1-513,544-802,824-842,864 -912,934-1351,1374-1829,1858-1909,1932-2480,2507-2634,2656-2656,2678 -3287,3315-3414,3436-3721,3754-3955
  Gene Ontology: Mol. function=zinc ion binding; Cellular component =nucleus; Biological process=embryogenesis and morphogenesis
atgacaatccaccatcacaatttatcttcttcggctgtagcatcattgccttttaacccaccaatgcttccagcgggtggtgttcatacccaaaagcgtcagcaacaaagcatggatttggagcaggatttcaaagtgcaggaagcacgacttgagcaattgaagaaggacaagagagcgctcgctgcgcgccagcgactgttgcagaaaaaaacgcatcctatggcaccggaggaggcgaacagacacgctgaagaagtgcgagcagtacagaacaactttgaagttgcgaaaaaggcgttgcaagtgcagcagcgactggtggacaagcagcgacaacggctaaaggaacagcagcaaaaacaatcgcaggcgatctctgcccagtcaacttccgtattggctgacccaaatggcagcaacacgacaacaagcaacatgaccggcacacaacatccgtcgatgatcggccaacagcagcatagccaacaacggcagcagaaacctatgatggtggttggtcagcagcagcagcagttacccacgcaaatacaacaacaaaaagttgtggcggaacgaacgcgaccacccagcacaacaacaagcaatgctcagcaacaccagcaacagccaacaacatcgggatttttgtcatcgatgcaccttgttgaacaacagcagaaagtggcatcacagacatcggatcacggacaacaacgacaacaacaaacagtgacaacgccaacattgggcgagcaaaaacccatcattggggtgggacagcaacagcaagtgaaaggaacacgaggcagaaagcggaagaaggtccaccaactaggcctttccttttctattccttttgtatctgttttagcctttgccggaaaatgtgcgttcttccgtccttggcggtgtgccattcactgctttgggcactcaacttgagcgagatgtgtacgaaacggtaatgggcggggaaaacagcgatttgtaactgtttttaaattgttttcaggtggatattctcgttggtttcgtcgctgcaaaaatggacagcagtagcagcagcggggcacctgctgacgataatttacttgttcagaaaatcctgtcacaacaaaataataccaacaacggcataaatgccattgcccaacaatgtgatgccaattaaatatagattaatatttttacattttatacgcattgttaggtccagggaaggtcaaaaagaggcgacaaacgcagaccaaaacacgcagtcagcccgacactaccaacgaattggacttgattcaggagcgcatcaaaaaaacggtaagaaaaacggatggaggggaatttctacgcgaataaatgagttaaaacatggtcattttctactcctaaagttcaggttgagttgataccaccgatcaacaactacatggagcagtaccaggcaaatgacaagcagatgatgaagtatccggatcagtccgctctccctgaccacgaggggtcggagccgcctttgcatggcaatgcgaccggcgaatacacattgccgttcatgcccgattattacgacgaattggaaacggtgcgcgaatacgtcgacgaggagacccttttgccgccaacaatgggcgaaatttgttggaacgtcgatttggacgcattggcaaagtgagaggagaagagaaagggaaaatgggcaaatgaatgtatcagatgcctactatttaatgattagggatggaatttaagtcacgaaaaaaaatcaacaaaaagtcaactaaaaaattcataaaataggcaacaacaaaaaaaatcacgaaaaataaaccaaaaattatataatagaattttatatttgcccgatttcaattgccttttaaccggtccaaccttttttatcggcatcttctttgctgaaattcaaattttggacttaattccgaaccctattaatgataggcaatgtcacccttttaaacactgttaatttgaaatgattttaagagacaccgaagatccgtctccgtccgctgttaatggagagaattcggacgatgtgaaggatttccctcccgtcgcgtgtctttctgtgacatctgccggcggaaacaacgacgaagacgaaaaattgctcaactttctttccattgaccaaattggcaatcggtcgaagattgtgaaatcggtgacccttttgggtgccccggggccaagccaagagacgccgcttgagccgcactggtcccgctttgacgaagtacacaaccattgttttgggcattaatgccgacaaacttcaacaattttgttcaaggaacctcgggacttggaccgaatggtggacgttgtgctcaccgttgacccatcagtgatgccacgggacgaatttgtggattcgttgtgtcaaattctcggcatccctcacattgaccacatcaccgagttggacactccgccgtacacgcccgactcgccgaggaacgacggcggcggcggtggtggttattaccagtcgttggccgagcacaacagcaccaatcagcaacaacataaactgtactatcatcatcaacaacaaacgataaaaagcgaaatcggagagacaacggtaaggactgaactgaccgcaacgaacagaaacaatgggcaagggaacggaggaggaaccatctgcaaacactgcaactccgtaattccgcctggcaaaactccaattgacgacactcacggccgactgggcttactgtcggaatcagtaagtctaaagataaaatagtccaagttaaataaatggtatttaaaatggtcgttcaaaattgcgcttttcagaaggacgaaaagatacatttctgttcgatgcaatgctactacaaattcttggctttgtttcgaatacctttgagcgtcgaatcattggaaatggctgaacgatatgtggacaatgttagcacatttaactttgttaccaattaagctcacctattaatgacttttttccaccaggtgaccctcgaaactctccggcaaatcagtgccgataattttgccaagcgaataaatgccgggtttacaccccaagcaaagttccttggcgagcaacaacagcattcctccggcgccgctgcttcggcctccatcgttcaaactgcaacaacttcgggagcaaacagtacaatgacactaaccgccgcaacagttaccatcgacggcggagctgcgatcgcgcaaagggaatttctgatcaaatcgtcggaattgcccgcattgctaatgatccagcagagcatggagaagaagagggtggcacaggcactgcacgacggcggattcaaatggcgcggcttcggctggaacatttgcgacacgacgctcgtccagtcgttcaggcgccaatacgacggcacaaaacaggtgaaatcggtggcattttgccttgactttcttccatttggttgttctcttcagcaatttgcagcggttcacttgcaaacgaatgaaaaacgaatgaattggagcgaagactcgcgccaatgttccttctgtgaacagattggggacggagaccaacggttgacgggccgacttttgaatgtggacgcgaacaaatgggtgcacgtggtcagttgaacgaataaaaaacaatcggaacattacattgtttacaattcgttttttagaattgtgccttgtggtcagctgaagtgcatgtggcggaagacgtgagaattttattttgttttatcatttacatttaatatagcaaaaatatctgtaaaattagggcggtctcataaacgtcgaggcagcgctgcggagggccaaagtgaccgaatgccgactttgtggtctaaaaggggcaagcattcgttgctacaaattggactgtgccaacaacgaattggcattccatttgatctgcgccaaacattcgcatggacatttcgttaaggacaaa

SEQ ID NO: 54382 - DNA, 353 bp, Heterodera glycines
  Genomic contig location: Contig_ID=SeqID_4420; Location=4034..4386; Strand=+
  SCN-specific regions: Sequence locations=1-353
atgggcgtcaaactttgctgtgtaagtgctggcaactgaggagggtggcttcccaaatgaacgtgtccgcatggaggtggacgattggcggtggagcgtcgcggacgtcggttttctgcccttcccgcgaccccctcgggtggactcagtgcgccgtacaattgtgctaaaaaaatagacagccataagtgaatgagcaaatgaaaagcaatttcaatttaaattaactaattaacaataagtgtaaaaaagaaaataaaaaacggaatatttttaattcccaattcttctgctattttcaacaaaaattccaggaatccggccaaaaagatgcaaagaatgcactaacataa

SEQ ID NO: 54383 - DNA, 1020 bp, Heterodera glycines
  Genomic contig location: Contig_ID=SeqID_23691; Location=193..1212; Strand=+
  SCN-specific regions: Sequence locations=1-21,45-260,282-510,533 -780,802-982,1004-1020
atgattagaaaagaaaaatttcaaattattttatttctaataatctccctgtgtttggccataactctgatcaaatcggcatgcccaacaattgtacatccaacggcagcggaaggtggatttaaattcaatttttttgcattttataactgcaagctctgatcggtaagcatagggttaaacccaaaaccgatctgaatttattctgttgcacttcaaattagatgagagttcctctaaatgaatttcgaagaattttgttttagaaaaatttctgttttcttttttttttgactttttatgaaaattcgcaccttgactagggtgttgctccccaacatttttttaaaatttctccaaccatcccgactaattttgtcgaaaaaatttcctacctgtcccagactgttctctcaccaaatgtcagggcccaaccctaggtaagacaggccatttcaaggaatataaatttcatttttcaaaaagttctgatcgtttttctgtttggcaatgccaaactgaacacattttgagttccatttttggctttatgcattcgttaattccataaagaacgcaaagttggcattctgtcgtcgtcatctccgttggcgccaaacacatcgccagaaacaagcattggaaatggcatttttgaacctcatcaacaccgtcggcgttggcgccgtggaaaaagtgcaaaaaaacaatttgtgaggagtcttagcagcaaatcgatgaagagcagctcgtatcggaccaagtcaggccgacgtgtgatggaggaattgttgccaaaagaagtgcttaagaagaaatcatttctagaaaagttgtttggcattttgtctaaaaatgcctgtcataaaaatccttcgaattttcagggtgaaacaaaaattagtgcccacaagcagacgtacatttaagctatcacttaaccgggtatagttttttttgtgcatatttaaaaaagccaaatatttatgagtttttcaagaaaatatgttcgaaagttaa

SEQ ID NO: 54384 - DNA, 49 bp, Heterodera glycines; identical to SEQ ID NO: 51181
  Genomic contig location: Contig_ID=SeqID_23692; Location=747..795; Strand=-
  SCN-specific regions: Sequence locations=1-49

SEQ ID NO: 54385 - DNA, 656 bp, Heterodera glycines
  Genomic contig location: Contig_ID=SeqID_23692; Location=67..722; Strand=+
  SCN-specific regions: Sequence locations=1-596,618-656
gttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataaatgtttgagtaccccaaacggacacttgaaaaaatcgattttttt

SEQ ID NO: 54386 - DNA, 116 bp, Heterodera glycines
  Genomic contig location: Contig_ID=SeqID_23693; Location=19..134; Strand=-
  SCN-specific regions: Sequence locations=1-116
atggtcagtcctccgctgggctttgatgggtcacttcgctgggaatggcattgctgcagcgggtgggccgggcactgccaacaacaaccaccgaaggcaacagaacgccaacaatt

SEQ ID NO: 54387 - DNA, 750 bp, Heterodera glycines
  Genomic contig location: Contig_ID=SeqID_23694; Location=1233..1982; Strand=-
  SCN-specific regions: Sequence locations=1-202,260-438,477-507,563 -598,678-750
atgtatatttatcaaaatttattctacaatttagggcataagattcccctagttcgtataaacaaatacaaataatatttaaaaggagatatgaaatacaattaattagattgagaatatttcttcatccgaccgttttaattggaagatactcgaggttcgagcaccacaccacatgaggcattaatgaaagctgtgccgcaaatatatttaaaaatataaattggaaaatttaaaataaattaaaaaattatttattctgaaagtgaaatagaaataggtttcaagaattcgccattgttcccgggctttacaactgtgcgactgcgtgcaaaccactgcttgctgcccggtcagcatcattatcgagcatttttgaagcgcgttggcattggtctagaaaaaagttatttttacattgcggaagcatcggaaaaaacattttattattaataataaactatagataaaatccatttaaatatcattttcttttaaattcttcgccatgaaaataaaataaacaaaatatggtttttaaaataatttctgactttgatataataaatgtgtgatgcaaaatgcagatttacgcaagaattttatttttaaaactttttaattaaccataattttattctttaaaaaaacataattatagaaaaaaataaataaaagccgactcgaccagatttttaatgactagggccgcgacttttagtgatgaaaaatttcgaaatagttaataaa

SEQ ID NO: 54388 - DNA, 1425 bp, Heterodera glycines
  Genomic contig location: Contig_ID=SeqID_23695; Location=1..1425; Strand=+
  SCN-specific regions: Sequence locations=1-171,217-572,594-796,846 -1425
  Gene Ontology: Mol. function=inorganic phosphate transporter activity; Cellular component=integral to membrane; Biological process=phosphate transport
aattctataatttcaattaattgctttttgtgctcagattgcccccatttttacgatgccaatttcgggcgaactttgcacttcttcgttgggttgcccgtcagtttactatttgcatggaattgttaccataattttattcactatttttatgctggtaattacaaggagaaattataaataataattgataattaaacaattcattaataattagtaccaccgaaattcaccaaacaaacatccgatgatgggcaaaacggaaattatgaaagtaccgaaagacaagattttaaaatttgaatttcaaacccaaatttaggtgatgttcaataagggcgcatcaatttacagcggaccatcgatggacggaaaaaggccgcccaagaagaaaaagtcacggaaagtgccatattgggcaatgtattcggacaaatccatttgggcaattttggtaattgggcaaaaaagtataaagaaaattgtaaggaaaaagctaatttaaggtggcatcgttcggtaattttatgggcactcaactttcactccaatttatgcccacttacattaacaaggcaaacaattggcacttttttaatgggttaattaatgaaaaagttttttttcatcatgtctttttataattgttccgttttttcattgcgtcactttcgcaggtccttcacatgccaatcgaacagacggggatggcatcggcaatttcacccgcaattatgtttttcatcaaactttttgctgggcagagctctgatcggatacagtaaaacaaattgataaaataaataagtaaaagaaaaatgccaaatttgtctttagatttattagtgacggaagaaaattgcgcatttacaacaccctttcgctgggaatgatgggccttcttttcattgttttggcattgctcaatccgaacaaaactccggctttatgtttggtgaatttgttttgtggcttcgctgtctttgatcgttaaatctctcttttcccaggtcattctgatcgtctccacttgcattctcggctttaactcgggcggatttttcaaatcttcgcaaatggcatttgttttctaacaaaatgcttttgattatgaattattggatcaaattcgattttgaggtgtcgcgtcagcattcccacttcactttggcaaacatttccttcctgaattgcgtctctatgctccttgtgccgttactcaacgaaattattgcaccggaaaacgaaccaggcatttttatgggggttaatctgtgtggaaaatggcaattagtgaataatattggggggtttaatttcagaaaattgggccattgttctgtggattcacgggatcattctgctgttgacaaatgcctttttctgtgcgttcgcttcggcaaaatccgccgaatggacaaagga

SEQ ID NO: 54389 - DNA, 824 bp, Heterodera glycines
  Genomic contig location: Contig_ID=SeqID_23697; Location=1330..2153; Strand=+
  SCN-specific regions: Sequence locations=1-4,147-153,175-273,796-824
  Gene Ontology: Mol. function=DNA binding; Cellular component=nucleus; Biological process=regulation of transcription, DNA-dependent
atggtattttaaattaatgataatgattttttgaattaataaaataataaatatttttaattaatagaataataaagtctaaattaaatattaaaattaatcgaataaaaattaaaataaacaaatattaataaaaatttaaataatttataaatctcaaaatgagttaattttaggattagacgaatccgggtatttgggcaaaactgggtccggatatttccgggtccagcaaagccgggtccgggtccaagtttttaaaccgggtacgggaggaacagaaagtggaagaggaacagaaagtggaaaggaacagaaagtggaagagaaagtggaagaggaacaaaagtggaagaggaaaagaaagtggaagaggaacagaacgtggaagagaaacagaatgtggaagagaaagtgtaagaggaacagaaagtggaagagaaacagaaagtggaagagaaacagaaagtggaagaggaacagaaagcggaagagaaagtggaagaggaacagaaagtggaagagaaagtggaagaggaatagaacgtggaagagaaacagaacgtggaagagaaagtgtaagaggaacagaaagtgtgagaggaacagaaagtggaagagaaagtggaagaggaacagaaagcggaagagaagaagaggaacagaaagtggaagagaaacagaaagtggaagagaaacagaaagtggaagagaaagtggaagaggaacagaaagtggaagagaaagtggaagagagacagaaagtggaagaggaacagaaagcggaagagaaagtggaagaggaacaaagagtggaagagaaa

SEQ ID NO: 54390 - DNA, 605 bp, Heterodera glycines
  Genomic contig location: Contig_ID=SeqID_4421; Location=279..883; Strand=+
  SCN-specific regions: Sequence locations=1-146,168-315,337-605
atggcacgacaaaaattggcgcagagaagacaattcgccggcgaaacattggacgaatttgcacaggaaattcgaagtttggtggcaaaagcctacccggacaacaccttggagatggacttggccaccttggctttgggtgatcgcgagaatgaagtgaaggaagaaaatgcaaaacggattcagcaattccgatcggaaatcgcgcgcgactttttcagagcgaatatgctcccggagataaaagagagggtcatgtacatggaggaacctcaaaacctgatggaagctcttactcaagcaaaacgagttgagcaaattcaaggaagcttggcgaatgatcagtggcggatggtgcaaagcagcaaaagcgtataaatgaaatcccgtggacagaaggaatgctagttctgttgcgaaaagtcgacaaaaaacataagttggagccgaactacaaagggccatatcgcgtaattagaattgagaagccaaatttgttgctaaaaaagttaaatcctgacggcacagaatttgaggcccatatggacagatgcaagccatatttccagcgcgaggtagaagagagaaatgaacctggcaatgaa

SEQ ID NO: 54391 - DNA, 1633 bp, Heterodera glycines
  Genomic contig location: Contig_ID=SeqID_4422; Location=554..2186; Strand=+
  SCN-specific regions: Sequence locations=1-165,187-429,618-826,855 -927,963-1127,1222-1575,1598-1633
  Gene Ontology: Biological process=protein biosynthesis
atgtcacgccacgaagcttttattcccgaaaaagctcgcaagtcccgcgaccaatcgtcaccaactccgcccccgattttggtgtcgatttcgtcggacgaatcggctgaagaggcttctgaggcgggaaatcaactgaaacaacaacaacgtccggtccgaccacaggacggccgcctgcacgagttttccatgaaggaggtccgagtcctcagcacgacggatgagaaagcaaaggaatcgattcgggagaaggagatccaggagcttaagcaaaaactcctgcttttggaggccgaaaaggcaagtgatgcgcgcaaggcggcgaaagctaagaaagaggcggaaaagcgagccaaaaaagaggcggaagcgagagtcaagcgagaaatggaagcgaaagcccgtaaagaggcggaagaaaaggccaaaaaagaagcagaagcaaaagcgcagagagaggcggaagaaagagccaagaaagaggcagaagcaaaagcgaagagagaggcggaagaaagagccaaaaaagaggcagaagcaaaagcgcagagagaggcggaagaaagagccaaaagagaagcggaggaaagagcgaaacgagagagcgaagagaaagcgcaaaaagaggcggaagcgaaggccaaaaacaatctgagggctccatccgagataagcctttgtgaggatgagttagagtgggaagaagcggaaaaaaaagtgctaaatatattgaaaaaaagcagcgagatagctaagaaaaaagaagaaaagaaaggggaggagaaagttgccagaggaataataagaaggaaacttacggtgaaagagaaagaggaaaaagccaagaaagacagtagtgaggcagcgaaaagagcggaaaataatgccattgaagaaggaagggaagaaattcggaaaatcgtgagagaagcagaagaagaagcaaaaacaaagaatgagaaaatcggtgaaagagggccattgataggggagaattcaaaaaaattgattttggacacaatggagcaagaatatgtgccaggaaaagtggtgggctacatagaagacccaagggaggaaaaggaagaggaatgggatatggccagggcattgaaaaaccgttcaaaagaagacgaagtgcgaataaaaaagagagagcaaagagaagaggggtggaaagagctaataagcggagaaagaaaagcgaagggaagagaaagaccgaaattggtggaaaaattcgtgaaaaatctgttgggcccagctgaaaacgacgtcagccgaaatcccgggatccccccccccgaaggtagccgcagaggcccgacaccgattccttgttggaaccgctacaaaaaaaggcctcgcttcgtcagtccaattcgaaacatcagtccggtccgaacacgccaaagcacagttggaacgcagacgacaaacgcatggcccagctgcacaggagatgtggtggaacaaatgcaactgatgaagacgaagctggacgaactgatcgccgctctcaagaaaagggaggaagaaaaaaacaatggaaacaacgagcaaattggcgagaaggaagaacaacagaaagaaaatggaaaataggaaataggaaagggagtaaaaaaaa

SEQ ID NO: 54392 - DNA, 1225 bp, Heterodera glycines
  Genomic contig location: Contig_ID=SeqID_4423; Location=1299..2523; Strand=+
  SCN-specific regions: Sequence locations=1-465,487-700,729-767,789 -1225
atgaactgctcgtcaaatttttttgattttgccgcaacttttgtccccgttttttttgcctgtaaacacgccggaacagttctttttgctttccaagcaaaaaaggttaggagaaagctgacgataaacgctccaatgtacgcggacgtagtggaaaattgcgagacgcttaggatgatcggctgctgctgccagttcattccgttgagccttccgccgatgctttgtccgatggtggcactgtccgtgtcgggcattgtcatcctcagtccggtgctaaagcattggttaatcattcgaaatgccaatttcagtcagtccgtacagattgacgcagttccatctgctgttgtggtgaatcgatgccctgtcgcttgcttccatttcaaattctcgaccatgcaaatttcctctttcaatttcattgtgccgttccgcgtattgttcatctgtcgaagaaaggattttttaatggattgtcaaaatcgttctccccacgggttaccccaaaaacgacaatgacaaaaatggtgaaaacgacgatgaatggtaacgatgaaaatttctgggagggggcctcattgcatttctgaataaaagagatttttgtaattataaggaagttaactttttcggtgtttagaaaggctaaaagaagatcagttttatttaagattgaccggtcactagttaaacagcctttaaaatattgttatatatattttttaggtttaacatttgagttttgtaccagttttgtgggagatctgacttttggggttattttgagattagtatttacggccttttccctagaacaaataaatggtgataatgtgaaagaaatatcgtcatatgaggtagataatgtcatgggtatcgcaggtggatgagcaacataattggaagtttttttgggaagtggatgaggtgtgggggcattatttttgtttgagtttgtttgttgttgttccaaaaagcccccaaacctcaaatcattgcacatggaagtcagttttttgtcggatgaacatttgtgatcagagaaacagtcggcggaaacatcgcagtgctttttcctttgatatcatcccgcagaatcaggcgatcattgtagatgatgaccataaaccatggttaaaaataagatttttgaaaaaacggcttttacattgtagagacaattaaaaacagagctgccaaattttcaatgcatatttggcca

SEQ ID NO: 54393 - DNA, 278 bp, Heterodera glycines
  misc_feature (278)..(278): n is a, c, g, or t
  Genomic contig location: Contig_ID=SeqID_23699; Location=21..298; Strand=-
  SCN-specific regions: Sequence locations=1-124,146-160,182-278
atgccaattgaaccatttgaattggtgaacgaacggacgaaagaaaagctgacactgaaacaggagaccgaagaatcatccaacgaaataatatataattggttgttgaaacggtgcccaattggggagacggcgacggcgccagttaagtggaaaaaccgcgaaaattcgggcgccaattttaactatgtcagatttgctctacggcatgccaattattcggatgccaatttgaacaatatccgatttgatttgtggggtgcaaatgatcccattgn

SEQ ID NO: 54394 - DNA, 671 bp, Heterodera glycines
  Genomic contig location: Contig_ID=SeqID_23699; Location=409..1079; Strand=-
  SCN-specific regions: Sequence locations=1-671
atgaaccgccggtcagcaaatattttgaaaaattacaaaattttcatttaaaattacaaattttcattttcccccatccattttttccatgtttcagttggctttgtaacgacgtgtggatggacattctcccatcttttaactatgccaaactcggcctcaaaatggcattgctttccgaccgtttcgatgttttggtggacaaacatttcgacagaaaaagcgaattgacaatttggagaagtgtcgtaattcgcaaggacaaaggaccaaaagcaaacaatattggaccaaaaccgaaagtgtctatattaattggtggctatggcaaatttgtgggatttccattgccggaccatccgttgcccaacaaaatcagctttaagaaccttcaaattcagtcatccttaacttttgtgtacgctaaagcatttttctcttgctttaggtacattgactattccgtgatcaaatttctccgctccaagaagcgattctttgacagaaatggcaccaaattgaaagtgtttgtgcattcaattgatacggatgtccaaccgatttgggatgtttttatccgtgaaatttggccaatttttgcgacaaacattcgtcatttgggctttgacgatggcgatgctttggacaaaacttcaaagaggtgtgtctag

SEQ ID NO: 54395 - DNA, 404 bp, Heterodera glycines
  Genomic contig location: Contig_ID=SeqID_23700; Location=473..876; Strand=+
  SCN-specific regions: Sequence locations=1-6,32-217,260-404
atgcagaaaaattttaataaaaataataaaagagaattggaacaaggtcagcatcaaatcttaattttaaaatgaatacactgaaattcataattagtattttttactaaatgcaaatagaaaatctttaattataaaatcatcatacaaaatagagctcattgcgcgccataaataccggaactcaccgcctgaattcattatttttagaaagtccaaattaatttataaatactttaatcatttaaaataaatttaagtgaatacttattggaataataattgctttgagttttgcaatttctatattcataaaactcatggttcgactttggaaactgaatagaaaaaattgagaaaaactaaaaatcctttcaagtaagttctaagaaaaaatatcaaaa

SEQ ID NO: 54396 - DNA, 621 bp, Heterodera glycines
  Genomic contig location: Contig_ID=SeqID_23701; Location=12..632; Strand=-
  SCN-specific regions: Sequence locations=1-11,33-78,100-167,198 -253,275-621
atgaaattctgtattttattatttttatttttgattgccctaattattccaattgaatcagaaaagaaaaaacttcagcagaaatcatttgatgaaatatttggagaaaaatggcaagaaaaagaagaagaaaggcgaaatgaactcaaaaaacgagaaataattggaaaatattataaaattaaagaaaaaataaagcaaaaaggaagaaaatattcagcaaaagaatgggataaaattaactcaaaaatagcgaaaaaattggggacaaatcggaaatatatttacaaatggattaaagaatttggtcttcaaaaacaaatacaaaaaagctataaatcaaaaactgatgaacaaaaattagaatttgtacaaaaattcattgaaatgaaaaaggaatataagcaaaaaagaaaatattcagcaaaagaatggtaccaaaattatgacgaaatttgtaagaaaattggagttagtcaaagaataattgagaaatggaagaaacattttggcattcgcagtaaaataacggaggaacaaaaaatagaaaaaatgaaaatttattggaaaataaaaagtgaaaatccaaaaatgaatgataataaaattgcaaaaacatga

SEQ ID NO: 54397 - DNA, 337 bp, Heterodera glycines
  Genomic contig location: Contig_ID=SeqID_23701; Location=843..1179; Strand=-
  SCN-specific regions: Sequence locations=1-55,77-125,228-270,310-337
atgaagctacaccaattattcattttgattgtatttttgatcatcgaacttcatcaaattaaaatggaaaataagaaattgcaacaaaaatcatttgatgcaatatttggagaaaaatgggaagaaaaagaagataaaagggaaataattgaaaaatattataaaataaaagagaaaataaagcaaaagagaagaaaatacacagcaaaagaatggaataaaattaattcgaaaattgcattaatttttctaaaatctctttacattgtgaatttattttatttttattgaaaatatgtttattatttacgaatgagctccagtagaaagtaataaa

SEQ ID NO: 54398 - DNA, 639 bp, Heterodera glycines
  Genomic contig location: Contig_ID=SeqID_23706; Location=386..1024; Strand=-
  SCN-specific regions: Sequence locations=1-527,550-639
atgcccgagaaaattgggcatcaaaatttattgactttgacgcctgccggattaggaaattggatatttgatcctttccagaaagaattgcacccgaacattgagcaactgaacaatttggaaaacgcgctcatagcacagattgaaaatgccgaaaataatgattcttccaccgatgcttcacccccttcagccggtggaaatgccagcgaaagtttggctttgtccatgaaacgccggcggcgacaatcaaaccaacagaatgccaaaatgatcgatgacactgacagagtgccaaaaatgaaacagcaacggcagccaaaattggcaaaatcagtgccagaaatttttgctgaggaaggcgaagtggcatcggatgaggaggagttggaagagatggaggaggagcagctgtccgcactgaaccggtcactttctgtttccgctgcccaacaatgggccggctttgacgggagaccaatccaaattgacaccacggacgagacaaagtccgaaaaattaaatcgaaaattttaaaaatttataattcttagccccctccttttgtttgcttcccatgccgccgcaagagcactcaatttgcgtattccgccacgatattttcaacgctaccagaag

SEQ ID NO: 54399 - DNA, 633 bp, Heterodera glycines
  Genomic contig location: Contig_ID=SeqID_23707; Location=113..745; Strand=-
  SCN-specific regions: Sequence locations=1-8,30-53,197-287,465 -569,630-633
  Gene Ontology: Mol. function=protein binding; Cellular component =axoneme; Biological process=eye photoreceptor cell development
atgaaggtaaattttgaaaaattaaatgtttgaacgtataacatttctttatcaatttttaaaaattttaaaatttagtaaaattttggcctaaaattaataaaaagtgaataattttttatcaaatataatttttttgtttgaagttttatactattctataatataattaatcaatataattaaaaaattttaagcggaaagaagcattgtatagtttaaacaatgcatggcacaactttttgaaggcgggtgagaaaatggatggtggtgatgaaaatgaggaggaggaagagagtgatgaggaagagagtgaggaagaagagagagaggaagacgagagtgaggaagagagagaggaagaagacgagagagaggaagaagagagtgaggaagagagagaggaagaagaggagagagaggaagaacggagtgaggaagagagagaggaagaagagagagaggcgaatgatgatgaagtggttgaagagagtgaggtagaggacgtggatgtggatggcgttataaatggtggtgatggagcagaaaatggggacgggagaggaaatggaggaggaggaaacgcacgaggaggaagcggaggaggagggggaggaagtggaggaggaactg

SEQ ID NO: 54400 - DNA, 59 bp, Heterodera glycines
  Genomic contig location: Contig_ID=SeqID_4425; Location=400..458; Strand=+
  SCN-specific regions: Sequence locations=1-59
cgaatttacaattgatttcaaatcgctttgtaggacttccaggggcccgaaaattagga

SEQ ID NO: 54401 - DNA, 231 bp, Heterodera glycines
  Genomic contig location: Contig_ID=SeqID_4425; Location=607..837; Strand=-
  SCN-specific regions: Sequence locations=1-231
ccctaccggccaattctctaccaccaattccctactggccgattccctaccgccaaaggcatttgggccatttccataccaaaagtgttgaatattgataaacattgagattaaaacacacaagaaaatttattcactgctttttagacagctcgtcaagagctttcggatgataccaaatttatcaagattcgatcgttttaaaaaagttagaagtgtcaaatctctcaa

SEQ ID NO: 54402 - DNA, 257 bp, Heterodera glycines
  Genomic contig location: Contig_ID=SeqID_4425; Location=902..1158; Strand=+
  SCN-specific regions: Sequence locations=1-157,179-257
aatctaataaatctaaatctaagagttaaaaaatggtccgccaacgcttccatataacatttgtttcatgtccaattcatccatatatagacctactcacgcacacagaaaaattaaattttagcacagaaaaatgaatctatgggtaagttcgatataaatgagaagatatgcaaggtaacaaataaataatttttttttgaccgtaaaataggtaggtaatttgaatttggcgctattaaatgtgatttatttat

SEQ ID NO: 54403 - DNA, 588 bp, Heterodera glycines
  misc_feature (571)..(571): n is a, c, g, or t
  Genomic contig location: Contig_ID=SeqID_4426; Location=1500..2087; Strand=+
  SCN-specific regions: Sequence locations=1-164,187-588
atgtctccaacggcatgtccccttttaaaaattcatggctcactccagcaaaaattatcagcaaaacgtactgcggcacacttgacaacatcgcctctctcaacaattccaacgaaacgacaacaatttttggacggcgcagcgcaattggacatcacagcactgctaaccagcactgaagtgtctgaacccgtgcgtgcagtcattcgccaactggacgcacttctcaagctcgcggtggacatggttcataagacgtcgacccaggacactcgcgcggtactggaggaggaccggcaagaacattcggtcgttctgatgggcgtgccggaatcggacagttgcctttcctctacacggcgcgcgattgctgaccaacagcaggtgttggacattctggacgtttgtgaaatcgaggcaatgccgaccaaggtttaccggatgggccaaagaaaggaaggaagaccccgacttctcaaagtggaaatgccaacccgaaagatgacacaaacatttctccgcaataaaaaccgtcttaaaaactccaaatttcaagctgtatctgtccgtnccgtctctctcccctga

SEQ ID NO: 54404 - DNA, 63 bp, Heterodera glycines
  Genomic contig location: Contig_ID=SeqID_4426; Location=124..186; Strand=+
  SCN-specific regions: Sequence locations=1-63
gactacgaggaagtggccattgacactgtggagggagatggcgctggagacgacgactattga

SEQ ID NO: 54405 - DNA, 1940 bp, Heterodera glycines
  Genomic contig location: Contig_ID=SeqID_23709; Location=495..2434; Strand=-
  SCN-specific regions: Sequence locations=1-447,469-572,601-611,636 -809,831-902,925-929,951-1173,1198-1303,1325-1342,1364-1543,1571 -1652,1674-1755,1778-1875,1898-1940
  Gene Ontology: Mol. function=glutathione synthase activity; Cellular component=intracellular; Biological process=neurogenesis
gtacgcatttggtgatccaaaaggcatcattctgttcatcacacaccgacgaaaccgaaaccgatttgcacagcgacacattgaatatgaattgtggcgtttgacaaagcataaagcggaaactgtgcgcattggatacccggaatgtacggaaatgatgaaaaatggcaggtgattaaagcgatcggtgggggggggggtaaaaaaccaatctctggcataacgtcaccctgtcatattttgaattttggttccgaaattagaggttctcttgatacatgggataactttaacttttcggcagagtgtccatttgtctttttttgaataattacttcttttggagtgacagaagcatcaaaagatgtacttttttcaaggcaatcatccttttctgttgcttactcataaaaatttcaaaaaaagttatttttgaatccaaattcgaaataaaccaaatttaaaaaattgtcaggcgatttttgtgtgaatgttcggcaaaaaaaaacaattaaaaaagcatttaaattagcactatttaatgagaaaaggggaacaccattaagcctacgaattaaaaactttatatttattatttaacggtccaattattttgggcattttttcaattattttattaaaaaactgaaaaaattcaattatgcgttttgtttaaccaattctcgaatatttcctcttcagattaacactcgatgacaactttaaactgcgttttgatgatcggacggtggccattgtttactttgtcactgatttctttaagccaagcgaagatgattgggaaatgcgactgatgatcgaacgttccaccgctattgtacgtataattgtaaaaatgccaaatcacttttcagaaatattcaaattaggccaattttccgaaaactaaaatttgtcaaaaaatgtaaaagttttatatttaaacacacgaaattgctgtaaatttaataagaaagtcaaggaaaaataaacattttctgaaaatttaactcatttaatttttgcgaaatattttcccgcacaattcgcatttttatggttgctgttcagaaaagcccaaccagcggactccaattggccagcatgaagaaaacgcagcaggtgaacatattttttaattttaatctttttactttcagatacaaatttccatttaaaataattagttaattagtttcactaattaaggtgcttgcgcaacccgggatggtcgagcgttttctgcctgaaaatccgaaaaaagccgctgccataagagaaacgttcgccgggctgtggagcttgactgatcaggacgatgcggccatcgaagccacgaaggtgaagcaattaataattgtttaactataagcatagaagaaaattgttttattttaatcaggcccaacctaataaatgaaattaaaagcttaccttttcttttttagaggcaagagaaatttttaaatagttcgtattattattattatagctcttggtaattagttcggcatgagacatttcaaaaaaagaatcgactgggtttaaaaaaattaatttttttatattagtttatccatcataactgaataactagagcaacgaataaatattttagttttattgcgtctcaatgaagataacaatgtttaaacttttgaaaataaatatgactttttaaaatgaccagcaaaaccacggagctcgtgattttgaagaattcattcattcataaattaatcacttaaatgagaattaattggatttgaattttttaggatgcaattgttaatccgagtaattatgtgctcaagccgagcaaagaaggcggtggcaacaacatttgggacgacgaaattacgaacaaattgctcaattttacctccgaagagcgctccgcgcatattttgatgcaaaagttgcagccgatgttttttaag

SEQ ID NO: 54406 - DNA, 233 bp, Heterodera glycines
  Genomic contig location: Contig_ID=SeqID_23711; Location=253..485; Strand=-
  SCN-specific regions: Sequence locations=1-233
atggccaaaaagcacacaattgtgcttacagtagtcggagtttgtatcgtagtggcagtggttgcctggggcattattcggttaattattatgtcataggcaaagcgaaaaaaccgttttcttacagtagccaattgggcggttcaaacacgagtggcattgttactgtgccggttcaactgtattcctcatccatcctgcacatatggctgaaaacgcgttcggccactcag

SEQ ID NO: 54407 - DNA, 353 bp, Heterodera glycines
  Genomic contig location: Contig_ID=SeqID_23712; Location=209..561; Strand=+
  SCN-specific regions: Sequence locations=1-132,155-353
atttttcaaaaagtccaaatccaacttcacataattctgaacaatcaactagaacggatctaacttcccctgaaaagcaaattggaaaggctcgtgcaacaaaaaataatgctgctggaaataaacggtaagaaaaaatttaaaaattttttatccctaccagtttctcccactttctttccggaacgggccaactccgtctggccaactccgtctgagccaactttgagtaaatataactcttgaagttattgaccgaatcaaacaatcttgatatcattcgaaagctcttcacaggctctattagcctactaaaaattacagaaaatttcgaactataaaaaaagatagaa

SEQ ID NO: 54408 - DNA, 306 bp, Heterodera glycines
  Genomic contig location: Contig_ID=SeqID_23712; Location=390..695; Strand=-
  SCN-specific regions: Sequence locations=1-306
ctcaatcacgttatcattcaaaagccctagatgtttagaagatatttataagctatttctcagtgattaatcagctctcaaaaaagttgtcagttgaaaaccgcaaaaaaggcagaattttcgaagttttttatttctatctttttttatagttcgaaattttctgtaatttttagtaggctaatagagcctgtgaagagctttcgaatgatatcaagattgtttgattcggtcaataacttcaagagttatatttactcaaagttggctcagacggagttggccagacggagttggcccgttccg

SEQ ID NO: 54409 - DNA, 777 bp, Heterodera glycines
  Genomic contig location: Contig_ID=SeqID_23712; Location=701..1477; Strand=+
  SCN-specific regions: Sequence locations=1-277,304-474,508-777
atgtgcaacatccataaaagaggaatagatattggaacaatgggtgagcaagaacctttttgaagtgggggcatccattggggcaatggacaaattaatgttcgaatgggcgaacattggatggaaatagcagataaaagcgatgacactttggttgaaataactgaaaaagaattccgaatttaggggtgtaaaaagacaaaatttattcaaaaaagtaaaaaaattaggccaaatctgtattgagctaaaaaattttaaaaccacaaattcttgtcaagaaataaataaatttttgagattgccacgttttttgattgttcgagtcgtcgtcgtggcactgtgaagcgattttgtgtataaaagtgaatttttttgaaaactgatttttgacttttttgttcgaattcgtgttcggggttcgaattggcttaaaacagatgccagaatcggtttccccgactctgaaaaccctaaaataagtttatttaaataaaaaatatttttgaaaatctgagtacagataaaaaaatatcggaaaaaaagattagttttgccttcgaacaccttgaaatgtattgttttgcaattgtgcgggtgaaaatgataaagaatgagattttttgggatttttatgcaaaaatcctttgattttcaaattttaagtacatatttcgcacatatttcagcattttttagcacatatttttattacatatttcaggatttttagcacataaaaatccggtctctaacaatcaatatcctgcttactaa

SEQ ID NO: 54410 - DNA, 1601 bp, Heterodera glycines
  Genomic contig location: Contig_ID=SeqID_23715; Location=163..1763; Strand=+
  SCN-specific regions: Sequence locations=1-90,113-129,163-792,822 -1128,1156-1291,1314-1363,1402-1601
atgatggaacaacttcggcacgatgagacggtgagatttttggaagggggaaggattgggtcaaatgtatgccatttttgtcatttgcatcttaaattacaaaaagttatggcattatattaatagtgcgtttgtttttactattttttgttgtattattttcaggcctcttcccaattcgctcctttcattttcatgccaaattgtgctccgttttttgcttggttactgtcacaacaacaattaccttacagcaacgggcggcggcacaaagcaacaaaaggtgccgacaatggcattgggctagggggaagtactgcttccgcctttgttgtgttcggccgaattggcgacgtcgcgcaacggaatggaactcgccgagtggagcattcccttttcgcacacccaaattggctgaaaggagcggaaatggttcgaaagcgatttatatttaaaaaaacaaaaaaatcgctgaaaattttgacacagggggaaacgacctgttccgggttaattgtgagtagttcatttctccaacgccggttctccccttcagttttcccctaaccaaaatttgttcctaaacaaatagtttctaaaaaaattaattcgaaatatgtgatcctccgtcctccatcaattttcaggtctctgatttgtgttccgacgttgccacaaaaatggatgaccagaagcagtgcgtcaacactacgacgaacaatggtcttgtccaccatcgtcgattgtcgtcaaaattggaatggctcgtatttctcgtggaggtacaaaatgtttattaattatttttaataatttattttccgattttagcagtgccactcggtggcatcgtccaatttgtcctctcttgagctgtctttggccccatcagaagccattttggtgagttttgccaattcaattttcaacatttgctccctttccattttggtctcgtttctcggcctctgtgttcgtcacgctgtgctccattttccaacacgttcaacaaacattttgccaaaatggcagtgccaaatttcgattttctcaaccgaatgtatgcacaaagaaattattgtaaaaatgaattcttgagattttcgaaatatgcttcacattatttccttttaaataattaaaatttattaattaccttcctaattaggtaataaattgtcttccccccatttagcccacaatttgtgtcccattgtcccactttttggccagcatttgcagtgtttacaaagcgcgcattgactccgatgagcgctggactttgctcaaatttttgcctctccgtttcttcgaaatgccagtaaaaattgcgagagaaaatggtagaagtgccgaaagcgaatttttaaaaaacattttgattttttaagaaaatggaaaagtctccggagacggacaacagaagctcggtgaacaaattgccgaattcaatgcgcgaacaattgctctgtcgcattttgccaatgcgcaagcgtcgcccaaaacaactccgattttgtcaaacaacaacggcacaatcggagaccgaattggcaatgggccaacggaagcgccgaaagccaaacggagagaagagataa

SEQ ID NO: 54411 - DNA, 304 bp, Heterodera glycines
  Genomic contig location: Contig_ID=SeqID_23717; Location=494..797; Strand=+
  SCN-specific regions: Sequence locations=1-304
caattgccaattgtcccttcctttttggccgttttttttatttccgtcgcttttcctcccctcccaaaatgggggaagttcgctttcactcggattacgtttcctccaccgcggaatcccaaatcatccaaattgtgctcggttttgtcgtctgttcggtgctttgttcgaattggtgtcaaattgcaaattaacgtggtaaaaacacacaaaacattttgaggtatggcgggtacagctgtttcggggagggccgcctcggttatgtgagcggattgaactttgtctgtttgatgattaacat

SEQ ID NO: 54412 - DNA, 1153 bp, Heterodera glycines
  Genomic contig location: Contig_ID=SeqID_4428; Location=294..1446; Strand=+
  SCN-specific regions: Sequence locations=1-30,52-158,180-241,539 -674,723-784,837-877,900-1001,1024-1153
atgatgtggataaatacaaatcgtaaattgcgaagagaacttggacttgaaaatggcaataaaaatggcgaaaaaaaatttcttgaacgacaaaacacatcaaaattaattgaattacaagtaaaatgttatttagaataagttattaaaattaatgagttaaataaatctaaattaattcctgggctttataatagcaaaaataattaaatatttagcacttagttttttattcacagagaataattatacaattaaaataataatgaattgttttaaaatttttaaataaataaaaaaaattaacaatataaatattatacataattagcattttgatattcatttcaatgaaaattattagcaattaaaattagcatattaattgttttaaaattttgaaataaataaaaaatttaacaagataaattatataattagaattttgatattctttttccattgaaataattgcaattaaaataataaattaattgtttttaaatttttaaatatataaataaaatattataaaattgtaattttgtaggaatttcttatcttttattcaatgtcaattgaacaagtgttcactttttggagtaaaacaaaagaaaatctgataaacaaaaaatacgataacaacaaatgcaatttttttctatatgcaaaagtaattaatttattttttattttttaatttcataaacaataaaattttaggtaaaaaagaatttagctgaaattacacgggaacgaatgagtgaatttgttgcgacaagaattgaactggaaaatatgtgaaatttcttgacaaaattaattaaattcacaaatttttagtagataagcaataagaaaatataaaattttactgtatttaaatgtatttaaatattgcctaatttgctagacttcattttttgcttttaatgaagaggtccgatgttgtaatttaaaatttcggttcgattaaaaaaatccgtgatttcaagttaattattgttgtttttgccacatggtttgataagacaaaattcgttttttaacgtgtttagtgttctcagaaccacttagaaacattgctgccgtggtggccttatggaattattttttaaataatcctccgccagcaggaggagtcgaacttcta

SEQ ID NO: 54413 - DNA, 1546 bp, Heterodera glycines
  Genomic contig location: Contig_ID=SeqID_4430; Location=1121..2666; Strand=-
  SCN-specific regions: Sequence locations=1-234,256-434,473-490,513 -664,686-1216,1239-1498,1536-1546
atggatatggtcaaggaatacatggacttggtccaatgggtcgtcgaaataacaattgtgccattggtcgaacagcccattctcggcattgatccatcagcttttttggcacttttaagccaaattcagtcgcaaaacattgcttgtttcttgataagcaagcaacacaagatggacttggacaaattgattagcatggcaggcgactacttacaacgagcgttagttcttttatattttatttttagtacacttttgatttagattaatttaaataacgcgattaaaaaattgtaaaacaaatttaaatcgaattaatttatgttttatcggccctctataacttctattctaaaattattgaattttcaagcaaaaaggtttgcttgagttcaattgatttttcgaatgtttttgcagtcaattactcaaggttctttcttttttattatttttgtttatgaaatttgagcaaaatgccaataaatttcctaaaaaattacccaaaatatgccttttggtaaactttttttaaaaaatttacagacttggcgcaacgaacaaaatacgaaatatattcatcgatgcaataactgaagctatgatgcatgccgagaacaatggcggacagcagaacggaccaaatttgctgatacaaaatgccaaaatttatttaaaaatttatcaaacaattgcagtttgtatgcttgatgaatgggtgccaatgatttctgcagtgccatcgattgcttacccatggattgcgatgaaaacctttcttcgtcaaagtgctgatcagttgagtgaattgatcgccgagtggaaaatggccaaggagcaccagttctctgatcgtgaactggaggaaaaagccatccgcaaatttttcatgaaaaattgcaactgatgtcttgcttattattcgtagaatgcctcttattggaaattatatttacagtataacttcacatgatcattatttttcacgattcaaaaatagctcgagcagattttcctcttcaatgtaatccaaatttgaattactgagatagagaagaagcttgcccgccgaggggaagattaatagattaagtgaggtgataattgatcccataagatcaagcaaattagggggttggagaggccagggttaaatacatttaaattcaacagagttacggtgactaagctagaggacctacagagatttttttttaatagatgtcaaataatttgtaagactgaattagtgattggtcccaaggtcccaatccgaaaaatttcaaaatccccttgtagaatttcctattatcttattaagcagtttcgcagattacaagttcattctgggagtgttatgccggcgggctacagcccggactgctggacaagaggggattccatgcagggctgggcgtaactggattttcaattaaggaatccgtaattacgggggtacaaaaaccccataatttcccgtaatccgtagttacaaaagtttaattttttaaaataattttcaatttttattaaatgatccaataaa

SEQ ID NO: 54414 - DNA, 1499 bp, Heterodera glycines
  Genomic contig location: Contig_ID=SeqID_4430; Location=3630..5128; Strand=-
  SCN-specific regions: Sequence locations=1-177,215-219,242-522,564 -571,593-631,653-915,937-950,972-1114,1180-1499
cagactggtttaaactttggcagctcaactgatcagaatcaggttccaaaccttgggttgaacattggcaatgtgtccaatcagcagaactttttggccacaaaccaacaatttgctcataacaatatggcaccaaaaaactcaaacatccaaagtcagatgaatactcttggcgtgcagaagaaaccgaagaaacaaaggaaccgaagaaagctaagccagccaacatatttattggaaagtgacgcaaaaaattttgccaataatgtacaatactggacaggagggaaattttcaaatttgttatccaatcaaacagccgggccatcagtaccaaacacgctcaatgccaatcagctaaattctatgcctggaccatcattaggacaggaatttcagaattatcagctaaattcaatgcctgggccatcatttggacaacgaaattttcaaccaaattcaatgccaggggcatcattgcaacaacttcaaaattatcagctaaattcaatgcctggaccatcattataccaaacatggcaaaatcatgaaaccaatccaacgccaagacggcaatttgaacagcaaaataatacgttacatgaaattcacttgcaatcaaatatggtaaactcattgctttgtgcacaaaatgaacagcaaattggcattggcacttcaaaacagttcaccaccgtttttggcatgcaaacgccaaacattgaacatggaaatgctggtttttatgccgaacttctgacattcataaatcgtttaattgaatcggctgcaatctcttcgcacaataatggtctattacacagtacccttacccgattaagtgaaaattaccggtaccgctctagtctacaatttattaacagattttgtccaaaaatgactaaagcatattttaagaaaattttgaatttttggtgtgtcgatgttgataggcgagaaattttttaaacggaatctttaacctttcacccctaaaagtgaaaggtgaaaggaccaaaaagtgtggaaaatgcgaaaggtgaaagcgaaactagctctggtacactaccattttaatggataaatattagtaaaatctgtgcaaatgagttggtttttataaaaagtacaaaataaattatatatattgtttttcttttaaatatttaaacaaaaattcaaactttttttctttgtaattgttaatatattcagtgataaacgtacggcgcattgtcgatttgagtttggtttgtctcgacattatgccacattcagtggacacacaattagaatttattaaatcaaatgaattgacgccaaatgttgtgttatacgaaacaagaattggccataacattgatgcagcaaaagtggttaattgtttgaatgagcggttaattgctgcaattaatgctcatgagtgtcttgaagtgtttaagccgaaagttgccgatattcaaagagagattgagctgatgtttggacaaaatcagtaa

SEQ ID NO: 54415 - DNA, 396 bp, Heterodera glycines
  Genomic contig location: Contig_ID=SeqID_23719; Location=107..502; Strand=-
  SCN-specific regions: Sequence locations=1-259,281-286,308-396
atgtttgtcggatgttgtgccattctttggttttattggaaccacttcaaaaaaccaccaaaaaagaaaatgtaaaaaacaaataaaatttcaaaaattgaaatttattttttcagtttcatctccgccgattgttggctttgtgtattcgatttgcttacgccttcacaacttggccacggaattgcgatgatcagtcaccgatttggcatttacgtggacgaacacttcaaaactcgcaaatgggcgctgaaatttattcaaattcacagcaaaattggagagaatggcaccaaggaagtggaaattgtcaatgatggtggagaagcattgccaattccgcaaattgaaatgccacgcaaagtcatcggtttcgaacgcatcagcatcttgtaa

SEQ ID NO: 54416 - DNA, 260 bp, Heterodera glycines
  Genomic contig location: Contig_ID=SeqID_23720; Location=1..260; Strand=+
  SCN-specific regions: Sequence locations=24-34,59-106,131-260
agttttgggggcgcggcggggccgataggcgccgccgggggaaaaaattggaaattttgatcatttataaacagtttttcactgaaaattatccaatttataggtaaaattttgaaaaattttatgggaatttaatccaattcttaggggtgtaaaagtcgcgtttcgcgccaaaaagcgaaatgcgaaaagcgaaatgcgaaacgccaaaaaatgcgaataatgcgaaatgcgaaaagcgaaacctaggcacatccctg

SEQ ID NO: 54417 - DNA, 651 bp, Heterodera glycines
  Genomic contig location: Contig_ID=SeqID_23721; Location=202..852; Strand=-
  SCN-specific regions: Sequence locations=1-88,115-358,389-528,565-651
atggaaaatgcagttgcaaaaacgcacagtgcaatcgtccggaaatgggctgccttgttggcacttttttcgccggctctcaccttgctattaagcaggtgttttctttgtcttatttctgggcgcaggaattgggtactcaggatcaaatgatgcgcgaaatccatatcggaggtttaccatcgcctgaaattcgacctgtgttttcaaaaaatttccccacggttcttatctgaatgtcggacctcttaaatcttttcttaaacattcttaaatccaattacggtttcagaaaaccgcttaatttatcctaaggcatatataaatatataatacaaattgtgatcacaccgcaacaaaagaacaattttatatacatcaaacttcattctattttgatcacttctcgataaatcattcattcacttctgctgctgatcacttggctcgatcattgttgcatcacgaaacacgaatgtaaaaactttttaaaaattctttaagtttttttacgaattttttcagctgattttttttaatttcttaaattttttgaaaatttaagtgtcttaaaaagtttttctaggctagaaaatccatttagattttttttaatctaaaaaattctaaaaaacgcagttctgcaataaa

SEQ ID NO: 54418 - DNA, 949 bp, Heterodera glycines
  Genomic contig location: Contig_ID=SeqID_23722; Location=1190..2138; Strand=+
  SCN-specific regions: Sequence locations=1-384,406-484,511-587,619 -709,731-949
atgcccgaggaacatcaaaacgaagacggtaataaatggaacagaaacggtccaagggtgggttacggtatacggagtaacgcctcaccagaagcgagggtggatccgaggctaaaactgcccctacccagacaaaccagataggatgaaagattcttaacaacaataaatcataaaacaggcatagattataatttttctccacggtggcacagaactccccctcccaaaaaagctccatggtaaaaataagtaaaacgtactatggtcaattatgttatatttaaatcatttttattaccacaaacaaaactttttatttttttaatgtcattagaattctaagttttattctattaacattttttgactttgtccacttttttggaacctaattatttacttgatttattatataaattactaatttggcctaccgaattaaatcaaaatgtttatttttgttacttctaaaacaattttggtgtatttttattggaaaacaattatgaattgttccatcataagttccattaaagccgtccaattcaaaattctgatcatatggtcttcaaaacgcagattagaatatataattattaatttttgtttattttagcacccaacaacacgacatttaccatggcattttgttttatcactcttttggccataattattctgctcaatggatggttgttgaacattgttttgttggcatattttcatatgcaaaaggcatcatactttcatactttaccctccctccatattacggtaattaccaaagaaatttagctgcaaaacgaggacaaatgcattcgacagaaattgttggttaagccaatgaggaggcgtacgttagtggaggaagacatcccagcgccaaatgtaaaaaaatgcattaatagtctcggtcatctagattttttgcaattgggattttgca

SEQ ID NO: 54419 - DNA, 328 bp, Heterodera glycines
  Genomic contig location: Contig_ID=SeqID_23723; Location=244..571; Strand=-
  SCN-specific regions: Sequence locations=1-249,284-328
atgctatttccaatagcggtaaaaaattcttgactatctacttttacatatttctgtaatttagctatggaatctgactcatcgcctcgaaattggtctttcaagaagcaacaattcgttagaagcgtggcataacatttggggggcccttcttgaaccaaacccactgttcagcaaatttgttaagcgaatgcttaaagaatttgaacgttggcagcacattgttgccgattttcacaatgcaccggcaaatgggataaggggaaagggccttaagagaaagtccatttatctacaacaagaacaatttgcggcaactcttcgctga

SEQ ID NO: 54420 - DNA, 467 bp, Heterodera glycines
  Genomic contig location: Contig_ID=SeqID_23725; Location=1356..1822; Strand=+
  SCN-specific regions: Sequence locations=1-155,177-467
atgttcttcatgtactcgcaaggaaccgcaggcgcgcaaagcgccggcgacggaaagccggcggaacccatcgccgaagcgacgcccccctcggcggacatcgctccgtcgaagaacgccttgggggcgaactccttgaagaaatcggagtattgttgtgccaatgttttccaaaatgaataccttagctgtgaattctttttgcacgtcgccgcatggccaaacggacgaagcgccgccgaagagagccattgggccgacggagacggcgccggaagcggacgaaacggcgcaaagggcggccgaggaacccatagcagagcccacggcattgttgtacatgacgaaaaagcaatgggagaggtggaaagtgccgatcgaaactgctgaaaaaggcatcaaaaagattgaagaagcaaatagtgaagtcggacgaaagccagccattgcattttgactttttaaaa

SEQ ID NO: 54421 - DNA, 1484 bp, Heterodera glycines
  misc_feature (1444)..(1444): n is a, c, g, or t
  misc_feature (1449)..(1449): n is a, c, g, or t
  misc_feature (1477)..(1477): n is a, c, g, or t
  Genomic contig location: Contig_ID=SeqID_23726; Location=7..1490; Strand=-
  SCN-specific regions: Sequence locations=1-151,176-511,533-600,623 -697,719-789,811-902,924-1258,1283-1484
atgacctttgccttttttgaagctcctacgctttttttgactgttactttatttcagtaagcacacatgcgtaaaatttaccaccgatctgagaaacaatccaaccgatgggatcactgtggttgacgatggggacacttggtcaaaagtcgggaagaaaggaggatggcaaaaactgtccctggggcaacgaaatgtatgtagaaataaacacaagcgagagattcctaattcacactaataattagggaggggaattatatggaaatccatatttttttctggactatggggggcctgaaatgcacgaaaaacatgtttttagcttggtttgaagcttctaggatggagttccatatccatatttttccatatttcgcgatttatgtccatatttccatattttggcattaagtctatattttggcatttttcaaaaaaatctctattagaacggccccccatcagataaattcggatttgaccacccaaaatcggaaaatttttccgaaaaagacattttttagcaaaattttgtagaaaatattgattaaatttaaattttcctaaaaattggttaatttatgttaaaaataagcaaaaaatggaaattttggtatttgggttggtttttcgcttaaaaatgagcaaattttagctgtatcatatttttttcttctaaaatggtattttgataccatatttagctatttttaataggtttactttacatttagcgaatttgaagaaatttttagaattatacactcaattttggaaaatttatgtccatatttttagcattttatgtcgatatttcgcgatttttggtccatatttttgcgattttatgtccatataattccccgccctattaataattaatttctcaaaaatggtaaaggaatttttgaaagttttgtaattgatatatacgaaaccgcaattttgccgatgggacggacgataataattggctaatattttgttttttgatagcctgggaccgttgtgcatgagctcttgcatgcaattggtttccaccatgaacaccaacgtgacgatgcgcgcaagttcatcaaatttgtaaccgacacaaaagatgacgacgtaattattttaagataacaaaaatgcttttctattaaaggactggaaaacaaatttcgagccgaaaaataggaccaaaaattttggatttgcttatgactttgcctcagtcatgcattatcgtacccgactaagaaaaaatgggtaatggaaaatatttataaattgaaaacaatttttaatttcacattttgttttatttttggtaatttacatatatccatcctcccagttcagtttaaagggcatggtcaccctcaaccgtttttacatgcgtacaactgggcagagggaaaagccatcattcaaagacattgcgttaatcaaccgcatntattngcatggtaaatgaatgcaaaaataatanaaataaa

SEQ ID NO: 54422 - DNA, 2378 bp, Heterodera glycines
  Genomic contig location: Contig_ID=SeqID_4433; Location=856..3233; Strand=+
  SCN-specific regions: Sequence locations=1-224,246-624,646-654,676 -1206,1228-2028,2078-2378
atggggcaagaaaacaaaaatttgaacacacgtgtaaattatgctctttaccgtttaaatgcggaacggaggcaacaatacgaacaaatatatgtccaggcatgcgaaaacacgaaatttcaattacagctcgcaaaagcaatcttacaaatcaacccaaatgagggggtgagaaaaatatttgacagggatgatttgattgcacgatgggtaggagaaaacctggaaattggcttttgtgttccaattatcccagagaaaattttttgggaccataaagttgacggggaatgttttgaatggttgccaattaacgcagaaaatgtgactttctttgttaaacctgggacaagagagttaagtgtattagggaaaaggattgattgtgaaaaagttgaaagcaatcgaattatggacaatgaaacacagttgattattgtcggggagttaagcaaaaatcttgaaaaaataaaaccaaaatatcgaaatatgcagaatccacttattttaaaagcggggacactttttgagtcggaaaatacacgtttagaaaaggcaatgctggaatatcggtccaaaattaacacattgccatcggcaaatttgagggcaattcaaaggcctaatatttctgaagttataaggctgataaaggaagaagcaaatgaaacattaggggctgtatttggcaaaacaggtgattggattgatatggttaaaaatattccagaaaaggcgagagaagcagttaaccacctaaaagggatttcttatttacttattttaatcccgttgctgttactaatcgctcttgtgacttattttgggattaaataccgagtaattatttgcgctggtttccgagcagggactcttttggtccgaattataaggcgtattcttggcatgaaaagacaaaaaacaagagtagcagcagttccaactgctcccgaacttgactcgatggaccaagaggcctatgtcttagactatcttccaccaagacgagttgcagtaattactaatgacccaagaagacttccatctattcatattcagataaacggcctctcaacgacggccttagttgattcatgcgcgagtgtctcttattgccgagaaaagacagcactaagagcaggactgaaaatttcagaactaaatgatgaaaaagttaatttattgacagcaaatgatacaaaaattcaaattttggggaaaacttgtgccaaaatcagaattaaggatgaaatgtcaggcaaaattcgtgaatgggatgctatacttttagtttcaccggacaaacactgtcccggtccagtcttaattggtttaccattactaatggagttaaaaggcataatttcgtgggcagaaaagaaagttcggttaggagaagtttggaccaacataatatcagttgtgggtgcagaaacatccaaaccgttacgaataacaatggaaaagaccgaaatttttgaaccctggactgaaaatattgtcatggctcgggtaaacgaagttttcccgagtgaacaaaatttcttggtaaaaggagtgcaacaccaataccctggaattatagtgggtcgaactttggttgcaccgggagaaagcaaaaacgtaattttacagctaatgaatgcggggaaagcaccagttaaaatttatgggaattcacatttggctgacttagaaacaattaaaataaatgcgttaccaggtgatgaaatctctcctaaagattatattccgccagaggcgagatggagtaccaaacttcctactctcccaaaaccgggattgaatcgccctccgtctaaaagaatatgtcttgaggggacgaaactgagtaattcgggacaaatttcgctaaaaaatatcgttgataaatattctgaggcattcgtcggtgatgacggtaaaattggactttacaacggccctatgcaaaatgtgatggcaatgcttctgagcatacggaacaaagcattggatgtccacgatgaagcacagaatgcttggaacgaattaatgaaaatgaaaggaaaaggggagaagaaagaggaggaaggcatggattccggacttccagggttttcaactgctgattggcaatccgatcatgaccgttggcgtggacaaaatcgttggcgcggcggaagaggagcaagacgttggggacaaccatggcgagggcgtgaatggaaccaaccaaatcaaggagcgggcccatcgacatcagcggcatcacaagaaggacaatggaatttctcaaagatggcgggatatggatagaaaattggattttgagttggaattggttgcattttagattttttttgggccaaaatacaacaaaaacaaacaaaaaaaca

SEQ ID NO: 54423 - DNA, 289 bp, Heterodera glycines
  Genomic contig location: Contig_ID=SeqID_4433; Location=3582..3870; Strand=-
  SCN-specific regions: Sequence locations=1-40,62-289
atggctaaagaatattcaaaatatttatgtggatttagacagaaagaaaatattaattgctttgatgaacatggacaaatggtctcttttgggttagacgaaatctgaattggaaaattgccaaagaaaccgatattatttggacattttatacgaatatttatttcgactttatgttgcaggtttatgcaattaactttcgtagtgtagcggggggcccttttcccagtcgcatccccagtacaaatggtataccgtcaacaatagtcctttattgggtaataataaa

SEQ ID NO: 54424 - DNA, 638 bp, Heterodera glycines
  Genomic contig location: Contig_ID=SeqID_23731; Location=1070..1707; Strand=-
  SCN-specific regions: Sequence locations=1-64,86-168,191-280,302 -599,621-638
atgtgtgcatgcgatcagcgtattgttatggtatggatacgatcagttggtgcaaaacaacggcaccagctgcagaaagaacggcgacactggaaatagtggtggtgaacaggcaaacgatggttcttcatcatgcacggtgaaatcaagaaattgaataagcgcaaacatttttatgataaaaaatatctgtcaaaaagtaccatcggcacttttgccgaaaattcatggaaataggcgaagggaggaacaaaaaagggcaatttgagcccattataaatattttcaatttataattgtaattaagtgcaattataatttagaaaccggagctggacgatgtggcattgcaactcagtcagaatcagttcggccaacagctgaaccaaaccgtcgacggaaacggtgccaatggcatttccggtgattgtgtcagtgctgaccaagtgccgactaccgcgcaaatcatcgcaatgataaaccagtactcctacacatacaatctgatcaacggaaaatccagcggcgtcaccgtaagcgattcatcttcgaatgccgaaatcaccagcgcaattggcacaatcatgcgccagacctctcagctgcagcaacagctgcagagcaactcgaagaaatga

SEQ ID NO: 54425 - DNA, 332 bp, Heterodera glycines
  Genomic contig location: Contig_ID=SeqID_23732; Location=418..749; Strand=+
  SCN-specific regions: Sequence locations=1-36,58-291,315-332
atgtttctgtcagcacaatcggttgctgaactgttctcaatcagaaattggctcaggttcgaaagggcacggcattggtcacaattttcccgtcattttttcaaaattcaatttaattattttttcagatttttggtcgtccgccaacgcattccccatttgatcttgggcatccaatttgcgtgggttgtcgaggaaaaaaagaaaaagcaaaaatcatcggccaatgccatttcgccaaaaaagcgatgccggacgatttgcaacaaaatgttgactgtttttggcatcaaaaaattgggcaaaaaatgaataattaattattactataa

SEQ ID NO: 54426 - DNA, 150 bp, Heterodera glycines
  Genomic contig location: Contig_ID=SeqID_23732; Location=1509..1658; Strand=-
  SCN-specific regions: Sequence locations=1-150
atctgatgagtgcccattgggccgactgagaacgtttggcgtcgcgctgggcgacgaggtgcaggaccaaaatctgatgttggaccgcattcaaaagaagacggagcgcaacgacggcgtcatccgctcgcaggaggaccaaatgcggaa

SEQ ID NO: 54427 - DNA, 87 bp, Heterodera glycines
  Genomic contig location: Contig_ID=SeqID_23736; Location=1730..1816; Strand=+
  SCN-specific regions: Sequence locations=1-87
atggcccgcgctcacttggcggcgctcaaatggctggcgctcagttggccatgcacccctcctataggtattgatttcatcgctagg

SEQ ID NO: 54428 - DNA, 643 bp, Heterodera glycines
  Genomic contig location: Contig_ID=SeqID_23736; Location=612..1254; Strand=+
  SCN-specific regions: Sequence locations=78-87,110-228,268-310,336 -346,396-398,474-643
ataataataaaataataataataaattaattaaacatttttataataatttaactaataaatattatttaattataaccctcgttcctttttcctttaaaatcaaaaattgggaaaattccgttaattgatttgtttattaggccttattgcagcactcttccccttcttcattgatttgtttattttgttcatcttaaggggtcctgtaattaatttggtttagttaaaataattatgcaaaaaaataaataaataaaaaaataaaatattgggctcataaattaaatttagataaaaaaaacattcaaagccaaagagttagaaaaaataaatttgcatcaaagtataaaatttcattgaaattttaattgtttgaaatttaaaaaaatatttgttattattttaataataattaactaattaattaattagaacattttttaaaatttataaataaatattatttaattatacggtcccccatttctttttcgctttaagtcaaaaattgggaaattccgttaattgatttgtttatttgaccccccttcccttcccgccacccgaactcgccatttcccttatccctcgctgcaacccttcctcgccactctcgctgccgagcaatttctcgccatttt

SEQ ID NO: 54429 - DNA, 1014 bp, Heterodera glycines
  Genomic contig location: Contig_ID=SeqID_23738; Location=98..1111; Strand=-
  SCN-specific regions: Sequence locations=1-345,376-462,484-653,675-993
atgcactctgataaagaacccgagaaaacagcgcagctttttaccatggaaagtgattttgtaagaaaatttttagatttttttgtcatgacaccaattccgaaggattaccaatatttacatcgactccctcccgccgaacttcggcattccttcaccttcaacgacgtcgacagtgtcgtcggcttggtgtgcaaatggacagtacggacgtccacagcgcgcctgagtatcgtgggggcaccgagttgacgagaacgggcttggctcagatggcgaacgaaacatttgaaaatatgcaaaacaaagctaaaaaatgaaaatgcgcaaatttatgtaaaacagtaaaaattcatttttttaataaataaaattggatggataagcaaagccaaacaaaaaagagaaagaattcaatgcattttgaataataaaataggagtaacattttatcaaatatcaaatgaataattcagaaaattaattgttttgcaaattcaattaagcaagccatcactttttcaatatttttgatgagcacactttcgcgaaggcacattcaatttcacaatggaataattaagagtatagaatagagaatgttgaaagctattaaattgatttctttgtaagaagatatttttatcctgcgccaaaattcattttttgagaaacagggggtccggcagtgccgatggctccgccggaaaatttttcaaaatttgagagaaatttgtttacatatttacgcaaaaaatgacaattgagattttggtttctcttttttaagaaaaattgggaattttatgcgtcaccggatgaaaaagtgcaaacgttggccctagcctttttgcatttttatcggagacctcaaaattcaggacatttgatttttcaaattggtaccctctaaaatcagtacacttggtaaccaaaccatgagattttgtaaaaaaaaaactgaatttaaacggaggatgggcgcacgaggatagaaaattcataaaaaataaa

SEQ ID NO: 54430 - DNA, 420 bp, Heterodera glycines
  Genomic contig location: Contig_ID=SeqID_23740; Location=87..506; Strand=-
  SCN-specific regions: Sequence locations=1-266,288-420
atgggtgccggtccagacaaagaagccatgcaaaaagctttgttgacatcgcacgcggtgccaatgccaagcgacatggtgcagctgttcatccaattgtggcattcctccaaatttggcgccgttcctcaacaattacgtgccatcaaatgtccgtcccgaagccgtcgtcgtcggaaacgacaaaatggcggtgatttgtcactgtttgacctggtgatgttcatcgtctcagtttacgtagcttcatatgttgtcgaattgttgaaaaatttattggaaaagggcaacgattttctcgaattcaacattgtgtccatttccattactattttcattttcgcattcattcgtcaacagccaatgcccaaactcggtgccaaatttattgcagaaagaatcatcgaacgtttgggctaa

SEQ ID NO: 54431 - DNA, 272 bp, Heterodera glycines
  Genomic contig location: Contig_ID=SeqID_23740; Location=1280..1551; Strand=-
  SCN-specific regions: Sequence locations=1-272
attgcacagaattgccgaaaaaattcgagaccaatttccgaatgttgaccgactaccgtatatgctctaattatagcccagtctctattaataccgcagtctccaattatcccctgtattctgaggaggttgaaaaataatcccccatgggctataattagagcatatacggtaattgccaaaacgaaagccgtctttgtcaaagcgccttaccgagtcaaaaaatttggaaatatatctcatatgcaatttcaactaataaatttgaagaa

SEQ ID NO: 54432 - DNA, 436 bp, Heterodera glycines
  Genomic contig location: Contig_ID=SeqID_23740; Location=585..1020; Strand=+
  SCN-specific regions: Sequence locations=1-214,236-304,363-379,402-436
atgtcggcaattgtgccacactttccatctacagtaattttggcttcaatttctctcttcttaaaaaattccaccagttttttgccatgtttttgcagtgccttttcaactttcttcacaaattgttctgaaatgccattgtccaaaagttggccctttttcaatgcttcacaatatttatcaacttccaaatatatttcaaccgaatcatcgccattatttttaacaattttatcatgcttttcatcattttgcattccgccaaaagcaatggcgcaattaaggaacttcgaaaataattggcaatattaaataaaaattaatgtacaatatattttttaaaacaattattaacaatttatcttttacagaaactcacccaagttgttttgcttgttcatcatcgaatttttcattaaactattagaaaactaaa

SEQ ID NO: 54433 - DNA, 582 bp, Heterodera glycines
  Genomic contig location: Contig_ID=SeqID_4434; Location=578..1159; Strand=+
  SCN-specific regions: Sequence locations=1-87,116-341,363-459,493-582
atgccaagaataatcattttttttaaaattaaggtactggttcgcaattgtgtcactgcgcaaacattttatttccggtgagtttccaaaaaaattattaaaaatattattttatgacttaaaaaagtactagaataatccacaaacataggcattggaagaatggatctgatcaaaatatgtagtattgtaaagcgtgctggatcgtttcataaaatccgccaattttagcgatttttcgacaaaacatggcataactttgcttaaaggcaatcaaattttacattcttggtatcattcgatagccaagctttttctctactagcttgcaaaacttcaaataaaattatcaaatttaacataagttatggcagaaatagtacttattttcatacaactttttctaaaatttaccaattttttttttaaattttgcaggctaacagagaaaacgctgggctttcaaatggtaccaagaatgtaaaatttggttgcctttaacgaaaattatgccatgttttgtcgaaaaaatcgttaaaatggcggattttacgtaaacaaactagccccttgtaaaggtga

SEQ ID NO: 54434 - DNA, 1583 bp, Heterodera glycines
  Genomic contig location: Contig_ID=SeqID_4434; Location=1190..2772; Strand=-
  SCN-specific regions: Sequence locations=1-207,230-464,487-516,565 -592,614-660,682-1133,1163-1533,1555-1583
atgccgtccagcgatggcaaaagtcctccatcctcggagcaaagcaatgtgctcagtttggcattccggctttgctggtccttgtctgttgaggtgaggaaatgctttgtcagcgcattgacagcaattccgacccgatgctccaacacttggagtttatctgagtgttaattgattgccgaattaatttactaattagaggctactataatggtattatgcatattacaatcggtatttgccctttacagtatccactcggtgtaccccaaaacacagccgtcgaaacacagccgagatataaaaaaacagccgggaataaacataaaaaatttttttaatctttgaaaaaaatttcttagaaaattcgatgaaaaaatttcaaaaaatttccagcgatttttttttgaaaaatttttgaaaaagcttagttattcatcattaaattttgaaaaaatagctggaaaattttttgaaattattttcttcaaattatctaagataaaattctcaaagatttttttattgaaaaatttcttagaaaaaatttttttttaatttattcccggttgtgttatgtctcgactgtgtttcgctggctgtgttttgtcctgttccggtatccactacaccaaccaggacagccgctggtgttcgatgcgttgctgccagaaacgccggtgtcgccgctgttccgacgctcacagctcggcgagcggaaccggcgatggtaggaacggtcgcgcgaccttccatcgctcgctgtgctgttgctggtgtccatggtggaaaatttggccttgcgcggtgacaaaaaagcggcggccgcactcaatgggctttcgacatgctgtagcagatactgctccgatttgatgccctttggaaaaggtagcgccatatgaatttcctaatttagtgggtagaattttcccctaaaaaatccattgaaaatcaaatagctatttgaactttttaccgatttggcattctgaaatgagcctgccattgtcaaaattttctcgatattcgagaaagataccctagtcttgacactgagactcggttccaggcatagaccctaaaactcaatattttccttgactcggtatcgaaattctcgagcagttaggtaaaaaaaaattttttttttgaaaaatttgttttcttaatgccgctaaaaattcaaattttcccatggtgacaacttttcaataccctcgggctggcttgcgttgcctagaaattttcacttttctagccaaattcatcaagtatttcattagttggcgcaaaatttcgctttttttcacgcacagatgagaacatttcagcgccgccgcttccgcgcgagccaccgccgttcatcatcgacaccgtttcatcctcatcacttccgtcggcatagtgccgtcgtgtgacaattgcctctgcaacgagcaacctctccaatgcgccgtcatcaatgccacggccaaaccaacggccacaactgtgtgtgttcaggaaaggtactcggaaagtcggtaattttcggcaaaagtgtataaaattcaaaaaaaaacaaattttttttcaataaa

SEQ ID NO: 54435 - DNA, 740 bp, Heterodera glycines
  Genomic contig location: Contig_ID=SeqID_4434; Location=3056..3795; Strand=+
  SCN-specific regions: Sequence locations=1-177,199-204,226-330,352 -504,530-740
atgtacccatgggattacattgaggtcaatgaaattttaaatttcgtttttaaactttacaatttatttttcagaaagtttttgtgtggttccgtaaatttttctgctctggtgaatcgaaaaagttcacacaagaacaacggtaagtggaggtgaaggatacatacaatatattgtcataatgccattaaatgaatgaataatgggtttaaattttcaaaaaatggaatttacaaaaaaatctcaaccaatttttatcacacagatcattgatcatctacacatataatttggtgtccaaaatttctggtatgtacgtcagactgaacaaattttaatactatatattagagttgctcggtaatcggtaattgttaaaaaaccggtaccggtactgaccggtactgcaaaaaccggtaccggtaccggtaccaattttttccaccggtaccggtaccggtaccggtaaaaaccggtaattttccaacgtaaaaatttttggacacaatttttcaaatacaaaatttttattcagttttcgcgcgagtgcctgttttttagcattagaattgttcagaagtatatgtatattgagggtgaccaagttttttttcaaattcaggataaagaacactaaaattcagatatagacctcaaaattcagattattgcaaaacaagggatcagcggacaattttccaattttgcgaaggggtctccggccatgtaaattaatgtaa

SEQ ID NO: 54436 - DNA, 557 bp, Heterodera glycines
  Genomic contig location: Contig_ID=SeqID_4435; Location=66..622; Strand=-
  SCN-specific regions: Sequence locations=1-119,201-215,243-415,491 -492,513-557
atgacagctttgatggttgacgcaaaaatgcactttgatcatagagttggctggtcacttgtgtccatgcgatcaatgggagcagtccggacaaaatgtgatcccttttttggttggttgaaaaagtattttaatagaaatttattaattttattttatttttttgttattcttatttagtttatttaatatttatttcaaatttttatgtgtccaagcaatttttataaaaagaaatgattaaaacttcggttaaagaattagtccagattaattatttgtcgataatgatcagtcaaatgaatcatgtgatcggaatatgattttatttaaaaaaatgatggtgggaactaccgtagcgaaaaaaggatgaacaaatggaatttgccttctttgccgacggcattatgtgctgaaaaaattgaataaattatttttttattagatatttttttattgaaattaatttattttaaatcattataattttggtatatatatatatatatatagtagagttgctcggtaccggtaccggtaccggtaccgaccggtaa

SEQ ID NO: 54437 - DNA, 1137 bp, Heterodera glycines
  Genomic contig location: Contig_ID=SeqID_4435; Location=776..1912; Strand=+
  SCN-specific regions: Sequence locations=1-117,155-190,235-595,631 -1055,1092-1137
atgaaaaatccttgttgcaaggcattgaggatatatgaagaacaatttatggttttttgtgtgatgtgtccatatgtaaaatcagatgatgtaaatcaaaaaacgaattaaaacaccataaatatatatttatatatataaatacatttattatgtacaaaatttgttgtatttcataaaacagtatcagattttaatgaattaaatttttctttttctttttttaaattttaagactgcccagtcaatttctttcacatcaagcggatttgaacccagaacccatttttaatgcaccgctaaatgaaaaattcacaatagaagtcgatcctgctctatccaatctatatatagcttatatgcaatttcacggagcaggacaaaacgtcgttggacgaatttttgggccataacttttttctttctccaccaaattaaacattcatgctattattcgaaagcatttgaaaaacgctattaaactagtaaatttccaaaaaaaatgtattcatgcacaaagaaatcagggcaaaaaaagttcgaaatactgggtttttgagttccttctggccataactttttttgaaacttaacgaaaatttttgaaattttacaaattaataataaaaaccacagagctatcgaacaacaccgaagaatgcttaatttgattgacaatgaacaaaaagttatggttcaaaaagtcttccgacgacgtttcggccgacgacgttttggggtgcaccggcaatttcatacatacatacagttgatatgttcccttgtaagcaccggaggtccggccgtcccgatatgatttacaaatcgctgaatattaattttttggctgttaaatttcaaaaaaaaaattgcttagtttaaaaaggttgtgcaccgaaaaggaggctttttcgacacttttgaccttttgtatgagatttattgcacgaaagggagtgtggagttggaaaaaaagttcgaaaaactagggtgaaaagaacgtgatcaaatgcatttcccggatataacctccaaaagtagatttcgtcaaaatgtttttttataaaaaaaaaaatcaaattttaattttacaggcagataaagaaatttatgtagataattaactttttattaaaa

SEQ ID NO: 54438 - DNA, 528 bp, Heterodera glycines
  Genomic contig location: Contig_ID=SeqID_4435; Location=2868..3395; Strand=-
  SCN-specific regions: Sequence locations=1-19,42-50,73-212,234-504
atgtcattaccaacaaaagcaacaacaccaataacaacaaatgttccgtcaaaagcagaggccaaaggaggacaaaacgggacgatttggattgttgcgatcgttgcgattgttgcgattgtggcgattgcgatttttgttgctgttgctgtaacggctgtagcagtaccaacaataacaacgattgttgctgctttaacgcaaagtgttgctttgttttgtggctaataattgcattggtatgcgttggcagcatcgctttatgtgccatcaaaatgcatcaaattactgctaatggacatggtgcacaccatagtattggtcatttcattggtggtacggtgggcgctggcatctttctggtgatttctgttattgctatggtgatcagctgttgtgtaattcgggatagctgaagtgatttaaacgcgctaatggcaaaacgtgcaacaacaaaaaaaaaaagttgaaaaatgtaacataaaatgtaaaaaaagaaaaaaatgctttttatttttccaaattaaa

SEQ ID NO: 54439 - DNA, 117 bp, Heterodera glycines
  Genomic contig location: Contig_ID=SeqID_4436; Location=203..319; Strand=-
  SCN-specific regions: Sequence locations=1-117
atgctcaaatcagcaaatgagctggtggacaatgcatcaaaattgccattggagaaacaaaatgccacgaaaatgtttgaactggtcaaaccgaatctgtttggcattgtgtgcgat

SEQ ID NO: 54440 - DNA, 93 bp, Heterodera glycines
  Genomic contig location: Contig_ID=SeqID_23741; Location=1439..1531; Strand=-
  SCN-specific regions: Sequence locations=1-93
aacggacaacttgggcccggcgaattgccattgagggaattgcgaagccgacaaatgttgttgctggacaaactgcgggagaaaatgcgactg

SEQ ID NO: 54441 - DNA, 772 bp, Heterodera glycines
  Genomic contig location: Contig_ID=SeqID_23742; Location=63..834; Strand=+
  SCN-specific regions: Sequence locations=1-411,433-447,485-502,524 -535,558-734
atgcacttttttccggcaattgccaatttgtatttcgtcggcgtttacagtcgcaatgttgtgccacatattttgattgttgaacgcattttggcaactgtgtttgtccgctcatatgagcattggcggggctacctgttcacaatcatttgggctccgatcgctgtaagaaatttttgtattttcaaatattaacggagttaaaatttaccaaatttttaccccccccatttttatgtaggaataaaagaaactaatcctttcttggaaaaatatttttctgtcatcaaattatattataaaatatgtaaacttcttaaatggcaaaattttctcgcattttttttttataaatttgagttgggaatccattagtctgaaacccaaatattttttagtggattttttttgtaaattttattaatcttttaacaaattccttaacaacataaattttaataaaagaaaattcctcacaacattttcaatttaaatcgtatttaaaatatatttaaatgttttagttgaccgtttgcatttacattgccttcactacatctcctcatagtgtccgaccgcttgccaatttaattacaacagctgttgaagtgttgacaggaagtgtggaattggccattttcatgaaactttgcgcttataacttaaaaatttatcaaaaaatgatgcaaaatgaagggcaacacagcctatcattacgctaccaggcaattttgaatttttcaaatttaatttaaattaaaatagaaattaa

SEQ ID NO: 54442 - DNA, 819 bp, Heterodera glycines
  Genomic contig location: Contig_ID=SeqID_23744; Location=250..1068; Strand=+
  SCN-specific regions: Sequence locations=1-819
atgtgtgccaaatcagacaaactcccgccgtcttccgctgcttcgtccttctcatcgcctgcgtatggtcggcctccgtccgccttcaccgccgcttcactgaaccgcgcggggtcgccctattcaatgggcggtggttctgagtacggcggcagacggaagggcgtcagttggtcggacgtcgtggaggagccgaagccgacgactcggacccggtccgactcgcccccgccggcgtcattcattcgccattcgatgccggtgccaaatttcatgccgaaatgattttcaagagtcttcgcaatttgacatataggcattgggcaaagacagtccttcgggatatggaacggacgaaggacggcactaccgaaacggcgcatcggacgatggcactttggacgggggacatgacggacggcaaaactatgacagataccgtcattcttcagtagggaacgagtgaaccaaagcggggagtaacggcttgctttctcatttcagcagaatccgttcgatcgtgccgatggttgggtttcgtccaacccgtggaccggatcattggaccatcggggcggccgaagccgtgacaaagagcgacaaggccctgggagttttttcaagcccgacctgcccacttattcggcattgggacggagtccggacaatttcaacccattccaaacgcatttgcatcgggaggaagccaaagggttgaggaaaagtcaggagagagaggaactgatcaaattccattcttacggcgatcacaaagtgtcgggcattgaaatgaaaccgaagggatggacaggaggcgaa

SEQ ID NO: 54443 - DNA, 444 bp, Heterodera glycines
  Genomic contig location: Contig_ID=SeqID_23745; Location=74..517; Strand=-
  SCN-specific regions: Sequence locations=1-444
atgtttgtcaaatgttggattgtaaattgtaatataaaatgtttggcacaaatgttttgcagtaattgtaaaatgtttgtcaaatgttggattgtaaattgtaagataaaatgtttggcacaaatgttttgcagtaattgtaaaatgtttgtcaaatgttggattgtaaattgtaagataaaatgtttggcacaaatgttttgcagtaattgtaaaatgtttgtcaaatgttggattgtaaattgtaagataaaatgtttggcacaaatgttttgcagtaattgtaaaatgtttgtctaatgttggcttgtaaattgtaagataaaatgtttggcacaaatgttttgcagtaattgtaaaatgtttgtcaaatgttgtattgtaaattgtaagataaaatgttttgcagtaattgtaaaatgtttgtcaaatgttggattgtaa

SEQ ID NO: 54444 - DNA, 1041 bp, Heterodera glycines
  Genomic contig location: Contig_ID=SeqID_23745; Location=794..1834; Strand=-
  SCN-specific regions: Sequence locations=1-727,749-930,952-963,1009 -1017
atgacaatgctccgattgctacggatcgtcaaaggtgcttgttttttgcgccaaaatttgaatcaaatgataattggtgaattttacagaaaatgggtccataattgtgccaacggatgtgtgctcccagaaaacatcggctgctgcgaaaatggtaaaccgattaagttatagcatagttttagctaagttataattatgatacagtatattttcctaccatatctttcagctacagtaacacccgacaaacactggcggcaccgaaatgacgaactctgttcaccatgtgccgagttggggctgatccggctgccaaccgtcgaagacttttccgcttgttccacgctggagcgcagtccaaagtcggcccgtggtgcatacggtggaacattcccgccggatactgtgccatcgccggactctgctgctggcggtgcaccgttggccccacatgaagaacctttgtcggcatctgtcaccccattgccgccaactgagtccgagcgaagcaacaacgacggcacgagtgccaaaaagatggtaaatacagtagtaccaatcggaactgttgctcttcttgaatattgggaaatacggcactatccggacagtttttggcaccggaatgccaaagattttcggtaaatttttctaacttgctgcgaattttttagtcaattttcgaaaaaattagttttttaaaaaaattttgaatgccaattttccttaatttaaagttttaattctaaattcaagagtttattttaagtttcccaagcaattctcggccgagtatggcaatggcattatttcattggaaatgccctcgtgttcttcctcaattgctacgttggcaccgcactcttccccgtcctcatgttcattgcatatgctctccaatttgtccccgtctagttcggccacatcgcatgaacgtggcccaacttatggagagtaatgaaaataaattagaaatttaaaaaaaattctaacatttaaaattttgggactgggattttaaatttttataaaaataaa

SEQ ID NO: 54445 - DNA, 1706 bp, Heterodera glycines
  Genomic contig location: Contig_ID=SeqID_23747; Location=28..1733; Strand=+
  SCN-specific regions: Sequence locations=1-780,802-1644,1701-1706
atgattttaccggctgtgagaaatcagccaagcaattctgatcagaccaagcaactgagtgtaaacgatgattccaatatgcttatgcgagtaaatccagctaataatttgccagaagtgatagcttcagtaaccaattctcagcagcttactgaccagaataatcagccgttgacggaaaatccaactgatcagtctgtaagatcaaatcaaaacaatcagcatgaaattcaagaaatattacatttaccaatgaaaaatcaacaaaacaataaaagagcagcagcaccaaattcacgacaagaatttggatttgatctggagaaagtgccaaaagcaaaaaagggtaaaggtttggcagaatggttgggtcatagcatagatcaaaagcagaaaattgctgtcgaaaacgcgtctgaacagccaactattactgatcatattaatttatcgtcacagacaacccaattaaacaatttgaataatccaacaaccaatcaaagtgtggttgatttatctgacaaaactttaagtacgaggcaaaccaatgaagtcggtccgttaaactcaatggacaattctgatcatcaaatgatgggaaacgctgttgttcagcaagtcgcatcagatcagtcatgccactcgacccagactgacaaattgtctgatcaaataacctttacaaaccaatttgacccgaacaatttggaaaataaattcaattagtccaatttcatcaattttcaattatcagggcaaaatcagacaaataatgataatcactctgaacaatctcaaccagttacacaacaaattaaagatgcacaaacacaaatattgccaaagcctgacggattgttaggctggctttatcgcaatatggacaactcagaaaatcatgacaattcgtttgaccaatcaaattgtcctagccagaaaaatcaaactaattattccgctgatacgtcaacagatttattaatgttaccaaatacagtaaatcattatattcattcaaatccaatgatgactttaagccaacaaaattactataatcaggaaaacccatcgacgtcaaccaatcaatcaacttatcctgatcacgcaaacacaatggctttgaacaatcaatcgatttatgctgatcaggcaaacacatatgcattgaacaatcactcaactttttctgatcaaacaaactcactggcattgaacaatcaatcaaattatcctgatcaggcaaactcattggcaatgaacaatcagtcaaattatcctgatcaggcaaactcattggcattgaacaatcaatcaaattatcctgatcaggcaaacacattggcattgaactattctgatcaggcaaacccattggcattgggtaatcaatctacttatcctgatcgctcactttttatggcgaaccaaaacaatgaagttaacggtcttattccaacaattgattctgatcaaactgatcaaactattttgcaatcaaataaaggctccacggacaacaactgcagcaaaatgtgcaagttcagcagggaaatgttccgacaatgctaagcatgacaacgccagtgcctgaacaaccattcgatgggacgcattcaatggtttctcaatatcgaatatttttgtacccattctttttggggtttttgttttttatttaattattaaaaaaacataaaaaacaagaa

SEQ ID NO: 54446 - DNA, 1187 bp, Heterodera glycines
  Genomic contig location: Contig_ID=SeqID_23748; Location=828..2014; Strand=+
  SCN-specific regions: Sequence locations=1-115,143-255,282-412,496 -523,545-608,632-1114,1136-1187
atggcggacaacgacgaagagcatgagaggctcgccgaacaggggcgcgagtggaaagctgcgcgccgggcggagagcattgccaacttgtttggcggtgcgccgcccccggcccaggatgaggaagacgaggacgaagaagtggaggacgaaggggtggaggacgagcagcgccctcgccgtggtgagttacggaatttttttaaatactgattatctaataaattcagcgcgaagcgcagggcgacgcgggggtgatgaggacgaagaggaagatgaagggggtcgggggcggcctcggcgtcgtggtagttactttttttcatgctttttaaaattaatgctcgccgaacaggggcgcgagtggaaagctgcgcgccgggcgcagagcattggcaacttgtttgccggtgcgccgcccccgcccccggcccaggaagaggaggagggggtggaagaagaggtggaggaggaagaggtggaggaggaggaggacaatcgtcctcgccgaggtaagttactgaattttttaaaatactgattatttaataaatttagcccgaagcgcggggcgacgcgagggcgatggtgacgatgaggaaggagaagggggccgggggcggcgccggcgtggtagttactttttttcatgctttttaaaattaatgaattaagttcgctctgcctgaacagccaacgaattggagagaaaagtcgaatgatgaatattttcgattacaaacaaaccactttatattattgtttgtctcatctgaatgcatttcatttccgtggtttcctttaattgtggacatatatttttaatgaatcagcgcagccgaaaagtcgtatttaaatttctttgttgatgtattttatgtttcaattaggccgtgccttagtcgagtagaaatggtttcgaactgatgaagtcggcacttgtctgatttcgttgggtttcgcaatggttaattggtgctgcttcaaattttggttttgctttcgacttttgcttgcttccatcgcgcacttcaattggtagaaaaattcctcaatttttgataagacgaccaattgatgagttttttaggtttgccgccatttacgtcaattgcattttctttacattggtttgttatgttaatgacttgtcttattttgtttctttttcagtggaaatcatatga

SEQ ID NO: 54447 - DNA, 809 bp, Heterodera glycines
  Genomic contig location: Contig_ID=SeqID_23749; Location=53..861; Strand=-
  SCN-specific regions: Sequence locations=1-174,197-280,303-333,355 -360,383-431,490-511,573-809
atggcgacaaattacattaaatatcggagttatctttgtgggaacaccaatgatataacaactattcaagaattaattcaagaaggaattgaaaatggcgaaaaaaaaaatttcactattaaggctaaaataaaagaataaaaataaacaaatataaggtaatatgagaggaggaattaaaaatatatattttttagggctgttgggagtgcggtaaacgtctgtcgaacccttgtttctgtgatgcttccttcgaggacaaattactatttaacataaaatttggatgaaagtggggagataaaaacgttttgcttcgaaaaagtcggaattaaaatattcaatcctttttaaacagtgttattttgttggtaaaaagaaataaagaatcaataactatatattttcacaatttaaacttcgattgagagtttatattttgttatttaataaaaaactttgaattagataatataaaatttttaaaaacacctcaatcagggttcttttgaattaaactttttattaaagattcattaataattaataaaaaaatatatatagtttttaaagattcgtataaagttttaccattatcagtatttgatttaacaattaatgaagcaagaaaaaaaagaaaagaacctatgattatgaatcagttaaaaaattgaattatagagctaaaaatattgataaacaactttgtaaagatgattgtttaactgtttttgaacatcttcaatcttttaaaacctgtccaacaacaatatctgttattcatttgttaagataaagtcgaaaataaa

SEQ ID NO: 54448 - DNA, 1295 bp, Heterodera glycines
  Genomic contig location: Contig_ID=SeqID_39; Location=1358..2652; Strand=+
  SCN-specific regions: Sequence locations=1-54,87-106,165-175,199 -228,250-380,402-560,630-927,956-1295
  Gene Ontology: Mol. function=receptor signaling protein activity; Cellular component=membrane fraction; Biological process=axon guidance
atgccttgttgtgaaaaaattttaaaaaataagctcgaaaatttcaagagaatgtaattaaattaaaaatgaattttattttaataccttttctgaaacatttcagataaaaaaatagaataaaaaataaagcaaataaattttatttctattaattttttttagtgtttttgacgttggaggccaaaggtcagaacggcgaaaatggattcacttttttgacgatgtaaatgcaattatttttgttgctgccatcaatgaatatgatcaaaaactgcgtgaagacaataaaacggtaattttaaaccaattaaatctaatcaaaataattaattttttcttaatttaagaatcgactcattgaagcgatgggtaattaataaatttatttgtcttaaaaattctaaaaatgattttttttccccagaactttttgacggaattgcaaacagcaaattttttaccaagtcatcaatgattctgttcatgaacaaaaaggatttatttgaagaaaaaattaaacgagtttcgctgaacattctttttccatcttataaaggtaaaaaaatttaataaaaaattatttaattaaaaagcaatatttttctaattaattaaaagttttttttgcgaacataagatggacttttgtttacatatttttacatattccctgatttttttatatacaatattttgaattttttctcattttttttttctgtaaatattttgcatttttgaggatttttaagtataatttttcctgttttctctagagaattttggaaatttcggaattccggaactccggcgaaaagttaaattccgagaaagtataaaatttttaaaatgcataaatttctaataaaaactttcttgaccctaaatttggaagtttatagaaacagaaatttttgcttgatgaaaatttttgaaaatataaattttttaaggagacctcacgtatgaggacggtgttgcatatttacgtgtcaaattccgcaagttgtacagaaataaacggagtttgtacatccacgagacattcgccactgacaccaaccaaatcaacacggttttccgatcagtgcttgacacgatcttacaagaaaatatgcaagacacgggcatgttatgattatgatcagttttggtgttgcattgtatggataaaatttagaaaaaaaatatttaagcctaattaagaacattaatgcctaagccataggatgttatgattatactttgggaattgggttttagtggcgaatttaaaagagcgatttttcgta

SEQ ID NO: 54449 - DNA, 6801 bp, Heterodera glycines
  Genomic contig location: Contig_ID=SeqID_39; Location=3290..10090; Strand=+
  SCN-specific regions: Sequence locations=1-248,270-1876,1898 -1932,1954-2308,2330-2705,2727-3162,3184-3218,3240-3462,3484 -3594,3616-3991,4013-4448,4470-4504,4526-4880,4902-5276,5298 -5732,5754-5788,5810-6032,6054-6164,6186-6801
atggtaaatatttcaataaatattggttctatttttctctttgcttttgccacaagcttatgtggaggcaagccaaatgatgacaaaaatgctgcctccagctcaagtgtgccaagcgaaacggaaaatcccaaaaacgaagagtcgaaaaagaatttggtgataattacggacatgggggcggatgatcaatttacactggagatgatcagcgcaacagaattggccggtaaagtgttggcaattgggacgacggagaaaggaagaaaagcggcattgtcacaatcactgggatttgagaaagtgccagtgtatgtgagaagcagtggcgaggaatacgagaaaatgctttttatgaatcccaatcagagtaggttcagtttgcaagttgaaacgtatgtcggcattttaccctgaaaatttttgttttagaggatacaaaaagagaggaaaacgaatttcaacattttttgaaaaatttgctggatgaaagattgaaaactaatgcgatgaaggttcattttttggtgctggcacctccgatcgatttaagtgcagtattgttggagaatagacaattggcaaaagcagttggacaaatacatattacggatggatgtaaaaattgtcaggaattgcaaccgccgacaccgcttagcctgaacaattttttgaggcaattaccaagggaacacaccaagccaacaacctacaatgttagcatggacgcattggcaactgtgtaccttttggaaatggccgccaatggagaagttaatgtcctactagtttcttcaagtttacttgctgaaaagttcggtgatggagtcgaatttggaaaaaaatttccaaatctgaaattgacaagaaaaaagaaaacattgggctttaaaattattgtagaacgagaaaaaaaatgtcaacaaaaaccacacattgacgagcaattcagtgctgccggtccaatagctgtgcttgcaattatggatatgacaaatgtaagggtggatggagtgcccgaatctgacaattttgtcctgtttacaactcaatcaaaaaaagtgagcttgatcaccccaaaaagtggagagcaaaagccagaacatggtgaataccaagtggaaattgggattaaaaaagcaacaaaaattagattgcttgtcaattttaatgttgacacatttggcaacgcaatgacattgattcttgagaaaatcaacaagcaacgccaagaggcgaaaaggaatttggtgataattacggacatgggggtggatgatcaagttgcactggcgatgatcagcgcaacagaattggccggtaatgtgttggccattgggacgacggagcaaggaaaagaagcagcattggcacaatcactgggatttgagaaggtgccagtgtatgtgagaagcagtaatgaagaactagagaaaatggtttttatgaatcccaatcagagtaggttcagtttgcaagttgaaacgtatgtcggcattttaccctgaaaatttttgttttagaggatacaaaaagagaggaaaacgaatttcaacattttttgaaaaatttgttggatgaaagattgaaatttatgggcgtaaaggttaattttttggtactggcacctccgactgatttaactgcagtactattgaggaataaaaaattggcagaagcggttggggaaatactcatcacgggcgaatgtaaaaattgccaagatttacaaccgccggcaccgcttagcctgaacaaatttttgtgggaattaccaagggaacacaccaagccaacaacctacaatgttagcatggacgcattggcatctctgtatcttttcgaaatggcctcaaatggtgaagtgaatgtcctactagtttcttcacgtttacttgctgaaaagttcggtgctgaggataattttgacaaaagatttccaaaactgaaattgataagcaaaaagacaatgggtgctaaaattattgtaaatcgagaagaagaatttgaacaaaagccacacattgaccagcaattcagtgctgccggtccaatagctgtgcttgcaattatggatatgacaaatgtaagggtggatcgagtgcccgaatctgacaatttcgtcctgtttacaactcgatcaaaaaaagtgagcttgatcaccccaaaaagtggagagcaaaagccagaacatggtgaataccaagtggaaatagggattaaacaagcaacaaaaattagattgcttgtcaattttaatgttgatacatttggaaacgcaatgacattgattcttgataaaagcaacaaacaatggaattacaaaatttcgtccgaaaaacaaaaggtataggacaaattagaaaaaaattgttctctaaatatgactcatattattcaataaccaatttaattatcctaattaggggaaagagaaaaaccaagatccaaatgatgagaaaaatactgcctccagctcaagtgtgccaagcgaaaaggaaaatcccaaaaacgaagaggcgaaaaagaatttggtgataattacggacatgggggtggatgatcaagttgcactggcgatgatcagcgcaacagaattggccggtaatgtgttggccattgggacgacggagcaaggaaaagaagcagcattggcacaatcactgggatttgagaaagtgccagtgtatgtgagaagcagtaatgaagaactagagaaaatgttttttatgaatcccaatcagagtaggttcagtttgcaagttgaaacgtatgtcggcattttaccctgaaaaatttttaattttagagaatcaaaaaagagaggaaaatgaatttcaaaattttttgcaaaatttgttggatgaaagattgaaatttatgggcgtaaaggttaattttttggtactggcacctccgactgatttaactgcagtactattggagaataaaaaattggcagaagcagttggtgaaatactcatcacgggcgaatgtaaaaattgccaagatttacaaccgccggcaccgcttagcgtgaacaaatttttgtgggaattaccaagggaacacaccaagccaacaacctacaatgttagcatggacgcattggcaactctgtatcttttcgaaatggcctcaaatggtgaagtgaatgtcctactagtttcttcacgtttacttgctgaaaagttcggtgctgaggataattttgacaaaagatttccaaaactgaaattgataagcaaaaagacaatgggtgctaaaattattgtaaatcgagaagaagaatttgaacaaaagccacacattgaccagcaattcagtgctgccggtccaatagctgtgcttgcaattatggatatgacaaatgtaagggtggatcgagtgcccgaatctgacaatttcgtcctgtttacaactcgatcaaaaaaagtgagcttgatcaccccaaaaagtggagaggaaaagccaaagcatggtggataccaagtggaaatagggattaaacaagcaacaaaaattagattgcttgtcaattttaatgttgatacatttggaaacgcaatgacattgattcttgataaaagcaacaaacaatggaattacaaaatttcgtccgaaaaacaaaaggtataggacaaattagaaaaaaattgttctctaaatatgactcatattattcaataaccaatttaattatcctaattaggggaaagagaaaaagcaagatccaaatgatgagaaaaatactgcctccagctcaagtgtgccaagcgaaaaggaaaatcccaaaaacgaagaggcgaaaaagaatttggtgataattacggacatgggggtggatgatcaagttgcactggcgatgatcagcgcaacagaattggccggtaatgtgttggccattgggacgtcggagcaaggaaaagaagcagcattggcacaatcactgggatttgagaaagtgccagtgtatgtgagaagcagtaatgaagaactagagaaaatgttttttatgaatcccaatcagagtaggttcagtttgcaagttgaaacgtatgtcggcattttaccctgaaaaatttttaattttagagaatcaaaaaagagaggaaaatgaatttcaaaattttttgcaaaatttgttggatgaaagattgaaatttatgggcgtaaaggttaattttttggtactggcacctccgactgatttaactgcagtactattgaagaataaaaaattggcagaagcggttggggaaatactcatcacgggcgaatgtaaaaattgccaagatttacaaccgccggcaccgcttagcctgaacaaatttttgtgggaattaccaagggaacacaccaagccaacaacctacaatgttagcatggacgcattggcaactctgtatcttttcgaaatggcctcaaatggtgaagtgaatgtcctactagtttcttcacgtttacttgctgaaaagttcggtgctgaggataattttgacaaaagatttccaaaactgaaattgataagcaaaaagacaatgggtgctaaaattattgtaaatcgagaagaagaatttgaacaaaagccacacattgacgagcaattcagtgctgccggtccaatagctgtgcttgcaattatggatatgacaaatgtaagggtggatggagtgaccgaatctgacaatttcgtcctgtttacaactcgatcaaaaaaagtgagcttgatcaccccaaaaagtggagaggaaaagccaaatcatggtggataccaagtggaaatagggattaaacaagcaacaaaaattagattgcttgtcaattttaatgttgatacatttggaaacgcaatgacatttattcttgataaaagcaacaaacaatggaattacaaaatttcgtccgaaaaacaaaaggtataggacaaattagaaaaaaattgttctcagatatgactcatattattcaataaccaatttaattatcctaattaggggaaagagaaaaaccaagatccaaatgatgagaaaaatactgcctccagctcaagtgtgccaagcgaaaaggaaaatcccaaaaacgaagaggcgaaaaagaatttggtgataattacggacatgggggtggatgatcaagttgcactggcgatgatcagcgcaacagaattggccggtaatgtgttggccattgggacgacggagcaaggaaaagaagcagcattggcacaatcactgggatttgagaaagtgccagtgtatgtgagaagaagtaatgaagaactagagaaaatgttttttatgaatcccaatcatagtaggttcagtttgcaagttgaaacgtatgtcggcattttaccctgaaaatttttaattttagagaatcaaaaaagagaggaaaatgaatttcaaaattttttgcaaaatttgttggatgaaagattgaaatttatgggcgtaaaggttaattttttggtactggcacctccgactgatttaactgcagtactattggagaataaaaaattggcagaagcagttggtgaaatactcatcacgggcgaatgtaaaaattgccaagatttacaaccgccggcaccgcttagcctgaacaaatttttgtgggaattaccaagggaacacaccaagccaacaacctacaatgttagcatggacgcattggcaactctgtatcttttcgaaatggcctcaaatggtgaagtgaatgtcctactagtttcttcacgtttacttgctgaaaagttcggtgctgaggataattttgacaaaagatttccaaaactgaaattgataagcaaaaagacaatgggtgctaaaattattgtaaatcgagaagaagaatttgaacaaaagccacacattgacgagcaattcagtgctgccggtccaatagctgtgcttgcaattatggatatgacaaatgtaagggtggatggagtgaccgaatctgacaatttcgtcctgtttacaactcgatcaaaaaaagtgagcttgatcaccccaaaaagtggagaggaaaagccaaagcatggtggataccaagtggaaatagggattaaacaagcaacaaaaattagattgcttgtcaattttaatgttgatacatttggaaacgcaatgacattgattcttgataaaagcaacaaacaatggaattacaaaatttcgtccgaaaaacaaaaggtataggacaaattagaaaaaaattgttctctaaatatgactcatattattcaataaccaatttaattatcctaattaggggaaagagaaaaaccaagatccaaatgatgagaaaaatactgcctttcaaatatttggaaaagcaatgacctttatgcttgacaaaattaacaaacaacgcaatgataaaaattatcggtgcccttgaaatgaaaatttgacgtaaaatgattaagcatgcatttcttcatcccttttttcgcggtgaatcaaccaaagttacagtatttggggcctgattaactatttatattattttccattttgatcggggttggtttcactatgttttactgtattttcctatttattaactttttactgttattctgtatttttctattcttaaatcataactataatatttccctttaattaaattttttttcgttatgctatattttcgtataaatgtttttccttcatacaaagaactgactggaaattctaatacaattataggtagagcatgaagcagaacgatatcccgcacgagaatttacgatttaaattaaattattgggtttaattcaataga

SEQ ID NO: 54450 - DNA, 246 bp, Heterodera glycines
  Genomic contig location: Contig_ID=SeqID_39; Location=10260..10505; Strand=-
  SCN-specific regions: Sequence locations=1-71,136-210
atgaacttctacaacagcaacatcaccgtttttctggtgatatttgctttgactggcatttgcaaatttggtaattattaaatataaaaaagtattaatattttctgattaaaaaataaaagaataatttttattcacaggcactatcgcttcacctgtgcacaatgaagaagctgaattaaaaaatactcagccaatctttgaaattggttaaattaattatttttctaaaaaaataataataaa

SEQ ID NO: 54451 - DNA, 2219 bp, Heterodera glycines
  Genomic contig location: Contig_ID=SeqID_39; Location=12474..14692; Strand=+
  SCN-specific regions: Sequence locations=1-248,270-544,566-615,638 -670,692-1876,1898-1932,1954-2176,2198-2219
atggtaaatatttcaataaatattggttctatttttctctttgcttttgccacaagcttatgtggaggcaagccaaattatgacaaaaatgctgcctccagctcaagtgtgccaagcgaaacggaaaatcccaaaaacgaagaggcgaaaaagaatttggtgataattacggacatgggggcggatgatcaatttacactggagatgatcagcgcaacagaattggccggtaaagtgttggcaattgggacgacggagaaaggaagaaaagcggcattgtcacaatcactgggatttgagaaagtgccagtgtatgtgagaagcagtggcgaggaattcgagaaaatgctttttatgaatcccaatcagagtaggttcagtttgcaagttgaaacgtatgtcggcattttaccctgaaaatttttgttttagaggatacaaaaagagaggaaaacgaatttcaacattttttgaaaaatttgctgaatgaaagatttaaaactaatgcgatgaaggttcattttttggtgctggcacctccgatcgatttaagtgcagtattattggagaatagacaattagcaaaagcagttggacaaatacatattacggacggatgtaaaaattgccaggaattgcaaccgccgacaccgcttagcctgaacaattttttgagggaattaccaagggaacacaccaagccagcaacctacaatgttagcatggacgcattggcaactgtgtaccttttggaaatggccgccaatggagaagttaatgtcctactagtttcttcaagtttacttgctgaaaagttcggtgatggagtcgaatttggaaaaaaatttccaaatctgaaattgacaagaaaaaagaaaacattgggctttaaaattattgtagaacgagaaaaaaaatgtcaacaaaaaccacacattgacgagcaattcagtgctgccggtccaatagctgtgcttgcaattatggatatgacaaatgtaagggtggatggagtgcccgaatctgacaattttgtcctgtttacaactcaatcaaaaaaagtgagcttgatcaccccaaaaagtggagagcaaaagccagaacatggtgaataccaagtggaaattgggattaaaaaagcaacaaaaattagattgcttgtcaattttaatgttgacacatttggcaacgcaatgacattgattcttgagaaaatcaacaaacaacgccaagaggcgaaaaggaatttggtgataattacggacatgggggtggatgatcaagttgcactggcgatgatcagcgcaacagaattggccggtaatgtgttggccattgggacgacggagcaaggaaaagaagcagcattggcacaatcactgggatttgagaaggtgccagtgtatgtgagaagcagtaatgaagaactcgagaaaatggtttttatgaatcccaatcagagtaggttcagtttgcaagttgaaacgtatttcggcattttaccctgaaaatttttgttttagaggatacaaaaagagagaaaaacgaatttcaacattttttgaaaaatttgttggatgaaagattgaaatttatgggcgtaaaggttaattttttggtactggcacctccgactgatttaactgcagtactattgaggaataaaaaattggcagaagcagttggtgaaatactcatcacgggcgaatgtaaaaattgccaagatttacaaccgccggcaccgcttagcgtgaacaaatttttgtgggaattatcaagggaacacaccaagccaacaacctacaatgttagcatggacgcattggcaactctgtatcttttcgaaatggcctcaaatggtgaagtgaatgtcctactagtttcttcacgtttacttgctgaaaagttcggtgctggggataattttgacaaaagatttccaaaactgaaattgataagcaaaaagacaatgggtgctaaaattattgtaaatcgagaagaagaatttgaacaaaagccacacattgacgagcaattcagtgctgccagtccaatagctgtgcttgcaattatggatatgacaaatgtaagggtggatggagtgaccgaatctgacaatttcgtcctgtttacaactcgatcaaaaaaagtgagcttgatcaccccaaaaagtggagaggaaaagccaaagcatggtggataacaagtggaaataggga

SEQ ID NO: 54452 - DNA, 664 bp, Heterodera glycines
  Genomic contig location: Contig_ID=SeqID_39; Location=14755..15418; Strand=+
  SCN-specific regions: Sequence locations=1-27,49-664
atgacattgattcttgataaaagcaacaaacaatggaattacaaaatttcgtccgaaaaacaaaaggtataggacaaattagaaaaaaattgttctctagatatgactcatattattcaataaccaatttaattatcttaattaggggaaagagaaaaaccaagatccaaatgatgagaaaaatactgcctttcaaatatttggaaaagcaatgacctttatgcttgacaaaattaacaaacaacgcaatgataaaaattatcggtgcccttgaaatgaaaatttgacgtaaaatgattaagcatgcatttcttcatcccttttttcgcggtgaatcaaccaaagttacaatatttggggcctgattaactatttatattattttccattttgatcggggttggtttcactatgttttactgtattttcctatttattaactttttactgttattctgtatttttctattcttaaatcataactataatatttccctttaattaaattttttttcgttatgctatattttcgtataaatgtttttccttcatacaaagaactgactggaaattctaatacaattataggtagagcatgaagcagaacgatatcccgcgcgagaatttacgatttaaattaaattattgggtttaattcaataga

SEQ ID NO: 54453 - DNA, 246 bp, Heterodera glycines
  Genomic contig location: Contig_ID=SeqID_39; Location=15588..15833; Strand=-
  SCN-specific regions: Sequence locations=1-71,136-210
atgaacttctacaacagcaacatcaccgtttttctggtgatatttgctttgactggcatttgcaaatttggtaattattaaatataaaaaagtattaatattttctgattaaaaaataaaagaataatttttattcacaggcactatcgcttcacctgttcacaatgaagaagctgaattaaaaaatactcagccaatctttgaaattggttaaattaattatttttctaaaaaaataataataaa

SEQ ID NO: 54454 - DNA, 599 bp, Heterodera glycines
  Genomic contig location: Contig_ID=SeqID_498; Location=201..799; Strand=+
  SCN-specific regions: Sequence locations=1-84,106-115,137-297,320 -534,556-599
  Gene Ontology: Mol. function=transcription co-repressor activity; Cellular component=26S proteasome; Biological process=embryonic cleavage
atgttggagttgctgaaccaactcgacggattccaacccaacgacgacatcaaagtgagtggtggagcaagccaatcaattcacattcattttgttttcatttaacgcaggtcattgctgcgacaaatcgtgttgatgtgctcgacccggcccttcttcgctccggacgttttgaccgcaaaatcgaattcccagcaccaaatgagaagggcagggaacaaattcttcgcattcattcgcgccggatgaacgtcgagtcggtgacagaattttaggaaaacaaattattcctcgttttcagcaaaaatgtcaactttgttgagctgtcgcgctgcattgaggacttcaatggagcacaatgtcgagcagtttgtgtggaagcggtgagcggataaacattttttgaggatatgcgtcagcttatctcatttttacagggaatggttgcacttcgtcgtgactccactaaaattctgcatgaggatttcatggacggaattttggaggtaattagtaacaatttgagaaattttgggggaataagccaaacttttcaggtgcaatgcttgaagaagaataatctggtgtattatggctga

SEQ ID NO: 54455 - DNA, 87 bp, Heterodera glycines
  Genomic contig location: Contig_ID=SeqID_498; Location=1495..1581; Strand=+
  SCN-specific regions: Sequence locations=1-87
ttttcgcccctatttcgcgaattttttgcccctatttaggtccctaaattggaatttttcgcccctaaaaatccgcaccctaataat

SEQ ID NO: 54456 - DNA, 768 bp, Heterodera glycines
  Genomic contig location: Contig_ID=SeqID_498; Location=5036..5803; Strand=-
  SCN-specific regions: Sequence locations=1-88,110-243,272-632,665-768
  Gene Ontology: Mol. function=structural molecule activity; Cellular component=basement membrane; Biological process=electron transport
gttgtccatgacatttacgaatgcaaacacaacacaaaagggttgaattgtgaacagtgccaagtgaattaacgtacatacatttgtttcaaatgtcctttcaaaataatgccaatttgaaggatttgtacaacgatttgccgtggcgccccggcagcggcgagcagtccaaagagcgtggcgaatgcgaatgcaatggacacgtgccgcggtaaaagccacaaaaatgatttaaatggatgcatttaattttaatggtttattttatgtgccatttcgattggtccgtttacaattcgactgcctttgcctcgggcggcgtctacgacaattgccaacaaaacacacgggacagaaattgcgagaaatgcaagctgtacttttacaagcaatcgcaaagcctaacaaaagctgttaatttgaattatacacttaaaaactctaaagatttaaaattccatgagaggttctcttcaagacccaaatgtttgtcgtccatgccaatgcgacaaaaggggcacccaaaacgacggcacatgcgtggcggaggatgacacggcacaccaattggtggccggacaatgcctttgcaaggaaaatgtgcaggggaaaaagtgggagaaattggacagaaaattaaaataataataataataaatttaaacaatgactccatttattcgttaatttgttcagctgtgaccgttgcaaagatggcttttgcgatttgtctgaggacaattcgaagggctgcaaaaagtgtcactg

SEQ ID NO: 54457 - DNA, 711 bp, Heterodera glycines
  Genomic contig location: Contig_ID=SeqID_4437; Location=995..1705; Strand=-
  SCN-specific regions: Sequence locations=1-65,89-511,542-631,653-711
atgccgcgaatcgcggatcgcggtcgcgctccacccctggtatgaggctccaaaaaaatatttgactaaaaaatgaataaataaatctactaattcggggaaggttttagttcgagatcgaagcgtttgaaaataagggtagaaatctcgggaatttttcattccccattagttcgatttgcctgaaaaaaatgacgttaagtgtcaactttcgctgtcttttatatgcatagtttttcctcaaaaatcggctcatgaggtgttactttggcgcgactccatttaaagttaagactttttccggcaactttttacctcacttaggagcacaaaacgcacttattttttcaaaaatataaaggaatgctgattttaaatgttattaatttgttttttttattccttcaatttgctcagctattataaatctgtcgaaactgtcttaatattttgtagggtaggtcgggaccgggactttttgggttgaaaaaccgggactttttggctgggaaaaccgggaaaaaacccgggaatttcccggtcccgttcaaaactggtcaaaaccgggacttcggtactcagttgtactcagttgtccgtggtttggtcccggtcccgacacactctatattttgctccaacaaaatgtcagacaaccgaaaagaagcagaggcaaaagcaatgtaaaatgaaaacctcattttcaataaa

SEQ ID NO: 54458 - DNA, 1418 bp, Heterodera glycines
  Genomic contig location: Contig_ID=SeqID_4437; Location=2012..3429; Strand=+
  SCN-specific regions: Sequence locations=1-174,196-263,285-862,884 -1383,1405-1418
atggcatcggccgtcaaaaaaaggaaaaaattttcctccgacaatcgccgactcatttcttctaccggaattggtgaaaatgaacaacagaaatcacttggaaaacgacgaattctttttcgacatgcaaagaaaatgaacaatcgaattttgaggaaaatgtgagaattttttggcttaataatttatgaatttcattttaaagcctctcaaaatatttttcccgcatttcagttggatttgcactgatgttttgatggacattctgccattttttgaccatgcccaacttggcctcaaattggcactgatttcgccacgtttcgatgttttagtggacacgcattttgatggcaaaagcgaatggcccatttggaaattagtcgaaattcacaaagaccgtgggtcggaaccaaaacttcgtgtgtttaccagctatgtcgattttaccaatattatgaattttccgttgcccgaccgtccgctgcccgagaaaacacgctttaagcgtcttgttatcatgtaattaaattaaaatcattgttaactgataaaagcatcccattttcaggtacattgatcattcagtcatcgcatttctccgctcaaataaacaaattttcaatggaacacgattcgcattgagtttgtcagtgcaggcgtccaagaacgctgcccagccgatttgggatgttttggcacgtgaaatttggccaattattgcgccaaacattcgccgtttgtacgttcccgatgctgaccatttggacaatttgcgcagtcgcacttcgccgacaattctcacggatttcaacattaattccatcctttctggtcatctgttgcccgatgtgctcgatgattttgatgggccaaatgcaactgcttctgctggccaatcgttgtccaaatggttgcacactccgaccaccgacgggaagccgaagcgattgcgttgcgatgatttcaacgggcaaggaaacgccgaatgggtccacaatttcaaggaggtgctccttcttttcccctattttgtcattcatttgcatctttttcggcaactaaattttcaacatttaatgcgatttgcttttaatgtgtccgttttcccattgtttagccgtttctccgtgccacttcttctgtctgctacataattcaattctttgccttctcatcaacgccaattgtgccatttgaattgttgaacgaacggaccaatgagaagttgacactgacaatgagcacagaatacatatggcttctgatgcggtgccaaattgggcagacgtttcaatgggatgccaaaaatttgaacttttttgtcggcattcatttgtatggttacaaaaaatgcattgggtgagcatgaaaacagaattttttaaaatacatttaaaactcgaacttaaatttga

SEQ ID NO: 54459 - DNA, 1372 bp, Heterodera glycines
  Genomic contig location: Contig_ID=SeqID_4437; Location=5960..7331; Strand=-
  SCN-specific regions: Sequence locations=1-155,195-512,535-822,851 -908,930-1372
atgaacgccggaatctggccttttatgaagtccttatttgtaatatttgttcttgttttcgggtacgaacgacacctttttgttcttatttcgtcaactttcaaataaaaacgaggctgtgaaaagcgcgcacaatttgttataaagggcaatgcaaatatacaattaaattatttaaaaattaatttaaaatagataagtcgttttttaaatgtttacctcaaaaatcatatttttatccgtattttgaaaatcttgagattgctcccgatattagacattgaactttataatatctcgagaaaaaataaagagacagtatttttttttgaaggagagaaaaaaatgaaaagatttagtttcaccaaaatgcaaggatttgcgtttagtgagtggattttcttcgtataaaatgaatgaaaatttaaagtgtacatatgaaaaatgtgaaagtgccaaccgattatggttttcttacggtaaaattgtgcgcccctccgggaagcttttccattatttttattatttttaaatcggcttttcctccatctccgtaggcggtggcgacaaaaaaattaatcaacaaaattgttgggcggcggatcagcacagtgcgcgaccgctttacgcaatttgcgcacaaagcaacacccatttggtttaattaggatgattgaaatggcgcgtcaaatgggcataacaaattattattattattttgttatgtgtatttttgtattttcgaaccggaaaatttgatataaatttcaatcttaaacacataagtttttaaaaaagccaaagaagcaatattcatattgcaaaaaataaaattttatattaatataaagctcaattttgaagtgaaaattttgaatctactaggaaattccaaaaaaaaaaacttgttttttctttgtaaaaaatttacatttttagggatgcttttggattttattctattccgcagattaaaaataaaattttgggattaaaaatatgcaaacgattatacaaccaaaatttgcatattcttgagaaaacaaacgttaacaaaaagttttcatacgttttgttatagcttaaaattcaactttttacgattaaataagtaattttgaagcgatttaaacaaaaacttaaaagaatgggccgccggcggtgccgataaacaccgccgggaaaattcggtggcttcctgatttatgaacagagtatatgcacccggaacatgatggggggacccagcagggaaaatccttccgatttctgttcctatctctgattaggattgttcatttttgttttttgccaaaaatgccctatttggcgttatgttgcggaaaaaagaaatttaagtatttccaataaa

SEQ ID NO: 54460 - DNA, 833 bp, Heterodera glycines
  Genomic contig location: Contig_ID=SeqID_23752; Location=6..838; Strand=-
  SCN-specific regions: Sequence locations=1-833
  Gene Ontology: Mol. function=chaperone activity; Cellular component =nucleolus; Biological process=receptor mediated endocytosis
gaaaattgttcctcttctaatcacagtttgcacctcttctgatcactgttgtacctcttctaacaattttgtacctcttctaatgactgttgtacctcttctaatcacagttgtacctcttctaatcacttttgtacctcttctaatcacagttgtacctcttctaatcacttttgtacctcttctaatcactgttgtacctcttctaatgactgttgtacctcttctaatcacagttgtacctcttctaatcactgttgtacctcttctcatcacttttgtacctcttctaatcactgttcttcctcttttaatcactattgtacctcttttaatcactgttcttcctcttttaatcactgttgtacctcttctaatcacagttgtacctcttctaatcacttttgtacctcttttaacaattttgtacctcttctaatgactgttgtacctcttctaatcacagttgtacctcttctaatcacttttgtacctcttctaatcacagttgtacctcttctaatcacttttgtacctcttctaacaattttgtacctcttctaatgactgttgtacctcttctaatcacagttgtacctcttctaatcacttttgtacctcttctaatcacagttgtacctcttctaatcacttttgtacctcttctaacaattttgtacctcttctaatgactgttatacctcttctaatcacagttgtacctcttctaatcacttttgtacctcttctaatcacagttgtacctcttctaatcacttttgtacctcttctaacaaaagagtacctcttctaatgactgttgtacctcttct

SEQ ID NO: 54461 - DNA, 325 bp, Heterodera glycines
  Genomic contig location: Contig_ID=SeqID_23753; Location=26..350; Strand=+
  SCN-specific regions: Sequence locations=1-12,196-258,309-325
atgccaaaagtagagggggaaccagagaaaaagagactcaaaagcagagggaaccagagaaaaagagactcaaaagcagagggaaccagagaaaaagagactcaaaagcagagggaaccagagaaaaagagactcaaaagcagagggaaccagagaaaaagagactcaaaagcagagggaaccagagaaaaagagactgaagataacgcaaatagaaacatgatttgaagaataattaaatagtaaaatcagacaaatgaaaaaaggctagaaatagggggaaaagaagtgaagagaagaggagagaatggataacagagagaga

SEQ ID NO: 54462 - DNA, 335 bp, Heterodera glycines
  Genomic contig location: Contig_ID=SeqID_23753; Location=450..784; Strand=+
  SCN-specific regions: Sequence locations=1-139,161-335
atgcttaagaaaaaaagacaatgcatcaaaggaggaaaggaaagaaaaaaaatagtgcgagaaaagagcgagatgaaaagagaaataggtaggtatcggaccggctcagttcggccccagcccagttttcgatctatcttttttctttgtcaacaaaatccaacaatcttggtatcattcgaaagatctttacatactctattagccttacaaaaagctaaaaaattttcaagcctggaaaaaatttatgaagaaaaaactttaaaaaattgattttttcagttttcatgttatatctttttggatatttgtctaattgccaagcaatagcttag

SEQ ID NO: 54463 - DNA, 256 bp, Heterodera glycines
  Genomic contig location: Contig_ID=SeqID_23757; Location=1..256; Strand=+
  SCN-specific regions: Sequence locations=1-256
cctatcatgctcgagagcattgtatgtgtataaaattatcaaaaaagagatagcatttttgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatg

SEQ ID NO: 54464 - DNA, 304 bp, Heterodera glycines; identical to SEQ ID NO: 51570
  Genomic contig location: Contig_ID=SeqID_23757; Location=333..636; Strand=+
  SCN-specific regions: Sequence locations=1-304

SEQ ID NO: 54465 - DNA, 54 bp, Heterodera glycines
  Genomic contig location: Contig_ID=SeqID_23759; Location=19..72; Strand=-
  SCN-specific regions: Sequence locations=1-54
atgtggatcccggacaatcggacagtggacaatccgacattggacaatccgaca

SEQ ID NO: 54466 - DNA, 2012 bp, Heterodera glycines; identical to SEQ ID NO: 4440
  Genomic contig location: Contig_ID=SeqID_4440; Location=1..2012; Strand=+
  SCN-specific regions: Sequence locations=1-443,465-2012
  Gene Ontology: Cellular component=CCR4-NOT core complex; Biological process=reproduction

SEQ ID NO: 54467 - DNA, 1095 bp, Heterodera glycines
  Genomic contig location: Contig_ID=SeqID_4441; Location=1..1095; Strand=-
  SCN-specific regions: Sequence locations=1-792,817-870,892-977,999 -1095
  Gene Ontology: Mol. function=dipeptidase activity; Cellular component= cytosol; Biological process=proteolysis and peptidolysis
tgaacgcttattttgagaaaaaacaggcaaattgacaaatgcaaggcgaaatggattgaccgattggcagaatcagttgcgattcgcagcgtttctccgagcgcggaacatcgccaagaagtcttccggatgatcgattggacggagaaggtgcactcctccgaattgcaagaaataaacaaaaacaaactcttttagctgatgaccaacttgggaatagtatgccaaaaaatcggtgatttgcaatttatacgattgctttctcagcttttatggttgtttctctcgtaagaaaatccacttggcactgaaacattgtccgatggaacgacccttccgctgcctccgattttgtttggtacgctgggcactgacaaaaacaaacggactcttttggtctacggccatttggacgttcagccggcggcgtttgaggacggctggtgcggcacctcaaaaagaccacggggcaaagaaagacttcaggaacacggaaccgttccaactcatcgaaaaggacgggaaattgtttggccgcggttccaccgatgacaaagggcccgtgctcggctggctgaatgtcatcgaaaccatgcaagggcttggcattgacatgcccatcaacataaaggtgtgtctgtctgtcgttgatggcacgcaataatgaatgagttggaattgtgcgtttgtcagttcgtgttcgaggggatggaggagtgcggctccgacggattggacgaatgcctcgagcagcgcaaagattttctctccggcgtcgacttcgtgtgcatttcagacaattattggctgggcaaacagaagccgtgcatcacttacggccttcggtctgtgccccgttcgcctttcgacagaatgcctttgtctccctcttcagcggtctttcgccgtttgccatcgaaatcagtgggcccaaccaggacctccattcgggcgtttacggcggcacaatgtccgccgcttttgccattttccgtttgcattttccgaattctcttcctttaaagccatgagccaatgaacgacctttgctggttgctcagcccaattgactgacacaaaggcgaacattctgat

SEQ ID NO: 54468 - DNA, 436 bp, Heterodera glycines
  Genomic contig location: Contig_ID=SeqID_23762; Location=72..507; Strand=-
  SCN-specific regions: Sequence locations=1-436
  Gene Ontology: Mol. function=glycerol channel activity; Cellular component=integral to plasma membrane; Biological process=transport
atgctctgcttcatcattggcatcatcaccgacaaacacgcccaaatcccacgggtggcccaaccggcgatgatgggacttatgctcaccgccatcaacatggcttttgggctgaacgccggtaatgcagcgaatccggcgcgggatttcggcccacgacttttcacacttttagctgggtacggttgggaagtattcaggtgagggagtgttgaaattgtgtccaatttcaaaatgcctttttcgtctgttgttcagttacaattctttcggttggttttgggtgccaatcgtttgcccatttttcggagccatcgtcggcacattggcctaccaattgctggtctcggcacagttcggaccaacaaaagagggaaaactgttagagaattcgacaaactcttcggcagagccatcgctggcgaaggcacagtga

SEQ ID NO: 54469 - DNA, 876 bp, Heterodera glycines
  Genomic contig location: Contig_ID=SeqID_23766; Location=249..1124; Strand=-
  SCN-specific regions: Sequence locations=1-266,288-387,409-876
  Gene Ontology: Biological process=growth
atgctcatccatccctttttctgttcagcttacactgacttggccaattcgcggctgtcccaacgtgaaagtgtgttctatgacggttccttccctttgctgctgcacaaccttcgtctgctgtcgtccgatgcgattgtgtcaaattcggacgaagcgtcgacaagtgacaaacagcaaaaggaaagcaaaaacggaggaacaccgacgtacgtggtcaaaatgttcagggtttgtggaggaaggaggacaacaaagcgcacaaaattttattttttgtttattaacaggacgaaattactatcaatttttattccgtccaacacattgtgatcgttgaatggatgtcaaaccccgtgaatgatttgtgagtctttgaatgaacaaatgaattttactgttttaccacattcatttcttgggcataaaaacataaattaatccgtttaagatttgccgatgcgacactttcggccattcttcacgcccaaaccaaccctatcctcgataaaagtttttgtgccaattttctgcttttatttttcaaaaactccagatgttccgaaggatttcggtgcgaaagcacagcaaattgagcaaaatttggaatcgattttggttgggacactgtgcgaattatgcggtgacaaaagtcttgtggaagtgaaagaggaggaaaaccaaggggaaaaggacgcagcagcggaggaaagcgacaaaaaagaggggaagagacggagagtgattcaattggagttggacgggaagaaagcgtgcatctgtccggtcagtctgcagatcactgaatgcgaggaccaattgctgcaccatcttttgtcctcgctgactcaaaaagtggcacatggcattctgcca

SEQ ID NO: 54470 - DNA, 864 bp, Heterodera glycines
  Genomic contig location: Contig_ID=SeqID_23769; Location=11..874; Strand=-
  SCN-specific regions: Sequence locations=1-325,348-864
atgggttggtcaacgcccgctgatgccgagtgccaatttgagcacatgaacacctgggatggccaattccacccatcggagaacgtgtggacgcacaaggaaatcgcactgtcctttgacggaaaagcgcaaaaaatcaaggactgcgaccggacacttgttgcaacggaccagggattcgcagtagatgccggcatgttcctcaacatgatcaacaatgcaaatggtcccagcggagtgcccaaaaaaggacagtcaccgggaggcgctcaaaaacggtcgctactaccggtggaccaattcagcgccgacactaacatgagattggaaatgatgaagcaaaatgccaatcaaacgaaggccatcatccccaaatcagtcgcagcggctccaaaaacggaagttccgaaaccggcagcgcctcgcccaacagttggcccagcaaaaccggagcagccgagccgaaaggcacaactgcaaccggttaaattgccaacgccaaaacaggcagcaccgatccaaaaagcgataaaaccaaaaacgacgacgacggcgcagaagtatcagccaccaaggccaacgacttctccaaaagctgagccaccaaagccaatcgtcgcggtgcccaaggttccaagcccggtaaccacgcaaacgatacaaccaacctctccgtcagaaggccaaccgaagagtcggaacagaggaagattccgaactcgctatgtggtgcgcagaaaccaaagcgaaccggaaaagttaagaatttacgacagtccgagacaaaagcgagcgacggtccacacggaacaactcgcgagtcaactgaccgccagccaagtcaacacaatggtgcaactttaa

SEQ ID NO: 54471 - DNA, 744 bp, Heterodera glycines
  Genomic contig location: Contig_ID=SeqID_4442; Location=39..782; Strand=-
  SCN-specific regions: Sequence locations=1-280,305-744
atgcgacgtgcttatgcattggcgagccgagcagtccgtccggatttggaagtgtttttgggcgatttatttgatgaaggcgttttgctgggaggcgatgaacaacagtttgtcgacacgcgcaaacgtttcatgaacatttttccgctcaatagatactccacaaatgtcagtgaaaatttgtacaattctaaaaggttttaccaagatttgtacctaaaaagttgaaaaattaactcaaattttaagcgaaacctaattgtctagttttacatttttgattaattttaaataaataaataaactcaatttcagcgcatttatttgcctggtgacaacgatattggaggagaaatggagccggtttatgcggaattgtacgaacgtttcaaacagcattttccaccacattttactaacggttcggacaatttcaaacgttttgtctccgtttatgaggtgcttttatgtcaattattctttttccattcaaagttgttactgaaattttgaaggttttatgggtccacaaaagcagcgatttatcttttaaaataaatgattgcaatttaatttttgttttttctgttcagtctgatgtgatcaattttggtgcagttaatcgaatttgttgtgaccaatcagatggaacaaacactgttcgcttattgctcagccattttcctgtcttaccgcacgcgactgtcaaaacggagcaggtcaataaagatgtacaaactgatt

SEQ ID NO: 54472 - DNA, 954 bp, Heterodera glycines
  Genomic contig location: Contig_ID=SeqID_4443; Location=1606..2559; Strand=+
  SCN-specific regions: Sequence locations=1-665,687-744,825-826,857-954
atggatcaactgcagaagcggttggccaaactgcaggcattccgtcctccctatttggacgagtacgaacgttacgaggcacagctgcgcgttcgctacgctgtggtacagttggccaattaccgtaatttggccaaatgtcaaatttcgaaccgatttttagtatgtgatactgttccgcaatttgcatgcgttgcaaagtcgtctagtacaatctgagcacgcggagcgcgagcaggcactggaggctgaacgttcaatgcgcgaaatggttgaaaaaatgcgcatggaaagcgaacaggcggctccattgtaggcgcttaatgaaatttctggccccaataatttggccaatcattcaattggtttgtctagccactttttaagaattgctggcattccgctgcacattgatgagctgaaccaagctgcagacgacgaattggaggaatatggacaaaatggaagacagcgacgaccaggaggtgggtggaaaaattggacacaaattttttatttcagtacaatatttaaaatagttgaaataaagtaattagagcttggatgggaaggagatcccgccgggactttcccgggatcccgatcccggctttgctaggacacggtttcccgttaatgcgtaaagacaatgtccctatggcggttgttcttttttctgtaaagtctcaatttccgcaaacagaagtgcgcgttttcggcaacatgactgggttgggactgtccgatgacgatgaggaggatgaggaagaggacgaggatgggctaggaggtggacgaatcattgaaatggaggatgaggaggaattggatgacgatgatgatgacaatgacgattatatgaacaattttatccgtggcggcggtaacggttcaacagcagcagcagaagggaacaccacaaaacgacaacgggcgttaattgagagcaaaaaa

SEQ ID NO: 54473 - DNA, 1766 bp, Heterodera glycines
  Genomic contig location: Contig_ID=SeqID_23771; Location=420..2185; Strand=+
  SCN-specific regions: Sequence locations=1-531,553-1169,1193 -1734,1756-1766
  Gene Ontology: Mol. function=protein binding; Cellular component =intracellular; Biological process=signal transduction
ggtattcaaaaaaacttctcccaatggaaaggtattccctatgttcatttgagccatatctattataattgcatatcatagattacaacttatcttggaaagcgcgattttttggatcgtggtgaaactgtcgacttaataggtaattgataagtcagttttttttttaatcgctattgtgttttagatggaatggttctaattgacgatgactatataaagtcaagcaaaaaagtgactgtccaactccttgcggcatttcgctatgggcgagaggatttggatgttttaggcttgactttccgcaaagatttaatctcgcaattatatcaggttaatcgcgtattttattacccacctccaattaaagcatttgactgtttaaggtttacccagcaacacaaaacgagtccctaaggccgatgacgcgactgcaggaaagactgaagaaaaaactcggtgaaaatgcctttcccttttggttcgaaatccctccgaattcggcgtcttctgtcactttgcaggttcagatttttctaaattttaaattataatttcctttttagccagcccaaggcgacacgggcaaaccttgcggagttgactatgaaattaaaacaatggtcggaggcgattcgacgcaagagaagcccaagaaacagtcagtttggaattcgaaaaaagtcagttaatcaactaaatttagcaactccgtccgtcttgccattcgaaaactcacttactgtcctcaattggagcgaatccaaccgatggttgacgtgaccaaaaattttatcatcagccccggtggccttcatctcgaagcgtcactcgacaaagaagtgatttgccacggaaactcctattttggctttaccttttttagatgtattaccacggcgaatcaattgcagtgaatgtgcacatccaaaataacagcaacaaaactgtgaagaaggcacgttcgtacttttgttttgacatgacaaaaaaaacattttacagataaaagttactgttcaacaaatggcagacatttgcattttcacaaccgctcggtatacttgcgatgtggataaaattgattcttggtaaatgaaatcaattatttattaaggggaagtagacatcaaattatttgagcatattcttaattggccagggttgtagtcaaaaaattttggaaaaaatgctaatgggatatattctcattttccggagcgttgcaataaaatggaatttattacttttattttcaaaattcattttgttgattctttttatcatttttgcatccgatttttattccagcgaaggttttcccgtcgggccgggttcaaccctgtcgaagatttactcattgtgcccacttcttttgaaaaacaaagacaaacgggggttggcattggacggccaattgaagcacgaagacaccaatttggcctcctccaccacttttgccgctttgagggtttgaattgaaattaaccctattggcctccaatttttattctcacaatcagcagtctgtccacgagaatctgggcataattgtgcaatacaaagtcaaaattcgccttctcatcgctggcgcattgggcggagaactgtcggccgaattgccattcactttgactcacccaaaaccaacggattcacctcatccaacggagaaaaaggcaaatgtcgccaattgccatgagcaacaaacaccgccaacgaatggggcacaacagagagaacagaaaggaaatttcgtggctgat

SEQ ID NO: 54474 - DNA, 124 bp, Heterodera glycines
  Genomic contig location: Contig_ID=SeqID_23772; Location=522..645; Strand=+
  SCN-specific regions: Sequence locations=1-19,47-124
aaattgtacaaaacttacgtttttaaaaaaaaaatttaaaaatttacgacttttcatcaaaaatttcggaagtcggaattccgaccccaaaaatgtcggaaatcggaagtctttccgtgccata

SEQ ID NO: 54475 - DNA, 647 bp, Heterodera glycines
  Genomic contig location: Contig_ID=SeqID_23773; Location=382..1028; Strand=-
  SCN-specific regions: Sequence locations=1-1,35-56,102-647
atgagcatttttatttctttgtttgctgttttttgccttggcctccattccaccggttaatttttcataaatttataaactaaaaaaaacaattaattattgcattatttagcgctgcaatgcaaagtgggccattacagcaattatggtgccattattgaaatcttggaatgtcctccgctgaaaacggaattttgcattgcctacggttgtcagaagggtataaatttggacataaaattcttgaaaatttttcgaatattttttttaaagaaccaaatgacgtgtacatgggctggcaatgttcggaaagtgacaaatgcccggatttaagtggcgctaatgcttttgctggtttgaaccttaccggatgcaaatgcaaaattggggagaagggtgccaatttgggcaatgaaaatttcacttttccgatcgatgacccagcgagttcagagcagaatgatgcctatcactcttcgatggagtctccggataaatcatcaggtaattagagatcggacaagcggataaagggtccaatcggcttttccgttgaaaaccaaaaaatcaaatcgatatatcgattcgatcttgatcaggcattgtgactttctgatcaaataagggttggattctcgagaaataaa

SEQ ID NO: 54476 - DNA, 683 bp, Heterodera glycines
  Genomic contig location: Contig_ID=SeqID_23775; Location=1115..1797; Strand=+
  SCN-specific regions: Sequence locations=1-133,165-411,433-489,513 -519,568-683
atgggtagtaagtttattttaaaaaaattatgagcccataattaatattaaatacgtaggggtttaaccagaataaaacttaatttatttgtttgacaataaatgaattgaaattatacagtgatcaatggaattttttgtttaaatttaaaaatatgtaagtaattttaatgccggcggtgccgtcaatatgcgaaaaatatgttttttattgcaaaaatggttgtttatgaatcaacttttaattaattacgaattgattgcaaaaatggggtgagctgtggaacattgggctcagtgtgaactgctcaaaaaagctgagaaagtttgccgccgtgggcctaattcaattcatttcagagggctattgataaagtaagtgtgcaagagtaatagagaagtgttgatggaattaatgacttttaaaaattcgtaaaagaacagtaaaaatttaatatttttttgtttaactttgtttgtctttttttgttaaattcttttttagaaattaaaaatgggtataaatttaattaaaatttataaattatgtatttatttagaaaatatggatgtacaaaaaagattaaaaatgcttgggttttaatcaaaccaaccaaatttgctcattaatattatcatgagttagttgggtaggtggaagttaaatgttttttttacagtaa

SEQ ID NO: 54477 - DNA, 1519 bp, Heterodera glycines
  Genomic contig location: Contig_ID=SeqID_23776; Location=237..1755; Strand=+
  SCN-specific regions: Sequence locations=1-459,486-1014,1047 -1433,1458-1519
atggacccaggattttggctcggtgagggcggcgtttccaaaaaaattatgacaagtggggcctggtaatgctgccaggcgccgccgtgggaaaaattcagaattttggcactattttttaacaatttgcagcaaaattacttttttttgtgtatttttgaaaatttagcaaattttcttggaaaattatgttagggaggtcggtcttggagctgggttcaaggtttttcattggttaagcctgccgctctgtccaaattaggccaaccataaatgcctgggttatggacagtaaaatccaggcggagaaagtaattgtctacaaaattgcatgagaatgtttacaggctcttcaactgcacaccaaactgatgaaggacgcggtggacagcgacgtgaagcaaaaagggggcgaaggaggcggcgattcggccaaatgggacgaagtgatggaaaagcgaaatgggaaaacaaaaaatggattttaaatggtgcccttttcaaggtgaaacgcgcaaaagcggaggcggaccgacgtgccaaattggacacggaaaaggaaggcacggcacgcgacgcaatcaaagaattggagaaagtcggtgttgaataatggggggggggggggttagttcatttgaaaaaatactcggcgaaaagtaaacaagacagcccctcccagcttaaatatacgaaatttattagaaaattgaaattttggtgaaactctttcaaaaatgtttcagaaaacgatatttgggttccgaaattaacagaatttttttttgaaggtattgtaatttttagaattttttatctagtatttttttgccaaaaatctaaaggacaacaatgtgaattttttctgaattcatggcgcatttattaatgctgattattttgctattttggattggaaaaaacttcaatttgtacccaacttttggcatgaaatttatgttcttgatttttttgcggcggtaaataacgcgtgcgaaaaatgaaatgcacccccaaaaatgggatttaatttttggaaaatggttgatgaacacactccacttgtttgcgacaaattttcaccacccttttcagctcattttgaccggctcacagaacagcgttggcgacgacgacggggaaatgcctctgttgctgaacgcccgcgagacggccaacaaattgtcgagtcgccttgacgagatgaacttgctgctgggccgagagcaggcgcagatgcgcattttcaccaactacaggcaaaatccaaaacgaatcaaaaaaattttgttttacaaatgcctatattttgaatatttcagcacctgggaaaacaggaattagtagctgttttctccaaaaaatttttttaccatttcgagaccaaatttcaaaaaaaaaaatatgagaaatgagggcttggaaatttttttggaaattttatggaaattttaatgtaatttgaaaagaatattgcttaaaacttattattattttttttaaacagacaataatacaa

SEQ ID NO: 54478 - DNA, 1040 bp, Heterodera glycines
  Genomic contig location: Contig_ID=SeqID_23777; Location=637..1676; Strand=-
  SCN-specific regions: Sequence locations=1-272,339-679,718-892,916 -944,967-1014,1036-1040
atgcataaaattaacaaaaattgtgaaaatattgagagtgaaaaaattttgatgtacataacaaatttaaataatttcgggagtttttacacatttagagaaggccggctttggctttttttcgcattttttaattatttttgggggggggggggggggggtgccgcaaaaatagaagagaagaacaatttagaagccacgtgacgaaaaattgcacttcattgaccaaaccgtgtgccattgcccgcttggcaaatttgaattaaatgtagtttaaataatgtttaataataaaaaatatgtacataatttaaattattttaaaatatttatttaaagctcgtcagtggtcatctaccgcatcgcttgcggcgaaggactttaccaagtaattattgttggagcagctcttttcctcgcccagttagattggaattttaaaaacgaaatttaatttttcgaaatttttaaaatatttttcccataaccaaaaagaaaagcttttcgaaaagccccaaacaaatggtttattttcagcatcttttggcctacgaagtgccgctggtcaagcatttgttggcgcaccgttggcaaagccaagctgacactgactgtcgtcaacaaattgcggaacatccgatccacaccatccaacatcaatcagctaatgcgataaagccacgggtaatggaaaaattatatggaaatcatggatttaaaaattacattcaaatttcaatgaaaaaaaatgttggtcccgcgttttcagaccgaaatacccgactggcacactcatcgacaagggcgtggtcagccccaaatgttctgagtcctttttggcctcgcagcgtgcgttgcaggtgccttcctctgttttttgaacttttaaatcaaaatttgaaattgtttttccccagggaactgctcgagtgccacggcacgccattttgatggacgacaacggatatccaacggacaaaacccaacaatcacatccgtatgtccaagcagacgaatataaattgtttaaaaatgtttga

SEQ ID NO: 54479 - DNA, 1504 bp, Heterodera glycines; identical to SEQ ID NO: 23778
  Genomic contig location: Contig_ID=SeqID_23778; Location=1..1504; Strand=+
  SCN-specific regions: Sequence locations=1-991,1013-1117,1218 -1357,1380-1504

SEQ ID NO: 54480 - DNA, 369 bp, Heterodera glycines
  Genomic contig location: Contig_ID=SeqID_23779; Location=220..588; Strand=-
  SCN-specific regions: Sequence locations=1-369
atggcttcccaaccccacttctttttcctgctgctggtgttgccaacaacatcattccccagtttctgctgctgtacgtcctgttgcatcaccgcggtggtggcacgacggttcagcgacggcattcgtgccaaaagcgcggatgatgagttggcagagcaggatgaagcggaagcggacgatgccgacgcggcggcattggcggacgatggagcggaagaaagagatgtaagcgaagcgggcgcttgaccttcggccatacgttgccgaaattttgccacagtggcactctgaaaaatgccaaaaccgtgattttaaaatttaaatatgccatttcttaatgcaaaaaattgttccgataaaaataaa

SEQ ID NO: 54481 - DNA, 1834 bp, Heterodera glycines
  Genomic contig location: Contig_ID=SeqID_4445; Location=185..2018; Strand=+
  SCN-specific regions: Sequence locations=1-510,533-807,829-1081,1103 -1240,1262-1341,1384-1834
agaatggcgcccttttccctttcgcccgtcgaccgaatgcgtcaaagtgtgttccgagttcgaagtcgtcttgcggtcaatttgttgtcggaagggttggccacctttctgctgctgctggtcggcaatggcattggggcacaacacattttgggaggggggaagctggacaattacatgcaggtgaattccaaggggaagtgccaaaaatagagtggccaatttggcacggctaactcagcggagacaacgagaattaggcacaacagacaaattgggggtgggagaacaatttagctaatttgagtgtcatttgacaacttactccgccacccgccaacggcaaaagcccaaacaaagagttttcggaaagttctttcatagcggtcgttttatgtaaattagaatttttcgcacccaaccgcaacctttggccaaattctttctgttctatgggaaggagcagattttactgcatatgttacgagccatttcattttcctttctttgtaaattgattttttaaaattatcctaatggagcacccaaaatcccaaatccgatcacttttattgtacgggtcaaaactttgctttgatcggttggaaatttattaaaagcagtttttctggccaaatcaagtccggagaatccaaatcaggcctcagatttgatctctgaattttctctggcattgtactgctccatgtcgttgacaagaagttgaagcagtacagggtcatagaacagcaactgactaaatctgaggcgatattcggattctccgggtttggtttgcccatgaaaacatcaatttcattttattaggtcctttcagaacaatgttgtacaaagagggtgctgaatcttggcacttttgagcacccattttcagacaggacaactttaaaaaaataacccatcggtcttggtggctctttttcagcttgtcagatagtcccaacattgctctacaaacccataatttgttttgcacctttagccttttcttggccaagaaatcagtggttgaatttggccacttttttaagtagaccgatcagtttatttgagtctaactatctttttaaaatctaaaaaatgggagaagattgtggagaataacggagcatattttgattaaaattggttcattagttaatttgttacgatttttttaaataaatttttggtcgctatgaaagaactttccgaacaccccaatattagagccttgaaatttaggattttggggaagggaatgtatgtaccacagccggcaccccggagaaaattctgaagcgttaagtgtgatctaaaaggttaggaaaatcatattagaatttaattttgaaaatactttgataaaatttttaaaaaatacaaaatccttaaaacataaacactgtaaacggattcctataagtttgtttcaattcactcctactaaacagtatctcgtttgcaaaaaatactttgacactgacgcattttccgatatcgcccaacctccccttgtggccatgactttgatagtggtcacataatttcaccttttcattgtgccaatttatgtcaggtgtgcttcggctggggcatgctaatcgctcttttggtgttcgccacttaccacacatccggtactactaaatgatgtggtgcccagttgtgccaatttccccccccccgtccaaaggtggccatttgaaacccggccgtgtccctcgccttcgttagccttggcaaattgccattcgcccattttttgctgtatcccctcgccaaactgtcggcgcctttttttgctcccgccctttgctcccacatctacaga

SEQ ID NO: 54482 - DNA, 1234 bp, Heterodera glycines
  Genomic contig location: Contig_ID=SeqID_4446; Location=2114..3347; Strand=-
  SCN-specific regions: Sequence locations=1-336,358-528,576-1234
atgaaagagtaagatcaaacccgttcatttgttagcttctactttttccctcataatttcattttcagttgtgtcgccttcggattcatcgcccaaaggcaaatggcattggatgagtacatttgcacccgcgacggcacttatgcgtggcttagcaatagccttttgtggaaaaacggttcccacacaattgacaagagatgtaaatacggtgctggcgatacggtcggatgtggcattgatttggctaatcgaaagattttcttcaccaaaaatggcattcgattgggtaagaacaacgaaaaagaagaaagtggaggtcaataaaaatggacattataagaaattaaaaaagaatcctcataaaaatgtaaattggtgctaagtcaagggataaaaagtgcaaaaatcaatggctctaatgcactttatgagtccaatcaattgacaatcccgggtttttatacaataactttgttaatttcttctatttatgtgataatgagggatatgtggtcctattagaggaataaaattaatttataattagtttacttatttttgtttatttttatctcacaattttccgtgtcaaaaggctcatggtaaaaaaaatagggtcatggtcatggttaaatgaccaccaacttcgtggtcattttaccaaagttcgtggtagctcttattctgcgggttttaccaccaacttcatggtcatttaaccataaccacgttcttattctacgggccctggcggggatgaaccgccacggcgagtgccgataaagcaccagtagtgtgtgtgtaaagggggccaatacctccactgaattattggtctcaagacaatggattaactttcgagtctcggttcgcaaaatttagtgggtttctagggagttccgataaatgtttgatttttgagtatttttgtactactcactttgtccgtcacgaaatggacatggatcagatggaggccaagtgccaacaccgcggtggccaacacgcactcggccaacccgagaattttgaggccggtcggaatgcggcaacagcagcatttccatttctcgtggtcaggatcgaagtccattagaaaatttttcgaaaatttaaataacacagaaattaaaattactaaaattgaagagggattttatatttaagtttatttgtcctatgagaaaccttgggaaaaagttaaaaaatcaaatttaaattagagaataaa

SEQ ID NO: 54483 - DNA, 974 bp, Heterodera glycines
  Genomic contig location: Contig_ID=SeqID_4446; Location=3498..4471; Strand=-
  SCN-specific regions: Sequence locations=1-60,84-115,148-828,853 -920,959-974
atgcaaaataatcaatttgcacttttggaacggatcagtgaattggaaaagcagcaactgaaacaacaaaaacaacagcaagacgagcattacgataatgaatacggtacttgtgttaaaattaaaataatttaaacatttaaaattcaaatcattttaagcttccgagcaattcactcagttacaaaatgatcagcagcagaaaattgaaactaatggattggaaaagcgacagcagaaagtggtaagtatgaattgaggaaggaaattttttatgaaagattgtaattttaccaatttagggttggtcccagatcagattcagtctcattccaaaacggattagagggtgctttaaatggatttaaaagattttatgtttaaaaaaatatgtaaatttcctccccgacaagagattattgctgctccccgacatgttttaaatttctcaagctatcctcacaaattatcggagaattcctacccgactttttcaaccccattaattttagatacctcaaaaaattttcatcactaacagtgtttttttttcaattttccgaaatttatggcaataagaaaaattaaaaaacaaaattacagatttcaaattattgggatgccaatttctgtcacagtgacctcgaaataattggtgccgattgtttgacggtccgtcacaatggagatataatggtaatgcatggtaagtcttgtttttgtacgaaatttttttgtaaaaattctggcttttagaaactgcactcaaaacacttttttcagaatcccgaacggatttcaaaaacgcaacttattgttagataattcaagaaaaaagtgaaaaataattttactgtctaaaagtaacaatttctttaattttcgagaatacatcaaaaatctggatagagtgaaacggatgtgtttttgaaaaaagatttaaattctttctaaattcctcgggtaaaaataaa

SEQ ID NO: 54484 - DNA, 904 bp, Heterodera glycines
  Genomic contig location: Contig_ID=SeqID_23781; Location=431..1334; Strand=+
  SCN-specific regions: Sequence locations=1-113,380-457,479-490,552-904
  Gene Ontology: Mol. function=ATP binding; Cellular component=muscle myosin; Biological process=muscle contraction
atgccaaaacggtgcgtaacaacaattcgtcacgtttcggcaaattcatcagaattcattttaaccgtgccggacgggtggcttcgtgtgacattgaacattgtatgtcatgcaaatttttgtttaaataattattttattttttttaaattaaaatatttattcaaataaacaattattgattttcattttaaatgtatttttatttatttatttattaacgaaaaaattatatttttatagaaagtacatcaattgatttccaataaaatattttttccaatttagtttcctgaatgatttatttcattatatttttgtttaatttatttatacaaaaataaataaataaatttaattataatttattttataaaaagtacatcaattgattttcgaataatatttttttccgtttagtttcctgttgataaaccaaaataagtatattttacttgaaaacatttaaaaggaactcagttttttttccattaattatatcatataaattttaaaataattataaaaaaaaatattattattaattatttgtcgtggccgaaacggacttctatttttttggttccatcaaatttcataatttcattttttttcgattattcgagaaaatctgagagtgaaaatttcgaaatgacaaaaattttgagtgaaaatttcgaaatgacaaaaattttgccgatcaccagaacagaccaattcagatttgctcgagaaatcgcgtgtgattcgccaagctcccggcgaacgttgctaccacattttctaccaaattttctccgaccacaagccggaactgcggaagaagcttaagctgaccaagaatttgaaggactattattttgttgctcaagctgaactgaccatcgacggaataaatgataag

SEQ ID NO: 54485 - DNA, 662 bp, Heterodera glycines
  Genomic contig location: Contig_ID=SeqID_23782; Location=704..1365; Strand=+
  SCN-specific regions: Sequence locations=1-364,388-662
gtgttctaaaattcattgattgcccttgtcaaaatgatgatgctcaattttttgggcaatttcacaaatcgaaaaaaaaattcataaccctaattcatatggtgaacaaaacaatagaagcagatgaaaagctggagagcccatctgtgtgctgtgttcgattaacattaattggtatttgtgatgatgtgccatgaggggggatgccaaaatgtcaaacgtacattatttgatgaggcgaaatgttaaaatatattttacattaattaatggaccaatgattacacttttttaattttttgtttttaaactctccctccctccatatccattatcttatttgtaaatgatttcacacattttgtcatcagcaaattttttctcgttaaagaatttagttccctccttccgccctccggggctgtttcggcttttctcacgtcatatccatggaactcacaacattgtgacaaaaatcttccagaaaagccacacaaatatcgtgtgccggcattgccactctgcgccggagggtgcggcacgcaatccggcaaattccggcacattcaaaacaatatttaatgtgtctactcgtgctaatggccaaagtcaattttctaggaagcttatcttttctttcctaattatcatttaaaatatta

SEQ ID NO: 54486 - DNA, 1175 bp, Heterodera glycines; identical to SEQ ID NO: 23785
  misc_feature (1088)..(1089): n is a, c, g, or t
  misc_feature (1101)..(1101): n is a, c, g, or t
  misc_feature (1107)..(1107): n is a, c, g, or t
  Genomic contig location: Contig_ID=SeqID_23785; Location=1..1175; Strand=+
  SCN-specific regions: Sequence locations=1-512,534-850,886-931,960 -982,1004-1175

SEQ ID NO: 54487 - DNA, 777 bp, Heterodera glycines
  Genomic contig location: Contig_ID=SeqID_23786; Location=294..1070; Strand=-
  SCN-specific regions: Sequence locations=1-37,59-59,83-180,202 -242,264-283,305-315,353-471,591-756
atgttcgtccaagaaatttcggcctttttacataccgtaaataattttcccaagaaattggaagagcacaaaaagctggaagaggacttggaatggacgtggacgagcgaaagcgcattggaatttgaatggatggtgagtgatcaatcagggttttaaatggcgaaaatagggaaaatgtttaattatattaaaaaattagcttaattttacatccattaaatattagattttttaggaaaaacataaaatttacttaaatttcttcaaacatttttatagcaaaaataaatacactgaaaatttttaatggtctacaaaaccaaaactttaaaatattttccatatttttgaaattttcatataattctgttccagaattcttgctaattatggaaagatgatttaaattttatattgacagtcaataaatttataaaatctaataaagaaactgttttattttagaccaaattaaaaattattatttaattgttaattgtttttaagtcaacgtaaattaaattagattaatctaaaaaaatgtttaaaattcatttaaatgatttacaataaaatttcaatattttcccaataaaactttcagaatttaaacacggaaaaaatgcatttggagcgccagttggaagttgccaaatattggctggaggaacagcgccaacgcgcggaagagacacaacgcaatttgaagagcgcagaaaaggaaaaagacagccttatcgaacggattgaggcactaaaggacaacttgaagag

SEQ ID NO: 54488 - DNA, 997 bp, Heterodera glycines
  Genomic contig location: Contig_ID=SeqID_23787; Location=173..1169; Strand=+
  SCN-specific regions: Sequence locations=1-761,800-820,842-997
atgaactcattaaatggaacagcatcatcgtcaaaccgaatgcagcgcgaacaaacaggtcaaacaaatggtgatgctgctgcagtacctcgtgggcatccggctgcacaacggaacgctgcaaactcgtcctcattggacgccgctgctaatggacgacaagcgcagcagcatgccaacagcgcagcacaaagacccgacagaacaaaccgaccgcaacgcggtgaccaaacacgtcaaacaagcgctgcaaggccaacaagaccaattgtgcaaactgtgcaagggcaacctgctgaacgagatcaacaacggctgcagcgaaacaatgaaggcaccacagaagatgaagagaatgcactgcaggcaaaccgcgcgcagcttacattatctgacattgcagtaagcatgggttacggacaaatcgtgatttgacagattttagcttcacatatgtagattgaaaatagagctgctggacatttttttgaaaaaagcctaggtctagattctacgttggatctggacctggcttttcaggacaaaaatccagacttgccatggtctctggatccagccaggtgtggacctggatttttttgaaattttttaagggctaacaaaggtttaaaaaaatcaaaaatctgaacccaggaaaaatccaggccaggatccaggtccagttcgagttttgttagaatgagatgaaatttttacaggcaaaagcagtaaaaaaaggcttccagtatgtaaacgtcataattttttgatcatttaaaatttcttctaaaaaataaagcatgaaaatttttgagacgaaattttcaattggaaaaataattgtaaaattttgccgaattgtgcttaagccataataaaagttagcaatattttatcaaaaattttaaatgctttaactattcaaaatatatatcataaaagaaaaattttctaggcaggaaggcaaggaaaaatgcacaagtttatgcacaaataa

SEQ ID NO: 54489 - DNA, 814 bp, Heterodera glycines
  Genomic contig location: Contig_ID=SeqID_4449; Location=682..1495; Strand=+
  SCN-specific regions: Sequence locations=1-377,399-814
atgagtgccaaaattgaggaggtgaaattcccagagcagataattagggattaaattttgcggggaaaaaaattcggtggcattttgaaaatctattgtgttatttagaaaattcacttggaaaatagatatattcgagagttttgttaaacaaatttcgccagtaaaataagcattttcaacagtcgagaaaataaaaaaattttcagtctaaaattttgaaaattattcgatcaaatttattttttttctttatattccaaggtcgatgtcattatgtcctccgatcccatgggctatatgctggtcaacgagcggatgttggagatgagcccgcaaatttcttcgccgtgttagtcactaataaaacaattttattttccaatgtttacctataaacatttttttttaaactattgtattttttccacatttgtaagacaagccaatgtgatggagttggagatgtacatcgatgaaaaggcggtggcaacggcaacaaccaatgccgcgagcagcggaaacgggaacatttgtcaccgaccgggtcggcgccgttggtaataacttttctcttaattttgtctttttcgtcattttttgtttgttactcaaaatttattttttatcaataatgcgtttttttgttattttgaagctaagtgtaataatttattaacttcgtaaacggtctcttccagtttttgcattttttagcacaacattgagtcagacaatgcaaaacggcgaatttgattgtactacaatatgttgttggtcgacactcagaaatgattttatgcgttcaatgcta

SEQ ID NO: 54490 - DNA, 890 bp, Heterodera glycines
  Genomic contig location: Contig_ID=SeqID_4449; Location=1764..2653; Strand=+
  SCN-specific regions: Sequence locations=1-361,383-433,455-464,509 -668,690-890
atggcgcaaccgaacactccaaccgttgaagttggtgggggaaaggggtggggggctgaacatggaataggggtgcactctcggcttgaaataccctaccttgcaccttttggtttgcaatagtctaaaatatgtatcaaacgattcctgtcttgtgcctgtaactttgtatcaaattgtcgccggccacccagacttagctttcacaaatggcattttgccaactaaatctaaatcggattattcgccaattattctaaaatgatgtttttgctggatgaaaatgtaaatacatggttcctgttcgttcttcgatgacaaaattatatgtccttgaaaagtatcgttcgaaaaaacattattttattaaaaccaatttttaaatacctaaaagttttcctaagcctaaataggccgtttttacggtattgtgttttctaagaatttttattccaaaaatcatgaaaaatttttttatttcatattttatgtaaatttttttaatttacagccctattgaccagaattcggaatcgtccgattttgtataattggctacctgtccgcgtccatgacgcataattcattttaaatcaatttttcccttattccggtccgctgatatcatggatatttttgaaaattatagccctaaaaactctcctttgatttttgaaaatgtatcatccctcaccaagcaaagagtgacaaaacatatcgccaaaaatgactatattgttttttaatcgctaacattgaacaatatttgtgaatatgcaatttttcctcaaattatttgtttaatattggactaaatgttatttttttacatgtatccactttaaggtcctctttttgggtttaaatttcaaacactttaactagtgtta

SEQ ID NO: 54491 - DNA, 1171 bp, Heterodera glycines
  Genomic contig location: Contig_ID=SeqID_4450; Location=655..1825; Strand=+
  SCN-specific regions: Sequence locations=1-230,256-329,351-786,811 -1171
atggtttaattttattatttttggcactttagaattttgacggcaattctttcttaatatgaccgttaaactgggaaagccattttaattaaagtattcaaattttgtagaattctctgctctgtgcgaaattgaatgccgcagcggccacgatggctgacatttatggtgcactgcttctgcatgcgattttcgatggcagcaaagtgtgttatattgaaaaaaagaattttttattttcagttttaaaaaacagggttaggcgcaggtgttccatattcgaacccaaagtcagcgaggggtggtcagccatcacatttattaatgggattaaccctcgaaattcgacatttttttattacttttcgcaaatctatgttcgtgttgtgttttgttcaaaaaaatcacgagtatggttaggcggcgccggataaatttttgttaatttagaaattgtttgtttttttgcggtgctgacaaatttttggaattttgagccaatttatgtaaataggcggtcgtttacctatgcatttttaagcgtttttgtctgaaattatgcgcacacttcgtttttaattgccttcattcatttcaggattacaccatggtcagtgttagcttccgtcgcgagcatcagccatttctgtcggagtttggggcgttgtgtaccaacctcagacattttctgttggacattaaacagtacttggacgaacgtttcccggcggatttctaaatacagcccattttttcaaaagcgccgatgccgctctaaattctcgacatttgttgttgttgtttaaataagaattatcttccgagactgtctgatttgttaaattttcaatggccgagtaaagattaaatgacatttagttaattgaacacacaaatttgcaaaaacgcaaaatgtgcactaaatttaccaaataatggaatttgtaaattgattgaattacataattttaatttttccaaaactgctaaaaatgaatttacaaatgataaattggccctaaactcaaatcgagactaaattctcgaaaatctctactgttctccttcatttttgcttttttaaagcaaaaattttcttaaaatgacgaataattcttatgtgaatttattttgttacgatacccattaattgattttaaacaatttgaaa

SEQ ID NO: 54492 - DNA, 594 bp, Heterodera glycines
  Genomic contig location: Contig_ID=SeqID_23791; Location=318..911; Strand=+
  SCN-specific regions: Sequence locations=1-18,40-279,302-594
atggttgatggaacacatgcacagcagaagatgctacaggaagaaggtaaagatagcgagaatcaacaccgcatttcaacatataaactcatcgaagaagtgcttcatggagagcatggacaattaatggcacaacaacgtcaatccaaaatggctgctgaatttgtttacaatgaaataactcagcgattcggcattcgaatgggcccaggagtaatgcacgttgatttgagcaaacagctgtcctatgtgttgggttttgatcacaaaacacgcatttacaaaaatcagtcggcaaaatatccacctgatctgtctggtggtgtccgtcagctgtacgtttacgcgcctaaactggtggaggactccatcataggtgaccgcatggcaccgctgctgcgagttgtcaacgtgtcaggaacaccggggttggacatgccagaggttatatataccaatgaaatttttcattctctccaaaataaacgcatttctgaaattaacattgaaattcagacagcatttggacgttacgtaaaatttggttggggaactaccgtaatcacattacattttagacaaaaactattctag

SEQ ID NO: 54493 - DNA, 464 bp, Heterodera glycines
  Genomic contig location: Contig_ID=SeqID_23792; Location=149..612; Strand=-
  SCN-specific regions: Sequence locations=1-464
atgcagcccactttggcacactgggatgtcattcccaaactctttgtgccaatgagcgtgggtttaatgaaaattgcgccgcgtaaggccttcctctaccgtatcccccccattaccgtattttcgctaccgtttccgtcctcagatgttcgttttgtcgctgctgctcttttacatgctctcaatggctgtgcttttcactcgccttcagcatgggtggaatctgctcgattcgctgtactttaccctgatcactttggttcacttttagcttttcccacctgcccaatcatcaattgtaattccccccccccttcccccaatttcaggtgaccatcggattcggcgacttttgtcccccgtcaaacattgccgaaggcggcgactccgccaatcattacggcggttggattctgttcattctggtcggtctcacattgtgcactctaacggtaaaaccctag

SEQ ID NO: 54494 - DNA, 152 bp, Heterodera glycines
  Genomic contig location: Contig_ID=SeqID_23792; Location=1202..1353; Strand=-
  SCN-specific regions: Sequence locations=1-38,60-152
agaatttggcacttccgtctgtcgatgggtcgccgccacttggccattgggttgggttgcgcatttaatctccaaacttttgccaaatttcaccaccatcagtcttctgatcaccaccagcacaagtccaaatggaacttccattcttcgtt

SEQ ID NO: 54495 - DNA, 766 bp, Heterodera glycines
  Genomic contig location: Contig_ID=SeqID_23794; Location=7..772; Strand=+
  SCN-specific regions: Sequence locations=1-40,64-285,307-417,566-766
atggcttctgatcgatgtgccgtggcactcaccttctggcttggcaatggtgtgaatgtgcagcccagctactacaacagtggcaaagtgtcgcttggcctttcccagttgaaaacgttggcaccgaaagttaaaactgtgcgcattgaggtggagccgttcattcccatttcgttggccaagcaatggatcagtgaggcggccaaaaacggcttttccatcattgtcacttatcataaggcgacagtgttgggctccaacgatgcaagtaagcagaaaaaatgccaaaagcatggaaaatgtccaagaaaatgccgaaaatgatatcgcgggtcgaaaattggatttttcagaaatctcgacctcgcttttgaattgttcggtcatttattagcaagacaaaaacaaaacaaaaagttaaattaaaatttttttaatttagttagattattttttaaatttttaaaattaaaataaaataaaatgaatttttaataaatcatatataaatatttaacctaaaaatcttaaaaataaattattatattatttattattattttaagatgagttgcagcaagccgctaattggtggaagactaattataaatcattagcgcagtccggcaaatttgtgctcaatctgatgaacgagtggggtgaccacacgatcacatcaagtgcctacgcaatcgcggttaacaacgcgttgaaaattgtgcgacaagtgtacagcggaacggtgatcattgacgcgcccggttga

SEQ ID NO: 54496 - DNA, 638 bp, Heterodera glycines
  Genomic contig location: Contig_ID=SeqID_23795; Location=172..809; Strand=+
  SCN-specific regions: Sequence locations=1-102,125-245,268-638
atgaattcgccaaccaatttcaataattttcattcaactactaaatgtgttccgcttgaaaatggctctgatagagagaaggattcgaccagtaacaacaatcacaagagaaggaaggataatgttaaaagtgagttgatagacaacgccatcggaagtccgaaatcgaacaaacgggcatttttttctgctgattgtgcactgaacccaacggcattggctgaaatgatgccgagttcgagattaaggtttaaagaaattactaaatgactgcttacccctgataacttccttcaaaaaatgtttaaaatcagaaaaaggcatttgcaataatttcagcatgggaatggccggccgtttgcgtgacatcgtggcgattttccctcaaaatgatttggcttctcctggaaaactgctctttcgggaacaaatgacaaattcggaccaaagggtattttctgccaagggacaagcggatgttccggggatgaacgccaaggaaataagctttgtcgggcgggaagaggcggcgggcgaaggattcgagtacattttggcaattgtggacagacggacgggccgagcgtcggaaatcaaacgaaccgcactgatcaacttccaactgagcaaagaacgcg

SEQ ID NO: 54497 - DNA, 1514 bp, Heterodera glycines
  Genomic contig location: Contig_ID=SeqID_23797; Location=116..1629; Strand=+
  SCN-specific regions: Sequence locations=1-187,224-290,313-1514
atggaagcgtttgtcggttggctggtcttccaactaccgttgaaatacgatacatatgcgtacagtcattatggtggacggtttgacatggtcatcacatttcgtgagctttttcgcagaggatttaatccggaaatgcttcgaaaggtaattattctttctttgccacaaatcttttactctctcttatcttttgtacatggttttctctgctttttattctcctctctttctctctgttagcactacactattcgtgtacatcatctcctcttcagtatatacactatttccattttccacgacttttccattttctctgctctcttgcttacagtaatttgtcattgctcacctcactatacagcgctccgccactcttttttatattaaaaaaatgaattattcacagggtaacaaaatgtacgagatgaagattggagcacagaagaagcggaacccaaacatcattttccgtgactccttcaacctgatgccatgtgcgctcggtcagctggtccccgcctacggcttggacgttgaggagaagccattcttcccgcacatggccaatcgtcccgacaactacggacgacagatcttcccgactcccgaggactacctggctcaggggatgatgccagagaaacgacgtcagttcgacaactggtacgaacaacatcggagtgaaccgtttttgctggacgaggctttggcgagctactgcacaaacgacgtggaaatattaatggcagcgttggtggcgtttcggagcgaattcttcagtattacgaggcgggaatgctacgtcgtcggagttgacgaccgagaaaatcatggtggtattgacgtcctaaagcagtgcatgaccatcgccagtgcctgcatgaaacatttccgcaccaatcaccttccggaaaatcacctggccattgtacctgagcgggggtacgacaacgcacaaaatcagtcactgctcgccctccgcttcttcaagtggtatgaggagaagcacaaccttaaactacagacagcacactcggctggcggagaaaagagggtggccaactactcccttgatgcgtgggttgaagcggagaagagagccatagaagtgaacggtaatttcaactccaaaattatttgaatgaaccgaaaaaattgaaggatgcgtttggcatggatgcagcaagtgttttccggaggacaacatgctgttgcccaatgggaagtcggccggtgaagtgcgggagcgggatggaaagcggctggaatttcttcggaagcaacttgggcgtgtggacgtctattgggagtgtgagattgagcgaatgctggcagaggatgaggagatgcggcgtgcttttgcaagctatgtggatgatggaccactggacatccgttccgctttcatgggcggacgcactggcccgctcaagctttttcataaagcgcaagaaggggagagaatttcatatttcgacttcacgtcactctaccccttcataaagtga

SEQ ID NO: 54498 - DNA, 274 bp, Heterodera glycines
  Genomic contig location: Contig_ID=SeqID_23798; Location=220..493; Strand=-
  SCN-specific regions: Sequence locations=1-274
ttccgggcgtcttgtggcggcggtgttgcagcgactgttacacgcgcgcgccgcgcacatttacgggctcggctggttcgcgttgcgccatggcgagctgttgctggccaacggactgcacttggaggtgcgcgagttgcgcgtccattcgctgttcaattggtggtggacaacgacggcaccgacggtggacagcgcggccaacgacggcggtggtcaacgcatggcactgaacgtgcgtgtgtccgtcggcacaattcgtgttggcaaacag

SEQ ID NO: 54499 - DNA, 194 bp, Heterodera glycines
  Genomic contig location: Contig_ID=SeqID_23800; Location=288..481; Strand=-
  SCN-specific regions: Sequence locations=1-136,158-194
atgcaagaagaactttctgaagacagcgatgatgcaattaatttcttcgaagatagcattgaggatattgtggaaaagtgagtaaacctttcaacaccttaaaatactgcttttattttaaggataaattgttctgaaactaaaataaaaaagtgggcagcgcagcgagtcaatgtggcagacgccaaaacacg

SEQ ID NO: 54500 - DNA, 607 bp, Heterodera glycines
  Genomic contig location: Contig_ID=SeqID_23800; Location=900..1506; Strand=-
  SCN-specific regions: Sequence locations=1-607
atgagaagtaagggtattccatgtcgtaagaaactcgacagtgaagacttttgtgtttcgtgcgtccaccgtgcgaaaaagcccagccgcaatttgtacctccgtgttgtactccaagattgtgatgacgaggaatgcgagcaggaaacaacagcattttcctatgcagccatcaactttttgagcattgccagcgtggaagctttttacaacctgtcagagaacgcacccaataagttggaatcgattttgcagtcaaaaatagatcaacccttgctcgtcaaagtcaacatcaaggtgggttcatgttttttttttgctaggtgtttatcccaccttagctagtccattgtgttccatgcaaaaattatttcagctaaaacacgcatattttaaggaaaataatgatacggcgatgcttgattggattatttcatccatatctgtggaaaaaccggtggcggtgaaggttttggatgacaaaaacaacgatgatggagttgaggaagaggcatcttcaagcgagccgcctaaaaagcgaaccaaaaacaatcaagtcgagcgtgctattggtgaagatgctgacgacatccatacgattgaatga

SEQ ID NO: 54501 - DNA, 672 bp, Heterodera glycines
  Genomic contig location: Contig_ID=SeqID_23800; Location=1815..2486; Strand=+
  SCN-specific regions: Sequence locations=1-251,274-386,411-435,457 -576,605-608,637-672
atgaatcaagccgtgtacaacagaattgtgtcactcccgtggaggcagctccaaatgttggcaaaaagtcgtggaatcgccgccaatcaaaaggtgggttttatttgaaaagggtgggaaaatcagtttttacactgctgacataaattttcatcgcctttggcaaaattaatcagccgaatttgatgatttagggggggggtaaattttgaaaaattgtggttgtgcgataggggctttgaaaatttgataaattttcaaaatttaaatttttgggggggggcttgagtttgctttgttttttaccaaaattaaacaaaacatttttttttgctttagaaacagattctcatcaaaaaattgactgcaaacttcagcggcacaaatcaacaacacaacaccaacacaaatggacaaaacgatgatggggacggcactgacaatgagcaaagtttcggcgacggcacaaatggacaaagcgatgatggggacggaactgacaatgagcaaaattttggcggcggcggcggcacaaatggacaaagcgatgatggggacggcactgacgatgagcaaagttttggcggcggcggcggtgacaacaatgttgaggaggagcaggaggggggcagcaacaacaacagtcaactgagtttacccgacgggtaataa

SEQ ID NO: 54502 - DNA, 1789 bp, Heterodera glycines
  misc_feature (946)..(946): n is a, c, g, or t
  Genomic contig location: Contig_ID=SeqID_4452; Location=683..2471; Strand=+
  SCN-specific regions: Sequence locations=1-91,114-169,191-515,590 -741,781-1461,1511-1523,1545-1789
atgtgccagccaacgcatttttttcttccgcttttcatcttcagcgccaacaaactgttggccgagaatcttgctggtatgaattagtgtattgaaattgattaggaaagatttttgatcaggttttcacgtgttaaattgttaaaatacacagtcgattattcatatgaaatatttaaaatttaaaaaacaatttcagaagctctcaagtgcaagcagggattcgaaatgcgtccaatggtcgaacaacaaatggatcctgacgaatgtgtcgatgttgcgtttcctcgatattgtgaagcctcaatttgcacaactgctggtgataacattggcgtacgtagccaggcccttggcttcggggggggggggctgaagtcaaaaactcgatttttagggggtgtattttttgttgttttttgttttaaatcccgaattaggaaggtgtattttataaaaaatgttagccgtttttcgcaaaaaaaaaggactattttttgccattaaaatatcggatttttttatttatgaaataattaaaattgatttaaaaactaaagaattaaatttgtttatttttgaataaaaagcaaaaattttccttattttaaaatctttttttcgataagaaaaattgatttttttaatctcaaatctggaaaactttttgacacagttacttttctttaatttaaaaaaagagtccatcctttggtgtttgttcatttttaatgcgttttgaattttaaaaagttattttaaatttttttaaaattaattggacacatcgcctcagaaaatatggctttctctattataactcctgttagaataaatcataaattttctggtcttcatatacagacaaatgagcagcaacaacaaaaaaaaaactcttaaaaatttttcattgctaaacaatgaaaaattgtcctatgaaaattanatgttatttcgcatttaataattcaaaaattttctcaagatgagatgccaacttttgcgagcattcattggaaatgtgttgaagaaaaaaatgccacagaatgtggcgaaagaatgaaacaaatttatgagaaaaacggtgacttaaaaaatgttacatgccaatgccattatggtgaagaaggtgaagattttggcaacaaaaacttcacgcttccgccgcctgccgacccagcggacaaaggtagacgaaaaaaatgagagaaatttgtgaaaaaaatcccaggagaaaattcgaaaatttttttaattgtttaaaactaatgagggaaaatttgttccttaatgagagtgtgccgaaatggaactttggaccatgaaaattgtgtaatgaagtataaattgggggggggggggcgggtcattgtggtaaatttcggcttttcacactgacccttaaacatatcgaagaataatacattgattaaagttttagaaacactttaaaaaattagcaaaaataaataaaaaatattatgaatatatataaaaaaattcaaattttccgttaattttgatttaagaccaatgaaatatttaattaattcaaacggaaattagattcgcttcttctctactcattttgaaagaattttttaaacgaactaataaaataaaagatgaattttgttaagtgccaatgtgcaagattggcatgatccattcggccagcaaaagaggtctcatcgacattggagtttgcaaaaaggatcaccattattgttttgcggcaagctgctcaataaagggtaaacacatattgagttcgacctgtacttggtag

SEQ ID NO: 54503 - DNA, 58 bp, Heterodera glycines
  Genomic contig location: Contig_ID=SeqID_4452; Location=3655..3712; Strand=-
  SCN-specific regions: Sequence locations=1-58
ggattgctggggtcgtgggttcgagtcccaccgggcgagttgccttttatgttctaca

SEQ ID NO: 54504 - DNA, 1195 bp, Heterodera glycines
  Genomic contig location: Contig_ID=SeqID_4453; Location=1174..2368; Strand=+
  SCN-specific regions: Sequence locations=1-207,231-477,503-504,526 -558,580-604,633-895,933-1021,1043-1153,1175-1195
atgtatacgaccacaaccacaactacgactccaacgccagctcctgttgtcgcaacggttggtttaaaaacagaaaattgttattgttttaggaacagagaaaaattgaaggattcaatttccaaaaattttcctctgaacttctaatttttgatcaatctttaaaaatttaagtgattttgaaaaaaaatcttcgaaaattgtttcgttttattttgtattttttggatcaaaaatttgtctgaaattgctatgcaattttaaatagtctttttatttctatctttttagtctttttatttgcgccataattataataaggtgcataatgaataaatttttttttagtttttcccaacttgggcagagacatttggacacggactatcaataaaggtacttgaattctaaaaattggcacttttttgcaataaaaattgccctttttgctaatacttcagaattgcggtgccgacgaaaaataaatttaaattttatttttgtctttactaaagtaaaaaatgtgctgattacgaatatctgagctcagattttgcaaaaacattaattttatttgtgattttcttcaagtacttgatttttcaaaattttttattatttaaaaaaattttcttgtaataattcggactaaaaatgcgctgatcatgaaaatgaacttagattccgaaaataagggccagtaattaaatttcaaaaaatcgtaaaaaactaaaaacttgacttctccagacattcaatagcgcattcgaaagatctttttcagttctacaacacatttatatgagtttttttatgactgacaaattttttttaaattttggaaaaaatcaaattgatgaaaaacatatattttgtaatcagcacattttttacccatgaaaacacacaaataaaattttaaactttatttccatcgggaacaaccacaattctgctgccgtattacccctttttttttgtcttttttattttccgttatgttttaataatgctcatttgtcattattattatattacatatacattatttcaggcagaaggaattacttttcatgcatgtctccggggacgcaaaagtactaaacagtttgtgctcactggaaaccaatgccttttcaatgcaattggctgttattttgttttttgttatgatggtaatgagtgttttatttga

SEQ ID NO: 54505 - DNA, 998 bp, Heterodera glycines
  Genomic contig location: Contig_ID=SeqID_23801; Location=726..1723; Strand=+
  SCN-specific regions: Sequence locations=1-167,192-425,447-655,713-998
atggttaacgtgaagaagggcaccgtcattcgttgtgacccggcaatgcgacagttcctgaagcatttggacgagacacgggctctgggcaggccgttcatcgtcaaggtggttgagagatcgtttttcgtgaaatatttcattctccattttattaaaattttcccattttaatttttttttttttttttgaggcttaattgtattgtaggtgttcaatccagtttctttagccatcaattttttcttcataaaggcccacatttgtaccaagcaaaagctttgtctaaaaatttttttctttaattcaattctgagccattcttgaaaagctttcgttcggttgataccaagaaagctgtcattgaccaaataagaaaaaattggaggcctaaaagtcgaattttgaaaaagggtttgagtttttgtcattttttaatttatcccgttttgacaggaccttgacgagttttgtttgttcgtggagcgtgacattgtgccaatgttggagcagagaatggatgcccttatggatgctttaacacccgacactcaaacataaaacccacaatttttgtttctcatttcctcaaatgtttattgaaaaatttaattcgcaattctgttaattggctaagagttcattctgtgatgctattattatacaaaattttttaaaaaacaaaatttacacattttttcaaaacattttgttgatgaacgacgctaatggcaaattggaggcggcacagaaacaatttgaggcaattttggccagcttttctcccaccgccgatggcaatgaacaatcgcagcagcagaaggagcagtttttgcgatgggttcgccaacggttgcgccgtgaaaatgcgatgccagcaaaagacacactgcagcacagtgacaaacggcatccaacggatttgtcggtgcgcaagcaacttggacgtatcgcaaaacgcctgcgcgaattggtacacatgtcattgtgcctgtag

SEQ ID NO: 54506 - DNA, 732 bp, Heterodera glycines
  misc_feature (663)..(664): n is a, c, g, or t
  Genomic contig location: Contig_ID=SeqID_23804; Location=652..1383; Strand=-
  SCN-specific regions: Sequence locations=1-144,166-408,430-489,589 -611,651-677,703-732
tcgttttttgccctacgaacaaatgaaaggcactcaattgatgatgaatttgcgaaaaattttgcagagaaaatggacagaatttaccacaaaatggaggaacaacagaagcagctggtgaataataaatttttgacaaaaaatatgagaatttttaaattttttcaggcgattaatacggcggaaaaaattgtcaattcggacgaaattcaggtggattttagaaagcattgctttttttggcggatcttcggttggccccagaggcatctcatactcacataattttttggcacctgagaaacgctgaatttggcgattgatcaaaatgaaaaaaatattttttttcagtcatttgtcagcgcagcgacccatgaaaaattggcattttttgtgtgcggaattgccgtttgtcttctgcttttgctgatcaagggaaatgccgacaaaattttgacgggaaaatttgggcgaaggaatggaaaaagcgacgatgagaaagaggtggaggaggaaaagcggacggatgaggagggaatggaagaaaattgcagaggcggaggagagataggagcgcgagaggaggagccaattttggtggccaatgatggggaagaggaggaagaagaagaaaaggaggaggaagaggatgaacgagagaannttgtggggaaaggaatgaggagaagagagagaggaggatggaatggaggcacttttgagggaaattga

SEQ ID NO: 54507 - DNA, 683 bp, Heterodera glycines
  Genomic contig location: Contig_ID=SeqID_23805; Location=131..813; Strand=+
  SCN-specific regions: Sequence locations=1-103,125-270,292-437,459 -604,626-683
gactcctaattcatggtaatttttcaaaatataccctgatcaggatcaagagtcaaattattattaatgagaaaaaaaatctggttgatcctggccaaatttattcaggatcaggatttcccagatggactcggaccggatttagaattaaaaatcttctttttcaggactcctaattcatggtaatttttcaaaatataccctgatcaggatcaagagtcaaattattattaatgagaaaaaaaatctggttgatcttggccaaatttattcaggatcaggatttcccagatggactcggaccggatttagaattaaaaatcttctttttcaggactcctaattcatggtaatttttcaaaatataccctgatcaggatcaagagtcaaattattattaatgagaaaaaaaatctggttgatcctggccaaaattattcaggatcaggatttcccagatggactcggaccggatttagaattaaaaatcttctttttcaggactcctaattcatggtaatttttcaaaatataccctgatcaggatcaagagtcaaattattattaatgagaaaaaaaatctggttgatcctggccaaatttattcaggatcaggatttcccagatggactcggaccggatttagaattaaaaatcttctttttcaggactcctaattcatg

SEQ ID NO: 54508 - DNA, 383 bp, Heterodera glycines
  Genomic contig location: Contig_ID=SeqID_23805; Location=1308..1690; Strand=+
  SCN-specific regions: Sequence locations=1-83,127-213,237-383
atgcttcaaatctttttgacaatttcatttctgttgataattggaagtgcaattagcaatggaactgacgaagtgaaaagaggtaaaatttataaatataaaatgtaaatttaatttaatttatttgcaaattaacccaggattttgtccaaatttatacaaaaccatgcttatttattggcaaaaaaatgcattgttttttcattcgattacaaaaaaataattaattaaaaaaagggaaaagatttctaaaagaaaaattttcacaacatttattgtttagtggaaataagtctacgggatttggtggatgatgccatcaattgggcccaccacattggcatggcatggcgagcggacaaaaaatttccgcggtgatttaa

SEQ ID NO: 54509 - DNA, 374 bp, Heterodera glycines
  Genomic contig location: Contig_ID=SeqID_23806; Location=1334..1707; Strand=-
  SCN-specific regions: Sequence locations=1-113,153-374
atgttgttgttattaatgtttgtcgctggtgccattccaagcaacaaatgtgttgacattgttggtgcccccgctgtagaagcagaaactgcaccaaatgttgttgttgtcattgatgatgaagatgatgatgataatgaggatgatgatgaggtgccaatgccgcaatcaatgaccgccaccggcggtgcgccggaacgagacggcggtgaaagaaggccaccaccaccgctgttggcaatcccattggctttaagaaattgggtttgtaaaaaactgaatacggtacaaactgtatgttacagtagtaaaggaataagaatacggtataactgtagattatacagtatagggagtgataagttcggaataaa

SEQ ID NO: 54510 - DNA, 924 bp, Heterodera glycines
  Genomic contig location: Contig_ID=SeqID_23806; Location=835..1758; Strand=+
  SCN-specific regions: Sequence locations=1-6,39-411,434-721,761 -853,898-924
atggctcagcaacaacaacaacaacatcagcagcaacagttggcaccccctccgtccacctctggctccatttcgccaaactccggtggaccgttgcaactcggtgctgctgacccaagctcagtggagtccaaccagtccaacaacgtgttccatcacacgaacatggccattggtagtaacggtaagtaaactagtgacaattcctggagggaggttacacttggcaccccctccacccaaggagtgtaaaatttcttaagaaaaattcgaaaaatttgtctagtggtacccctccccaagcccggaaagttttcgaaggcgtcgtcgtttgggaagagtgatgtatatctcttaaaaagcaactccaaatcccccgcatttgtgttgtaccttaataagaatgacggaattttcattccacttctgtccaaaccgaatcccgaattctgttccgaacccgaggcccggccgactcggtaaattttccgtgatattttttattccgaacttatcactccctatactgtataatctacagttataccgtattcttattcctttactactgtaacatacagtttgtaccgtattcagttttttacaaacccaatttcttaaagccaatgggattgccaacagcggtggtggtggccttctttcaccgccgtctcgttccggcgcaccgccggtggcggtcattgattgcggcattggcacctcatcatcatcctcattatcatcatcatcttcatcatcaatgacaacaacaacatttggtgcagtttctgcttctacagcgggggcaccaacaatgtcaacacatttgttgcttggaatggcaccagcgacaaacattaataacaacaacatcattaataataacaataacaacaatgttgcgccgactgttgcacataatag

SEQ ID NO: 54511 - DNA, 952 bp, Heterodera glycines
  Genomic contig location: Contig_ID=SeqID_23808; Location=24..975; Strand=+
  SCN-specific regions: Sequence locations=1-31,53-244,276-304,326 -596,620-671,721-823,917-927,951-952
atgacgaaaaaaaatctttcaattaaagaaaaaaggataatgttaaagcaatttgatcaaatatatggcaaattaaaaacgaaattaaatgaaaaattggaaggaaaaaggacaaaatgccaaaaaataatagcaacacatttgggcattgatattagcaccatttataaatggaagaaacaattaaaagatggaaaattgattaaaaatcaaaataaagatgagcaaaaaagagaaattgttgaaaaatattttaaaataaaaattaaatttatgcaaaatggaaaacattcacgaaaagaatggaaagaatttagagcaaaaattaaacaaacattttgtgtggattatacgacaattgaaaaatgggccgagaaaattggcatcaatcaaaatatttcaaaaggtgaatttaaagattttaacgtatttttttaaatttacagagagaaaaatgttaacaattgctgaaaaaatggaagtgattaaacaatattatcaaatcaaaaaacaaaatccaaaattgaaagaagatgaaattgccaaaattttaaacattccaaaaaactcattacgcaaatacaaagctgaatttggcattaaaccaaaaaacaaattgttataattaggacgatcattattatccgaagaatatttggaaaatttcagacataaaaaatattcaattttttacaaatgtttttataaataattttttttcggtttatgaaattattaaccttttttcatcgcttataaaaaatatttgataaaaatcgttgattatgctaataacatttttaattggtctagttgaaaaaccaaattaatttttcatatttatttttattttgaaaaatgagtaaatatggcaaaaaaaaagtaaatttttagagaaaaattaattaattaaattcaataaggacaatttttaaaccaaatatttttatca

SEQ ID NO: 54512 - DNA, 1727 bp, Heterodera glycines
  misc_feature (770)..(770): n is a, c, g, or t
  misc_feature (1596)..(1596): n is a, c, g, or t
  Genomic contig location: Contig_ID=SeqID_23809; Location=30..1756; Strand=-
  SCN-specific regions: Sequence locations=1-327,430-482,504-563,721 -952,1001-1121,1164-1260,1486-1699,1722-1727
atgaatatttcaaatggcgtccattatggttcggcttcaattgtggacacaccgtcctggctgctgagcatctcattggaattggccattctcgagctagtcgtccatctgatgtccatgctgatcacggttttcaactgcattatggtgttcaacagtggactgttgcacaccaatttgaaatgggtgttgttggcacaaagtgtcagcagttttatggtaattaaaacttaattaggcatataattaataaaagttatcgaaaaattttccgtatcaataccataaaaattgaatttttttataagaaaagaaaaaaatccaagcaataatttattatataataatgttaaactttctaaaaattaaaaaatgtctcagaattttttatcatttaattaaaaatgttttaaacaaaatttatttaatgacattctaaaaatcatagattacataattaaattttcctataatacgaccatagccaaatgggcaaaagttcactcaaaaaacgaaaagttacaaaaagatttaatgaaaaggtaaaaactctttgagatatcatttttacaaattatttaatataaaaaaataatttatttttattatcagcatttttaaaattattttatataataaaagtttttcattaatgtgttatttagccaaatttaaaatttaataaaataaattctcatttaagatttttattatttttttcagtcagaattgtgccgtttctcggtgatggttgtccaagtgccatctgnggacatttttacaagaccaccgtatgccaacatacttggctcactttacgttttctcgaacacatatcgcatctttcttgcttatgttctgctggctgaacgtacactagctaccgtactcttccgcgactatgaacagtatgacaaagtgtgggctaacatcagttggctggccattactgtaatttttaatttttattataaataaaaatatttaaaaattaaatattcttcagttatctctctcatttgttgtcctaataacacaagacagttctgcgcatgattacaatcgtttcacattaccctcaattatcggattatttgttttgcaaattgctgcaatcgtggtaataatttatatttcaaaaattaaatcattttttaaatttagttattacgtcataattaccatagaaataaaacacgatataacagcggcaaaatttggacattgaaagaacgttttcaagtaaaacaattttctcgcaatattaaattaagataaattattatttatatcggtataaagcattttaaattattaattaattggtttataaatcatagttaaattattttatgttaaatattttgcaaaataaattattttataactgtaaatattgaatttttttttaaaattaaatttaaattttaagacaaaaattaagcaaaaaaaatttttaaatataatatttaatttaattttattcattaaagttatcggaaaatattcgcacactgaagcaacttcgtccaacttttgttttctacacaataaatgtgctcttgatttatggcatcaaatttttattcatttttnggattggttgtgaacgacgtgccaacaaaaattgcttttatgttccaaacgctgttgctcgccattgtaaacattggcattgaatggacagttataacgtaaacaaaggaatttttcaaaaatttattaaa

SEQ ID NO: 54513 - DNA, 983 bp, Heterodera glycines
  Genomic contig location: Contig_ID=SeqID_23810; Location=233..1215; Strand=-
  SCN-specific regions: Sequence locations=1-160,182-983
atgtatggcgacagaattgtgataccaaaagtctgccagaagaaaatcatggatccgctgcacaaaggccatccaggtatcaagcggatgaagcagttggcccgacaatatgtctattggccgaagttggactctgaaattgaagaatttgtccaaaactgccagccgtgccaagctgctgccaaggcacctgtcaagacagatttgcactcgtggccaaaggcagaacatccatggcaacgaatcaatgtcgactatgacggccccttttacggcaaagaatttttaatcgttgtcgacgcattttcaaagtacccggagtctttgaaatgccaacaaaatcaactgccgccactgtcgataaattgcgttatctttttactcgacacggaattccagaaattttggtgtcagataacggcacacaatttgccagcaacgattttgctaaatttactgcggcaaacgggatttcgcatttattttcagcaccatacaatccaatgtctaacggacaagtggagcgatttgtggacacctttaagagggcctttcgcaaattaaaaggggagggagtcccaggaaaggacgtcattgaaacgtttctggtcacttatcggaccacaccaaatgattcgctcccaaacatcaaatccccggcggaaatgctccttggtcgcaaaccgcgaaccactctggatttactgaaaccgccgctttcgcaaccctcggaaagagacgcgaaaatggaacggaacttcaatcgacgttttggcacgaaacaacgaacttttcagataaaagacagggtgtacgcgcgccaccgcctctcccataattggagggcgggattaatttgcgattgcaaaggcgtgatttatggtgtaaaattcccggacggatcaatcaatctgtatcatgcgaaccagctcagggaacgccgaaatgtggaaaatttggaagtctctgaacattttgaatga

SEQ ID NO: 54514 - DNA, 424 bp, Heterodera glycines
  Genomic contig location: Contig_ID=SeqID_23810; Location=1308..1731; Strand=-
  SCN-specific regions: Sequence locations=1-315,338-424
cattcacaaccacttgaaggaagtgtttgaccgaatcccaaacgtatgggtttcgggtgaaaattgaaaaatgttcatttttccgagagcaaataaagtatcttggtcaaattgtggacaaaaatggccgccgtcctgatccatgtaaaatacatgcgatcactgagatgccaccgcccaaggacatttcagcgctccgttcattcattggcatgataaatcactatcaacgagttcgtcaaaaacgatgcgtttcttgagaacaccactggacgacatgctcaaaaaggaggagtgggactggaatgaaaaatgtcaaagggcattcacaaaattgaaagaaattttggcatccgatttgctgctgacacattacgaccctaaattggagatcgttgtcgcggcagatgcctccgattatggc

SEQ ID NO: 54515 - DNA, 581 bp, Heterodera glycines
  Genomic contig location: Contig_ID=SeqID_4456; Location=212..792; Strand=-
  SCN-specific regions: Sequence locations=1-498,534-581
atgcgtgagcttgggtccgctgaaacttgggaaaatacagtaacctcgtacactacagaattacagtatccggaggcttcatcaaattatgccaataattggtatttcattgtttttgaaaaactttgcgccattttttgtgtttgttttttcaattttttagttttttgaaaatcggatcccgagttaatcgctttcgccccctacatacaaattccatcccggaagcgattgtaggaggggatagagctttggaatttgtcaaatggatcccggcgaaggggcggatggtcggacggttggaaaaagccttccgcaaatgtgctccgcgttcttggcaatccaatgggacgtcgtcgttccctgaccaattaataataattagttaccattaaagaaaaaatttcaaatttttcagtatttttaaacttatttttgttaaaattattacgtctaattaatttagccgacaaaaagaaatagagagacaatgaatcatttttagaaagatattttattttataataatctgttctcttacatttaagacgattgtttttgtgtaagatgaaatgaataaa

SEQ ID NO: 54516 - DNA, 455 bp, Heterodera glycines
  Genomic contig location: Contig_ID=SeqID_4456; Location=885..1339; Strand=+
  SCN-specific regions: Sequence locations=1-168,190-403,444-455
atgaagaaccaccagcagcatactatcaaacgcaaccatcgccaccaagggtactgtattttgaataaggaagggtactatctactgtatgagaatgactgtatttcaatgggcatgatatgctactgtgtgagaatatggaaggacactactgtattcaacatacatgagagactatactgtatgagaatgggcaagagaggcaaagaaaggcaaaaggagaattcgaaagggaaaagatagagagagaaaacaacaatgtccttttttcaaggacgtggaaatttttcaaggacacacctaatctgacaatttcaccaagcaaaaaacaaaaaattaatcatcggtgcattaacatgtttgtaacacatgttttatatttttttgaaaattcataaaaaattttgaaatttgtcaggctaaaaatgagtataatcaagaattgaaaattacta

SEQ ID NO: 54517 - DNA, 1294 bp, Heterodera glycines
  Genomic contig location: Contig_ID=SeqID_4458; Location=13..1306; Strand=-
  SCN-specific regions: Sequence locations=1-308,331-347,376-438,460 -634,656-955,977-1042,1066-1294
ctgttgctgtaagccgatcatcatcaaattgccgccaccacctgttaaggtaattaatttagatgctctattcgtatgaagcacccactatctccaattacacgcttaattacgcggggtggctctaattaagggaggggcattctaattagggagcctaactatgcttattaaataggggagggtcaaattaggggagagtcttttagtgagataggcatatttaatcctcttaatgaatggcaccaaattaattcttccaatcccatccacaccacagctttgcccatgctgctgcggatgcgggtgcggcggcggatgctgctgctgtatgagaatttttccgcaaaaaaataaaattaattttaaaaatttctcaggcaagccatgctgttgctgctgctgcaaaccgtgctgttgttgctgctgtaagctagctttttaaaagaaaaacaatttactagcgcctttcgagagtcttggggctttactggccaaatccgacaaattcttggatttgcttacataaatttattacggttacagtagccgaactcgagagtcgtgtactcttgctgctccaatccgtaaagttttttgaaattagcatttttctcacttgaggttaagcattcaaaattttacaaaaacaaattacggttacagtaccccgctctattaagaaacctttccattttcaggcaagccttgctgttgctgctgtaagtttaattttttttttctccgctgcggtttttctggactagggaatattttttgaaattttaaaattttctctctgccccaggcccgtgctgttgctgcggtggaggcggtggtggccgtaagcggcgcagtgttgtggacttgatggcacgcaaattctccgacgtgttgttgccccagcacaaccaggcaaaccggatttgtcaataattttttgaaacaaaaaaatttggaaattatgagaggcatactgtacaaaaattgtactcactctacgttctacggtatattacaggatgccatgatgtctggcatgaatggcggtggctgcggcggtggtgcttcgcaaggcgtttcgctttccccattgcacgcactgtgctcacagattccgccatcgcagcgtgtaagtttactgtaaaaaaacggcggttttttccaattacggtgggtttttttatgaaatttcccgatcgttttcagggcccggcctgccaacagatcactcagcatgccgccgcacaacaattcccgctcagcaaggacattttcaaccgtcaacagcagg

SEQ ID NO: 54518 - DNA, 1102 bp, Heterodera glycines
  Genomic contig location: Contig_ID=SeqID_23814; Location=104..1205; Strand=+
  SCN-specific regions: Sequence locations=1-118,154-240,263-394,417 -533,557-925,948-985,1007-1102
atgtttagacacttccaaactttcattatgaatatcaagtatgtcgtacttttgaaagacgtccaataattgagcttcaagtggttgagtcgcacgatctaattatatgtttaacggatgtacatttgtcaattcatgatgctgtagaaccatttaagtttgtgatttacctttttttaatttggtcctctattttcaggctcttggatgtatgttctaagtacaaatcaatttccgcattttctcattttgtgacagaggtgagcaaagacgattatcaatagtttttgttttttcagagccaaactattcatattgcaatttccgcaagaaagcatttacacattttcaaatatttattgggtgaactttgtgaaattaacgactgtgcaccgattactcttcctgagaatgcccaagccgttgtgtggtatgtgttaaatacactttttttttgttagattttcgtaaattatcctctgtaatatcaattttctaaccttcgtgctccgcataatggttttcctggtcactacttactgttaatacttattggtaatttttaaccaattttaaggtgcggtgtcaacaatttaattctggcatttaaatgcgagttccaattctgggacatggaccatttcctccacagagatgatttgatcgacgaaaaagtaacaaccaatttatttttgtgagttcgtcatttagagcatgagtctcgcaaaaagtccgacaaaagtggaaaccattcggactgagtcaaacgaaattgctccactgattgtcgctatgtcggacctgcaaatagtggccattcgtcgagaaatcagcacagtcgaattttttgagcccaattctggaaagatgattactcattttaacaattgcaaattttcggaccaaatactttcattgagtaagttaaattaaattacattcattttttcaaaacaatagcataccaccatccctacttgatcggaatattaccaaaaaatctgcttgagattcgctctgttaatcctccgatgctaatccaaaagattcccctgctgagagtttcgatgatttgtccaggcggcaggttaccaaattgtaa

SEQ ID NO: 54519 - DNA, 1206 bp, Heterodera glycines
  Genomic contig location: Contig_ID=SeqID_23817; Location=1..1206; Strand=-
  SCN-specific regions: Sequence locations=1-38,65-687,709-895,919 -1077,1099-1206
tgaaatgaattttataaaggaaattcgcaaatatcttcattcatatatatgtatgtgtacatgtaaataaatcggatgtataaaaaatgacaaaaataaatgcgaaaatctaaagttttttagaatttgtgtaaaaaaaataataaatcataaattggtatttttgcacaaaattattcggtatccagacaattatattcattagagtccggtaaaaaaaaatttccgggaacgggatcgggagttcaattttttttccgggatcgggaatcccgtgaaaatcccgctcccgttaaaatcccgcagaaattttgcgggagtcccgggcgggagcgggagtaattcgaatttaaaactgaagaagcgaagtgatgtgattaagctgtgctcactgctcaacaaaaacccgaggttctctttgcgcgccatgaggagacatttccgaacatgagcacgggtcggaagaaccaacttcatcggacgtgggcgggtgcccagttttcccattcggtactgtgtaataggaagcgcttcaacatcgcaaaggtccaggatttgcatggccgtacctttgtcggcggtggcattgtttcctttcttttgcaccttatgttaccgaacttttcagaatctcatttgataccggaaaattaccgaccttttggaaaaaatctataataattcctctctttaaaaaagggataaaagttgtcccaccaactatagaccaattgccctcacatgttcactgtgtaaaattttagaaaaatttgttgtcagggcaattactagtttccttttaaaacatgacctaatctcagtacaccaatttgggtttgttaaaggtcgttctactgttacccaacttattttaactcttgaaaattggtttgacggtatttacaatggaaaaaatattgactgtgtttatattgattttcgtaaagcttttgatgttattccccatagcttacttttatataaggttcataaaattggcattagaggtaaaatccttaattggatttctgattttttggccaatcgctcctttttagttcgtgttgaaaattcgttttcttctgaatacaaaatgtgctctggcgtcccccagggctctgttctaggacctattttgtttcttatttatattaatgatttacctaagaaaattccgaaaggaatttttatcaaactttatgcaga

SEQ ID NO: 54520 - DNA, 885 bp, Heterodera glycines
  Genomic contig location: Contig_ID=SeqID_23819; Location=99..983; Strand=-
  SCN-specific regions: Sequence locations=1-476,498-562,588-605,628 -632,654-666,699-840,862-885
atgggactccgcgaaattccccgcccgggcggttctcccgcacaattttttacttttatatagttcagaaattgtaaaaaaaatttttgaaattaaattccattttgcagagaccggaaaatacgttgccatcgatctgagcggcaaaaaccttcgcattctcatgctgacactgcagggcaaagacaaagagccgataattgccactaataatttcgttgtcccttatccgatcatgaagggcagcggagagcaggtttatttgtgtccaaatttatcttatttgttgctgcaattttgccaaatttgggttttttaggttgggcatttgtattttttttttgacattttctgttactttcaacccatcccccaattatactatagtattttggtatttttttgcgcaccgaataaactggatttttgcgttgttttagacttaagttgtcccattgtccaaattccatccttccaataatttttaaaagatttgctttttcaattcaattgcaacttttggtcctgagtttttgaaaaattcaataaaaattgactagtgaatacattttctttcttttcagctattcaatttcattgtcaactgtcttcaaaaggtatgttttttaaataatggtgacaaattaattattgttcgagcgcttgtaatatatttaaaattttttttgaaatataaacttttgtagagcccggaaaacacaatttatgtgacccgcctcccggattgggacacaaatctttcgagataaagtttccgatcccgcgggatccaatccaacaatttcctaaatatctcggagtttaggactgctaacgggtacaacaaaattcccggaatcccgtcccgcatcgggtacaaataaa

SEQ ID NO: 54521 - DNA, 1095 bp, Heterodera glycines
  Genomic contig location: Contig_ID=SeqID_4460; Location=285..1379; Strand=-
  SCN-specific regions: Sequence locations=1-5,43-154,176-508,530 -626,648-684,754-1095
atggacgccgatgagcagcagcaacaacaacaaccgcaacacaaactcccattttccgtcaaacattcgtcatgctcattttcaaccgctgcggaattgaattatgaattcgcagcctccggcacttcgtcctcaaaaggtgggcgggcacaggacaaatgaagaataaaattgagttgaaattgtaaaaaatgacaaatctaccgccttaatgtaatatagccccccccccaggccagtatctaggggggcggatggggggacacgtgcccccccccccgaaatgaaaaaccaaaaagttttcaagcaaaaatgggcaaattttctgaaaattttgcacattttcttatttttttttgaaaatttgagccaaaaatggcaaactttgtgatttttcggcgcaaaatatctactaattcctgctttttggctccggtgctagagattttgaatcaaaaaaaggcggcattttcgaaattttaattatacgaaaggttgagcagtattgaaaattaaaatgtttgcattttctttgcaattttaaaatgattttgcattaaatttgcttcttttcaagcatagcagcctaaggagccaggctcccgcatttttggctcaaactttgaaaaattaaaaggatttaggtaatcgcccttgggcgatgccaataggcgtcacgccaggaaatttttttttaaaagtttaacaaaattttaagaaaattgtgttaaaaatttaaaaaattaaattattcatcatcctccatcaacaggcaaacagcatcagcagagagccggcaccaaaaagcgcaagttggactggaaccggcgggacgaggacgaggactatgtgagcagggcaaagttgtcacggcatacagtgccagtgccgtcgtcatcgtcttcctcgaaaaggaagcaaaagcgtagcggaggaggcggaggccgaaaggcaacggcaccacttgcggcagcagaaacagcgggcatggtggacgaagcggacgacgatgacgaggagggcatggcagcggcaatggtggcggccgaagccgaacaaatgttgctggtggagaagcggcgatcaaccaggaag

SEQ ID NO: 54522 - DNA, 1546 bp, Heterodera glycines
  Genomic contig location: Contig_ID=SeqID_23823; Location=310..1855; Strand=+
  SCN-specific regions: Sequence locations=1-523,545-1386,1408-1546
atgaattcaaatttactgcttttaagcatccaaccaaacctttcaactcgtgacaaacaactaaaagcttggggacgacttgtgctcgattattgccaagcaaatcgtatttacaccactgatttggacgaaatttcaaagtcggatttattcaacaatcgtcgactgaatagtgagtaatttagcattttttaaaattaaagttagcatgcttaaggacatttggatctgtcagggattcgggcagtgttcgactttctcgaacttcaaagtctgtttggccttttgttcgtaataatttctgcccattcactcccttaagaacacgtcgagtggaaggataaggacaagacgcgctgcaacatttattggcgtagaccagaagagtggggccaattgctttacgagtgggcaaattcaattggattgttgaacactgtggtcacattgtacgagttgacccaaggcgaagacgtcgcgaaagaatgtgagttggcaaggcgacgaagaaaaaataaattggaatttggtttttcagctttttacggtttggacaaagacgtgctgttaaaagggctccaacatttggagaaccaaggcaaagctgtgctgattgacattgacggcgaaaagggcggtgtcaaatttctgtgaacaaagctttgtgttcaccgtttctatggccatggaaaagggttcgttccgtccacacttatacaatttcacaaaacaaccttccaggttcgaattttttgcgcaattccgacattgttgaggagggggacaccgtcgttgtttatgttaatgcggctgcacagtacagtgttgtggtgaagcgggggcacactttgcacatgaaatacggcgcactgcgccacgaatttttgatcggaaagcggtgttatctttaggatttacctaattccctgggttgaatctcccccccccccaattttcagttatggcaccgccgtgtccgcctcggccggttatgtgtacgtgttgaggatcaacccgagcatgtggacacggactttgcagaagagcacacagattttgtacacgccggacattggcaccattctgctgctgttggacgtgaagccgggcgcacggatttgtgagaccggcacaggtagaacggaggggggggggaaggcaactcggactgaaacacatggcattttaaggcagcggttctttgtctcacgccattgccaccgcagtggcaccggacggccatttgtattcatttgacatcgatgagaaacgtgccaaaactgttcataatgatctcaaagtaatgcttttaaagagggtggtcgaccaagtttatgaaactataaatttttcaaaaacaagaccaattggcaatgattttttgaaaaattacacttacctattaattttaaaatgaaaaatgagtaaatataacttttaaatttgttgactgaacccagcaaatttagtatcactcgaaagtttttaacagattattagtctactaatgattatgaggattacccaaactaaaaaatttaggtaa

SEQ ID NO: 54523 - DNA, 758 bp, Heterodera glycines
  misc_feature (735)..(735): n is a, c, g, or t
  misc_feature (748)..(748): n is a, c, g, or t
  Genomic contig location: Contig_ID=SeqID_23824; Location=1..758; Strand=-
  SCN-specific regions: Sequence locations=1-163,185-253,280-289,319-758
tgtcttttaagccgagttttgcgctttgtccgtgccaagtttctctcccaccaccttttgctcgccttcgcttgtgtcttgtacatttttcttggtgctttaatgttccaacttttggaagaacgccattttcttggttaaacttaatacattcgtatttttaaaattgtcaaatttcaaaaaacagaatcaaaagcgcgtcacctccgccgtgtcggcgctgactctgaaaaatacgctgaagcggtgtggacggaaattcagaaaaatttgcaggaaattccatgggacgaaattaatgaaaataaaatggtggccgaaattcgggcagcaacggaggagaagtttcataattatgtggacacggtttacgtggcccatcgggcagttcggcacggctttgaggaagtaattatcacactttcctccccccccccccttctcaaatttgcacccaaattgagaatcctccgacttgggacttcaagaattcactgttcttcaccgccacaatgctcacttcgattggctacggtttcgtctgtccgtcgaccttcgaaggtcggcttttcggcgtcctctattgtttgatcggtttgtccgtcgtttgttggccatttgcgttaattgtccttttaattgtcagggattccgttgactttggtcactgtggcaaagtgcgtctttctttttctgttttttctcaactcatttgcctctttttttttgttcaangcgttgccaaatntcttttctga

SEQ ID NO: 54524 - DNA, 1262 bp, Heterodera glycines
  Genomic contig location: Contig_ID=SeqID_23825; Location=807..2068; Strand=-
  SCN-specific regions: Sequence locations=1-40,62-93,115-159,181 -351,397-576,598-896,918-1056,1109-1262
atggacaatgtaaaaatggacgtacacttaaaagtgagtgtgcaaagtttgcccaattttagccatggattttggtacttttttttgaaatttggcaccatttctttgtaaagccaaactccggtgcataaaaattcaagtaagtctgagaaatgtaattacaatttcaaaaatgagggatttcttaatttatagataaaatttttcctccaaactctacatcaagcaagctaatatttcttctttagcgtgatctagcaattggaaaacgcctttgttttatgggcattttcacttttttggccgaaactataaacaataaaatttcgaatatattgtaagtaattaaccttaaatattaattataaagtggattttttattattaaataatattgcatttattatttcagattgagtgcttttactgggcatgtcgcttcaaaatgtgttaattggcttagtaacgctgtccgacgaaatttaaggctcggtgaagcaaatgagcctaatccaacaccatttttgcgaacactaagtgcttcagaattggtttcactacatgtaatgaattaacaattaatttatttatttattactgattttcgcttatatatttgaaattgaatttttagttccaaatgtctgaatttggcatttcgatcgaacagattttacgcttttgggccaatacgatgaatgtttttattgatgacaacaatttaacggctgttgaccgaatggaatcgcaaaacgtaattgatccgttgtttggagcatggctggaccaaattacgcgttaaagaaattatgggtcttttttgggagcgaaaattacggatcgtgttgtggaaattaagacgttttgagctctgagattacgggttacaaatttccataagtgaaatacaattttgtccagccctagttagaaaattttaagtagaattttttaattttcaataaataacatacgtattaaccgattcttgacctagaaaagaacaattttctaaatttataagggttttttcaatattattggtttaatgtatagaaaattaagaattatttttagcaaaaaaaaacaaaattaatataatattttaggtcaaacaacaattgactgaattaaccagagaagctattcttgggttgttgtcaacaaaaattgagttggtccaatgcgaaaattgaaatgaaaaatggaacaatttctttaacatatggccaaaaggacattgaaatttaaacatcaataaa

SEQ ID NO: 54525 - DNA, 913 bp, Heterodera glycines
  Genomic contig location: Contig_ID=SeqID_23827; Location=14..926; Strand=-
  SCN-specific regions: Sequence locations=1-172,194-246,268-889,911-913
aagcactaactgatctgcggcttattggaacagaaaccgaagaagaagaagtcgaacagtcaccaacagaaattggctatcatcaaagagtgccaatcgatcagcgtgaagatgaagctgaacagtcggcaatggaatttgcgcctgatcaccgccgaatgtcaaccgatcagtgtgaagatgaagctgaacagtcgtcaatggaaattgcgtctgatcatcgaccaatgtcaaccgatcagcgtgaagatgaagctgaacaaccgctgatgaaattgcagtccaactgaccagcaaaaaaatgaagcgtcggaacaagagctgttggttgactccaaccctgttgatattgaagaagaagcgagtccaatgcattcgccacgttcccgatcaccatttcgatcagcagaattattcccggatggggaagtaacgacagtgaaacaatttgagagcgtcacagatccatctggagatgaacacatgcatttttttgttgaatcttccgatgataaaatggcaccattctcccaaatgcatggagaagagcgcccatttgcaccagaagaagtgtcaagtgaaggccatgaacaaatattgcctcttctcatgacggaagtagctgatttcaacggaagaaggccatgaaagaggtgaaaatgtggaaacggaaaaaattccgcaagaaattgaagcagtatcatcgccagaaattgacggacatgtaacgaccgaaattttggagacggaagatgttcggcatgaagttgaagcagtaccggcacaaatttcatcagaaagacaggaatatgatgatattgtggaatcagaagttctgcatgaaattgaaggagtaccggcatcaattcccctagaaagacccgaaaaagatgatattgtggagtcagaagaa

SEQ ID NO: 54526 - DNA, 274 bp, Heterodera glycines
  Genomic contig location: Contig_ID=SeqID_23828; Location=80..353; Strand=+
  SCN-specific regions: Sequence locations=1-274
atggaattaataaatgccactcttgacaaactgtacaacaatccatcttcccccgcggctttttccggtgttactgcactgtggaaagaggcgagaaaaaagataaaacaattaagtaaaaaagaagtgcagaactatttggaaagtcatcgtacctacacgttaatgcgcccccgacgggtgcacttccggagagcaaaaactgttgcagcaggattcatgacagatgtccaagtggatttggccgataaaatcatattctgatagagaacaa

SEQ ID NO: 54527 - DNA, 829 bp, Heterodera glycines
  Genomic contig location: Contig_ID=SeqID_23829; Location=916..1744; Strand=-
  SCN-specific regions: Sequence locations=1-190,217-386,409-438,460 -472,533-563,623-639,689-829
atgagaacggcccgggaggagttggacgccgaatggccggatgtgttgcgggtgaattacaaaaaaaaaaaaatttaatgctaattaatgatgcttcctaattcagctctgtgagctgctggtgagagaaaagaccgccggacctgccgagctcagagggtatgtccatttttgttaaagctccctcctcaaaaccaattttaaaaaataattgaaatgggcaattttttgaaaattgctgctaaaaatggacaagctgagcaaaaaaaaaactcaagcagacgagggggaaggggattaatccaggaaattcaaaaacaatgcccacctggtttttgctaccactccgatcacgcgttcattccagttgttcaccaaaggacaccttaaaatttttaaaataaatttggttaagcatattcggcgcttcgctgtgggaacaaaaccaccccggagacgccgaatatttgttgggggaggaggaagaggaagacgatgatgaggaggaggaggacgaagatgaggaggaggacgctgatgggggcgacgcggcgccagatagagaggagggagaagcggtggaagagaatggggatgaggaagagggggaggaagatgagaaccagcagattgaatttgtttttaaaaaaaaaacattttgatttttttttttgtttgataaatttttgttgtgttgacagaaagctttttttccccaatcggcggtgttcggttccatgccagccaacacattttttttgaaaaccatattttaaaattttgttttttcctgtttttttgcacaatcaataatttaaaacaaaataaa

SEQ ID NO: 54528 - DNA, 781 bp, Heterodera glycines
  Genomic contig location: Contig_ID=SeqID_23831; Location=560..1340; Strand=+
  SCN-specific regions: Sequence locations=1-542,660-781
atggacgccaaatcaattgacgaaaaaatgttgaaaaaaatcatagacactgagaagggtaaaatccatgtgttacggcttgaggcgggaggtgagtgggcggaaaaaagcagaatggccatctccaaaaccaagaaatctgagttttttcaaaactcgggaattatcgggttaaatcccaaccggcacggatcaattggcaaaatgcagtcctgggaagaggaaatagacgaatggaaatagggaggaggaaccataaggacattcgttgctcagattttttgtgtctgatattcgctgcataatgaaaatgcaccctttctaagacaaaggtacagagctggccaaatccaaagtgttcaaagaccgttctgtgtgtcatcttctgttgaccatttacaacacaaatatatccaaattagaaagcttattgaattccatggagaaggaacaagggtaagcggaagagaaaatgcaaaattaaaatacaattgaaatttcgttggtgaattattaatttagttataagttgtactcgataaaggagctgaaaaacgaagaagcggacaatgaacaagttgagaaagaagaggaggaaaacgaggaggaagaaggggagaaggaagtaaacgacggactgagggaggaggaggaggcgggacggcactatgcactcagcttaatcggccaacaatgccagaagagttatggcataaaatgaaagatgaaggaaagaaaagctattcgttccttacccatattttctaccttttagcgttta

SEQ ID NO: 54529 - DNA, 1329 bp, Heterodera glycines
  Genomic contig location: Contig_ID=SeqID_4462; Location=202..1530; Strand=+
  SCN-specific regions: Sequence locations=1-3,26-458,488-525,556 -644,666-1329
tatcatccggatgtcacaggttccaacgaatcgtgcgcaaagaaatatttggaaatcaaagaggcttatgacgtattgcgtgatgaaaaggtggggtgatgggattaggggtggtctccatccaatggaatgtttttctgtggtttttaccgtgctgaaattcagcaacgagaagaacacgaccgatggttagcggccgaagaagttcagcggcaacgtccaattaacggacgacagccgtatgtacgcagacagaaagtgtacgacgatttgtggccaaacaatggaaccttttcggatgaggaaatacgaagggttggtagaattcaaaagaagggggcgggtaaaaggaggttgatggtgtcggtaaggtgcacttcattcacctctgtcattaaatttctaaaaaatttccaacgcttcaaagtgttatggtgaattattattgttttttttaattttaccaactttaaatttttcaagaaattttggtattccttgttttgctacccccccccccctccgcccccttgaaaaattttaaaattcaaaaaatcatagatattttgttaatctatgaccagatatcatcagcagatgtcaaacaaaacaccattttcgtgatcagtgaccttgaaaaccccaaaatatgaattttttaaattttcgagggggggggggggtagcaaaacacggaagtaccgaaattttctcataaaaaaattgtcttaaaatttattaagagaaattggacgacttatcatttcatttgtggggtaaggcttcataccctttgccctattcggctgcatattttccgttaattttaaataataacaattgtcatttatgacagatttggcgcagtatgagtggcaacagcgaatttggacggtcgaattgggaatttgaaacggaggtgaagcgtaaacgacagatggcatatgaggaacagacgaggagaagaaatgagtgggcgaagaacgggttcggccaaaacaatggtcgaaggtgaaaatcgggaaaaatggaggggggggggagtttaccattgaccaattaataccaagaactttagtgattggactgaccaggaccaatacaaaatcattggcaaaattctcctctgttatgtgctcatcactttattcatcgaaattttcaggttacaatgaatttttgtctttatttacatcagatatattttaagcgcttcccttggacttttccgagacccatttctgccgccatataacagagaagaagacatcagaaaaaggattgaagaaagaatgcgaagaatgccgtaggattgacatgataatttaa

SEQ ID NO: 54530 - DNA, 2625 bp, Heterodera glycines
  Genomic contig location: Contig_ID=SeqID_4462; Location=2549..5173; Strand=-
  SCN-specific regions: Sequence locations=1-44,66-559,581-678,700 -1097,1134-1310,1332-2078,2104-2352,2374-2390,2412-2625
  Gene Ontology: Mol. function=arginine-tRNA ligase activity; Cellular component=cytoplasm; Biological process=arginyl-tRNA aminoacylation
atggagaaagtgcaatttgggaaggagctcatggaggagtgtcctgaaattgctgccaaagtgcaagagagggacaaattgaagtaccaactgaacatcctgaagagggtgagggcccgggcagggactgattaacctttttctttattatctgcgattagacttcctttctgttcaaattgcccattttctgcaaagtttaggcgaatgccgtgccaacagagggacaccaaaccgaaaagaaattggcaacggatgggaataaagtcgccaataatcggacagttccaaatgggccgagtggcagtgcgcatttgcaaatcgaagactttggcgattcaatcatcgaacgactgagcgatgttttcgcaaaggccgtccaaaatgtgaggaagtcgaataaaatcgcattcattcccatttttgaggcttacccaactcttggcatggatccttcgattatacgagtcaaagaagcgaacaacccgaagtttggcgactaccaattcgaaatggtcatgcaaatttcacggcgccttctcagcgaacaaagcgtcaaggagccgcccccggtggtggccaagaaaattgtggctgcgctggagcaaatcgaattggtcgaaaaggtggggaaaaaaggaatggaagtttttgaaatgggaacggaaggggcggttgagagaattgcaaaatccattgaacacagcgaaaacggacattttgctttgtaattgaaaatcttagtgatccgaccaaatccaccttttcttgaaatcaagccttcatttcttctacctttttcattccattttttcttggcttttccttttgataatctcccattttcagtaccaactcgtcaatgcctatattaatgtatacatcagccgtaaacatttgggaaaacgaattgccgaaatctctagaaagggtttttcgcttcctaaaattgccaagaaacatgtgattgttgactattcgtcgcctaacattgccaagcaaatgcatgtgggccatttgcgttcgacgattattggcgaggcaattgcacgtcttttggaatgctttggatttacggtgagaaagagaaataggcgataaattaatcatttcatttataattaattaaatttgtgttatttctcaggtcctccgtttgaatcacatcggagactggggcactcagttcggaatgctaattgcccatctgaagaaatgctttcccaattatctgaatgaaacgccgcctatccaagacttgcaagagttttacaaggtaaacggaagtcatcacttttttgggcacggacaaagttggtgagttaaaaatatgataagaaagggtaacagtgacgaattgggtaggacagggcaacacaagaacattggcattacataaataccatgaaaaaaacccaaaaacaaataaattttatgatacacagactttttagcaatcgaaagtgaaatttgacaacgacccgcagttcaaatccgaagcctaccaatgtgtggtcgcactgcaaaactttgagccggacacagtgaaggcgtggaaaatgatctgtgacgttagccgaaagggtcagtcaatggacaaacaaaatttaccctaatatggccaattaatttaccaaagcttccctcagtggccatggaataattttgtgcttaatttttgttttttcctctcctttaaagactttgcaacaatttacgagcgtttgggcatcactgaccttgtcgagcgtggcgagtccttctaccagtcgcgcatgcagtcgttgatccaggagttgaaacagactcaactcctcgtcgaagacgacggaagtgcgtctttttctctttcatttctcactactttccctcatctaattattcacttttatcgcattctagggaagcttttcttccctcacgagtgcaacattccgctgacggtggtcaaaagtgacggcggtttcacctacgacaccagcgacttggccacactgaagcagcgactgtctgaggaacgggccgattggattctttacgttgtcgaccgtggccaatccgaacatttggaggtgttaatccttaaaatgcacattttcaattataaacaatggtatttattcgttctgaagaacgttttcgctaccggaaagcagctgaagtggtttgatgcggcacaaaaacgcgtggaacatgtccaattcggattggtgctgggcgaggacaggtgacagaaagcgacagtggcattgagcaacaattgccaataatttgttgcaggaaaaagttcaaaacgcgttccggcgaaaatgtcaaactgacggaattgctggacgaaggcgtacgccgagcggaggaaaaattgcgcacaaaaggcaaagaaggagtaaggcaaagggattttcaaagggatttctttggtaatatttttcaggagttcacaccgcaagagtttagagaagttgccgagtcggtcgcttacggatgcattcgttacgcggacatggcccagtcccggaccggtgactatgtgttctcatttgacagggtccgtttcgagggggaccagtgggggtcataaggatacaaattggaccaatccattatatcgatggatttattaaa

SEQ ID NO: 54531 - DNA, 282 bp, Heterodera glycines
  Genomic contig location: Contig_ID=SeqID_23834; Location=512..793; Strand=+
  SCN-specific regions: Sequence locations=1-282
gcacattccaaagttgcaacaagaaactgcggaacaatgtgatgtttatgcatcacatttgggcccatgtggcccaacaaaagcccaccgactcggaagaacagtttaccaacatgcaggccgagcaacataacgccaacagcatcatcaccaacggcacgaacaacggcaccgacacggccaccggcgacgagcagctcagcgatgtcagccgacttcacatgtgcccagagtgtctgttggaacagcccacaccgcaccgggcgcacctccattaccacc

SEQ ID NO: 54532 - DNA, 99 bp, Heterodera glycines
  misc_feature (24)..(24): n is a, c, g, or t
  Genomic contig location: Contig_ID=SeqID_23835; Location=6..104; Strand=+
  SCN-specific regions: Sequence locations=1-99
tcgtcgatgagcagtgtgatggcngagaacaacggcaactcgtacaacgagtacagcgtggttgatggtcaacagcagacggaagagcaccagcagtag

SEQ ID NO: 54533 - DNA, 366 bp, Heterodera glycines
  misc_feature (363)..(363): n is a, c, g, or t
  Genomic contig location: Contig_ID=SeqID_23836; Location=499..864; Strand=+
  SCN-specific regions: Sequence locations=1-366
ttttaagccaatttattcacaaaatacatttttttttgttgccgaaatgagcacggaacgctattccttctctctcaccaccttcaggttttgtttttgaaaaatgcataatcaattctattggtcagattgttcctttataactgaaaatgtagaactcttaatgtaaataatttccgaaatagaaaaaaccgattttcatacggttttggactatggctaaattagctgcttttttcaaacattgtaataatatgcatattaatttttttccctctctcccacagtccctcggggaagttgatgcaaatagagtatgcgttgaatgccgtcaagggcagtgcgccatctgttggcaccccngag

SEQ ID NO: 54534 - DNA, 919 bp, Heterodera glycines
  Genomic contig location: Contig_ID=SeqID_23838; Location=132..1050; Strand=+
  SCN-specific regions: Sequence locations=1-65,87-611,633-676,698 -700,749-919
cagagaagaaaaaattgaaacaaaagtcatttgacgaaatttttggagaaaaagggggagaaaaggaagaagaaaggcgaaatgaactcaaaaaaagagaaataattgcaaaattttataaaataaaagagaaaatcaagcaaaaaagacgaaaatacccaagaaaagaatgggataaaattgaaagaaaaatagctaagaaattggggacaaatcgaacgaaaatttataaatggatcaaagaatttggtcttcaaaaacaaataaagaaaagctataaatcaaaaactgatgaagaaaaaatagaaattatacaaaaattcattggaatggcaaatgaatataagcaaaaaagaaaatattcgccaaaagaatggcaaaaaattcattccgaaatttgcaagaaaattggagttagcctttcagtaattaagaaatggaagaaacaatttggaatgagtaaatttataacggagaaagaaaaaatggagaaaatgaaaatttattgggaaataaaaaaagaaaacccaaaaatgagtgacaaggaaattgcaaaaatgatgaaaattgatagaacgaacatttcaaaatggaagaaactgtttggataaaagaatcattgaagattgaaaggatgattataagaaaaattggataaatttgccgaaaaaattatcagaaaaactatgacaatttctagttttttttctaattttttgtatttgtattaaaaaaattattttaattaccctaaattttgaaatttttcttagtgaaaataagtgaaaacagtcaattcaaggattgggagggtatcattaaaaactgaacaatgttggaactgggctcccagtatgcctaaattttcgattttagaggccctgtaaaactccttggggttttgctagggtgaaaaata

SEQ ID NO: 54535 - DNA, 368 bp, Heterodera glycines
  Genomic contig location: Contig_ID=SeqID_23839; Location=63..430; Strand=-
  SCN-specific regions: Sequence locations=1-29,56-144,235-267,292-294
cgttcacatattttgccatctgtcaaccaatcatcatcatcatcgtcagcatcgtccgtcaacaagttcaacaacaaaacgttcaaaatgtctgcggaatcgccaacaacatcacaacgccgtgctcgcagtcgcaagacgaagaaacgtgcggccagcgctggcgagaccaaaccactgcgacgctcggcacggattgcggcacagaaagcggcgaaggaaaaggcagccaaagtgacgttttcggacagcattcctactccgtcgtcactcattcatttccccttttttcagcagaaagctcgtgacggctccaccgcgtcaacgaagtctgctggtcgtggtcgtcctagtcgctcgccgaagaa

SEQ ID NO: 54536 - DNA, 169 bp, Heterodera glycines
  Genomic contig location: Contig_ID=SeqID_23842; Location=1..169; Strand=-
  SCN-specific regions: Sequence locations=1-169
cgcccgtcctgaggccgcgaagcggccgaatatccccaaaaaaataaaaagacgggcgcgaagcgcccgtcctgaggccgcgaagcggccgaatgtcccccaaaaaattaaaaaacgggcgcgaagcgcccgtcctgaggccgcgaagcggccgaatgttccccacaaa

SEQ ID NO: 54537 - DNA, 750 bp, Heterodera glycines
  Genomic contig location: Contig_ID=SeqID_4463; Location=653..1402; Strand=-
  SCN-specific regions: Sequence locations=1-37,60-192,224-539,564 -611,633-750
atgctgtcaactctggtctttgccagcactgtgttgatttttgtgctctttcttcttcaggtattttttttttccattcaaattaaagtttaccaccccccccccccccacagcttctcctttttgggttgaaggttcgccatgcggtggcaaaccgcttgttgcggcgacagctcgttcgtcagcaacaaaagagtaagtatttatttatttttgttttcataaaaaaccatattttttcttagagctgaaaacgctcagatcgctgcgtcgccagggcgcgcaggagacgccgctggtcgtgttgggcggccgccgcccatttgtggcaccgcaccccgccggcgcccccctggtcgaggtgaagcgatttttgtttgtttttttttcaaaattaaaatttgttcaggcgaatgagccgcctgatgatgggccggtgtacgatgttccggccggctgagtgagaaagaattccggacagtgcggagaatttaggaatatggattttaaatttaaaaaatcgcaacatcagtgaacaatttttgaaattttttccttgaaagttaccggtctttcaagtcaaaaatttgtaaattgtttaatattggtcagaaaattcttgaggctaaaacatgccacaaagtgcttaatggatagcagaaaatgcgctttttataaatgtttttccgacacgaatgagctccagtgatatacgcgaatttttataaaattcagagattctgtaataaa

SEQ ID NO: 54538 - DNA, 805 bp, Heterodera glycines
  Genomic contig location: Contig_ID=SeqID_23844; Location=426..1230; Strand=+
  SCN-specific regions: Sequence locations=1-470,493-805
atggatgatttttacattgtactaccttcgaacacaccgggaccagggaacagtacatcaaaattcacagttcgactccccgagactttggaattgggcacaaattggtcagtagctctctcatcaattatttacccctactcattcaccgcactcggtataaacggtcaagagtttattaaagtatgggaaaacgacagcagtgtccctactcaagtttatttaccggacatgaattttaaaaccgccgggggcctgggaaataaaattaacgaggcattcacacatcattacaaaatcaaaaaacaacgtggaaagagagaagccaaggctgaagataccaaagattcaaaaattgatgtcgcaaagagggccgcagaacgcgccgggagagacgtagaaagacattttaatcagatcaacaatatatcgaattccatccaaacccaactaaacacactacgagaaacaaatcctcaaattttagaagagcctgatataaaaatttggtttgacaaaatggttgagatgggaaccgaaattcaaacatcccgaaatgaacttaaatcttttcaataagaagtagataaagccaaaaacataacattggagcatgtgaaaaagaatgacatgaaagaagcaaagaaatcagccgacgtcgcaaagggaatcgccagacaggcaaagaccaaatatacatcaactctcgaggaatataatgataaatcggaaaagggttttagcgggatggtggttaggcttaacgaggcgctcggtgagcattttaaacgtaaggaaattgaaa

SEQ ID NO: 54539 - DNA, 264 bp, Heterodera glycines
  Genomic contig location: Contig_ID=SeqID_23850; Location=639..902; Strand=-
  SCN-specific regions: Sequence locations=1-264
atggtcgcatcagtttttgtggatgatggaagtgaacgctcattcatccgtgccaatgtggcaaaacaattaggccttccggtgattgaaacggaagaatgccatttgacgggtttcggagagaaagaagccaaacgctacgtgagcaatgtggtccgcgtaggatttctgggagtcaacggagatccatatatatgcgcactcaatgaaatggaattcattgtgaaagcgatgcccatcataacgctgaattcgaaggattaa

SEQ ID NO: 54540 - DNA, 488 bp, Heterodera glycines
  Genomic contig location: Contig_ID=SeqID_500; Location=1217..1704; Strand=-
  SCN-specific regions: Sequence locations=1-409,431-488
atgaagtcaaaggccaagggcgctggggcccatcgtgaagtcaaaggccaaggggcagagtgcccagcagaagtcagaggccaagggcgattacgtgcacacgttggtcaagcgtgggaatgtcgcggctcgaatttagccgcgactgtccgatgatcggacagttgtcgaatggaaagagagcgacgagcgaaagggcaaaaaagggggaaaataatcagtgggcgatgaaacgatgaaaaatgggcaaaaaagtggcaatttggagagagaataacagctcaatcgaccaagcggcgcacatgaatgaacacagaaaccggccctccccgcccaaacatggtccgatggggacaaaaagtgcacgtgaatggagacaacatcaaccaatgcatgtgaatgttctgccgcaaatgaaggaagtcacagcgaagaaagaagagaaggaagagaaaaagacagcccatttgatcagcccatttctctaa

SEQ ID NO: 54541 - DNA, 3384 bp, Heterodera glycines
  Genomic contig location: Contig_ID=SeqID_4465; Location=31..3414; Strand=+
  SCN-specific regions: Sequence locations=1-114,136-478,501-569,609 -715,748-806,842-842,866-966,988-1017,1047-1114,1160-1215,1275 -1289,1311-1387,1492-1657,1704-1915,1937-2048,2072-2509,2547 -2651,2681-2821,2859-2984,...
  SCN-specific regions: Sequence locations=...3025-3062,3099-3309,3332 -3384
  Gene Ontology: Mol. function=cation channel activity; Cellular component=membrane; Biological process=olfactory behavior
ccagccgctcccctacgagtcggcgctgaacttgtggccattctatgcacctgctggttcgtgttcatacaacaaattgacgagttgcgatgccatcagggcatacgtgcttacttgtggaatttggtcagtgaagttactaagtaattaatgaagtcaatgaattaattaattttttatgatttccggaggactaatatttagaaaaaaaaaattcctgaattaatttagttacaaaaattttcttgaaaatatatataattcctaatttcaaataattttaagtcaactgtgcctgcaaaaattgtttacgtggtagcaaatttgtgccttctcatttgtgttccattgcgcttcaccggtctcattagggtaaataaagaaaataaccctcctttataagcaaaccaaattcggatgtttttcaattttaggggtacccaaccccttgaaatccccgctccctaaaagatcggagacaaaaattttcaagaaattttaagatagaagatgctctgttatcgttcgttttgcctggcagttgggcctatgttcttttttttgccaggtttttaaaaaaaataaataaatattttattttaataaaagtccaaaaagggagataaaagccgcttacacttaaattttagaacaacaaaattaattggaccatttgttcaaatgatttacacaatgattgctggagatttggtggaattttttttattattaatatttaaataatttctcagtttcggtttgtgcttatttctacaatttttatggtaccattcacggaaagttcgtataaaataaattttaaatttatatttaaaattttctttttcaattttagcaatgttttttcttggcaaagacatttcaaccaaacaatatctgaatgaatcagacgccgaattctgtccactgagttacagcacgtcgaattacgactcattttttagcacatttttaactttatttcgagtttgcatgaatgcaatttttgtaagaatttttatttatttattttatttatttatttaattttgggcacttttttagtacgaagaattggcatgtgcaaattatgaacagatgatgaaaacactggtatttaataatattaatttaaaaagataaaaaattttattttttagttcgtcctgttcacatttctcatggtactttatttaattaggataatttaccaggaataattaatttaatttaaaatgcttaaaaggttagattaataatttaatttaaaaaatgtttaacagtttatcatgatgatcactcttctgatagccatgataaacaacacttacagtgaactaatagaggaggcggaactgacctggcgtcaacaggcaaattttaagacatatattttaaatccaaaaaattaaatattatttgttttaattaagtttttaaaattgatttctattaaagcagaaaaaaataaagttttttttttaaattaatgacttagatagagaagaagctttcctgagatgaagattagtggatcaattgtcgttccctaattgatccactaatcttcctctcggggaagcttcttgttctttatctcattactaataattaaggttctctcattcatttagtttgagtaaattgaaaattgagcaataaaatagtttttaataataataaaaaataattttattaaatttccagcaaggccagattgtgatggtgctggagcgtgccataaacgcggaaaaattggcggcatgccagctggaatattcagtgcagatgaatgtgccgggcagagaagcgcgcggactgatggtgatcaagcagaccaccaagacgagggcacaccagcgtaaacaggcactcagcaactggaaggtggggtttaaacacgaaaaaaacacctaaaaatatatctgaatttgttcatcaattaaacacgaaaaaaatatcaaaaaatatatctgaatttggtcgtcgatatttaggtatcaaggattttaaaatatttttatccttaaaaattggtaaatttacacgatattttaaaaaattttcattcaccgaaaatttatcgggattatatccattttcggtaaattggtgaatgaaattctcgttttttgccttttccatcaccggataattacatttgcccgagcactaattttttaaacagaaattcgtcaaactgaaaaatatcccaagaaaatatttttgattttctgaaataattttcagttggttggccgtaaagtgatcacgatggccaaggagttgggcacccagtcagccttgtacttgttgcacagccatgatcggctggtcgcgaacgataccgtaggcggtggcgggaccagcgtaccaagaacgccctacagtagcacgcgaccgtactcggtgtttggcgggagcacggcaacattggtaaaccatcatcgactcatgacaagcattggcaaacggagggcggaagaagaagtggaagaaagggatgcaaaacaacgacggcaacaacaacaacatgaacaacagcacaaagaccaactggaacaaactcagtccgatggtgatgaatcaagtgttattgaacatgtactgcaaacaccatcacctagaaaggttggtaatattaagtaacgataaatttatatatattttttattattttgaaatccattgaatcggctttgatcgaatccatctgggaagttttcaatccatcatcatgatatttttttaaagaataaaataaggattttaatatcgaaaaaacaaaaaccctaaatatgaaagcctaaaaattcttaactaaaaatagaaaattttttaatttgtaaatttttatacactaaacttaggaacttttcttaacaaatcttaaaattagattgtttgcaattctttgaaaattttttggaatatttttttacagttaaattttttcatatattttctttcgcctttgaatttccaaatttaaaattcattaaataaaaaaaagaaaatttttttgaggaagggcgattgcggcttataaaacattcgcattgaaaataaatattataaaataaattaaattattttttctagcgccgcccatcagtgccaaattttcagcaaccaaggctgagcataccaaccatggaccgtcaccagcaccaacaacaacatttgatgatgttcgcggaccagtccaaactgcgcgacgttgtcacacatgcgacggtgaacaacatgaagttgaggcgtgcagagctcgaagaggcacaacaacgccacaaaaaacctgtatcggcgcaatttttaaaatttcttaatcagtttttgatccccttaacagatattgcacgccgaggttggacaccagcgtaa

SEQ ID NO: 54542 - DNA, 421 bp, Heterodera glycines
  Genomic contig location: Contig_ID=SeqID_4466; Location=17..437; Strand=+
  SCN-specific regions: Sequence locations=1-38,61-186,208-275,372-421
atgccgagcagtacccaacagattcttgacgacgtggaatttaaagaacaaaacaaaaaatctgttgatcagataaatcaaaatgctccagatttattgaattcgacaaatgatacaactggcggcagaaaaagggctcgtcggcgagttcgtcccgacctattcagagccaaaaatagtccaccgacaaatagctcaaattctgacagaaaatgaaaaaaactgcgtaaatgaaaattctcttgctgaccagtgaaaaacatttttttttgtggaaatatttatttattttatttaaatatttgtttgaatattacatattatacatatagataaaaatgattttaaacttatattataaaatatttaatcttgaaaagttgcaaacgaaattgataccaattttaagaaaatgaaatta

SEQ ID NO: 54543 - DNA, 2008 bp, Heterodera glycines
  Genomic contig location: Contig_ID=SeqID_4466; Location=687..2694; Strand=-
  SCN-specific regions: Sequence locations=1-171,197-397,430-462,485 -526,549-557,606-644,666-857,879-1333,1356-1409,1442-1593,1629 -1733,1760-1910,1946-1972,1997-2008
atgtgtcaacagcaacgaccttcttacccccctcagtatgggccttcgcctcaaccaccaccctattcgtacccatctgctggtccggtagaacctggccaaatggcggttgccattgtggccactgttgtggtcattcaattccgtgtggcattaaaggaggtagaaaacatataaatttttaaaaataatatttgctggagcaaccaattttggcacttttcccccctgcagtggatggtcaagctggcaatggcacttgcccgacatttgtttggtgcatggcaaaactctcgtcgcgagtctcgagagcaacaagatggcggcgcatcgagagccgtagcaaggggcagtactgatgccattcgacaccgacaatatgccgataaaaatgtacatattttattttaaaaattaattacaatatttcaaaaatccccccgccctcccaagagccctcccgaaatactgcaattaaatcattttaatttagaggaataaaatcaaaaagtctcggacttggtagaaaattaaatttttaaaaatttccgttagccaataatagaaaaaaaaattatttttaattattttttaaacttttatttgaggttggttctgataaggacaccgctgttgaggaggaaaatgacaattttgtccatgtccaatgtgctgaagtgctttaccatcccaacgaaattggggaggaggaaatgctcaaacggtcacaattattttacgagctcatgaaaacgcggcgcagcgtccgttgcttcagcaccaaagaaattccgttgaaaattttgcaaaacatcatcaaaacggcaggtgtttaaaaagtgtctcgccaaaatggcaatatattttttaaaattttactgggactaagtgacatttcgccatgactcctttggttttatgccaaaataaagcttattcataggcccaagcaagcgcctatgcctgacctagcctgaagcttaggcctagcctaatccattgtacgagttgtaatgacaccaaagttccacataccaatagcacccagactctggtcatcgttatgctccatgttttctattttgtccataaattttggttttttaacattcaatgacccatcatttttgcaggcacttcgccaagcggtgccaatctgcagccgtggaccttttgtttggttaggaatgcgcgaatcaaacgtgcaattcgtgaggttgtggaagaacaggaacaaatgaactacagcagacgaatgggtgcccaatgggtgttggacgtggcaccgcttaacgtgaattggaacaagccatacttgaccgaagcaccattcctgctggtggtgatgaagcatgtgagacggaaataaatgaaaaattaaacaaaaaaaggatattccatcccaattgatttataataatttaaataaaatttaaaatttcgaataaaggcctatcaacttgatcatatgggtgatcggaaaccaacatattacagtgagcaaagcacatcaattgcagttggaatactgctcgctgcaattcaggtgcaatgcttaattggattatttgcattttgccattattaaatgacatttaattaattaattcaattaattttatttaattgatattctttcagaatgccggtctcgtcactgtcgtcacaacacctcttaatgcgggcgcagcgattcgcgaaattttgcaaagacccatcaatgagaaggtcgcaattttattaaaaattttttttatttgtttttaggtttctcttttactgccattgggctactcagctgaagaatgttatgtgccggatattcaacgaaaaccaattgaagatattatgcggatatattgagattttgtgtttaattaaccatttttaatacatatcatttagtaagcatttttaaattgaattttataaaatgatttttaatggaaaattctatacaagtttatgcctgttttattaattgttttgtttttatgaaaaaaataaa

SEQ ID NO: 54544 - DNA, 3978 bp, Heterodera glycines
  Genomic contig location: Contig_ID=SeqID_4467; Location=25..4002; Strand=-
  SCN-specific regions: Sequence locations=1-215,256-393,415-445,479 -516,538-640,684-807,881-1132,1158-1205,1262-1300,1349-1532,1557 -1611,1653-1757,1829-1941,1964-2300,2343-2378,2404-2410,2433 -2879,2956-3128,3153-3291,...
  SCN-specific regions: Sequence locations=...3317-3467,3495-3682,3708 -3978
  Gene Ontology: Cellular component=actin cytoskeleton
atgacgtcacctccaccgcaacaacgcgagctggcattcagacgcccatgggatataatgtgccaatgatttcgatcttgaatatttttgaaaaaaaaattttttttcaagggttggcaaaacgccaaggaattcgctggccggtgtctcaccaaaccgagtcaccttttccccgttcaccagcttcaatcttacaaaaaccaagcaaatggtcctttaaaaaacattttattatttatagaaatattttttttagactgacccaacctcactgttaattgaaactattgacgatctgaggtacagttgtcaaaatttgttttcatcaattatgcttgtaattgccaatttttatttgtttaataatcattagtagcggagaaagattaaagcataaatattatttaatttaatccattatcatcaggcgttaaaaaattcgatgaaaaaaaaattattttaattaaattgtttatttgttttcagggaattcagtgtgttcatcttcaagaagcaaacccacattggccaacaaaacaagcgtgaaacattagtggatgccattttcaagcggagtatgcgcgagtttcacatggaactgtgcgcgtacacaactttggtgtatccggtaaattttgacaaaaatatttaaataaatttaaaattttaaattatatttaaatgggctgttcatttgaggagggcaacactgtgctgaaataccatgacatgatcaacacttttgagggcttactgtccaaaatgtgccatgaggagcaagtgacatttccgacaggtaaatttgtcaaaaaattatttaatatattttttaaatatttaaaatataatatttttttaataaatttaaaaaaaaatttttcgctgtaagtgttgggtgtgaatgcatttcgcggtttccttaacgagttcatgcagcaacggaagcgacgcagcagttcaaggaggacagcagcagcagtgctaataaaggtagggcaaaaaatgtgtgtaaaagacgtattaaatttttgaaattttggttttgtaaaaaatttgttaataataaaaagatttgtttaacattgtatttatttttcgattttttgcctttaaaagtgaggataaaatagaatagctttttaaaattatttaatatgctgaattcttctaaaatataagcgataaaacagccaaaaaaaggtgggaaaaaattatttatttattaaaaaaagaaatacgaaaactaaaaaaaaattatattggaactattgtagaatggtattaaaagcttaaaaaggccaaaaaaaaaattaattaattaattatcatttattttaaataaaattttcagactgttaaaaagaagcgccgccggtccgatattacagtatgtgccaaaaattgaattcttttaaaaaaaatgtttgcaccttattttaagcttcacaatggtcatcatttcaatttggaatatgttcatattccgacatattgcgaaatttgcaatatggttggtatactgtaatttatggattaattaaaattttaaaataattccaaattttaagtttatgtggcatgctgaaagggttagtcatgtctcgtcttaacaatttatataaatcaatttttaaaaattaagatttttatttgtgtctcatgccgattgtcttgccataaaaagtgccataccaaagtgaattatgtgtgttccagggcaacaactgctgttggcgaaatgccagtaagaaaaactcaaaattatataaataatttttatttgaaataaattcattaagcataaaaaaaaacagaattttttttatttgggaacccaaaatacgacataccttgagttccagattgattgaatttatgtcaactaaattatgcacttgataattataaagaaatttttttagaattcctccaaattcttcggtgccgacctttccaatcttttgcttgatgatgcccaaacagtgcccgttttgctcaaccgtctgttggcaaccattgaagtgaaagcgttgttcaccgaaggcatttatcgaaagagtggccaattggcactgatcaaacagacaagacggcaaattgaactcgctgaaggtagtgagtgcaacataagtatttgtaatgatatttccaattgtaaaaataattttttttttcgcaattaataccctcaaaaaatgtcgggaattaatttcaaaaattttctcagcatgaaaaaatttcatcaaatattaaaactttgaaaattagaggagagggcctttaaaaaaagttgtttttccttaaaaaaaatttttttggaaaagttttaaataatttaatttggaaaagcgggtggttagcacttagggatttttgagattttataaaaaaatatataaaattctcatttttcctaagatcccgactccatttcatttgacgatgtgccaattcatgtgttgaccagcttggtaaagtcatttttccgggaactgtctgagccgctgatcactgctgatctctatgaaaattttgtgaacatttcaggcaattaccgtactcaatttccgctccttaattaccgttcccctccaacaactgtagaaataaaagagaccaatgaccgtatacggtgcctacgcgcaatggtcgaaatgttgccgaagggcaacaaatgtgtgcttgacagactcgtctaccatttgggtgcggtaacacaatgggggtttacggtagccatgcttaataaaaaggggaattacgatgcacctttttttggtacaattccacttgttttttagcccgtgtcgctcatcaggaatctgtcaataaaatgtcggcatcaaatttagcagttatttttgcggtaataatggcactttttaaaataattgcataattttttaattaataactattgtaattaattagtttaaaaaaattaaatataattttcagccgtgcattgtccgccgtaacacatcaacaatacatgcccaagaacaactaatggatgtgcaaaagcaggcggtgagtcaatgttttcggagctttttggggtccaattttaattttgacattattcaattttcagatttgcgtgcaaacactgatcgaagacaaacttcgtcattgccaagaaacactttcccaaattattgaactggaatcagccagtgaaaaagtaggaatttaccaaatttctataattttaatcataaaaatatgccattattttatttatacaatatttaggtgacagagaatctgagactgatcgaagtatgtttgaatatattaataaaaaaaatttaatcaggcttatcttggcatatttttgttgttgcaatattccaacattccaacacattttcgctcgtttaattgcgagagccctcctgcacccgctaatgcgatttctaaatccgtatttcctaaaataaatccatcgagggctctatttttctaccccctccccctcctccaaagggctttatttcagtgaggggttctatttaagcgagtctatattttaggaaatacggtattgtatattatagaagcatcgcttgtccgccagtgccgccgtttcaacggaatgcattgctgtcgatgatcaaactcgcgctggcactccaagcgcaactggtgccggattgctgctgaacacatccgcaacaggcgacaacaccaccaccaccacaaatgcccacatggaacaacagcagcagaacatggagacggcacggcaattgtttgaggagcagctggacttcctagaccgggagaaggcacggctgttgcaagaattgccaccgcttgcgcccgtggccagctcggaggatctgacggacgaagcggagcgtgaaggcggcggcaccggaacggatgtgaccgcagcgacaaataatggaggcggcatttgcggatcagtacaatgccgtagagcaaaatcctcggggaggcaacgttccgttg

SEQ ID NO: 54545 - DNA, 1002 bp, Heterodera glycines
  Genomic contig location: Contig_ID=SeqID_23855; Location=244..1245; Strand=-
  SCN-specific regions: Sequence locations=1-1002
atggaagtggaaggagatgaaaaggccctcgggtcatcagttctgagtgtggaagcccaaatggacccaaatccaatgtcaaactctgaccaagtcgaaattgaaaatgaggaagtggataaaggcgagaatgggcaattttcaaagaaaaattctcgcgattcagatgaagaggaaaatttcggtggtggtaagaaaatggtagtttgccaaatttgggaggacggagtcattgtgattcctttcggtcaagacgaaagaccgggattcgtctttgtggctaatgatttattaagtgaaatttgggaaacgttggccgtgattggatttcaaattcaaaacggatcaacgccgaagccgaagcgacttcaattgcccaagtgacaatgtcacgaacggataaggacgtcagcatcatttccgacattcgaacaaatcccaaacaagggaaccggttggtttacgttgaatttgcggtccccggttttgaggtctgtcaacggctctatccgcaccaattgtcgttacgcgatcaccagcaactccaaattggcgcattgatttttgccacaaccgttcaaattgatcgaccaccggacttagcaattggacagtttggactcttcatattgccggccaaacacgacaaagcttcggatcagaaaatcatttctcataggccaatttgaaacccttcccaagttccaattccccttcagtgccgcaactgacattcatttagctgaaaaaggcatcgcagcggcattgtcgtcttgtttccttaaaaatcggataaaaatggaagagttcgccattgagacaactctccacattttggacaataacggaaggacagttgttgccacttttgaacattttcttgacaacaaacgtaagtttgttgatttggttgaattttgggaggaagatgccgcaattcaagcgagattgaaaggagtaagaaaaaattgtgccaatggacggattttagaggtgaataaa

SEQ ID NO: 54546 - DNA, 531 bp, Heterodera glycines
  Genomic contig location: Contig_ID=SeqID_23855; Location=1..531; Strand=+
  SCN-specific regions: Sequence locations=1-203,225-531
atccgaagatgataataaagctctccaaatttgtccggttccactttgctccgacgaaattgagctgaaagaattcgagtaaaacaaaatcatccgattgaccatggccgttgcagattcgcaggcgctaagcacaacttcatggccctcacaaatgaattcaaaatcgccatcggagtcgtgatttttggcagtttggtacgccagcagaatccttgcctgaaagacccccccctggacatatttattcacctctaaaatccgtccattggcacaattttttcttactcctttcaatctcgcttgaattgcggcatcttcctcccaaaattcaaccaaatcaacaaacttacgtttgttgtcaagaaaatgttcaaaagtggcaacaactgtccttccgttattgtccaaaatgtggagagttgtctcaatggcgaactcttccatttttatccgatttttaaggaaacaagacgacaatgccgctgcgatgcctttttcagctaaatgaatgtcagttgcggcactgaa

SEQ ID NO: 54547 - DNA, 417 bp, Heterodera glycines
  Genomic contig location: Contig_ID=SeqID_23855; Location=1386..1802; Strand=-
  SCN-specific regions: Sequence locations=1-102,124-417
atgcccaaaaagtataaaaaggcgaaaaaggacaaagttggtcctgaccttcctcctgctcctcccccgtctatcgaaccaccggccgcggccattcagtacgaggatttgacctctgatgaggaattggactcgagagccgccggaggcactgccactgctcatcttgttgatcagcagatggaatcccttttggcactttcacccaaaaacaacggcgctatgttggcactttctcctgactcgattgatcgtcttcttgaagacacaaatgccggagaggtgaacgaaaattcaaaaaaaaaatgaaaataatttaagtctgtgcccataacagcggagtccattgaaaaggccctcgggtcgacagttttgaaagagggaggcgaatttgcccaatcattcgggcgaaaatga

SEQ ID NO: 54548 - DNA, 1490 bp, Heterodera glycines
  misc_feature (1464)..(1464): n is a, c, g, or t
  misc_feature (1469)..(1469): n is a, c, g, or t
  Genomic contig location: Contig_ID=SeqID_23856; Location=940..2429; Strand=+
  SCN-specific regions: Sequence locations=1-555,577-1340,1366 -1396,1419-1490
  Gene Ontology: Mol. function=glutathione synthase activity; Cellular component=intracellular; Biological process=neurogenesis
atgctcgaaattttggaggatgtgcacagcggtggtgtcaaacagcatatcactctgctcacacaacgcgcggttaattattagcaattggaggggtaaatcaatttttttgcggttttctactcttattgttaggcatttcaattttgcatgtgtttaccatcacatgtacctacatttattcatccatttatgtttttaaggattacatgtgccatgtaacaacaattgatgaccaaacagagacagcgaggcaacagcaattcgagcttaagcaggttctatctgttgtaaaaatctccgcctttaacaatttgtgttttttttcagattgaggtgaataacatagccgttagtatgggcggattggctcagcgtgcttccgttcttcatcgacgcatgttacaaaaaaccagcaaaacgagagtaattgaaaaaattgactcagttttgcctgaaaatcgaccaattgacacactgactgaaggcattcataacgcttggttggacctgttgttttttcatcagtaaaacaaaaattaataatttggcgttatttgtttaggaaacaatttggcgacccaaatgcaattcttttggttgttgtgggcgaagtgaaccaaaaccaattcgatcaacgatttgtggaatatgaaatggagcaaaaaacgacgggacaaatcaaaattgttcgtctcacacttacgcaatgttcgcaaaagtaaaacaaaaggcaaaaacaaatcggaaatcaactaaactaacaataagcatttttcaaattacaggctgaaacttgacccaaaggagtacactcttcatttggacgcccttaaagtcgcggttgtctatttccgggctggttatgcacctgaggattatccaacccaaacggaatgggaggcgagacggaccatcgaacgatcgacggctattgtattaacccaacgcaacgtttaatcttctttcataaacaacagacattcagaaatgcccatggattggtcttcaagtggcaaacacaaaaaaagtccaacaagttggtggattgttttttgtttgtttttttcgaaatttaaatttcaggttcttgatactcccggtgctgtcgaacgttttttcaagggaccagccgatgaacagaaagtggccgcaattcgtcatgtcttcgcaaaaatgtggggattggatcgtgacgatgctgaaacaaacaaagttatgcaagtgagaatttacactttcagtgtctgttatcagtcagttttcgtcttacaaaggatgccattaccagtccccagcgttatgtgttgaagcctcaacttgagggcggaggcggtaaccattttggggaggaaattgtgagcaaattgcgcactttgactcccgctgaacgggctgctttcattttgatggaaaagatacagccactggtagtaaaggtaggcgtttttgactaattcttgnagagnttaaaaaagcgttattttaaa

SEQ ID NO: 54549 - DNA, 971 bp, Heterodera glycines
  Genomic contig location: Contig_ID=SeqID_23858; Location=54..1024; Strand=-
  SCN-specific regions: Sequence locations=1-480,671-820,843-971
  Gene Ontology: Mol. function=protein heterodimerization activity; Cellular component=mitochondrion; Biological process=positive regulation of growth rate
tttacaggcgaaattacttcgcgactgaccgcggatacgaccacaatgtgcgtaccgtatcctaccgtactacagtatccgtccctcctttaggtcggatacaatcgctcttaacgtgaacagtcagttgtttgtgctttcttttcaacaaactgtgcgtcgtcgcttcagtctttctgcgtaacactgtccaaatgggcggttcgatgctttttatgatgactctctgctggcgcctttctctcgtcccttttattgtcgttccaatcattttggtcgcctcgaaaatctttggcatttattacgatgttagaaggcactccaaattttggacatttgtctgtttagtttctgagtgaaaaggctcaagacgcggttgcttattccaacgatgtggcggaagaggtcggctgaaagggaacagcaaatggaattggggatcgcacgggaattggagatggcatgggacccattgaattggggatggcatgggaattggagatggcatgggacccattgaattggggatggcatgggaattggggatggcatgggacccattgaattggggatggcatgggaattggagatggcatgggacccattgaattggggatggcatgggaattggagatggcatgggacccattgaattggggatggcatgggaattggggatgtcccaaaaaggctggcttttcattcactcatcgcataggttctctcaacgatgcgaactgtccggtgagtttttcattgattgaatcattcacaatttcttttctgattacttactgattatcactttccaattgttcgactttatttttccttttcccctccattcgtaatgaaaggtctttcgcttgtgaagaatacgaatgcattcgattttatgacaaattaaccgacactttgctggtcacaaaacgtaaagcagttgcttacgttgcgtatttgtgggtctctga

SEQ ID NO: 54550 - DNA, 501 bp, Heterodera glycines
  Genomic contig location: Contig_ID=SeqID_23860; Location=93..593; Strand=-
  SCN-specific regions: Sequence locations=1-352,374-374,402-501
atgtgcagtttcttatgcttgcagttgaccaatgcgttcaacgcgcgttcattcattccgatcacttggccgtccaagccgcccacgaggagaagcgttggcgcgcacacgcgatccaacacattcattgcaaggtcgggacgaccgccacgcgacacaaccgcgccgatgggcgtcgaagtgtcagtgagtgcggcagcggctgtcaacgcggcaccggcgccagtgctgttcaaatgctaattttcaaaaaaagaagtccatcctttagcaatcatgtctttcatttatcacgaaattttttttattggtcaaaatgaatgtcaggttcgtgatcagcgacccggaaaacactaagaaccatgtttttagagaaatttaaaaatttttaaataattttagaaaaatgttcgaattaggattcggggtccggaattcacgaaaaaaggatgggatttgtactcaatgcctccaaacaccccccgaaaagtgttattataa

SEQ ID NO: 54551 - DNA, 142 bp, Heterodera glycines
  Genomic contig location: Contig_ID=SeqID_23860; Location=466..607; Strand=+
  SCN-specific regions: Sequence locations=1-142
atgaatgtgttggatcgcgtgtgcgcgccaacgcttctcctcgtgggcggcttggacggccaagtgatcggaatgaatgaacgcgcgttgaacgcattggtcaactgcaagcataagaaactgcacattgtgccaggggcaa

SEQ ID NO: 54552 - DNA, 1396 bp, Heterodera glycines
  Genomic contig location: Contig_ID=SeqID_23862; Location=331..1726; Strand=-
  SCN-specific regions: Sequence locations=1-596,618-630,654-654,676 -862,884-930,958-961,983-1396
atgcatatgatgatatttacaactattggtgaaagcagcaatcgaatcaatgtttatgtggtaagacaatattttatgtgaattgaaggaaaggtctacatacagaaatggcaaaaaaaagcaacctattatacagttaattgtatagttcaaaaaaaaacccaggtcattaattccgccccgtttttatagtcaaaacgccattgtaagccagctggatatttgtgtgggggtcatttttcacgaggtttttttgacacatatgattttgggaatttgaagacttccattaaatttttattgccataatttttgaacgggaaggtctaataccgacacggttttttgagagaatgaaaaaatgtaatctaagggtttaagatatggggaataaaatggttatacgtataattgccaataaaatgtttaaaaatctggtcagttgatgcggtaaattagattcgtgagcataggtatttaaaaaaagaaacaatgctaaaaaatgcattatcattagggcttatattcatagttttttcatccctatgatatgaaacggaaaacatgtttttattttggcgttttgcccacattttaaaacaaaaatgcaataaaaacgaaaatacactctaaaatttaattatttatttattgacaaattttctaaaaacttatgtatttcacctttttttttggttttggataaaattcacgattttcacccatcaatttgaaagttttagcaactatttttccatttttagcaccttttggggtttttttagaaactaaaaattagctattttacagtttttgcaactataaatataagccctaattatcatgcatttagaatcttattaataatgaaattgaatttttagcataccgtcgtcaaaggcaccaacagcgtatatgaagtaatatgacaattaaaaaaaaataaatttaaaaattctcaatttaacagttttgttaaaaacggtttaaattccgaattctatttaaaattaatacatgttatcataaaatcattatcagcacaagaacgatacaaaaccgattggaggacatgcaatgaaactaatcggatggggcgaggaaagcacggacaaaggcgagctggtcaagtattggcttggcgtcaattcttggggcactaagtaaaaattgtcaaaattttgtaattattctgccgaattatttagctggggactgaatgggctgttcaaatggcgccgagggacagatgaatgcagcattgagtcatccagtgtcgactttggcactcccgatgtttaaaagggtttaatggactgagttcttcttaaaattttccttatcactgatagggaatcagattttttgtgatagcctaagttagctgaaaaataaa

SEQ ID NO: 54553 - DNA, 381 bp, Heterodera glycines
  Genomic contig location: Contig_ID=SeqID_23863; Location=87..467; Strand=-
  SCN-specific regions: Sequence locations=1-381
atggacgcgcaacagcttcaacaattgcttaatgcactgcaacaaatggtcacaaatgccgcaccgcaaaacgccgcaccagcaaatttgagcaatgccaatttggcaagctctattgatgctcggctttcagcattcaattacaatccggaggtcggcaccacatttgaaagttggttcaaacggtacggaaaattgatcgaggacgacggaagcactctgcctgaggcctcaaaagtgcgactccttctcggcaaacttggagaggaggagtacaacaaataccgggacacgatcagccccacacagccggaccaagtgaattggaatgacaccatttcgcacctcaaaagcctttttgctgaaacccgctcgctgttc

SEQ ID NO: 54554 - DNA, 1524 bp, Heterodera glycines
  Genomic contig location: Contig_ID=SeqID_4468; Location=43..1566; Strand=+
  SCN-specific regions: Sequence locations=1-704,728-983,1019-1049,1071- 1524
  Gene Ontology: Mol. function=cytoskeletal protein binding; Cellular component=actin cortical patch (sensu Saccharomyces); Biological process=cell proliferation
tcgctcgaatcgattataaaagatggtggatctcatgcaccaataagaagaaagagaagcgcaattgagccaacatcacctcctaatgcacgtattgtgccaaagtcgcgtccgaatgtcactaaaaaagtcatagtaccaacatctcccccacgtgtgggacaagaacatgaagaaaatgcagaagaaatctctaattcattaaccaatgtgaccaagccaccggaaaaacaacaaaaaattgaaaaacaacccgaagtcgtaaagccacaaaatgaaaaacaacctgaagtcgtaaacccaaaaaatgaacaaataaatcaaacacaaaatatttcgcaccaaaatgcacctagtccaaaacctccaccacctgcttcaattccgactacgaaaaaacacgaagaattaaaaagcaccattgatccaactccttcagtttcaaaacctccacctccattgtcagtttctaatccggttgaccagaatagaaacgtgtcggtcaatcaaagtgtttcaaaaaaaaaaaatattcctcctccatcagtttcaagttcatcaataaatgtgcctaaaaagcaggaagaattaaaaaacagcaacggaccaacagtttcaaagcctccgcctccatttccagtaactagccaaactacagtttcaccagttcagcaaataacttctgctcaaagaaatgatactaaaccatcatcatcatcattgattaatgaggagaaactgaaggaaattggcccgccaccaaaacaaagaactgaaaaaagtatagtcgagacggtctcaccgacacctccaccagctgtacccacgcactccaatgctacagcgaaaaaggccacttctcctcctcgagttattgccaccgacattattggaccaccaccaaaacagagaactgaaaaaagcttaaataccaaacatgtgcaagcacagcttgttaacgaaataatcccagagactactaaaaagacaacaataacaacaacaactaccaccacaattaccgaaccaccaaaagacacaattgatgattttattgggcaaattgaaaaaccaacgaaaagaaacaatgcagagcagttgcttgctgtcttgtttggaaacgatgaatggaaaaaagttaacttgagaattcttaggcaaatcattgaaggagttgagttacagtatcatcccaattttgaacgatttaaagcggtttttacacatccgagaattgaatatatctcattttcgcctcagctcggctatgtgttgggttttgaaaattctcaatatgtaagaaataatgaaatagccaaatacggaagtgatctccgtggtggattcgcaagctttgccgtttacgcaaaaggtctaaccgagaatatgattgttggaaattcattgagctcactccttcgtgttgtctctgtgtcgggggcggtaccaggcgaatatacggaaaaaatttacgactcaccgctctatggcacgtgttctaccaaaagaagtatcagaaattga

SEQ ID NO: 54555 - DNA, 2872 bp, Heterodera glycines
  Genomic contig location: Contig_ID=SeqID_4470; Location=199..3070; Strand=+
  SCN-specific regions: Sequence locations=1-249,272-447,478-909,951 -1493,1532-2021,2060-2872
atggacagcaaccaaatcaccagaattttaacgtcgtccgaaataacgagccgcaagttccttggatgcttcccatgcgatcaactacctgagccgatggccatacgatttccggcatcattgattgttaatttggaccctcatcagtttcccggctctcattgggttgcaatatttgttaatggattaaataagaaggtcgattactttgatagtctatcgttacccattaatgaattggtagttaaatcctttcttaatgtctttcctggaatttattgtaaccagaagccctatcaatcagtttcatcaaattcatgtggacatttttgtatttgttttgtttattttttatccattggactaacttttacccaatttttagacaaattaaattcttttcataatccagaaatgtttgttcaaaattttattcgcaattttccgataaaataaaaataatatatatttttatttgccttggatctttttggctcactccgtagaagggatttagtggagggaagggaaagcaaacactatatgccgttcagtgccagtcaccaatgactgcggagggaaccgctttctttcatttaaatatgctcagagagtggtatatgccaaaaggtcaacagggcgagtgagctttgccttcacaaaattggcgaatgctgattggttgaaggagaggtcaggaaccaatgaatgccgatgggagtcattccattcctccccgaataaatggttttctgaatgtgtaaatagagcgagtgagctttgccttcacaaaattggcgaatgctgattggtcgaatggctcttttcgtattctctcttctatgatgctcattggcggaatttttgtgcaaagacgactgaattaaccaaataaacgattttttgttgaatatattataaaataatacaaatattttatataaaataaagaaattacaaacgaaaattcatcgaagagttgcttcgggaaccatacaacgagctttcgcccccacaaaagtcggcaaaagattacgtcaaaaaactcgactcggaaattgaacacgttccaaaatttcaatgggttaaaaacaagtctcgcttcgccattgaagacgtcccttccgacccagagggcttattgattggcatttttcaacactgtatggatgaatcgattagtgacagccggtcaagaggagttgagccgacacacctcggctgcattgtttccagtgcactccttacttcggatatatggattccaattcggcaaatgacttcagacacaataaacaccattctcaaccgctttaacgacgtggctcaaagcaaaaaacaggatggtgtgacgctttggggcgacccatttaccgtaaccatgacaacagtcaaccgaaacggactaccagccaaacgacaactgaaaggaggcgcagcgcggaagttaacacatgtccaccacagagttcacgaacagtgtctaattaaggtttttaattaataaatatttttaacttatataaatttagatcgaaaattttgatggagacaactattgtctattttatgctttgcaagcaacaatgattcgttctgttgctggattgacacgccaaagattttatgactacatgaatgggaaccgtggattccatggaaggctgaaaagtgaagcagtggacatgatgaatgtcgtcaaagcaccgccaaaacagccaagttatgatgctgaaagatatgtcccgcgggttattgattggtggaacaacgttaaatttgctggcgtttggaaattcaaggcattcatctttggagcaacgggccattacaagcctctgttcaaatacggcccggaggattatgttgtgccaattatcctttattttgaagatgggcatttcaacggggtgcagaaaagcggaaaccttttcggaaggccttattgcttgagctgcgaaaaaacatatgaccgaccaaaacagcatactttaagctgcaagtctcgctgcattaaatggttaaaatattttaaataaaaaattttcaaattaatttagttctcaaatgggaccaaatttcccttgcaagccagccccgggctttcgacaaaaatgcaatggatgcaataaaacgtttttcaacgacgaatgcctgcagcatcatctttcttccaatttttgtcaaatgagcaaagagtgtaaatattgcggggtcgtttgggacatgcacaacaacaagagaaatgggcgagaggtttttttttaatttgttttaatctgttcaaatcaataaattgtataagggtcataagtgtggtgaacgatggtgtgaaaattgccaaatttttcatgaatttgagcgaggttgttttattcggcctttggagccaaacaaaaagaaggaagcagtggggtggcggcttgttacgttcgatgtggagactacgcagcaccaagccgtcgaccctgattttccagaacgacgaaaacaccaagtcaactttgtcacagcaaacgtcgcttgtccgagctgtatttcgtcgggaatgtggaaagaaagcatgcgtggcaaattctgcaatatttgcggctttcatcggacaataacattcagccaaaagccattctgtgagacaacagtcgaccgacagacaatcgatcgtcaccctctcgtcgcattcgtcaaatggattctctataaactgccaaagaaatacgacacagttgtctactcacatttcggtggacgctttgacatggtcttggtctttcgtgagctcttcatggaaggactaaacccgtcaatgatcaaaaaggggaatcgcttatttgaaatgaaggcaaacattgattggttcactatttgttaa

SEQ ID NO: 54556 - DNA, 820 bp, Heterodera glycines
  Genomic contig location: Contig_ID=SeqID_23866; Location=362..1181; Strand=+
  SCN-specific regions: Sequence locations=1-613,635-820
atggcaaaccatccgttgcaaaaattgaaggatgtgtcaatttatcgtaaaaaattcttccaatggtctacagaatggtcaaatcaacggtccaaaacgtcggatatttggtctgacacttcaaacgcattcataaagttgtgttttcaatttctttcaatttttttcgtcaaacaatttagtcttacggcacacggaatcagcaaaatatttgtcagaaaatcatttgtactgtctgcggcccacacggaaaacattgtcgtacgcggtgcgttagacagaaatgagctgtaaaaaagcttcttgctaaatgccgccgcattgttgggcactataaacattcaccattggctacaagcattttgaaaagaattcaaaaggatttgggcatctcagttcatacacttttacaggttgtactcccaaatgtacattcaatccaacgcataatttttaataaattaaggacacgccaactcgatggaacgcggcatatcttatgatgcgccgaattgaggagcaacaagaagcattggcacattacgcaattcaaaatcgaaaatttgattttacatttgatggcactgaaagcaatttgatgaataaacttctgaaagttttggatccaatggagcaattaagcagattattctgcctaggaacgtcttcaatttccgttaagtacccgttcacaaaattaacaattcaaaatctggaacaaatggagtttgaaaaccacgacgtaagcgaaatacgggatcaaattgtcgatggattgaagacaaaaatttttggctgtaaagatgaaaggtctaaatag

SEQ ID NO: 54557 - DNA, 455 bp, Heterodera glycines
  Genomic contig location: Contig_ID=SeqID_23867; Location=400..854; Strand=-
  SCN-specific regions: Sequence locations=1-455
atgaccatccaggatcacttcgagtggtgtgacattgccgaatttgtgcttgagaatggcgataacgcattgcgaatagtcactcgccaaaacattgccattctgatcagtggacaacaaatggccatcgtcaaaaaactgatcgagaactttgtgatcggtggggcaaaggtaaaaaaatgagagggacataataaaaaaagagacagcggttggagaaagcaattaactaattattcgtttagcggcgtcgttttgtggttgcagtttcctcctacggcactcgccagcccaacattctcagtttcgaggcgggggattacattcagctgatcgaccaaccacactcggaaatgccttcgatcggcggccaatggctttttggaaaggtgggccaaaaggaaatgatgaaaagcgggtcaatcaatcaatctaatggttctaaactctgttaa

SEQ ID NO: 54558 - DNA, 277 bp, Heterodera glycines
  Genomic contig location: Contig_ID=SeqID_23869; Location=177..453; Strand=-
  SCN-specific regions: Sequence locations=1-79,112-277
atgaagcaaatggaacaaattttggatgctaatatcagcgattttttgatatattgtgaaagaaatgtgagagtttttgaaaaattaaaataaaatattaaatatttttaaggattattttcccattcaaattgcgtttgggattagttttgttgaaaatttaatttcttatacattaataattatttgtggctacaaaatggccttgctcataaaaatttggacaaaaactgaactcgaaggaaacaaattaaccggcaaattacaaccaacctga

SEQ ID NO: 54559 - DNA, 187 bp, Heterodera glycines
  Genomic contig location: Contig_ID=SeqID_23872; Location=1432..1618; Strand=+
  SCN-specific regions: Sequence locations=1-69,99-187
atgggacaactgaactcctatttcttctcgccggaagaccattcgtcgtccgtttgtgctcagcccgtgctgatggagaaggaggaggagggtgaaaagtcgatgaacgacctggtgaccgcttcgtccccaacagaagttcgtcctgcttctcctcccgcttcttcctccgtctccgttccgccat

SEQ ID NO: 54560 - DNA, 1246 bp, Heterodera glycines
  Genomic contig location: Contig_ID=SeqID_23874; Location=71..1316; Strand=+
  SCN-specific regions: Sequence locations=1-401,439-466,488-565,632 -674,696-783,805-863,900-1049,1181-1246
atgagcaatagtccagagcagttgggcacatggtttttggagagatgccaatcccattcccatctgcactatgttgggtgcgaaaatggtgagaagcttggatccgggacatggaccggtcagccctctttagggcctacaggtgaattgccatttagcgctcaacccaataacgtgccaacacctggactaagggagggaggagggccatgacgtgcaacgttagggcacttccggtttccattgcattatgcgatgtgtcaactccaattattggaggaaaccaagtgcatgtcggctgacgcaaagaccctaacagactaaaacgcgcctaggtagcgaagctcaagaagcgcgcagcgctttcccaagcgccaccctcgcatgcacacacccgctagttttaaatttaaaattgatttttattataaatattttgataatgaagtagtgtattttgaataaatctcttaaaaaatataaatttgtaggtgagtataaaaaatgttcatcagatcctatgtcgcttttcccacgggtgtaaaaaatttcgtttaaaccacagaattttatatgttaattattattttaaatattatttttcattacaattttttgtttttttaatattgtcaaattacaatgtacatacatttagttttctccttttacgatttattatatttttgtaatttgaagtcttaaatttttatattgcatatttgtcagttattgtttaagggttaataattacttataattaattgcgttaatttagtacagaaattataaataataatttttctcacccttattttcgatatttttatttccataatcgattatatgccttttccgttatctatttaatgtatttatttttcttatttatatataatcatttcatatgactcggtgcttaattttagtttctaatgagatttattagttttgataatttttagtggattatttcgcttttttttcttgtcaagtaatacccgttttactcctgagtatgttgagcatgcttttcattaaaaatcaacaaaaataattaatatcttttaaattaatatttttaaaggaaattatttataatatgattatatagcaatttcataacaatttatttaaatattattacaaattcttaatttatgaattaaaaaaattttaacaatataggtctaaatatgaaaattccccatagtcttttgaaagaaacgcgaaattgccgggggca

SEQ ID NO: 54561 - DNA, 975 bp, Heterodera glycines
  Genomic contig location: Contig_ID=SeqID_4471; Location=105..1079; Strand=-
  SCN-specific regions: Sequence locations=1-184,207-581,603-789,811 -945,973-975
atggccaataagctcattctcctgccttttgagcattaccgaggattagttgcagcgagagagggtgtcggcgttgcgaaaggagacgacgatgtggcagagcagacaaatttgggattcgtcaaacgacagctggagaccgtgaagaggaaacggacagcgaatgtcagcgaacgaaatgtactgtacaaccagcagctgaggagatatttgaagctgagaaaggaggtcaaggacaggcccctcaaggtacagctaagcaacggtgcgcaactgctgaataagacggtggaaacgggcgtacaggtacggcctggccccgacgagccgaaggacaactccgtattgattagcagtctcatattaatttcacaggtttggcacaaagtcgtaatatcattcagctgccactgactgtttcgtttgtattcagtaaatcgctgatgtcgatcccgtagctcatgtttcacacgtagaaactcaaacgcccggaagagacaaaagttgtcattgtttgtcagctcgaaagttgtcccatcgcagatgctgtacgggatgttgaagtcgggtctcctccctttgccagccagcttcttcctctgctttccgctctcgatcgccgtgatgtcgatgacgaacgattcttcgcagattgagggcctttccttcgccttgttgctctggtcgacaatctcaaagcgcgtcagaattgtctcagccattgttccgtcgatcttcttgatgtttttgaagtgcacggcaatctcgtagtcaaggtggcgtgccgtcagaaggaagatgaagtggttggccacgatgttcatggcttctgctcccttcattgcgtacgtaagacacaacaggaacaggctcttcaacacgtcttctgggtagctcgaattccaaatgtagtccagcataaaacggcccaagaaacggtatgctaaaatggattttatatttatttagaataaa

SEQ ID NO: 54562 - DNA, 784 bp, Heterodera glycines
  Genomic contig location: Contig_ID=SeqID_4471; Location=1069..1852; Strand=-
  SCN-specific regions: Sequence locations=1-354,376-675,701-784
atgctgaaaaagttgccaaaacccttccttattgtctacgatgacctcatgggcgacattgacgcgaagaagttggctgatctgtacaccaagaagtcacaccacaacaacttttcggtgatattcctcacccaaaacctgttcgacaaggcgatgagagtgccaaggtccaatgcgcaatacatctttctgatgcgtgcgcccagcgatatgttgagcattcgtaatttggccagccaaatgtttcctcgcgagcaagggtttctgatggacgcgtataagcaggcgtgtgccgatccgtacgggtatctgttggtgaccctacacgcaaacacagacaacctcttacgactgaggacaaacattttcccagacgacgaagaaaagattgtctttgtacccaaaaatggttaagaagcaaatggttggacagcgggtgttggacaactacgagtatctgaagtcccttgggaggacgacatctcacaagaagaggcgtcatttgttgagcagtgcaggttgtgaagagctgttgaccctggtggagatttgcttaaacctacttaacggatccttctgtttgacgcggaaacagaaacaaaaattgttgccttttgctaacaccattcgacggttggcacgcgtgagaagtgagcagagtgcgagaaagctgatcttacaacaacaacaaccacagcaggagggaggttcactgtttgcccctttgttggcacccatactgttagaggcggctcgttatctgctgcacaaagatggccaataa

SEQ ID NO: 54563 - DNA, 545 bp, Heterodera glycines
  Genomic contig location: Contig_ID=SeqID_4471; Location=2665..3209; Strand=-
  SCN-specific regions: Sequence locations=1-247,270-545
atgcccccactgacaacagccttatccaagctgctgaactgtaaagctgagaatttggcagagtacctgaataacccggaagctgtgaacaaggcgagtgcatacctgcgaggaaagaagctcaagacaacctactcgaacaagggcggcactacaaaggaggtcgagtttggcaacttctcgaaaaagtctgcttcggagacgtacgccttcgagggattccttggcaagtgtcttttctgcaagcattccctcactttggaaagttcagaggtcaaagttcaccagtacttctacataaagcaccggatccgcctgttgtaccctcagctgaagtgcatcgttgagtaccacagcaaaggtcattgcaagtactatccgttgggtaagctttaggctgcgatgaaagcccataatctcgcacggtttcagagttgttggccatagaggacagtgcagagataacaggcgaaaagccaacagacaccaactacttggactacctcggcttccgaagtgtttggcagccaacccccgtctattga

SEQ ID NO: 54564 - DNA, 811 bp, Heterodera glycines
  Genomic contig location: Contig_ID=SeqID_4471; Location=3430..4240; Strand=+
  SCN-specific regions: Sequence locations=1-47,88-811
atggctcctcgtaagcagaatgagcagtttttggacgaaatccagagtaaattttaaaataaaacacaaaatataagcattttatagaagcgaaccacgtggaagaagcacaaaacaatcaaagaaaacataaaatgggtaaaatttttcacaaattttacaaaaattttggatttttttctcatttttccatgtttcagatagtgatgacgacgtcaagttggttgactctcagtcatctcacgcagaggaacgccctgtgctcaagaagaggggccgaaagtctcgctgggaaaaactgctggaggacgtgaacaacgcaaagaaagccaaccccgcagaggttgaagtcgcagatgtcgacgaacgcaaagcagccaacgtcttcgactacccaacaattttctggaagctcgcacgtccaaaggtaatgtttgctctggtggcagccctacaatgttcttcttccgttgcagtatggggtgttcacctttatgtgcaacgaatgccgtaacgaaaacttcaagcgaggcgacaagcgcttcatcctcaacactggcagtggccaagagaagctggagttcacccaaacattctgccaagactgtgccaagttgaactttgactgcaccgacctgatcatgaaacaccaaaagaaagatgacggaccatctgcacagaagaacggaggacggaacacctattttaagatggaaaagtgatctctgatcattcattcattgatttttcgttgaaatgagcaactctttctttgtaattttgcccagcaatacgccgggatttgtcggca

SEQ ID NO: 54565 - DNA, 2227 bp, Heterodera glycines
  Genomic contig location: Contig_ID=SeqID_4471; Location=4502..6728; Strand=+
  SCN-specific regions: Sequence locations=1-177,210-226,445-465,489 -582,606-860,884-1234,1256-1593,1617-1686,1708-2227
  Gene Ontology: Biological process=N-linked glycosylation
atgcaccatggcatgatagcggaaatggaacgacacctgacccgaaaaaggtcaatacagtacccggatgagggggagattgttgacatggaagtcgttgaggaggaagagcctgaagaagcaccattaaatccgttgaaaaatcgcacaaaactcgcccaacttagcttgaagcatgagcgagacaaaaaagagagagaggaggaggataaaaggcgacagcagcgagaagagcagcagcagagaaagcagcaggaagagcagagaaagcagcgagaagagcagcagcagagaaagcagcaggaagagcagagaaagcagagagaagagcagagaaagcaacgagaagagcagcagagaaagcagagagaagagcagcagagaaagcaacgagaagaacagcagcaaaaacagcgagaaaaggagcaagagaaggcaaagaaatctgaggctgaccgcgtagccaaagagaagaagtcagaaaaggagcggttggcaaaggaggaagaagaacgactcgccaaggagaaggcggaggaggaacgcttggccaatgtgaaaaaggaggaggaacgcttggctagagagaagaaggaaaaagaagacgtacaactcgccatggaggcagaggagggccgtttggccaaattgaagcaacgagagttggagctgctaaaagagctgaagccgtggcgtggtggctacatgcgactggtccacggcaaggacccgacccccgacgttcattatctgcacgagaaggatgattatcactttgtgaatgctgtgcacaagtacattgtgcgacatccggaacttccatgggactcgccggagtttaacccatcagcaaacattcaacaaaacatcgcagaattccggaaaatctttgagcgcgaagttttcgacgaaaattatgagctaaagacaagagaggagaagaatgagctgatagagctggtcaagggatttcgattctatttcgcggacgagcttggacgttttacgctaaggattttcagcgacaaaatatcacacatcactttgacggatcagctggcctacgtgttgggctacgaacagcagcaagaaattcataacgaagaccaagccaagtacgctgttgacttggccggtggtgtcagtcacctgtgcatctacttaaacagcggaataatcgagagcatgatttttggcaactccttcgccaatctcctccaagtgattgcggtcgagggtacgtcgggcagtgtggtcgagaaggactttcagtcaccgttgttccacaaaattgtggctagagaggtggacgtactggacgttgagattcgtacgctcacaggacggtagtgttgtgattttcaaaatattttccctactttttttttggtttaagagaggtgccttttgaatttggccaagttgtgctgactcttcagtttaaaaaagtcgtaactttctgatacaatggtccgagttatattcaacgggtcgaacttgcggttggagaattatcatcagcagggtggcagagggaagagaaggcatgaaaaccttgctggacaaggcgtccgcatcgctacagaagggcatagggagaagaaggaggaagagagggacgaaagccgagatcattttaaaaccctcagacattgttggacaaactgttccccagagagctctgttgaaaaagaaaagatttgattcccttggttattattaatcggcatgttgtataaaaaagttgatgctgcgagtgcagaggtggtcaatagcggattggacttcttcagtacaccgccaacaaactgtgcggtgtccaactccagctatcgggagtacttgacgctgaacccgatcagctcaaggcctttccattttaaggcaattgtttggcaatgtataactcttatcagtgtttgttcagattcatccgatcaccagctacatagacctcagcaaagtgtttgtgtgcacggaattcaagctcaagaaaatcgcagaagacggagtggtagttgacgtaccagccaacgcggctgttggccttatacaaatgcccggtgcaactttcatccgcaatctgaaggtgcacatcaaccagcgtgaggtgtacgactccaaccagctgtacagctacaaggtgtacctggacaccgagctcagttaccctgcggcaggcaaaggatgcctactttggcgtggcgggctattttcgagacagtga

SEQ ID NO: 54566 - DNA, 365 bp, Heterodera glycines
  Genomic contig location: Contig_ID=SeqID_4471; Location=6832..7196; Strand=+
  SCN-specific regions: Sequence locations=1-365
atgatcagcaatgtcgagattgacattgagctcgcactgcagtcggacgactttatgatccaccaggacactgcgaataaggacaagtacacggttgagattgttgactgcagactgatcgtgaagactgtcgatttgatggacgggctgagtcttgacattgccaggaagttggacactgagcctgccagatacggaattcggaagtcattcatgaaatcgcttttcatcactggtggtcgttatgacttctcggccaacctattcacggagaggtgccacgaagggttgtcattggcctggtgtccaaccagaattatattggccataatcagaagaatcccttctattttaatcaccacaac

SEQ ID NO: 54567 - DNA, 80 bp, Heterodera glycines
  Genomic contig location: Contig_ID=SeqID_23876; Location=581..660; Strand=-
  SCN-specific regions: Sequence locations=1-80
atgaggtgcgcatcatttgcaaacaacaatttgtcatccaccgaatccaaagtcgtgaaggccagtacagactgtgcaag

SEQ ID NO: 54568 - DNA, 332 bp, Heterodera glycines
  Genomic contig location: Contig_ID=SeqID_23877; Location=901..1232; Strand=-
  SCN-specific regions: Sequence locations=1-140,230-233,255-332
atgcgcgactttgactttctgaaggatatgcactgcaacataacagaggaatttcgacgaactgttaacttcatagaaaattgttataaagacggattcaaacagccgctgattttgttttgccaacgagcggtaagaaataattgaatttaaatttaaatagacattcaatttattaattatttaaattaaattgaatataaatttagtaaacatttaatttattttaggattatatgacacatgaaagtgaagagaacaatgagaagaaattggaattaaagcaggtaacaattgaattttattttcaaaaattgggtaaattggactaa

SEQ ID NO: 54569 - DNA, 1362 bp, Heterodera glycines
  Genomic contig location: Contig_ID=SeqID_23879; Location=66..1427; Strand=+
  SCN-specific regions: Sequence locations=1-562,584-1269,1291-1362
atggcggacctgcagaaatttgaagactggtacaataacaactatgaacaatgcttcgaccttaaagaaaaattacccgaatactgctgcaatgacgtccaaatccttatccacgctctcgtggaactgcgcagggaattcaaacaacttacacaacggcacggaaaacacggaggaatcgacattatttgccaagccattaccatcgccagcgcctgcgtcaaaaattatgcactcaatcacttgaaaccaaactcactcgccatcgtcccggaaaaaggctacactcctcaacaaaatcaaatcgctctggccatcaaatacctcgactggtactcccatatcaataacgtcaacattcaaacggcacattccctttacggcgaatatgtgtttaagcgtgaaggacagatataccaagtggacggctacataaaaggcacaaatgggaagcgggacaaaattatagaggtgaatgggtgtctgtggcacggctgcgaggagtgttttgaggagatggacgacgaaaagatgtcaaacggaaagacgctgcgggagattagggaaagggaagagaagaaacatgaaatattaagccgttacgtcgacttggaggttatttgggaacacgaaataaatgagaagctgaaaaaggacacagcaatgagggagtttttcgacaactggaaggaccgctcgccaatcaaaatcagagacgcttttcatggaggacggacaggaccaatgaagctactccacacagcaaaaccgggacaaaaaatcagctacaaggacttcaccagcctctacccgtggaccaatttctctacagactatcccctcggccaccctaaaatcatcagtatcccaccaaatgagcagacggtcaactggcgctctccatccgacaacccctacaaaggtctgctcaaagtgctacttctacctccaaacaacaacatcaacgtcactgttatgcccataaaatttgatcaacgcctcctcttccctctctgtgagaagtgcgccaaatacatcacagcaaaatatcccaatggcctcaaagacaacgactattcctgcccacacttcaaccctaacgaccgcgcctttgtatcaacctgcactcatcttgagttaaacgcagcactggaagccggctacacagtccgcaaagtcttccacgtcctccaatacgaccaatggagcgacaatgtcttcaagtcttacgtgagtgaaatgatggccctgaagatccacgcaaccggcttcccgtcatggtgcagcagcgaagaggagaagagtgaatacattgaggagtgctggatgaaatttggaattcatctggagaagagaagatga

SEQ ID NO: 54570 - DNA, 757 bp, Heterodera glycines
  Genomic contig location: Contig_ID=SeqID_23881; Location=670..1426; Strand=-
  SCN-specific regions: Sequence locations=1-757
atgtcattccaatctctgggactcaacccactagcatttcaagctctgagactcaattctcaggctttccaatcgctgggactcaacccaccaacatttcaatctctgggactcaaatctccggaattccaaacactgggactcaacccaccaactttcattggcattccaatctctgggactcaacccaccagcatttcaatctctgggactcaacccaccagcatttcaatctcggtgactcaaatctccggcattccagacactgggactcaacccaccagcatttcaatctctgggactcaattctcaggctttccaatcactggaactcaaatctctggcattccagacactgggactcaaatctccggcattccaaacactgggactcaacccaccaactttcaatgacattccaatcactgaaaatcaagccaccagcattccaatacttggactcaacccaccagcatttcaatctctgggactcaattctccggcattccaaacaatgaaatctccggcattccaaacactgggactcaacccaccaactttcaatgacattccaatcactaaaaatcaacccaccagcatttcaatctctgagactcaattcgcaggctttccaatcgctgggactcaacccacaagcatttcaatctctgggactcaaatctccggcattccaaacaatgggactcaaatctccggcattctaaacactgggactcaacccaccaactttcaatga

SEQ ID NO: 54571 - DNA, 973 bp, Heterodera glycines
  Genomic contig location: Contig_ID=SeqID_23882; Location=123..1095; Strand=+
  SCN-specific regions: Sequence locations=1-75,97-309,367-496,539 -659,696-899,942-973
atggaaaacggagtgacaaagtgttgttacagcgccattccgaacaatgatcggacagtagcagaaaatgagcaaggaaatgggcgggaaatgagtagcgacggtgatcaaacgggagcagcaaaaggcatttccatgggcaaagggacggcggcgccgtttcgcgccgctgaacgccgtccgatacgttttgccaattttggaatgggcgccagcctacagtattcgtgccaatttgcacagtgacttggtcaccggactgaccgttggcattatggtagtgccacaaggtccaattgatcatgagcgaaatttatttaaatatcaataattttacatttttaaatttaaaatgtttaaatttaagggatggcttatgccactttggccggcgtcgacccggtttatggcctttattcatgctttttcagtgcattattctacatgttttttggcacttccaggcacatttcaattggtccgtttttggcttttgtattttttaaattaataataattgtaatttatgtttttaaatgactttcggttgaatttattaattgccataatataaacattcgtaattatcggcaatcataatttcttttatcaaaccacttaagatggataattaattaggtggctacttatgaatttactttatattttaaaatttaaaatattaaattttatttccccttaggcacttttgccgttgccagtatgatggtgggcagtgtttgcgcaaaatttttgtcacccaattcaaacaacaacggcacatcggctccggagacgattatcggaaacgatgacatttttttggacgatcaaatcactccgctggtgttgaccagcacattgacattcggggttggctgttttcaggtcactcattcaatttaattaattaataattttaatacatttttataaattttgaattgttcttagttgtttaaaatataattga

SEQ ID NO: 54572 - DNA, 297 bp, Heterodera glycines
  Genomic contig location: Contig_ID=SeqID_23883; Location=868..1164; Strand=+
  SCN-specific regions: Sequence locations=1-48,72-297
aacttaacaaattttataagtgtctgatcgcccgaccctttccgacttagtttttgaagtcagcagaaacatcgaccgacaagtggacgcagcgaattgagctcggaatttcgtgcactataaaaattttgaagattcgatcatacaattctcttttttcgattcattcaatatttaaaaatatcattatttttcgtgaaaattgttatttatttatgcgattctggtaaagtattaatgaatttcgtattttgaagccttaagaatgtaattttaagactttttcgctaattttta

SEQ ID NO: 54573 - DNA, 313 bp, Heterodera glycines
  Genomic contig location: Contig_ID=SeqID_23884; Location=696..1008; Strand=-
  SCN-specific regions: Sequence locations=1-126,149-157,180-204,226-313
atggacgcggcggaaccaatcaaacaaaaaaggatttacaaaaagcaaccaaaaacaccaaaaaaatgtttaatttgtggacgaggtgcagcgttcaaatattacaatgtgcaaagttgcaatggtaagaataaaaatgaactttcaagcatttcactaaaatataattattaattaatgagtaaacaatttgttgcttaaggatgtaaacaattttttcgccgtatagtaaatagtcagcgaacgttcacttgcacagaaacaaattcgtgtattttaagtgatggtaagtaattttattaaatcaaataaa

SEQ ID NO: 54574 - DNA, 784 bp, Heterodera glycines
  Genomic contig location: Contig_ID=SeqID_4472; Location=1646..2429; Strand=+
  SCN-specific regions: Sequence locations=1-1,101-167,190-318,340-784
atgcctctggcgccgctgctgctgcttctgctgttgttcatgttcctcctccctctcttcctgcttgtgatggctctgtggttgtgttgctggtactgctccaggagctacgactgtgccctcctcttcaccgacgaggccgggcgagaacgcctgttgcttggcaacttgttgctgttgttgctgtcgcaagtgcgcgaccatcgcttgcattcgcaaccgctccaggcacagccgttgctccagtgagtcgaccaggtcaatctgggcatggcactgctgcgccgtcgcactgctcgtggcgtcgtcaacggcggaatggcactgggacaaatgggcgagaaaggcgggcaacgagtcgcagggctgaaaaacaaaaacagggggcatcagtcgccaattgccgtcttgaaaccagagaaggaatggcaatttgtttttatctatcggtccaaaaatgaaaatgttgtcgggatttttcggcaggattttcatgcagattctcattagttagggaaatacaagtttccgcgtggctcagtcggttagagcccatccctcattgtttggagagccgtgggttcgagtcccacacacccgcctgtcgatccccaacaaataattgccgtccacgggtgcactacgtcccccccccccctcggatcagttcccttaaaaaaattttcctttataaattttcgaactcttaatgattcatcataaaattttgaaaaaaaacaatggttcatcagaaattttttgaaaaactactataaaaaattaa

SEQ ID NO: 54575 - DNA, 199 bp, Heterodera glycines
  Genomic contig location: Contig_ID=SeqID_4472; Location=2830..3028; Strand=+
  SCN-specific regions: Sequence locations=1-53,76-199
ctcaccgccgagcagtgcgtggtgcagctgctgatgttgtggtggcactccgacggcaccggcaccgccgccgagcaacccgagtgccgtcaactgttgccacagctgcaagtcaatgccgccggcatggccacctatggcgaattgctgagccagccgatcctggaccgcaagcagcaacagttgctgctccaactgt

SEQ ID NO: 54576 - DNA, 2472 bp, Heterodera glycines
  Genomic contig location: Contig_ID=SeqID_4472; Location=1394..3865; Strand=-
  SCN-specific regions: Sequence locations=1-521,543-572,594-961,984 -1026,1198-1379,1450-1881,1903-2031,2054-2120,2220-2472
  Gene Ontology: Mol. function=transcriptional repressor activity; Biological process=negative regulation of transcription
atgcacagcactgataacaacggcaatggcaatggtaacaatccgtcaaacaataccaacaccatcgacgagggcagcgacgacggcgggcacagaaatggcgacggtaccatcggtgccggcggcgaggctggcacaagtgggaggaacaacgctgcggctggcaccagctacgacaccgccggtgccgtcgtcgtcggcgatccgcaaagtcaacagcagggcactattgcgccgaattccgtgccgcctcaccacattcttgcccacgcggtaccccctccccccgccgctgctggtggtggtggtcagccgcgtgacgtgccgccaccactgctcagcaacagtgccgtaagcgttggtggtggtctctcgagactctcgacgggagcttcggaatgagaaaaccaataaatatccttctgcagactgcctgaggggtggcgtacctttgccaccacacctttccgttataacagcgcccccccccccctcccccaacaattaccttaatttacccgggaaagacccgtgagactgggagattcacgatgaaacggcacaacacccctaagaatcatttttgttgagtctcgagtagttacgagaattgctaaaacggaggaccaagtcaaagggatttttccgaaagtttttatggcaaattttaccaatgtttaacccaaactattgacgaaagcgctaacttttgttgttattattgtatttgttaatatgctgttacgaatggattggcaaaatgtcaaaataaaataaaaatctaacggaaaaaattgctaattaaccactaattactcactgccccccattgttaacacagttggagcagcaactgttgctgcttgcggtccaggatcggctggctcagcaattcgccataggtggccatgccggcggcattgacttgcagctgtggcaacagttgacggcactcgggttgctcggcggcggtgccggtgccgtcggagtgccaccacaacatcagcagctgcaccacgcactgctcggcggtgaggggggcgcagtcgccgcagcggcggccgccgcggcgacagcgattgcagcaacaacagcgggcggtggcgtcggtaactcgctggagatgctccagcaacagttccaacgggcggcggcgacgatgacagcgagcagtacaacaacggcggcggcgacggcaccgtcgtcacagctgctgatgctgagacaacaccagcagcaacagtcggccgcgtcactgatcgcggacgacccaaaccatcatcatgaccagcaacattatccgctgtaccagaatggtcgctgcgcatggttcaactgcgaccaggtgggcagcagggaatagctcgtttcctcccccgaaatttttttaaaaaaatccaaaaattaacaaattctttacaaacaaaacattttatttaattttttatagtagtttttcaaaaaatttctgatgaaccattgttttttttcaaaattttatgatgaatcattaagagttcgaaaatttataaaggaaaatttttttaagggaactgatccgaggggggggggggacgtagtgcacccgtggacggcaattatttgttggggatcgacaggcgggtgtgtgggactcgaacccacggctctccaaacaatgagggatgggctctaaccgactgagccacgcggaaacttgtatttccctaactaatgagaatctgcatgaaaatcctgccgaaaaatcccgacaacattttcatttttggaccgatagataaaaacaaattgccattccttctctggtttcaagacggcaattggcgactgatgccccctgtttttgtttttcagccctgcgactcgttgcccgcctttctcgcccatttgtcccagtgccattccgccgttgacgacgccacgagcagtgcgacggcgcagcagtgccatgcccagattgacctggtcgactcactggagcaacggctgtgcctggagcggttgcgaatgcaagcgatggtcgcgcacttgcgacagcaacaacagcaacaagttgccaagcaacaggcgttctcgcccggcctcgtcggtgaagaggagggcacagtcgtagctcctggagcagtaccagcaacacaaccacagagccatcacaagcaggaagagagggaggaggaacatgaacaacagcagaagcagcagcagcggcgccagaggcattcgccgccgtcaccatcgtcgcaaaatcagcatcatttttgcaccgccggcggggcaacaaccgcaacgccaacgttgacggcattggacgctgcgcaacaacaaagacaagccatcggcatgccgttggagaacatttacatcaaagaggtggggtgtgcagcttgctcgagaatctcagtctcggcttttttgggtctcggtccaaagggcgggggaatgaagtgtacccttctcgagagtcgtttctga

SEQ ID NO: 54577 - DNA, 1078 bp, Heterodera glycines
  Genomic contig location: Contig_ID=SeqID_4472; Location=4643..5720; Strand=+
  SCN-specific regions: Sequence locations=1-455,477-638,660-770,801 -1078
atgtgtccactctccgatcattctttgggaatggttaaccactaccaacaattcttaaagaatttgcggtgcattcgccaaccgttggacgaccttttgaaacaggacacggactggaattggtccagcgaatgtcagaaagcctttgatcaggtcattggcacgcttcagtcggaccaactgctcacacattatgacccatcacaagaaataattgtgtccgctgatgcctctgagcatgggatcggagcagttatttcccatcgttatgcggatggaagcatcaaggccatcgcgcatgcgtcgcattcgttggctccggcagaaaggaattatgcccaaattgagaaggaaggcttagccttaatttatgccgtgcaaaaattccacaaatacctttatggaaggcattttatcctgcaaacggatcataaacctttgctgtcaattttcggcaacaaaaaaggaattaatcctgcaccgccaatcgattgcaacgttgggcattgattttgctcgcttatgattttgatattgagtatcaaaacacatcggagttcggacaagcagacgctttgtctcgattgatctcaaaaacgacgattgaagacgacgaagtgatcgtggccaatttgatgaatgtggaaacggaacttttgaatgctgttgtaaagcaatttccgttgaattccgatcaattaattgttgagattggaaaagatgaagtgctaaaaaaggtcatgaagtaccttcgcactcaatggcccacttcaaagaatatgtctttagaaatcattccatttcaacgcaggcgagaagccttatcaattgagaatggatgtattatttatgctgaccgggtggtgatccccgcatcacttcagaaggaagtcttgcagcaattgcaccagggcacccgggaatgaaacgcatgaaaaatctggccaggcaatatgtttattggcctggaatggaccagcaaatcgaagacacgaagaacccgtcgtggatgaagctgatcgagcccccgaagtgcccgctcaatcgacgaccgcctgatcgctacactccatcatga

SEQ ID NO: 54578 - DNA, 119 bp, Heterodera glycines
  Genomic contig location: Contig_ID=SeqID_4475; Location=266..384; Strand=-
  SCN-specific regions: Sequence locations=1-119
atgagaaggaagccggggccgggatctcgagattgttttgaaggtcaagaatttcccgagcctctcgaaatgggaccgttcctcgagactcttagtgaccaaaactcgagaatctcgga

SEQ ID NO: 54579 - DNA, 573 bp, Heterodera glycines
  Genomic contig location: Contig_ID=SeqID_23886; Location=314..886; Strand=-
  SCN-specific regions: Sequence locations=1-110,132-420,442-573
caattccagaaaatttattttgttgaagcatttgatcatgcagcagcacacgtacacggaacagcctcaacgccaggcaattaattaatcgaaacttttcgcaatggcataaaccaattggattttgtttagaattaccaatactacccaaatccgcctcccccggtggtgtaagtgccaattgttaaacaatttgaaattaaattaatcagtagggataggaaggaatttgaggcaaattgtttttttaaacaaaaatcgtccatttttaaaaccaattaagcgcactcattagctgcctaattaggcactgccaaattgcttaaggtacgaacgtcgttacgtggagagggacagcggcccgcgctgtgtgccgtgctgctgctgcattccgtgcattccgatccctttgtgcttcgactgcggctgctgaacaccggcggagaagcaaaacgaatgttttgggaaatgcgcgaaaatggaaacgcttttattacaactcatcactcaattaattacataattaattgtcattaatgcaaatttacatttgcgaataaattttttcagatc

SEQ ID NO: 54580 - DNA, 117 bp, Heterodera glycines; identical to SEQ ID NO: 53938
  Genomic contig location: Contig_ID=SeqID_23886; Location=1216..1332; Strand=-
  SCN-specific regions: Sequence locations=1-117

SEQ ID NO: 54581 - DNA, 171 bp, Heterodera glycines
  Genomic contig location: Contig_ID=SeqID_23888; Location=281..451; Strand=-
  SCN-specific regions: Sequence locations=1-65,87-114,136-171
aaaatcaatctgatttcactttacaaatacgctcccttgacttcatgtgatgttgaacgatcattttcaatttacaaatctattttgactgacaatcgctcatgtctatctcccgaacatcttgaaatgcaacttatttgcaatgcgaatttcaataatgatttggattaa

SEQ ID NO: 54582 - DNA, 1268 bp, Heterodera glycines
  Genomic contig location: Contig_ID=SeqID_23890; Location=208..1475; Strand=-
  SCN-specific regions: Sequence locations=1-116,140-668,690-1019,1041 -1233,1258-1268
atgacgatttgctatggtggtaacgcggtggcaatgagttcagcggtcagcggaagtgcatcggcaaatgctgcaaaagttggggatggacgcgtcgaatgtgccgccgaatcgggcagtaaatacaatggcacggggacttttcaatggatggtaagggaataaataaagaaaattcaatggaaaaataaaagataattaattacaggctcagatttggtgacgcggatgctttggtcgttttcatcgtttcccccgaggacaaattccgattcgatgagcgcgcaattgaaaacgaacttcagcagatttccgatggacaaattgaagttgagcgaatgacgtcagaagaggcctttgtcaagtgattgaccactgtaatgacttttgtttaactgtcccccccccccttttcttgaggttgtttctcgacgagaatgacttcactttgcgtcgtttgtccgatcgtcgtgcggttgccctcgtctattcgtcgaatgggcatttgccggaatggacggacgacgaatgggagacacggcggagaatcgaacgatcgcgggcaattgtaaggacaacagcggaaggaattcatttccatgggaaattgtcggggcatttttaattaattatgcaattagcaaaaagagcattaactaaatattcgtaaaaagtatgctttttagaaaacatcgacggtgtttagcgatttgagcacctcaaaagcagtgaggcaggtgattaacggataagatgagaattgcctcaattaattaatgaattcaccattaattaatgtccatttgcccttttgaagctgctcgcacagcgcggacagatcgaacagtttatgcgagacgaagaagacaagcaaatggtggagacaattcggagaacatttgttgagcaatggcctttggaagagggcgacgatccgacccgacaattgatacaggtgagtaaacacacgaaaatgggccaattaaaatggaaattgcaaaatgttgggtcaaatcaaagcaaataaatcattttcctttccataaatgtctcttcctctttctcgtcctttttctttcgttcacttattttggccatttattcagttggccatcgctgaccccggcctttatgtgttgaaagcgcaaaacgaagaaggaacaccaaattatgttgacgagggactgagagagaaactgcagcaattcacgcacgaagagcgagcagcacacgaactgatgcacagaattcagccggtgacggcgaag

SEQ ID NO: 54583 - DNA, 336 bp, Heterodera glycines
  Genomic contig location: Contig_ID=SeqID_23893; Location=16..351; Strand=-
  SCN-specific regions: Sequence locations=1-52,74-165,187-336
atgcctttacatcaaaatttaataattaagttctcattaaaaatttatggttatgaaaatcaaaatttccacattaatcaaaaggtaattttatttcgaaaagaaaaattaaagagacaaagcgtttttaaatcacaaaatttaattttaaattcgatattttcgattgtttagcatttattcataaaaatggacacgttgccaaatttggactatgccgaagaatacggcgacgacggcaccggaagaagcatcgaattgcagccgaccattttgccgaccgagtgcaatttgtcagcagcaaacattgccgaacagaacacgtggacaatgtga

SEQ ID NO: 54584 - DNA, 725 bp, Heterodera glycines
  Genomic contig location: Contig_ID=SeqID_23893; Location=419..1143; Strand=-
  SCN-specific regions: Sequence locations=1-183,219-222,255-269,384 -671,693-725
atgtccttattttggccaaatgattatgcaaaatggtttggatgtgtgtgcatttgttatcgaagtgctgtgccaaaaaatgagtggcaaagaatggcacaaaactccgcaagaaacgaaaggaaaaattaaacgaaatttggccttataaaaagataaggaagagctaatgttgaaaatgcgaaaatttaaataattttctttcatttgatagataatacaatttttatgcttttaaataattagaataaattcgtctttctgtataatttttatttttttttgagtttgctaatattttcaatttttttccttcgcttttcctttttctttaatatttaattctttcttttttttatttttttatattttagttttattttcaaaatcgatcatccaacaataatggccctttgttgcccggcaaacttcataaaatgattcaattacagcaaagtgccaacgcctacccctcccattggcacactgtgccgtgggctccgctctcagtttcggcctgtccaaaatttatctcattggcttttgagtgcgaaaccaattaaatgttcatttcccatttcacttctatcgcaaatgccaacaaatttaacgcgccattggccgctcctaatgaaagaaacaaaacgggtgcttacttatgtttttgcgcgtttttcttctttcaaaaattcataaatttgcgcgaaatttctatttaaaataaa

SEQ ID NO: 54585 - DNA, 915 bp, Heterodera glycines
  Genomic contig location: Contig_ID=SeqID_23894; Location=116..1030; Strand=+
  SCN-specific regions: Sequence locations=1-20,42-275,297-552,574 -806,828-870,892-915
atgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaatagttatttctgggactttttcagaaatcagaattaattctccaatgtggcccaaattttaggcccccagccacagccccttgcttctccccagttttaagtcttggatttgtcaa

SEQ ID NO: 54586 - DNA, 736 bp, Heterodera glycines
  Genomic contig location: Contig_ID=SeqID_4476; Location=302..1037; Strand=-
  SCN-specific regions: Sequence locations=1-186,208-736
  Gene Ontology: Mol. function=ubiquinone biosynthesis methyltransferase activity; Cellular component=mitochondrial inner membrane; Biological process=electron transport
atgaacgatgctatgagcttaggaattcatcggttgtggaaggaatattttgtgcagcagctgaacttatcaaaagactcaacggtgttggatatggcaggcggtacgggcgatgtggcgtttcgaattgtacaagaaatgcgcaaacaaccgatcggcaagggatcaatcactgttgccgatatcaatgatgtcagtgatcactgtttctatttatctatgaatttctcatgttttttttcacagaatatgctggaaacaggaaagactcgagccaccagagcactctccccatctgaccaagcccgactttcatgggtctgtgctgatgcggaaaatttgcaatttgaagacaacacttacgacttctacacgatttcattcggaattaggaactgcacacatttggacaaggttcgacggtgtcattttgcaaatttggctaataatttgtcaatttttgaattggtcgagtttgtttctgattttcttttgtttctaaggtactttctgaggcctatcgtgttctgaagccaaatggtgtttttgcttgccttgagtttggacaaattgagaatacgatgttaagacggatctatgacatttacagcttccaatttattccagttttgggtcagcttttagttggagatttcaacagttataagtacctggtggaaagtatcagaatgttcccttctcatgaaaagtttgctcaaatgattaatgaggccgg

SEQ ID NO: 54587 - DNA, 2887 bp, Heterodera glycines
  Genomic contig location: Contig_ID=SeqID_4476; Location=1672..4558; Strand=+
  SCN-specific regions: Sequence locations=1-233,256-612,635-807,830 -1286,1308-1364,1386-2008,2030-2068,2090-2091,2113-2422,2444 -2661,2756-2837,2884-2887
atgatcggctcaaaattcatcggcaataaagccggcatgagctccattgacaaggagcaagtggcgcgcataattgctgagaataccagcgcaaattttgagggttatgaaaagaaaagggcgagtcgcattgatgaacaaataaaaagaaaccgacaaaggcttgattcattgacggaacaacaaataaaacaaactcgagaagaggtgggacaaattcctggaaatttaactaaattattaacaatgaataataaacatttagttggacagaattgttgaagacatggagaaatggcgtcggctggacaggattaaagtgcacattgacatggacgcgttttatgctgcagtcgaatgccgtgacaatatccatcttcgagacgtgccaatggctgttggcagcctttcgatgctggtgcgtcattttattttataccattttaagagaccatgaattatgagtccatgcaaactttccttcattgaatggtttaggtatttgattattctgtagttttaccaaaaaatccattgataattactgccgatttaagagcacttccaattacgctgcccgtaaatttggcgttcgttccgcaatgcccgggtttattgggaagaaactctgtccccatcttctgattgtgccttgtaacttctccaaatataaacgggattcgtcagtgtttcgggcggttttccagcgctatgactccgaagtttcaatgggaagtttggacgaagcctacttggaccttacccatttcatctcacagcgaaaagaaccgggtgggttttttcgccttttacttttatttgaatgtttagtaatctgtcgaagggttcgttttatgggcccatgcgtttgtcgccttcctttggtagcaaatcccagtgaaattgggcccgaagtcgaaaaaactccgacaatttgtgcaaaatgtgggaatgaacgtattgaagttgttgactcgattgaatttggacaagacgttgactcaattgtgcgccaacttcgttttggtatgaaacgatgcgtggggaaacgaattgttgcggactaatggggacaaacctgtattctgtaggggcatcctaaaagttttttttgctctcattgtcagtccaaaatttgaactaactattcacaatcgacgacatgaaaaaaagagagcatttttagccctttttattttattcataaataaactaaaaagttattgggaatcggaatggaaatttcagaagtggagcaagcaacaggcttaacatgcagtgcaggtaattttccaaaatgagttgaaactgatctctgtttctccgtttatttttttcgttgccatttctcttcaggaattgcctcaaattccatgttggccaaaatttgctctgatctgaacaagcccaatggccaatttcgccttggaaattcccgagaagagattgcctcgtttatgcattctttgcctgtccgaaaagtgcccggcatcggtgcggtcaccgaatcgttgttgaaagggttggacgtggtcacttgcggcgatttgctggagaagcggtccattgtgcatttgttgttcaccaaacgctgttccgagtggctccttcgcgttgcgcttggcatttccggccacgaaattgcggacgatggcgagacggagcaaaacgaccaaaatggtggggtcaaaaacagtaaaactcagaatcatcagcaaatgatcattgccatttgtgtccagacgaggacaacccgaagagcacgagcattgagcgcactttcactccgacaaataattcggacgatttgctgtccattgtccgttctctatgtgcccgtcttatccaatcacttccatcctctgaaattgtgggaggtcgtgctgtgacgctgaaagtaattgcgtaattttttttttttcatttttttcactcagataaaattcgccaattttgatgttgtgactcgctgcaaatcggttaattttgttgtcaccgccgtcggccaactcattccaattattgaagcgatgctgcgcaaggaattcaaagagcgaagaaacatggcggtgtgttgttattgttcattttaacaacaacaaaaaatagtcatactttttgagattcgccttttgggcgtaagactttcccaattggtttccgctgatgcaaatttgggagaggaggcgaaaaagggcgttcagctgagtttggccgggtttatgtcgcgacgtcctttggccaacaaaaagcgacgagacgaaccccccgaggtggtggaattaagctcatctgatgagatggaaacgaaggaggaggaaggagacgaaacaatggaagtgaaaccaatgccattttcggaggaaaaagagccggaaaatggccaaaggaaaagtgaaagcccaaacgacggatgtgacaaggcggagacgagcgaacgcagtcggagcaacggccaacgtatgcaatcttctgacgaatgaatggaacggatcccatgtgattttgccaatttcagaagcaagggaacgcgacagcgcacatggagacatcattgtgatagaggacgatgaggagggggaggatggcattgtgaacattgacgaatactttgactttgttgacgacgacgacgaagtgattgactgcacaaagtcagggggagagaaaagggcaaaaaacggaagaaaagggggaggacagaaaagaaaaagacggagggaagagagcgagaggaaaagggatgggaacagaaaaacgaacaatttgttcaaatatttccatacaattcgttaatttaacgacttttgccgtacaaaagaatctgatctctgaaattgacaaatttcattttaaaatttttcattatttttaactttcgtgcaaa

SEQ ID NO: 54588 - DNA, 158 bp, Heterodera glycines
  Genomic contig location: Contig_ID=SeqID_4477; Location=967..1124; Strand=+
  SCN-specific regions: Sequence locations=1-7,29-158
aaccaacaaaatttataaaaaaataaaacaacggaggcaaaaatcactcggtattttgagaatttaaaaactcgttgtatttcttctcaaagtcgaactcatattcaatgccaatttcgcgcagtttcgccattctctttcgcaattcccccacaaat

SEQ ID NO: 54589 - DNA, 685 bp, Heterodera glycines
  Genomic contig location: Contig_ID=SeqID_23897; Location=1397..2081; Strand=+
  SCN-specific regions: Sequence locations=1-72,94-156,192-213,257 -312,334-685
aaggtctcaagtgcaagcagggattcgaaatccgtccattggttgaacaacaattggaaccggacgaatgtgtcgatgttgagcttcctcgattttgtgaagcgtcaatttgcacaacaggtgatcactgatcagaaaggcacagatttttcgtagaaaaaaaatcattaataaattaattaaatattaatggtgaaaacagtgcgaaatgtcaaaaaatgtataaaattaaaaaaatcataaaagttttatttttgaatgtaaacaaaaactttttcttatttttgacattttttcgaaaagtccatgttctccaaaaatttattttataaggtattaaaaacattttattatgctattcgatagatttttggtttttacaaatacacaaatgaggaaaaaaattttcaaattatcaaaaagattttgttttatggaaattaattttctttttcgtgttttataattcaaaactcttaagatgaggcgccaaattttgcgagcattcattggaaatgtgcggaagaacaaaatgccaaagaatgtgccgaaagaatgaaagaaatctatgagaaaaagggtgaattaaaaaatgtttcatgccaatgccattatggcgaagaaggtgaagactttggcaacaaaaggttcacgcttccgccgcctgccgacccgacggacaaag

SEQ ID NO: 54590 - DNA, 1380 bp, Heterodera glycines
  Genomic contig location: Contig_ID=SeqID_23898; Location=212..1591; Strand=-
  SCN-specific regions: Sequence locations=1-1155,1177-1214,1236-1380
atgtttcctgaaattgttgccgacggacttgggcattgcaaaaaggtgaaggcacatttgtcgctgaagcccaatgcaactccaatttactgccgaccgcgtcccgtcccattcaacaccaaatctgttgttgaagcagaattggagcgacttcaatcgatgaatgtcatccgtccggttgaacacacaaattgggccgcacccatcgtggttgtgaaaaaggccaatggttcaattctcgtctgcgccgacttttcgactggcttaaacagcgcactgcttttgcatcagcatcccctgccgcttcctgaagacatcttcgccactttgaatggaggccgaattttttcgcaaatcgactttcgggatgcttatctacaagtcgagttggacgaaaattctaaagagttgtgcacaattgccactcatcgaggaaattttcagtaccaacgtttgccatttggggtgaagtccgcccccggcattttccagtcaattatggattcgatgttggctggttgtgcattcgcagttgcatatctggatgatgtgatcgtggtaagccgatcatcagaagaacacaagaagcaccttcaagaggtcttcaagcgaattgccaagtttgggttccgaattaagcctgaaaagtgctccttcttcaaaagggaaattaagtaccttggcttcatcattaataagaatggaagaaggccggacccagccaaaatacaggcgatcgctaagatgcctgtgccaaccaatttgtccacacttcgttcgtttttggggatgataaaccattatcagcagttcgtgaagaacatgcgtttcatccgccaacctttggacaatctgcttaagcaagatgtggtctggagttggtccaccgattgtcagaaggcctttgatcaggtcattcagattctgcaatctgatcagctattggctcactacgacccatcgcaacaaatcatcgtgtccgcagatgcatcagagcatggaatcggagcagtgatttctcaccgctattccgacggcacaatgaaagcagtctcccatgcttcacattccctgtccccagcggaaaagaattattcgcaaattgaaaaagagggactggctttggtgtatgccgtgcagaagtttcacaaatatctttttggaaggcattttcttctacagacggatcacaagccattattgtccatttttggcaataaaaaaggaatcaaagcgtgcaccgccaatcggttacagcgctgggcaatcattcttctggggtacgattttgaaattgagtaccaacaaacattgagttcggccaagccgatgtgctttcccgacttattgcgaaaactccgatgccagaagacgacataa

SEQ ID NO: 54591 - DNA, 639 bp, Heterodera glycines
  Genomic contig location: Contig_ID=SeqID_23899; Location=816..1454; Strand=-
  SCN-specific regions: Sequence locations=1-14,36-201,224-384,406 -595,617-639
atgcgctttctgaaacagcagcaggcacaactccctaatccccccaagccccaacaaatcctggcactatctgtgattttgggtaggtcgaaatttgttttaatgggatgtccttcttttattaggaatgtttatttactttcttcttatgtgctacacccatctcataagttaaaggtcattcactcattcatttggaccgttttattatttatttgtttgcatttgacgtcaaagaaactcatttatattattttattatgtattcatccgttccctaaggagttacttactagtgctgttcgagagcgtctcggtctcgactcgagaaagtctcgggtttttgggtctcggtctcgagtctcgactcgagaataaggataatgaatataaaaattgatttttcgtttcagcaaattattggctattaaatgcacaatttaatggatgtgtttttggaataatttcaatgattgatgaggacgagaatgaatgagtcaattagtctctcaacacagcagtccaaaattttcctactaagtgcgttacataattgagtagtgagtgagtgccgtccgaatgcgcaaatttcgccccaggaaaatttttgcatgaaacaaattaaaaccaatgaataaa

SEQ ID NO: 54592 - DNA, 373 bp, Heterodera glycines
  Genomic contig location: Contig_ID=SeqID_23900; Location=492..864; Strand=-
  SCN-specific regions: Sequence locations=1-245,267-301,325-373
atgccaaaagaaccttcgtcccgcgcatttcttttcaaaaaatgggtttccaattacatgaacgatgtttacacaactgattcaaagataatttattgtcaagcatgtcaaatagaggtttttgatacaatttgcgatattggaaaaattctttctggtcaaaaaatcaatttcggtatgccccccaatctgatttcactttacaaatacgctcccttgacttcatgtgatgttgaacgatcattttcaatttacaaatctattttgactgacaatcgctcacgtctatcgcccgaaaatcttgaaatgttacttatttgcaatgtgaatctcaataatgatttggcataatattttttgctttttgaataaa

SEQ ID NO: 54593 - DNA, 2517 bp, Heterodera glycines
  Genomic contig location: Contig_ID=SeqID_23901; Location=1..2517; Strand=-
  SCN-specific regions: Sequence locations=1-23,45-284,306-347,371 -465,493-899,937-1398,1420-1493,1515-1542,1565-2461,2498-2517
  Gene Ontology: Mol. function=UDP-glycosyltransferase activity; Cellular component=extracellular space; Biological process =regulation of N signaling pathway
attaccccgaggggcgtctctcccctcttttttctctccctttacgcccccaacttttacaatttttctttgtccattttttgttttttggaaattgcttctgccaatggtccctcaccgttcactttgcccaaggtcacttctccgctaggctcttccgtccattggcttcgttcggttggatcatcgccattcattttcatttgtctcccccgggggcattcattcgttcgcactttcccacccatccgttcattttttgtctgttttggtcataaaaccgtccccctcccttttttgttgttacatttcggcacttttagaggccataattgccaatttcgttatttctccccttttccttggatttattttccctttttatttgccattcgtcgccccttcggcaacgatgtgactgacccttcccaaaattgtctctttcctccgcttccttcggcaatgcctttttcctcctcttcctctttcggcatcttcttccaacagcagttcgtcttctttttccctctattttggttgttgttctcctctccatcggtgagttaattagcaaaataatcgcgcatcattagggcgtaattaattaacttggaggaatctctgattcactcccgcatttgatgtctctgttaaggcatcgccagttccgatcaacagcccatcttctgtgtccgacccgtccattttgatcaccgtaaaaacgacaagggcaaaccatcggagccgagtcgaagacgcattggccacttgggcatcgatggccgggcgtaaaggggcagaaaatacggtgaaaatttcgttgccaatcggacagagggaaaatgtcggggattttgacgatgaattgacagggaaaacccgggaaagcgggagaaatttacggattagcatgtttaaaaagcattgttatttttgtcccattttccggatgccttaccataagaagtcaatgcgattgatttcccacacaattcgcttatttcagcagattttgttcgtctccgatgcgaactctccgtcccctctcatccaatcgaccaaatgccctccgggacacacaaagtgaaccctcaattacttatctcctccaatgcttaatttagcgctgcactgtgctgcaaaatggcagccgaacttcgaattgcgcttcagcggtcgccggagtaatttgggcggacatttaaaatccttccccactaaatcgaaccggggggggcaattaaaggaccattgaccattagttaagtatttaagataaggttacttttgaggtcagcaattatggtcaattggtcatgtcagtggtcgctcatttccccccggggttaattgctgccttttccatgaattccctcccttccgtgccttatcgcacgaacaaatcggtcagaaaaagtgatgggcaaaactatgcacacaaatgggtttaaatttttcaaataattggaaaatgaaaaaaattcggagaatcgaaaaaccaatttaatttctttttcaattttgttgacattactactgtaaaaaagcttatcataatgccaaatcacactttaaaatcgcctatcaccatattacaaaaagttcgctgactttttgcctcccttttcgaattgttttggcattttaagtttttggtgccatttcgacgacgacagttttgtgctgctcgtcaatctgcgcgcctttctccgacagtttaggccccatctcgacgacctttacctgggccgaccttccacctcagctcccgttgtgctgccccaacttgatgaccgtccccaactcttcgccccctttcggcaccgaaaaagtccattttggttcggcaccggcggggctggcatttgtctgtccgcgctaacacttcgcagactgcgccgattcattgccacgggcgaaacccatcagcaaaggggcaatttccaatgggtctgtgcccaactcggcgtgccggacgacgtggcacttggattcattttgggtgagggcgcggggggagcaaatcaccgggggaagggcaagcggaggactgaaaagttcaatccaacggatttaactgtcacaagaccaaggctcttctagaaagctgatttctcgagtcgagtctcgacaccattagtaaaagctaacaacaattcgaatgttgtttttcagagaattttcttgccatccctctgactcggacggaccgattccattcgcatttgaaccgaatgggcgcaattccgcgctctcagttgagcgatcaggtagaaatttcaactgaaagcgggccaaaacgcacaacactttggacagatcagtctgagcggttcggaaaagggcgccaattttgtgaatgtgccggaaaatttccgaccgccgcacgacggcgacggaaaaagaagcgatttactgcactttcgctcacttttcaaattcattttgctgagagaaggacagaaaaggagagacaaagaagcaacaaaagaaaaggaggacaaatatttgatgaaa

SEQ ID NO: 54594 - DNA, 549 bp, Heterodera glycines
  Genomic contig location: Contig_ID=SeqID_23902; Location=245..793; Strand=+
  SCN-specific regions: Sequence locations=1-41,63-174,196-549
atgagcacttcgatgctgaagacggcgtaccgcggcatggcaatgtttgagggggaaatggcggaggaaagggcacaagggaacaaagattgcatcattcttacgcttttatgcgggaaaatattggactattttgagcagcagctgaaagaagcgaaaatggacgggaaaaatgaaaaaggggagaaaatggccaaaattggcaaattttggaaattattcacgcgaatttttgaccttttcaagaaaaaaagcgaaatgcacgacaaaaaaggcattctgatcaaattgagccaacttttgcgttatttaaggggccaatttggggagcaaaaagtgtcgaataaatggcaattaattggggaactatttgagcagggatttaccaaattgtacaaggaaaatgaggaattccgaacccattttaagaggaacatcattcaaatgatcggattgttcagagaaatttgtgaaattgcagaagagaacggggaggaattcttttcgaagcaattttggaccttatttggtggaccttttgtaaattaa

SEQ ID NO: 54595 - DNA, 326 bp, Heterodera glycines
  Genomic contig location: Contig_ID=SeqID_23902; Location=1074..1399; Strand=-
  SCN-specific regions: Sequence locations=1-326
atgactatggtaattatggcaattactttattaattaggcgtaatcaaaaaagtgaaatcattcggaaaaaggcgatcaatttcactgtccgtgcatttcgcctttcccctattaagaaatgaataataattattaattgcctcctcctgctcgtataatgtctatttctttcagcttttccactgggatattcttttttgggcattcgataagaagtagtgattttatttcgttctgcggcgtattggtcgtcgttttgtttaatattttttcttaattaagcaaatgttaatttatcgcatcgctgtcgtattttcataataaa

SEQ ID NO: 54596 - DNA, 399 bp, Heterodera glycines
  Genomic contig location: Contig_ID=SeqID_23902; Location=1426..1824; Strand=+
  SCN-specific regions: Sequence locations=1-97,120-377
atgacttcactgtacaaagaattattaatgaaatcagttggcaaagatgaaagtcgcggctacaattcaagccaaattcacattttggcaatgcttttgagctacaaaatacaaattgactttatgattggcatagggaaacagtttgaagaaagaactgaaaaatttgaggaccaattggaaaattacatgaacgaatttgttgtcgaaaggccagaatccggcagcgaagaggaggaattatgcgaaatgcacaaattggcacattcgatagctaaaaatggcattttgagggaggaaagtgccaaatggggcaaatttattgagcaatttgtgggcaatgcaacgaaaacgccaactgaacgggtgaaaaatgcaattataataatattaatttaa

SEQ ID NO: 54597 - DNA, 1236 bp, Heterodera glycines; identical to SEQ ID NO: 23904
  misc_feature (39)..(39): n is a, c, g, or t
  misc_feature (49)..(49): n is a, c, g, or t
  Genomic contig location: Contig_ID=SeqID_23904; Location=1..1236; Strand=+
  SCN-specific regions: Sequence locations=1-457,479-579,603-1020,1060 -1134
  Gene Ontology: Mol. function=phospholipase C activity; Cellular component=intracellular; Biological process=intracellular signaling cascade

SEQ ID NO: 54598 - DNA, 100 bp, Heterodera glycines
  Genomic contig location: Contig_ID=SeqID_23906; Location=702..801; Strand=-
  SCN-specific regions: Sequence locations=1-100
ttggatttgcaacgacgtttggatggacattttccccagttttgaccgtcctcaactcggcctcaaattggcacttctttcgccacgtttcaatgcgttg

SEQ ID NO: 54599 - DNA, 1509 bp, Heterodera glycines
  Genomic contig location: Contig_ID=SeqID_23907; Location=1..1509; Strand=-
  SCN-specific regions: Sequence locations=1-140,303-837,859-1509
  Gene Ontology: Mol. function=growth factor activity; Cellular component=extracellular space; Biological process=cell-cell signaling
ctctgctcgaatttctggcagtcgcttttggcctggtgtccattcggtcagtgaccaaccgccactttctgtgcatggactcctcgggacagctgtatgccgcacctgccagccgatactcagccgactgtgtgttcatggaggaaatgagtaagagaaaggaaacggggatgagagagaatacaaaagagagagagacggaaaagaaatgacggatgagagagaatacaaaaaagagagagacgagaaagaaaaagggggatgagagagaatacaaaatgagagacgggggagagaaggaggaccgagataaaaactgtgcagactaacgatatgagtttttagtgcacaattactacaatttgtactcgtcttgcgtctacggaagtgcgcgaagtccgtggtttgtcgcattgcgacggaacgggcaacagcgacgaggacggcacagccgaagacggcaaaagtcgtcgcattttgtcattgtggagacgccgaacaacaacagcaaaacggacggagtgagtcatttaggattgatcagagcacttttcactgatcactgatcagtcccttcagagcaccgttttggatgggttcggtcactcaaagacccgcgtcggctcttgggcctggaaatacttttacggtggggttaaatttcaaactgacgcgatcagcgctgactccgctcatccgccaagatctgtacagcagcacaacgcatcatcgtcggcagaagcatccctggaggggacataagaaattgcgttgggagttgcccaaagaggtgacgtcactgaattggatagaaagagactaattaggcagcaattagtggtctaatgatgaatttttccggaattcggatagaaattccaaaagctgagccatttgacccacgaaagtcgcgagctaattacatttaaatggtcacaaagcacttgttcaggttgtactgctcgatatgaatgaaagacatcgtcgaacacaaagaacggcataaaatgccgtcaaatgaaatgggagaaaagttgtgccaaaatggcaaaagcggtgctaatgaggcgggagacgaccaacggcggatgagcagtgattgacccgcagaacagaacagcacaacacaaaccgatctctccactttgattgtccattctcaatttattaagcccatttttttctttttgataaattctgccaaaaattcctcgcgccaattcatttggcgcgactttcgccgtcggtcggcgggtgatcccttccccatttatgatgataaaattcaaatccctcctttcccgtcgtccttacttcccgcgccagtccgtctcctttcttccacattttgggtgggcgaccacctcggaagtggagaaatttgtggtctgtcggatgatgaatggacccatcgctcgttttgctgggcattcattgcccgtcgtcgtcgtccttgtcaatggcgccttccccccattggacaccgactgatccacccccccccccccc

SEQ ID NO: 54600 - DNA, 585 bp, Heterodera glycines
  misc_feature (565)..(565): n is a, c, g, or t
  misc_feature (574)..(574): n is a, c, g, or t
  Genomic contig location: Contig_ID=SeqID_23908; Location=490..1074; Strand=+
  SCN-specific regions: Sequence locations=1-108,267-585
atgaaattattaccactattctttttaattgtaattttaattatcaaaattgaccaatttggagcagagaagaaaaaattgaaacaaaagtcatttgacgtaatttttggagaaaaatgggaagaaaaggaagaagaaaggcgaaatgaactcaaaaaaagagaaataattgcaaaattttataaaataaaagagaaaatcaagcaaaaaggaagaaaatattcaagaaaagaatggagtaaaattgaaataaaaataacgaaaaaattggggacaaatcgccaatatatttataaatggattaaagaatttggcctctataaattcaaatcaaaaactgatgaagaaaaaatagaaattatacaaaaattcattggaatggcaaatgaatataagcaaaaaagaaaatattcgccaaaagaatggcaaaaaattcatgccgaaatttgcaagaaaattggagttagcctttcagtaattaagaaatggaagaaacaatttggaatgagtaaatttataacggagaaggaaaaattggaaaaaatgaaaatttactggaaaatanaaagagaanatccgaaatga

SEQ ID NO: 54601 - DNA, 1760 bp, Heterodera glycines
  misc_feature (42)..(42): n is a, c, g, or t
  Genomic contig location: Contig_ID=SeqID_23909; Location=182..1941; Strand=-
  SCN-specific regions: Sequence locations=1-120,142-349,388-578,601 -631,688-1077,1101-1240,1315-1590,1622-1701,1724-1760
atggtgcagcatgagaaggcttgtgaaaaagtggtgagtgcnggcacaaaatgagggcgactttggacccaatttcagttcgaccacccatttgcgtcctcctcatccgctcccgcctgtgctgtggctgccgcttcttccgccatgatgccctcctcgtgctcttccgcggtcatcggcaccacccattccccatcatcatctttccatgctgctgggaccaatgccggtgctgctgatggaggtggtggcactcttcggcgccaccaatcgccgccccttctcgcccatccgccgcccgctcttccaccgccgctcctcgatcaccaacgggcccaacaaaactgtgcctccgcttctgctgcctcctcttcctcctcctccctgaatccgcatcatcatcatcatgttggcggtgttcatccgtccttctcttccatcatcaccaccaacatttccggcccacaaatccaaacccaacagaaacagtgccaaaatgtgtcgccgccccaggcattgctcgaggccgaacttccatttagcgactcgcaatttgacggcaccgttgaggtgggtattgttcaaaaatcatttttaaaaccaattttatcatgtagagcatactcgattgtaattttttataacttaaatttttttaaatttcaaaaaaaaattacaatttttttagctatttttcaaatttatggttgattttttatattaactcttttcttacttttattactggttttttatttacaaatgcaaaacaaatgaaaaatttgatggaattacgaccaattttcaagatttactaacaataagttttttttaattttcaacaaatcgctgaaaaaacttttttattttttttcgtgtggaatcctcccccccccccccccaaaaaaattatttttttctcgaaaaattgcacatccagcagagaaaggtgaaaattaatatgtttttttatttttaggcacttttaaatttccgccagaattattgggatgccaatgcttgtcatgagaaactcgaaatcattggcgacaaaagtctcattgtccattataagagaaatgagaatggtattttatcataatttacttagttatattatatattctccttaaaagatggtatgtgttctgttttcgctaaacatccgattttgctgttcaataattcgtccgacattttttactacgaaatttcaatcggaaataagaaaaagtaagagattttttattttttgaataaatttattaggaatataaaaatttaattatttttattattattaataataaatttccagtgttttgttattcggattcgccgtcaaacagcagaaaaaaccactgtatggagatgaaaagggcacttatgcatatgacaattatggcaatattttcattaacggaaaacaaaaggaatcaaatgccaaatatgcctacggtgataccgtaggaattggcatcaattcggccactcgacagatcattttcacaaagaatggacaacgtttgggttggtaaacaaacagttactaattgaattattgtcttataaatgagctatttaattgcctattttacattaattattttttatatttaaacttattgagaaacctttaactttttcacaggtttctccgattttttcgttgctccatcttttgttggccaattgttcccattcgtttctttgcgcaactctgatgacaaaattgaggcgaactttggatccaatgtcaa

SEQ ID NO: 54602 - DNA, 1268 bp, Heterodera glycines
  Genomic contig location: Contig_ID=SeqID_23910; Location=233..1500; Strand=+
  SCN-specific regions: Sequence locations=1-145,167-707,729-778,801 -803,830-832,855-861,883-957,981-1268
atgtcatccaattttctcgaaaatgacattgatgaggaaatcatcgatagcagtttcgatttttcccgtccctatggcccaatgcatttcccggattccgacttgaccgccccaatctcgaacgaagcattggcggagtttaggtttttagagggatcattatttttgtatttataagaatgagtagggcatatttatacaaatatctattatttttattttaaccattaaatttacagcgcatggcttagcgaaaaccgggagggtcgaggtggcttgacaccactatctgatcttgtgcggtttgagacctcgaacgcagagactgagacataccccgaccagccgatgccgataccaattcatatgggtaatgtaaaaatggtcttttttaagtaatctgtatatggtagcaattttgatgacaatttcaggaaatcgtgaatggaatgtccagggacctcgcatgaatcagggatatcgcggggattattggcgcgggcagcgtcgaatgccattcccggttggtggtcgtcgtggggggcgtcattggcgcggacaaagtggcaacaatcgatacgcagcccaaaatggtgggtttgaagaaattgtggtatgcaaaattcggtttgtagaaggtgcggaatgcatttttggtgtgcaagtcggtattcagggggtgcaaaatgcctttgtggtatgcaaatgtgagtgtgtagggggtgcagaatgaatttgtggtatgcaaatgtgagtgtgtagggggaggatacggtataatatgtttttgcaaatttataccaaaatagttctaacttttctttattaagcgaactttgaaccaatcggaccaactccgctaaaccaaggtagaaaattccccactccttcaccatacacatatttaaaaacttttagttcgctcacatttatatgggagtaagtaatattttttcaattataaatcaaatgactaatcatatacagtaccagatggcatgagacaactgttcaacccggctcccccacctccggtgttttatgtgtttagagggcccgcccacctactgaatgaccctcgcctgtttgagcgcgttaacgggggtagtgttatttttatgccgcctcaaaacacaaccttaaaaaacatgattttagcgagtcctcaaatgccgatgggtctccaatatgaccgaaatggagttgcgattttcaacccggccgttccaccccccggatacgagaaccttcgccccccgggaacataa

SEQ ID NO: 54603 - DNA, 255 bp, Heterodera glycines
  Genomic contig location: Contig_ID=SeqID_23911; Location=52..306; Strand=+
  SCN-specific regions: Sequence locations=1-255
gactatgtggtggttgagttggaattcgccgccaccttttccccgctcaattggtactgtttcgtcgtcgatgccgcgtcccccgcgctgtttaagcgccgcgtgcgcgcgttggccaaatgctttccgaatgtaattatgggagacgagcgcccgatgaaaagtgacggggagggcatgatggaagcggtgttggactgttttgagcgattggacgcgccacaacgcaaatgggaatatgtcactctgttgcaa

SEQ ID NO: 54604 - DNA, 840 bp, Heterodera glycines
  Genomic contig location: Contig_ID=SeqID_23912; Location=280..1119; Strand=+
  SCN-specific regions: Sequence locations=1-85,109-134,156-464,486 -603,645-723,745-840
atgcctttccgattaacaaccgccggcgcagtcgccggtcaaatagcggacgttcttctcgcacttattcaaggtgaaaaccaatttatgttattttatctaattattgttataatatcttttaaaagacacataaaaatataaaactaattgatagtgtcaatgaattcaactctataggtctattcaaaatcccgttaggtctcgttctcctcttgctcgtgatcgccctgctactggtagagccatgtctgttggtggtgctaacaataagaaagcacaaaaggagaaaactactgaagaattggaccgggagttggagcagtacatgcgtgggaataaggtttctgtccctctttgtattttggaaattctcacctcttattttcagcatcctcgcatcaaattggattcttgaactcttttggatctatgaccgtatcgtaagcatcggatgtttcactaaaaactgatctgccgtttatttcatcatattacaaattcaagaacgtatttctatccattatcggttttaaggagtttgattttgttttgtttttcttttgataaatgtatgtgctgtaaacaatttgtttgttcctgaaatgtattaaaacataaaaaataattagattaatttttgtcatctaatatttgaacataaattagggtaggaaatggagcagagtgaaggaatctcggtcggtgagcagcagtcattggatttcacaggtggacaaagtttggcatgaaatgccattgcctttccatttttaaggtgtgcactcaattgggagcgaatgttcttttgccgccccatccgatgatatttctgtccga

SEQ ID NO: 54605 - DNA, 1208 bp, Heterodera glycines
  Genomic contig location: Contig_ID=SeqID_23915; Location=111..1318; Strand=+
  SCN-specific regions: Sequence locations=1-349,371-482,505-700,731 -1208
atgtctcggctcgagaaaattcccttgtctttgaagtctcggggttttaattgggtcgagagtgtagaacttgagaacagtcttggattgtttgctctatttcgagtctcgtctccaacaacactactagtgttcaatgatcagatcgggacaccactttattcatgctattttgtttccatactgtatcattttatgtgtttaactacggtattgcgttgattgtacatattacacttttgtatttgcataaatggtacaccacattttgatttttgaatttttttatcattcagtattgaattacaatattccttgaattgtgtaacttatgaaattccgctacgaatattaacatatttaaaattttttagttaacaattgctatacttctaggacctttgtacgatttcgagtttctaggttgagtctcggtccgtccgtcctgttctttgtgcggaacagtaaaagaccaagccggggtgggacttgaagccacaccccagtaatccgtgccgtactcttccaattactatgtaggcaaaatttcgtttaatagcactagaagtgaccaaatgatcatagcattgctggaacattcctaagtctgccaaggggggaaaaagtcctaaaattgcttacaataaattttttatttctcttgaatatgatttatccaagtattctcatattctctaccataattttaattttttttaagttttttattgtattttctggtttaggaatcgcttttttcttgacaccagcgggctatcactgtattgaagcgaaatccactggttactgtttttgatttgtatggttgaactacggtattgcgcttttgtgtaagtgtcataccttttttcattctgttttaccgtttaatattacatacattacaatattacatataaaaataattttacagtatgcattgttcggaaatcacaaaaatattcttagaaaatgtattatattcgctttggcgttttttgccgagaaggaatcacattctgaagtcccttttacgaaatgaacatcaaaaaatggaattctgttgacaattaattggtgtttattctaaggcccggatgaactcctaaaatagtaaatttattagtgatcaaacaaaggcctagaaaaagctggtcagaaaatttaaaaaaatcaccaagcccaaacactcctccagctcctacaaa

SEQ ID NO: 54606 - DNA, 175 bp, Heterodera glycines
  Genomic contig location: Contig_ID=SeqID_23916; Location=1371..1545; Strand=-
  SCN-specific regions: Sequence locations=1-175
atgcttcattttatccttacattctctcaggtcaaacagttctaccggactgagggatttgaatttttgaaccgaatcttccaatgtcctgccgagttggagcaaatcaccggattagccgagttacagagacaagcggacgcatttcaatcggaagttatcgaaatggacgaca

SEQ ID NO: 54607 - DNA, 803 bp, Heterodera glycines
  Genomic contig location: Contig_ID=SeqID_4481; Location=2916..3718; Strand=+
  SCN-specific regions: Sequence locations=1-68,91-803
  Gene Ontology: Mol. function=translation regulator activity; Cellular component=cytoplasm; Biological process=transcription from Pol II promoter
atgcaagcagtgacgcgtccacccattgttttggagcgtggagtttccgggcgtgtaaaatggttcgatttcagtaaaggtttttcacattttctcgcactttgattcaccagaacggttgtgtttcttgtccaggttatgggttcatcacgcgggatgacggaggtcaagatgtgtttctgcacgcatcatccatcgttcgcaaagtcaatatgtacttcgtgctgattgagggccagcgggtgagtcggactgattttgagtcgaccgagggattgggacacggagaatcaggggagtacaacgatccccgaattcaggtagaattcgacgtcatcgatggtgagaagggcagggaagcggccgctgtgtcggggcccggcggaattcgcgtgggcaccgccatccaatacaacaacactgcgcgcagtcagccgttgccggccaatgccaacaattccgccggacggatgttcatcgccggcagatttcggcgccccgttggcaaggttttgttcggtgttaaaatgcgcttttttggtcccctcacttttacaccaaacaaatcatttttcgggctatcaaaatggacttctaatggactcgtatgtccgtacaaatgtgtcctgccttcggctgattccccgccaaatttgttttccccatcagccgaacaacaaagccaagtcggccgtcgcttcggtccccgcggtggtcaatggcggcgacgacggtgcaaagggtccgccgctctctctgtccggcgtcactcgcaaaggccgtcgcatgttcaaagcgaatga

SEQ ID NO: 54608 - DNA, 538 bp, Heterodera glycines
  Genomic contig location: Contig_ID=SeqID_4481; Location=1621..2158; Strand=-
  SCN-specific regions: Sequence locations=1-538
ctttgcagatcattcttccggcactgaccttgacgttcagttccccccacacattgccaaaggcagtgaattcattttccgtttgactgtcgtcgaattgctcaacgttcccaaggagtacacggacatgttttgtcagttcaagtaggccaaatgcgaacaatggcatcccattcttcgttttataattaatttccctccagttttctccatcggcacgacgaagcattttcaacagagccagtcaaagggactgcgaagggcgaacatcgcacgttaccgtataattatgtacaggtggcataattagcaaacgcattgccctatcaatggaccatttgcaatgattgcctaattgttccaattgcccttttgaggagttcaaagcggtggtcaactcggcattcatccattacctgcagcactttcccatcattttcaatgttcacatactttataccattttcttttgtttcttttcgcgattttctccaaaattatttttcactatcataataaaataaacgattaattaata

SEQ ID NO: 54609 - DNA, 1594 bp, Heterodera glycines
  Genomic contig location: Contig_ID=SeqID_4481; Location=4116..5709; Strand=-
  SCN-specific regions: Sequence locations=1-508,530-670,692-834,856 -1205,1228-1594
  Gene Ontology: Mol. function=inositol/phosphatidylinositol kinase activity; Cellular component=1-phosphatidylinositol 3-kinase complex; Biological process=positive regulation of cell growth
atgcaactgttcgggttagtcaattcgctaattttgcgcgaagcggaaacgtcccgtcgcaatttgaccatccaacgctattcgatcaccacactgagtcagagcagcggactgatcggatgggtgccgcactgtgacacattacatcagctgatcaagtaactttcagtttattagtcaatgctcatgatctacttatgtcatttttatttaaattgataaaacaaatattttttgtttccattttgtttagagactatcgcgaaaaacgtaaaattccgatttcggaggagcacaacaaaatgcaaaaagtgtctgttgacgttgagaaaagcactttgctgcaaaaggtcgaagcatttgaggaagcattgcgcaccacgtcgggtgacgacttacgacgaatgctttggatgaaatcgccaaagtgagtccagtccattcagcgcaggaggggacttatgactatactttttagtaccgatattaatataattgaattcaagagtttctgatttatgttaatatattgtagtttcattcagttctgagatttggtttgatcggcgtaccaattacacgcgttccatggcttgcatgtcaatggtcggctatattctcggtcttggtgacaggtacggttgagttgggattttcggggaaccttgttttttaaaggcagtttctttagacacccatcaaatttgatgttggatcggcttagcgggaaaattgtgcatattgattttggcgattgttttgaagtggcgatgaaacgggaaaagtatccggaaaagattccgttccgactcacgaggatgcttgttcaggtggaaaaataaacaaaaataaatagttgactgtcgacattgattatgtgaaagcctaaaacatgagctacctctttttacgttcaaagattattttctctccccaggcaatggaagtgactgggattgacggtaactaccgtatcacctgcgaacgcgttcttcgcctcttgcgaaaccacaatgacagtgtgttggccgtgttggaggcgttcgtctacgatccggtgcttaactggcgtcttacacaagaggccgggacagcgcgacgcgctgcgggcggaacacatcacatgccaaccggcgcactgggtgggggatgggacatttgaagcacacatattttgaaactggcaaaaaaaactgatttttttacttgtttccttccaaactctaataattttcacttaaagcggctcccactgaggacaattccgatgcgacgcacttaaacccgcaggacaggtatgactgacccacccaatgccaatcatttaactttaacaatttcagacatgtcttccaacacccacacagagggcttggcaccagtcgcggggacagcgaagcgatcagccgagtccgtgccaaattgtgcgggcgcgacttcaacccgtgtgtggagatctccgtgcaggaacaggtggttatacattcataactctaccgatgcgtataattcgcaggccgatcggctgattgagcaagccacgctgaatgataatctgtgccagtgttatgtcgggtggtgcccgttttggtga

SEQ ID NO: 54610 - DNA, 435 bp, Heterodera glycines
  Genomic contig location: Contig_ID=SeqID_23917; Location=10..444; Strand=-
  SCN-specific regions: Sequence locations=1-435
tccgaaattgatcaatcgacgtttccaattcgtccaaatcccgtggcgacaatggctgggccttaaatttatttttgattttcaaaaaacccaaataaaaatgcacttttgtaaaagtttgtatttttgcaaattttcccaaggtttgacaaatgatttgcggccattcagctgagtaacacctctccaattggtccgcatgaatcagaacttttcttattgagttccccgtcatgtcctttttcctgaacgcttccctccaggccctgatgctccggaaaaattcgttcgcaatttccgcgttttccgtcgatgcttcgagctctttgatcagagcatttccaatgccctggaagacgtgaaaaggcgccagaattattcgttcaaactcaattgattgtaaaagtgactcatcgacagttcccatggtgagcg

SEQ ID NO: 54611 - DNA, 1775 bp, Heterodera glycines
  misc_feature (1229)..(1229): n is a, c, g, or t
  Genomic contig location: Contig_ID=SeqID_23918; Location=35..1809; Strand=+
  SCN-specific regions: Sequence locations=1-304,335-1775
tcgacccattcatttctgatttgccaacttcgtccaattcttttaccgttcaaaatgtgaatatttcgtcgcccaaaggtaagaaaaattgctagtcacgttaaaaacccagcaaatagctttacacactattagttaatttttttgaaaaatggaatggaaaaggatatattacaattattgctcagtgttgaattttggttcgtggcttgcgattgacccaaatggacattaatccgtgatcagaaaatcgaaacccatccgaaaagtctttatttttaactactacttttgttaaaaagggttgtgtgaaaaatttaaaaaatggttattccgaagatagattttcctggaatcaccgtagaaatatttaattttccttttttttttgcgcagtgctaaacagattccgagtgccctctccaacgacagtcggacttgacgaggatgtctctgccccggtgattgcagcggcgacaccctcccccggagagaatgtcctgccgaggccttcgcttccaattccatcgccgccccttcggcctctttccccttctccgcccgcttcaccgccacaacaactgaaaagaaaggacgccgacgtccattcgcccgaagggtcggaaagtcgacgcgcgaaagtggcgcgagtggagtcgccggatgtactcaaattctttttcatcgacgcttatgaggacgccttcagaaatccgggcacgaatttgcctaagttttcgaattatctgtcccttttttacaggcaaagtttatttgtttggtcgggcgaaggaggaacccagcggcactttctcgagttgctgtttggcgctcaaagacatttcacggaaattgtttttcattaaacgggaaaaggtcgcctattcctttgcgttgtgctaattgtcttttcccattaattgtaagattctttcctcgggtattccggcgacggtggaagacttggaaaacgaagtgcgaacggtgttcaagacgaaattcggaattcgcaacatcaaatgcaaaccggaagtaaatgatggacataaaacacatttctcaataatatttgtcgatttgtttagctaattaccaagaaatttatctgcgctgatgaatctgtgcccaaagagtgccaaacgatggaagtttgtgtaaatgtgagcaaacaatttaaatgtgtgcaaaaatccaatgtttggccatttcagtggaaccccgaacgaatntccgtccgacctttctggtgattgctttagtcatgtgatgaacacgacggcaacggcattcgaacgactgatggtcgaatgtgaaatatacggaccatgttggcttagcgtaagaaacgcgggtataaacaaacattcaaattggttagacttattctacaaaagttccgcttctaagttctcgctgagtcgccagtttcgtactgtccattggaatacaatgtcgacatgagcgaaatgaagtcaatctcaatggcactgaactgtgccgatccgctccctccaataagcattatttctgtgaatgttttgacggcattgaacccggaaaccaaagagagtcaagtcggtcgtcccgttttggagtttttttgtttggtcaattttccaccttttcagatcgtaatggtttctctcattgagcacaattgtaacttggaaaagagcaccaatttcgacgcaaaaatgatgctgaacaaacgcttttgtgtggttgcgaagcttaaaaaggggctgaccttaccattcgattggacagccaattga

SEQ ID NO: 54612 - DNA, 851 bp, Heterodera glycines
  Genomic contig location: Contig_ID=SeqID_23919; Location=281..1131; Strand=-
  SCN-specific regions: Sequence locations=1-851
atgctcaagcggatcggcgaggacaaaaacttggcgatcgaagtcaatgggtaaggaaacaataccaaattatgctaattttcttcccattcagatgctattggcacatcccggagagggagggagagtctgggcaaaccatgaaagtgaaagacttcaacagtctgtacccgtccaggtaaaaaagaaaataaaataatcaataattaaggaacatgttcaccaactcccccgtcggtcatccaaaagtcatcctaatggacaagaacgtccactggacagcgcctgaacacattgtcgacgaaggcgtgaaaatggagagaatcatcaagtgcttcgttgtgcctccacgccattgcctctacgacattccggtcatcccaatgcggtggaacaacaggaccctcttctcactctgcctgaagtgcgcggagacgtaccccaagggtctggtggacgctgactacaactgcccgcactttgaagacgccgaaaggggtaactgtcgagtttgcttgcccataattttatattttccttcgcaggattctcgaccacaatcccgcacatcgagctggaggcagcgctgcggttattactagggtagacatatataaatacgtttttttttggattctcaatgctctaattagtaggaaaacattttcttttttgtgtttgcgaacaaaagttgggatttttatattttttggatttttcttcatattacatatatgtacatattttggactttttcgtacatatttcgcaatttttcgtatatatttttattttttgcatattttgaggattttagagaatttatagaaaattttttgtgaaaaattaaa

SEQ ID NO: 54613 - DNA, 763 bp, Heterodera glycines
  Genomic contig location: Contig_ID=SeqID_23921; Location=699..1461; Strand=+
  SCN-specific regions: Sequence locations=1-19,42-432,455-694,716-763
atggccggcgacccctcagcacaacagcaacagcagcaaccgaattttcctgcgtcgcgcatttccatttcggttggtttatctgtttccctcaatccattcattcccctactaatttaccccccccccccattttcagtatagtaaaccgtttgagcaacagcagcagacaattatgagccaacaacacgagcaacggcaggccatcatggagaggattcggcgccggctgctctccgagctgtccttaatgtaagcggccaagccgctaccggaagacatcgaacattgcgcagatacaacgcgcatggattgacggacgtcggctggcttctgcttggttggaaggagcaaatgctgataaggtgatcagcatttggacggttccgggggggcataactttcaaattgctttttggtggtcaacagcgaataattttttccgccctttttcagccgattgaccggcgtggtcgcccagtcgtgcgtgatgggcggaccaaacgccaaatttcgaggacggaaattggtgctgtagttcgatcgcgacgcatcacagcttttgtccgtcaaggaatgggagcggaatgatgggcgtcccagcgaattggcacgggcgcaaccgggtgaccgcgtgttgctacaacgactgacacgcaaagcaagggcgcggccgtcacttcgctcgacaacacctttttattttcttgctcatttggacagttttccgtgttgcagatattggcgcacaccggaaatggta

SEQ ID NO: 54614 - DNA, 62 bp, Heterodera glycines
  Genomic contig location: Contig_ID=SeqID_23922; Location=663..724; Strand=-
  SCN-specific regions: Sequence locations=1-62
caaatggctctttgatggacaaaatgaggcaaattggacaaatggctaacggaacaaaacga

SEQ ID NO: 54615 - DNA, 885 bp, Heterodera glycines
  Genomic contig location: Contig_ID=SeqID_23924; Location=107..991; Strand=+
  SCN-specific regions: Sequence locations=1-201,223-522,548-804,827 -842,866-885
atgagagtgccaaggtccaatgcgcagtacatctttctgatgcgtgcgcccagcgatatgttgagcattcgtaatttggccagccaaatgtttcctcgcgagcaagggtttctgatggacgcgtataagcaggcgtgtgccgatccgtacgggtatctgttggtgaccctacacgcaaacacagacaacctcttacgactgaggacaaacattttcccagacgacgaagaaaagattgtctttgtacccaaaaatggttaagaagcaaatggttggacagcgggtgttggacaactacgagtatctgaagtcccttgggaggacgacatctcacaagaagaggcgtcatttgttgagcagtgcaggttgtgaggagctgctgactctggtggagatttgcttaaacctacttaacggatccttctgtttgacgcggaaacagaaacaaaaattgttgccttttgctaacaccattcgacggttggcacgcgtgagaagtgagcagagtgcgagaaagctgatcttacaacaacaacaaccacagcaggagggaggttcactgtttgcccctttgttggcacctatactgttagaggcagcacgttatctgctacgcaaagatggccaataagctcattcttctgccttttgagcattaccgaggattagttgcagcgagagagggtgtcggcgttgcgaaaggagacgaggatgtggcagggcagacaaatttgggattcgtcaaacgacagctggagaccgcgaagaggaaacggacagcgaatgtcagcgaacgaaatgtattgtacaaccagcagctgaggagatatttgaagctgagaaaggaggtgaaggacaggcccctcaaggtacagctaagcaacg

SEQ ID NO: 54616 - DNA, 875 bp, Heterodera glycines
  Genomic contig location: Contig_ID=SeqID_23925; Location=26..900; Strand=+
  SCN-specific regions: Sequence locations=1-875
atgccgtactgttcaggcaaattgactgtgatggcaccggtgccggtggaatttgaaacggccctttgcgacgcgacgtgccgcgaaggggacacgctgaagctgaaggcggtgcttcttggcgagccgatgcccgacgtcacctggttcatcaacggcaagaagttggaagagtctcagaacatcaaaattcacgccgacgccggcacgtacacagtgacaataaaggtactaaggggcagacgaattgtgacagaatgccaacaaacaatttattgtgccaaggacatcaccatcgactactcggggctggtcgtgtgcgaggcgctcaatgagttcggcaaggcgtcgtcgcaggcgacgctgaaggtgctgccgcgcggggagccgccggactttttggaatggctgagtaatgttagggcccgtcccggctcacaggttggaggaggggaagcatgcatatttgaaatattcattttatttttattctctgcctcataggtgcaccacaaagtcgtgtacacgggcgacccgcgtccgtccatcgcttggttcatcaacgggcacgaggtgcgcgactcgagcgaaataagcatccaaacggacagcaacacgtccgcgctggtgatcaacagcttcagcccggacaaacacgtgggagagatcatttgcaaggcggagaatgacgcggggtgagaagcattttgaaatggagggaaaagccattaaatggtaaataatgagttaatgactaatgcataaatgaaaataagtttaaaattaaaattttagtcattttatcaaaatctcacataaaatttaaaagatttctcggaagtgtgaattggaaaatcagaacacttttctttaaa

SEQ ID NO: 54617 - DNA, 1165 bp, Heterodera glycines
  Genomic contig location: Contig_ID=SeqID_23926; Location=172..1336; Strand=+
  SCN-specific regions: Sequence locations=1-13,38-641,702-1046,1092 -1165
  Gene Ontology: Mol. function=amino acid-polyamine transporter activity; Cellular component=integral to membrane; Biological process=neutral amino acid transport
cagtacagtcagctgtttggcactgacgacacttcggtgccaacagtcgtctcatccaatggcattttgactcaatcggcgccaatgtttggcaccgccggtgacgccaatcaaacgttgaccaccgatggaatttcaattgcaacaaccgcaacgggcaatgccgatgactgcgccaccggcgattcgtcgtcgtcgaccccctctctgcccgacgacagttgcggcgacgcgcgacgaccgtcggcgatggcaaaacgcgtcgacgacggcccttccgcgccctataaaatgggctatttcggcgcaacatcgtgggcaatttcaaattcacttttgtgggcttttcaagccaagactttccaaaatatttaattgatttcccccccccccccattttcagttatgtcattggcaatatcatcggttccggcattttcatcactccgtccaccgtcgtccgttgcactgattcggtggcactttccctcttagtttgggtggtcggtgctctgatcgcttttctcggttccctctgttacattgagcttggcaccagcataagagaagcgggttgtgactttgcctacatttgctacgtgaaatggtgattaaatgccgggcccatttattcacaataattcatttattttttattcaattattattatttttacatttttcattttattttctattttccctctcttcccccaggcattccattgccttctctttcatgtgggtgtccgttctgatgacttaccccgccacaattgccgtcatcgccgaaacgttcggccaatatttaatggagggccttcgccacttttacgccgtccccgccgaatgggcgcccgtggcacagaaatgttttggcattgcgcttctctgtaggtgctaatttcaaagcaaaccaaaggcatttgccgacaattctcccagggcttatcacttggatgaattttttcgcaattggcaaattcgccgcacgttttcaaattgcggcaacagtggccaaattggtgcgcatttccatttttgggaaatatttattttttattaatttaatttatattaataatttaattgatttccaattcacagctctcttgcgctttaattattgtgatgggcttttatcatttgttcttcaaaggggcgg

SEQ ID NO: 54618 - DNA, 358 bp, Heterodera glycines
  Genomic contig location: Contig_ID=SeqID_4482; Location=2578..2935; Strand=-
  SCN-specific regions: Sequence locations=1-7,42-160,217-358
atgacacaatttttatttttaaataatttaattattattttcaaacatttgagcagtccgaccacacatccttgggcaaatgctggtgagcaaccgtattgacagcacaaaatcacacaaaacattaaacagacggacagaaatgaaaaagttgacattcttttaaaataagaaaataataatttttatttttttaaaattaaaaagatattttttgccaggaaattggaatgagacagtccgtcatcattgcctgaatattaatgcatatagaatttgccacgtaatccatcgatttgacattaggaaatggcatttgtattaattttttccataagtttaaaaaatgaacaataaa

SEQ ID NO: 54619 - DNA, 687 bp, Heterodera glycines
  Genomic contig location: Contig_ID=SeqID_4483; Location=1022..1708; Strand=+
  SCN-specific regions: Sequence locations=1-383,406-518,540-687
atgacaattgaaactttgagcatagtttatgtgaaaagttttcaaaaatttatcgtgacttcaatcccgcggaatcccgcgggattggcaaaatggtcgggagggatcccgattcgggatcccgatgaaatcccgatcccgagcaatcccgatgaatttaaaaaatcgctcgggacggatcccgaggtcggtatcccgaatttaatcccgcgggatcccgaagaaatcccgcaggatccctatcccgtccggtctctaatttaaaacctccaaaaaaaaaattcaatttctattcttttataaaatgacatgacaatttcttagttttttttttttgcttttaaattgctctttttgtggcacggtttttgaaaaaaactttttgggaacattggggggagggggagcggcagtgccgataggcgctgccggaaaaaaaatttgcaattttgagtgcgatttgttaacaaattttgtcaaaaaatgattttgactgagggttttttgaaaaaaaatgtttaagatttgaagaaaaagaacattttgccaaatatacctaatttttcaaaaaatcatgcgtttttgtcacttttttatcaaaagaccacaaaaatcctcaaatttctcaaaaggtgttgtgactggggagagtagtccactcggcttggaatattttttttaattaaa

SEQ ID NO: 54620 - DNA, 1155 bp, Heterodera glycines
  Genomic contig location: Contig_ID=SeqID_23929; Location=19..1173; Strand=-
  SCN-specific regions: Sequence locations=1-879,901-1155
atggaacaagaggcattttacacggtgggggagttcgacagaagcaaaattgaccttaacaagccggcgatgactgtcgaagaatacatgcaacaggtgggcggagggattaggagttgacttttgtacgaattgtataacactgaataaagagagaggaacggagttgggcaaacggtgtaccgttttgtctctcatagcgtccgccttttctaaaaaatatcaaaaaggcctttttggcaagaacaagctgaaaaagttgctgatttgcaactactataatttttgctgatataggtttgccgaatttattattgtttccgtttttgtattatttttgttcggcttttgcggcatggaaatttatttgtcggtagcaaatgcgatcattgtcagcttgtttgttggctttttataatgtttttattccttcccaaaggttgtcgttggccgtgagcttttgcccgacgtcgccgtcgcttctcccgaagtgctcaaacggttcagcgccactcccttaagaaagtctctcacaaatcttccgggcatttgcgatgactcacgaaccttcacctccaggttcgggccgaacaaggagtggtgtgtagcgaaggtgcgtttgaatggctcagaatgcttcaacaatggtgggggtgcgtgaaaactcacagcccggggatacattaaattggacacattaaagtgaacatattaaattggcacccatcccggaacatcgtatctttttcgaaaagtattgtggcaaactgttggttgattttaaccatttgcatttttctaaaaatatttcatgcttaattagtaattatcggttggccttttttcagagcaacgaattctctcagagcagatccgagtttgagtgcgtcaaagtgcctgatgatgaccccctcaaagacgtccaattgccccccatggtgaatggtaatgccctctttggtcattgtccctttctttcagaatgattggatgcgttggtgccaagtgtgtttcgagagccgattggagggattcgcaattgcgcctgagaatgagaaacgcttcgcccaccacaaaggcactccgccgacggtgtcactgatcacgagcctcaaagaccaccaagtgaacgagctgatcatccaccaaataaag

SEQ ID NO: 54621 - DNA, 570 bp, Heterodera glycines
  Genomic contig location: Contig_ID=SeqID_23932; Location=641..1210; Strand=-
  SCN-specific regions: Sequence locations=1-570
atgacggtcggaggtggcactgatcaggagaaggagacgaagttggcggccggaagtggcattgacccggagaaggagacgaagttggcggccggaagtgccacagatgcggagaaggcgaagaagatgacggccggaggaggcacagaggctgggaaaggggagatgacggtcggaggtggcactgatcaggagaaggagacgaagttggcggccggaagtggcattgacccggagaaggcgaagatgacggtcggaggtggcactgatcaggagaaggagacgaagttggcggccggaggtggcattgacccggaggagacgaagttggcggccggaagtggcattgacccggagaaggcgaagaagatgacggtcggaggaggcacagaggctgggaaaggggagatgacggccggaagtggcattgacccggagaaggagacaaagttggcctccggaagtggcacagatgcggagaaggcgaagaaacagtggcccagaagccagccgttggaaaaagtgaaacgtcgcattatactacgaaacattgaaggagccgacttatga

SEQ ID NO: 54622 - DNA, 527 bp, Heterodera glycines
  Genomic contig location: Contig_ID=SeqID_23933; Location=450..976; Strand=+
  SCN-specific regions: Sequence locations=1-238,263-527
atgattgcgttaaggtacacttacgacaaggaattgggccggtgtttcatgaagtcggccatctccgattcatacaaacactcgggaatgacttccggactgaaggcgaacactcacgcgggacagggcgcactgctgaggaacattcgaattgcgggaggaactgcgtcagctgttgtgcacttgcccaacacggaggactgcatgcagtactgcacaggtgggcagagggtcaaactggggaagagaggggaggggagcgaacggaggggtaattgggtgccaatgccatcgttagttgggcaaagcatttgcattttcaattggttttttcaatgatacattaaatgctaaaatccattccccttatagcctatggcattttctcgtggagtcctttgcctccctcatcaacaacaacaacggcttcgtccaacgtcggtcggtcggcctcgtccattgttccgacttcctctcaacagcaacaacaaggcaagtggccaaatgccaattgggccatccgcgcc

SEQ ID NO: 54623 - DNA, 688 bp, Heterodera glycines
  Genomic contig location: Contig_ID=SeqID_23935; Location=2..689; Strand=+
  SCN-specific regions: Sequence locations=1-181,239-298,329-407,454 -467,501-688
atgaaaagtggaagtgcaagtgcaaattcggcaattcctcacaacccatgccatttccatttccccttggtgaaggtgagctgttcagttctgcatgagaccgaacacttcccgagactgaggcccaaaaacacttcacatagttgaggctcaagaattttttcaacaatttgttattcacttaaaaaatttaaaaacaaaaaattactattttattttcaattattaaatataattaccatgctgatgggaacagtggtcattagtacacagaagccaaatggtttttaccaatgagaaaatattaaataaaattaaatttttttttgtcctttttaggtccaaccactgcaaaatccaccatcattcatagtaatgaataaaatcagttttataaatttcctttgtatgcagaatttttaatttgttatgtattttttagtttcattcaatgggacaaaatcaagtaaagaattttcttaattttattttatgaaaattttcatttacttttaaatcagaaaatgggacttcaaaatcaggtaactgtacgtacataaagcagacccgtgcatcagcaggccttacaacgcgttcatagttttggcccgagccaaatgagttcgggccggtcagggctctttagaagcgggcttttgcctaaaatctcgaggctaaaatttcaaaa

SEQ ID NO: 54624 - DNA, 292 bp, Heterodera glycines
  Genomic contig location: Contig_ID=SeqID_23936; Location=1102..1393; Strand=+
  SCN-specific regions: Sequence locations=1-78,101-164,188-292
atgactttagtattttttgtaattatttggcaattttttcaattttcttttaatcaatggacaaaatgtgccaagatttgcttcatggccatttttaaacaagtaaaaaatgagaattaatataaaacattatgtgcagtttgttcatgtttttagcagtgatcatcttccgcttcttcttcttcctggaggccaagcggcacaaatggcacatttattggcatttccaaatttgtgatcattttgccctccgtttccaccgaaaatataaaatgaaattcgccctaaatta

SEQ ID NO: 54625 - DNA, 1956 bp, Heterodera glycines
  Genomic contig location: Contig_ID=SeqID_4484; Location=402..2357; Strand=+
  SCN-specific regions: Sequence locations=1-116,171-768,827-1099,1160 -1739,1761-1812,1834-1956
  Gene Ontology: Biological process=positive regulation of growth rate
atgggcgaactgttgcgcagaaaagtgcagcaaaatggggagaatgaattgtgggcaaaaattggcaaaaagatggacgccggagaaatgattcccatggtgggcgaagtccaaccttttttttaataaatatttattcaaatatgttattaaaaattttatttattatactactcgtataaaatatggtgcgtttaatctgcaaaatttcattaaatttcaaaaagttatgactaatgaaattcaaaaaattttggttttcaagtttggttgctttagcgtaaaattataagcaaaattttgtagtttttttaaataacggcatagcacctaaaaatacgccttaaatggttgcaaaacaataaattttctattttttttaaatcatcatattttaaggaaaacctcattttatttcgtaaagaaatttttcaaataccttttttaatctggcatattaaaaccaaaaaatgcactcactaatttactaattaatgccataatttgtaaattcactcactaatttattaattaatgccatcattagtgtgttttcgcctttgtcagagaatatgccgtgaattgatttacgcgtctgtccatgaacgctgtcccaacagttggggcttcgtcgtggagggctttccgcgcacgttggcccaggccgaggacatcgaggcacagctgggccacattgacttggcactgctcatcgactgcacggaacagttctgcaaggacgcgttgcgaaagcgttacacgcgggacaaggaggagggagcggagagggcgggtaattggggaaaaaaggggaaaagccaaaagactaatagccctaattgacgaacaattagccaattaacagcggataatgaagaaaaaaggggaaagccaaaagactaatagccctaattgacaaacaatagccaattaacaaacgaccgattattggagtataaaacccctaattgtgcaaccaattagcaatttgaaatgttgctcaaattaacatccagggaacgcccttctgatcaaatgccatttgcgcctatgtccacatcggttaaaaaaatgttttttttttcaaaagtagctaacctaaattaaaatattgttttacaaatttaaaatatttgaattaataattattttaaaaattctataagaatgcgagtatcgaatgttatcttttcatataacttaatgctttttaactaggattgaaaagaaattggaaccgattttggacatgaacttaaagcttatggtcctcccaaataatgcgataatgaatcgaaactctgccttagattaattttggaattaaattcggtcattgaatgtgaatcaaaaatgaaaaaaaagagacggggtggacaatcaagagtaattagtgaaagaatccaaccccaaaatttgaccgttttatttcttctaatagtcaatttgaaggatttctagtccaataaattttgaaatttttgaattttattatgttgtaataagcatgtttatttatttttcttgactcttaagatgatgacgagggcgtggtccgaattcgcatggcccagttcaaggcaaacactctgccgatgctcaaacatttggacgaccagggcaaactacgcgtggtacgcttggaaagagcggcacacattggggcggtgtctgaaatggcaccgatgggaaaggtcggtggtctgcggcccagcaaattagccaattaaaaacagcaatttttaattgtttttctttttggaaatcaaattacataaagttgaatttaaacgaaaaaaggactcttaaaattaaactctttttgataaattgtcaaaaattgccatttttagaaatattttatgattggcatacggcagtgccagaaagtgccgttggaagatttttgggtttttgacgaattccccagaagaattacgcataaatatcgccgta

SEQ ID NO: 54626 - DNA, 648 bp, Heterodera glycines
  Genomic contig location: Contig_ID=SeqID_4485; Location=2158..2805; Strand=-
  SCN-specific regions: Sequence locations=1-48,83-98,127-153,175 -180,204-338,370-626
atggcggcgattcatcaaacgcagcaaacaattaatggaataagtacgaaaataatttatatgaattttaaataattaatttgacgtataattttgagtaattgcaaaataataataatgtcaataataatggacagatacacttttataggcttaaaattccttttaagaatgggcaattagtcattttaaaacattttttaggcttattaaatgctttcaacgaaattccgtcaacaattgttggcactgaattcgattgtgcaatttgtcttgatccaattccgagtggcacaagtgtgaagcctttgccagcatgcaatgttaagccaatttagaattttaaaaaatttaaaatttcattttttagcatatttttcatgaagattgcctaagcacttggtattttttgaaaactcaattagattattttcatataattaaattttgacgactcaaacgaacgaatgtttcttatttatttaaggcttcaaggtgggaataattcatgcccaatatgtcgttatgtcataatgaatatgccagccgaacgtcaacaaaatggttaataggggagaacaattatatcaaaagattagctaatgaattaattagctgctaattccaaggtaaaattaaacaaataaa

SEQ ID NO: 54627 - DNA, 722 bp, Heterodera glycines
  Genomic contig location: Contig_ID=SeqID_4485; Location=3198..3919; Strand=-
  SCN-specific regions: Sequence locations=1-55,99-194,216-274,310 -483,545-562,586-611,633-722
atgaataaacttcatttgatcctgaaaaagatctcagcaaatgaaccaatcaaagtaaaaataattatttaaaaaatgattgaaatttttttattaaagaattcttcccattcaattgaatattttgcaaataatcacgaatacaatttgatcaaataccgtatcctatcaatttatcacaatgacccaccgttgagccaactgttaaacaaactaattatttctgtaatgagcgtgataaatggaatagaaaaaggtaaaattgtagtcaatcttataataatataaaataagaattttttttaaattcagataaaattgatggatttgggataaaaattttgaaacagcgcttaaaatttgtaattaattttgttgcaaaacgtctccaaatccaattcgacgaacgaagtaacttcgatttttggtcagaaaatggtcaaatttatctgttgcgagagatgagtcattttttggaaaaggtttttttattgtttattttttattgatttaaataaataattgcttttttaaaattaatttaggtcaagatatgcagtcaaaatgacaataaatgctggcataattgcacgaaataccatgaaaatgacaaaaaatttaacgagaaaaagcggacaaagcaatttttgcaatttgtggcaaaaacaattgaaatttgcgaggatggcacggcaaagagacgaaaacgtgcaataaattaa

SEQ ID NO: 54628 - DNA, 1078 bp, Heterodera glycines
  Genomic contig location: Contig_ID=SeqID_23937; Location=504..1581; Strand=-
  SCN-specific regions: Sequence locations=1-114,136-153,175-392,422 -510,544-582,624-1042
atgcatgtctccggggacgcaaaagtactaaacagtttgtgctcactggaaaccaatgccttttcaatgcaattggctgttattttgtgttttgttatgatggttggtaatgagtgttttatttgatttatttaattgagaattgtgaaaaggaacaaaaatattcaaaaattataattattagggctgtcaaaaatatgcaaatgcatatttttcctggattctacgtagtctaattactaggaaaaacagcttctttttggtatttgcttttatttgcatatttttgcatattttgccatttttcgtcaaatattttacgatttgaataccccataagaaaaaaaatatgcatattttgcgactttatgcatatttggtgcatattgcacgaatttatttgtatatttttgcgcatattttggccatttttcgtgtatattttttacagccctgataattatgatataggtgtgtggccctatgaaaatggcttgttttatgatgtatcgaattttttccaaaattaattttgagatttttacaaattcatttgttttaacgatgaggaacatttggatctatattatatttattattttcaagtttttaattataaatttccaaatttttacagtgaaacttgggacccaacactttgccgaatggggctgtgacccagcgccgataaataaaacatacgaaggctgtcgtcccatgtaccctgatcattatgaagatgaaaatgtttggaagtgccattgcgaactctgcgacattaaaagtcgtgaaatgtgcaacgaacaccacggttttgaggaattctacaagaagttcaactcgacgaaaaagtaagaacacaatgcaatatgatacgtggaggctaattctgagatcggcaacaatctgaccaatcataaaaacggttctgctggttgatttatttacgcattcaattttctaatctttactgtagatcatcaaccttggaatttactcatataaatttgtaggcaattgaattttttgatccaataattggtaataattttctttaaattatttacaattaaataaa

SEQ ID NO: 54629 - DNA, 483 bp, Heterodera glycines
  Genomic contig location: Contig_ID=SeqID_23939; Location=1103..1585; Strand=-
  SCN-specific regions: Sequence locations=1-77,123-483
atgcgcgatttcaatggtcaaaagatggacgagaacagcccaattatggacgaacggtaatcacacaattcataaagtttaaagcatttttggaattaatcctttgaaaaaagggaaaaaggcggagagttcagcccaggaaattttaattgtaaaacaatttacaattttatcgggcagttttattttactttatacatatgcacttcagtgaattttctttgcctttaggccgtacgaaatggacatcgaaattgcgtacgactgaagagaatggacagaacgccgtcatcacagccattaaaagaaactaaccaaacaaattaataaccaaattcattatttaatatagaactaattatcacctactaaatagttaattagtgagagagagaccctttttatcactgccactttaatttatttgtaatttactctaaggatggaatcataattattttttattcgctatttataaataaa

SEQ ID NO: 54630 - DNA, 67 bp, Heterodera glycines
  Genomic contig location: Contig_ID=SeqID_23939; Location=1..67; Strand=+
  SCN-specific regions: Sequence locations=1-67
ttgatgacaattaatgctttttttaatgtttttgactttaaggacaagtaaaaattttctaagcttt

SEQ ID NO: 54631 - DNA, 383 bp, Heterodera glycines
  Genomic contig location: Contig_ID=SeqID_23940; Location=774..1156; Strand=+
  SCN-specific regions: Sequence locations=1-225,247-383
atggctaaacactccccgcaacaccaccacccaaatcaacggcagaacacgctcgaggagttgggcgagttcgacgagagggactttgtcccacgttctgagatgctcagacagaacagagtaagtgcaagctgacaaagtccggtgaagaattgagtggggttgcctttaacttcccccccccccttctcaatgcttttccgttccgttctttcgccgttcaccggaaaaaaggaaagtggaaaatgtgtcagtgaatcagttcttatacaattttgaccttttgtactacaattcttaatgctacagaactttattttcaatacactgtattactgccgcattttcctttagccgttcaatgccaatgcattttacgcaaa

SEQ ID NO: 54632 - DNA, 654 bp, Heterodera glycines
  misc_feature (9)..(9): n is a, c, g, or t
  misc_feature (60)..(60): n is a, c, g, or t
  Genomic contig location: Contig_ID=SeqID_23942; Location=258..911; Strand=-
  SCN-specific regions: Sequence locations=1-360,383-536,570-654
  Gene Ontology: Cellular component=mitochondrion
gcagttgcncctgtatgtatctcggaatttcgaaattttcaggatttaaatgccgtattngctaggaggagggttgaaaaaaaaacaaagcccccgagggttctatttttggaaatatagtattggtaatttttgtgatttgagtgtttgtttttgtttagaaacgtgcattctcgttcggctggtacgcctgtaattgaatggttggccgcgcatggggcgcaaaatgtgctgttgcacgccttcagtggcaatgtgaaaaatgctcaaaagggcatcgaaaagggcttcttcttttccattcctccatcctttactctctcaaaagaaaaggcagtgaaagaatcactaagaaatataaaaacaacattgaaaaagtttcaggaagcactgatccagaaaatcccgttgagtcaactttgtttagagagcgattcgcccgtgcttgggccagttgccgaggagcgaaatgaacccaaaaacattaaactcagtgccgagttcatcgccagaattaagaatgtcggaatttactcttttttttacttttttaaattaatttaaaaattgaaaggtttccacggacgaagttatccgagtgacaactgagaatgcgaagaaattgttttcgaaattgaaaatttgatggaatac

SEQ ID NO: 54633 - DNA, 662 bp, Heterodera glycines
  Genomic contig location: Contig_ID=SeqID_23945; Location=210..871; Strand=+
  SCN-specific regions: Sequence locations=1-662
aaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaac

SEQ ID NO: 54634 - DNA, 1499 bp, Heterodera glycines
  misc_feature (1488)..(1488): n is a, c, g, or t
  Genomic contig location: Contig_ID=SeqID_23946; Location=252..1750; Strand=+
  SCN-specific regions: Sequence locations=1-437,459-1088,1110 -1397,1423-1499
atgcatcgcgaaatccgcgaaacaatacatatgcaactgcacagatgcagtgacagttggtgtggtcctagcgacccaatttacgggcggtgcaagaaggggttcccagccccttactcaaaatgtacgattttgcgcccggacaggcccgcaatgtatttccggccttcaccaactgatggtggtgcccaattagaggtaaacggcctgatatacgacaactcacatgtcgtgccgtataatccttatattctgctgcgttaccgagtacaccataatgtactgtttgcatatggtaacaaagcaaatattaaatacgcactcaagtacccttttaaaggcccaggacattgttatgtcgagtgcaaacaagagtccggcaataaaatcggaattgatgagccggctcaatatgccaagatgaacttccgtggtgcaacggaagcatatgccattgttcattcactgccatttgccaaactttcacatcaggttgtcaaacttagcatccatatgcctaatcaacaaccgattgtgtacagggcttttcagctggtgagcaaagctcaacaaatccagcaaggcaaactgccagagacgcaatgttctgcctattggaaacaatggcaaaatgaatggaagcatgatccgaagctcaaggacatgctttttgaaaaagtccctgagcattttatatgggcaaaggacaaatggaacaaaaggaaatataacctaacaaagagaccaccaatcggtcgaattgttcctgtacccccatcggacccggaaaggttcgcgctctattcacttatgcgtcactttcctggagacccagaccatcttaagatggttaatgggttgctttgtacctcattcactgaggctgcaataatgcatggtcttcttgaagacgacaaaatttgggacaaaactctggcggaggcagctctatcgcgctggcctgatcaaatgaggtggctcttcatgagcatcctcgtttatggccagcccagtaatgccgtcgaattatggaacaagtacaaagaccaaatgtactttcctcaaggcattaccacaccggcacaacgccaagcagcagagcttgaagccctagccgacattgattggcggctgcacagctgctttaacttaagctgtgtgcattttagcctgccagacccgccaaactcaattgccaaaaatacaaatgcggcaattaatgagtttttctttggcgatgatgatttgaatttaccgcctggccaaccaaatcctcggcctaagcaaatcactcctccgccactcaacagcgaccaacaaacggtctttgatgctgttgttaaggctattcagtcggacccaagggattcgactgtcccccgccgtttcttcatatacggcgatggtggcacaggaaagacattcctgtttggccaaattattaggcgcttgcgaaaggccccatacacctacaaagtgcttgctacngcatccactgg

SEQ ID NO: 54635 - DNA, 873 bp, Heterodera glycines
  Genomic contig location: Contig_ID=SeqID_23947; Location=172..1044; Strand=+
  SCN-specific regions: Sequence locations=1-3,39-59,82-156,178-236,259- 493,516-536,579-813,836-873
atgattaataaaaatattaaaaataatatattttttatccttcctttggaagtttggagtattttatatatttattttcaactgctgaaccccttgacagggataacaaatgccgacagtttggagaacagtttcgacgaatttgcgcaattggtcgttcaaaatgagaaaaaaccaaaggtttgttggaattcgtttaaaccaattaaaacatttaacggtcacagaactgcccacaaatggatgacaatttgttggagaattcacttgcttcactcaaaaagcaattggacggaaacggtggaaaaatgaaaaaataataacggaataattaatgtcccaattaacaaacagagtccaaggtcaataatcttgaaaatcagctgaaggaattgatgcaaaagcaaacggacacttctgagcagcaagaaatggacaaagcgcaactgttggcaaaaattgacgaggtgggagagatatggggacaccggacaaaagggcgacagaaaaagtcgcgactccgttcatttcttttcataaatgaacaaagaaaaactgacaaacatttagaagaagcatcattcattcaatattgtcaagcgattcgcttgcttttaatgttcttttccgtaaattttttattgaaatggttcaaatatcaaccgttaatttaaagaaaaaaaaattggatattttttttacaaatcgttacacgctggcttttgttcttgtccgtaaatttgttgaagtcgttaaaatatgaacgtcaatttaggcgctcgaagtgcagaaaaatgcccagcaaaagacgatggaatatctgaacaaaacgaatgaaagactgaaggcgacgggtaaagaaaaaaaatgaaa

SEQ ID NO: 54636 - DNA, 75 bp, Heterodera glycines
  Genomic contig location: Contig_ID=SeqID_4486; Location=1486..1560; Strand=+
  SCN-specific regions: Sequence locations=1-75
tccaagtggggaattgaacccaggcgaaaaattatgaaaggtagaaagtttaaccactacaccacatgtgcatgt

SEQ ID NO: 54637 - DNA, 456 bp, Heterodera glycines
  Genomic contig location: Contig_ID=SeqID_4488; Location=931..1386; Strand=-
  SCN-specific regions: Sequence locations=1-124,147-456
atgccgggttccgggccgggttggattttcaaaaacgatcgggttccgggcccggcctctcaaaacccggtcaacccggataacccggtcaacccggattttcccaaaaatcgccgggccgggttgccgggcccgggaaaacccggtacccggcccggcccggtccggactctagaaaatacattaaacacaaaggttgtattctctctcctattcaaaacgaataagtgataaagatagacaacggaaggaaaggcgagagaacgcaaagagtgttgccccaggagagaaaaagcgagaacagagaagcaaagacaaggagtgtgcacgttagaagaagaggaaagtgagacagtttagcagacacttcacaaaaccccttgggggaccacgaaaagcgaccgaatcattgtgaaacgacgaacgcaacgcaacgcaaggcatagagacaataaa

SEQ ID NO: 54638 - DNA, 130 bp, Heterodera glycines
  Genomic contig location: Contig_ID=SeqID_4488; Location=436..565; Strand=-
  SCN-specific regions: Sequence locations=1-24,59-59,116-130
atgccttccgctcgaacttttgttcgaaattgtgcctctcatccctgccgaaaatgccgcaccgaatgcgctctcgtcctgtcggctgctgcacaaacttttgctgccacgtgtcttaaaatggaaagag

SEQ ID NO: 54639 - DNA, 1077 bp, Heterodera glycines
  Genomic contig location: Contig_ID=SeqID_4489; Location=191..1267; Strand=+
  SCN-specific regions: Sequence locations=1-551,574-821,846-1048,1070 -1077
atgaatgaaatattccccttggatatgcgtggattcggaaagggcgtcgccaatttggccatttacggtaccgcgtgcgctctcgaccaaatgtttcctgtaattagtttttttttgccaatttttcatttctattttattttcgcagatttttctcaaccaaattggccaaccgcagacttttgccatttttgcgctgatcggtttttgttcactgtttttcacgtggcgatgtttgcccgaaacgcatggcaaatcattggaggaattggagaaacaattcaaattaggcgattggaatgcgctgaaaaagcgccggcaaattcacaaaacttacgacgcagcgatcagaacagcccaaaatggatcaatcaataatattcaaatcaattgagaacagcagggtctcctccgtattttggccatttattataataatgaattattttggtgtttttttttgggaaagccgtaatgaatccaaaaaatttaagcaaaattcgaatatttaatgtggcataagatttttgagttattatgattgttagcaattttctcttttttaacataatgtcccaacagaatttatcagtacgttccggtaaaaaggcatttaaaaaattcatcgtttttgaatttacacagaaacaaattaagcagcaaaaaaaaacatgaacaaaattgtcgggagggatcccgatgaatttaacaaatcgctcgggacggatgccgaggttgggatcacgaatttaacaggatcctgaaaaaatcccacgggatcccgatcccgcccggtctctaatctaatgcacttctatgacataaaaatatatattataaaaaaaggacaaaaaactttttcactttaaattaaatctaaccaacatcggcggtgcttgttcagttgccaagtgccaatggaattaagaaagttatcaaaaaaacgagtaattgtttcgaccaaaacaaaggcttctcggactcgcacctgcaaaatttgtctacagttatcgagcgaaaagcttaaaactgttcataagtgaacccaattttcattttttaataatacgcccacta

SEQ ID NO: 54640 - DNA, 267 bp, Heterodera glycines
  Genomic contig location: Contig_ID=SeqID_4489; Location=1829..2095; Strand=-
  SCN-specific regions: Sequence locations=1-146,168-267
actaatagagcatctgaagagctttggaatgataccaattatgtttgatttggatgacaaagaaaaaagttatagtccaaaaacatggtggggcccaaccagggtagacacagagtttccatccacttccccgtcccgtttttcccatccacggaaacagggacccccgcagcctgggatggacataaaaacactttaataacatcgaaccggagaagctgtgttggactaaaagaagagttcaatactgtaccacaatccaataaa

SEQ ID NO: 54641 - DNA, 2038 bp, Heterodera glycines
  misc_feature (1143)..(1144): n is a, c, g, or t
  Genomic contig location: Contig_ID=SeqID_23948; Location=158..2195; Strand=-
  SCN-specific regions: Sequence locations=1-290,325-401,429-434,458 -699,724-1163,1185-1287,1327-1396,1433-1769,1803-1971,1994-2000,2029 -2038
atgggagtatgttgatcagggggagaggggggaatagggcctaacaaaaccatgcgaaatgcacaaaagaatggcctaaaattgtgaaagtattttcagccagaattgccgtcaaactcgagcaaagcactccaagagtcgccgaccctgggcctgaactttgacgtcgtgattgacaaggaccagcaacaaatgcgaaccgtacacctggtgagtgggaaatgcgccggtgccgcccccccccccctcaaataataaaaaaattccaatactcatggtatcattattttttgaaattttggcccaaaaaaggggcaaaatttgtcactttttggctgaaaccctctacattttttttcccttttccggtcccgccgcaatcccccccccctcacctccccgaaaattaaaaaatatatatacttcctgctccgctctttttcttcctcttcctcatttctttttttaacagattgaagatcgcagatcttcgccatcggaggcctttcaagcaaacatcgcgcattcgccagttggagggtaattatgtgaaaattgattaaacaaaatggatactttttcatgattctaattagaaacacataaccataaccacaaaaaaatttttttttccttttctgcctattgttttaaaaagattacgaattttgttaacagtaataagattttttttaaatacacccattttcctttaaaaaatttggaggatttccccgcttcataatcacggccctatttcctcgtgtagtcctctcacccttgattaccatataaaatactgatttatctctaacttttcgggaaaatctgaaaattcttctgtttttgcagcacgccttcgccgtaggcttggcggaaatttcctgcacttcatgaggcgttttcttcgacgccgtggcactacaaacaggtagtccatatgaaaaaatgagtgaaaaggcttgcaaacgaaatttcattacgagattgaaaaaaatcgaaattttgaaaaaaataaaatggataatgaagtgcgctccgcttaaaaccttgtctgctcttcgattgcttgaagaatcggaccctcataagtcaacagacaatttctcattcggttttgatgtgctaaaattgctatattannacaggcaaaaaaagtgcttgagagagtggcttcgtcagtacgaggtctctctttctagaaaaaaatctgtttcagccctgaactcgtatacagaacaattgtaaaaaaaatggcacaaaaacaggttgcacccagacacagcaaaaccagcagcaggccatcagcgccaacaacatccagctcgcgcctatatttagaacaatgtggagaggaaaaatgtttcttgtttaaaaaaatattgtttgcaagcctttaatatggaaaggaagaaaattaaaaagctagaaactaggaaaaactccccaattatagtcaatggctcacggcgatgatggaaaagtttacgacgccccaatggtcggcgtcaccgtcggcctttcaagaagtggcagctctgggggcctcttactttgaagtggctgaaacagaccccttcgacgccaattcgagaagaaactcaattgtcatcactgccggaggtggcacgctggacacactggcaactgactccatcatcattgcccgctgtgccgccaaaaaaattatgcgtgagcaacaaaatagttatttggatagggccaacctccacttgaacatcgtgtccacggtttgttttaactgttgccccaaaaagctttttaacttttttaaatcaagttctgaaacagaaaaatgaaaacagtgcaggtggggaattataaatcccttcccggataggtttaccccgcatcgttgctcttcctgaaaaattttttatcttcggtccaaaacttacaagaaaatttttctccatctgataattttaaactttctttgagctttttttccaagacaaatataaaaatggcaattagtcaaaaaattttttttacaaattttaaaatctcaaataaa

SEQ ID NO: 54642 - DNA, 124 bp, Heterodera glycines
  Genomic contig location: Contig_ID=SeqID_23949; Location=235..358; Strand=+
  SCN-specific regions: Sequence locations=1-124
atgggtgcgacgcttttcgccacggcttgttgttgtgcaaaacggcggatggaagcacaggtaaagaatggacaagcaaacaacaaaagtgaagagacctcaattctgatcagtgctgatcaaa

SEQ ID NO: 54643 - DNA, 1053 bp, Heterodera glycines
  Genomic contig location: Contig_ID=SeqID_23950; Location=122..1174; Strand=+
  SCN-specific regions: Sequence locations=1-113,153-421,443-536,558 -830,860-923,945-1027,1049-1053
atggagttgaggggatttaaccccggggaaaagcaagaagtgggcgtgttcttctacaaccaggcaattggctaccacgacctcagtgagtggtgacaaaagctcaaacattgtaaaaaaaataattaattattactttaaataatttattagccaaaaagtgtcgacttttgttctttcgtttgaatttaaaaatattttagtatgtaaaaaatcaattaatgaaagtaaattactgtttaaaatcttagttggcaagaatgtgctgaagattatattgaacaaccaaaacatcagcttaagcagcacttatgtgagttttagcttggtatttacttgtaccatattcttactaaatgtgcttaattactttatcaatatgactttagcggtgcttaaaaatgggtttcaaatttatatttccaataaaggctccactttatatgatataagcttgcactaacaatttttaatgtgtactttgcattaatttttgttataattaaatttgagtccgcttttcgacaaggcgctcaaatttgtcatgaatatttatttagccaaaacaatggggcattgatgtacaagaagacaatcgtacaatgcatggagctctaagagcgaataccgtactgaacttcacaattacggtgaaggcgatcagcgattttgagttgattttgagcaggaagggcaaaaaagacgcggaagaaaaagcacttttaaagcatttattcaaacaaattatggtctcggaacaaaaacagcctttgcccgcgtgggccactcaatacgttacggtaagtgttactgtaacaaatcagttgaagttattaagaaaaatttaaaaaatatttaagataacttacaaagggatggcaactccaaaagcgcaagtgttttgtgtgccggaaaatcgttgtaccatgaaaaatggagaaatggcgtacgaatatgtttttaataaagcaaattccaccaattaatagcaattaaattatgttatcgtttttttcattttcattccctaaaattgcacattttgaaatttga

SEQ ID NO: 54644 - DNA, 1873 bp, Heterodera glycines; identical to SEQ ID NO: 23953
  Genomic contig location: Contig_ID=SeqID_23953; Location=1..1873; Strand=+
  SCN-specific regions: Sequence locations=1-51,76-693,715-1270,1337 -1385,1470-1584,1638-1668,1718-1732,1756-1873
  Gene Ontology: Mol. function=sodium dependent multivitamin transporter activity; Cellular component=integral to membrane; Biological process=molecular hydrogen transport

SEQ ID NO: 54645 - DNA, 542 bp, Heterodera glycines
  Genomic contig location: Contig_ID=SeqID_23956; Location=573..1114; Strand=+
  SCN-specific regions: Sequence locations=1-36,58-107,179-291,318 -375,397-472,513-542
atgactttttattcgaagcatgtggcaatatcaataaaaacattcatgaatttaaaagtttatataagcagaaatgacttttttgtcggtgttcgttacctaaaaagtaattataaaaatatttaatactttaattcaatttttgattgaatgttgataaaaataaaataaaattattcttaaaactcgtcattcttaagactgaaaatccgagaaatagtttatcgtttgttgtagaagttgagcgggaccgcaaattttggcaaatccgggaccggcacttgcatggacaaatttattaatttcaaaataattttggatttttttatctattatctttgaattcaattaaattttaatcagctatgctgaatgttttaaaattaaaaatttaatcatacttttcgcaaaagttgataaggttttttttttaaataaaaccaaaatgcttcagacataagatttgcacatcaaaaaatttctttaaaatctatttaattttattttatttagcctaaattaaatgataactatatgtaaaa

SEQ ID NO: 54646 - DNA, 313 bp, Heterodera glycines
  Genomic contig location: Contig_ID=SeqID_23956; Location=1302..1614; Strand=-
  SCN-specific regions: Sequence locations=1-206,228-231,253-313
tcggggtgtccgggggcttcttacaccggacacacggttgaaaatattgtttcgacctttaaattcggacgtgaaattgaactgaacgagtttcgaaaaaatcgtcgtgcattttatgaaccggaaatattttgcggtttaaatttcaagcggggtaaaagcatgacagcgttaattttctggaccgataaagtcgtaattacgggaactaaaaacaattctgaaattgaggaaatgtatcatcatattctcccctatttgaaaattgctcaaaagaatttaatgagacgataaaaattttttatttattgag

SEQ ID NO: 54647 - DNA, 2398 bp, Heterodera glycines
  misc_feature (1964)..(1964): n is a, c, g, or t
  Genomic contig location: Contig_ID=SeqID_501; Location=388..2785; Strand=-
  SCN-specific regions: Sequence locations=1-42,65-280,303-402,432 -457,494-564,641-828,850-883,906-1062,1145-1173,1209-1371,1393 -1575,1629-1751,1774-1776,1831-1973,1995-2110,2134-2172,2194 -2283,2305-2398
aagtgaatggcgatgcaattagtttggaaaatgatggacaatttgatggaaacagtgaaacgatcactgatcaacaacaacagcttaaggtgggcggaagaaaagctaacagaagaaagaattgcagaaaaattgaattaatgtgagacaaaagcgattttgttaatttaaattcaggaatttcatgaaaagtttgccaaattggaaacggaattgaaaatggccaaattggaactggaaaatgtgagtttgctataaaaatttgagtaaattataaatgccaaaattttctaattatttttagaaggcactaaagttaaagcaccaggaaatgataggcgaacagaaggcattgaaggaaaaagtggccaaaattgaacagaaaaacggtatggtaaaatgaaaataaataaagaaaaatatatttttaacaggatcattttttacgaaaagaatcataaaaatgtttaaatttagattttaaaattaaaatgtcatcattcacgacttcttcatcggccgacgaattttctcctcttcaacgtaaaaaatttgttaaaatgcataattaaaatacaataataaaaacatttttcaataattaaatttgctaaaattaattttttaaaaattaatttttcattttcagcaatttttccaaatctgagcacatcggaggaaatgagtgttctgattgcccgaattgctgagctgaatcgagcgaaaacaacggagccatctgtcgcaagttgtgaagtgtttggacaagacggatacggtagggaattttgtataattgagtggatacagtatgaaaattatacattaaaagaaatggttttgaaatttattaatcaaataaagcgaaaaatttgggccctattgctgcagttcacaggacaataataaaagaaatggcctaaaattatttgaacacttgaaactatagcattttatagaagcaccacccaaattaacattctttgtatcatttatagctccaagagtccttttattctgtaaatttcataaaatttgttttgttcaaaaaaagtaatggccaaaaatatttagaaaataacttttttatttaaaatagagccaaaaattattattttaaattttatttcataaattttattttgaggaatgaatgatgatcagttcagtctggaggaagaagaagaaggaaaagaacagcaagaagacaggaaaactccgacaaaagatggtaatatacaaatattagaagacattttcagctataatttgctaacttaacgacaatttaaaaaaataattgaaaattgcttcaaatttcagtttcggaagatcatttgaaagcaattttggagagaattggtgaaatggagaagcagcaacaacagcagacaaaaggcgagggcaatttaacgaaaatgaaatttttgggcttttctttggtaactgcgcaattggacatttttcgaatcctttaattattgagaacattttgactggcaacagcagaattaatacaatcagagaaaatcttaaaactcgaccgattctgcgaaaaaatgccaaaaccataggaatataattattaaatttattttattttcatttaaataaataaataattaattgttttctattttaagctgctgaggaacggttcttacaattgcaaaatgatcagaagaaaattttggaaaaaatcagtgaattggagaatcagacaaagaaaaaggtgaatgaattggaagagaaaaataaagtaaaaatattttacggtaaaaataatttttaatttatttaataaattattatataatattattaaaaaatcgaattatttactttcaggggtttttaaaattccaagaaaattgttggaatgccttcgcttgtcacgaggacatcgaaatcagtggtgacaaaagtctcattgtccagaatatgggaaattataatggtatttntaaaatttacataaaaattcaatttcccttaaaaaggttggcgctccgtcttcgctaaatatccgattgtgctgaataagcatttgtccgactttttttactacgaaatttcagttatgaaaaaagagaagtaagcgaattttggtataaaaagtgaaatattttaaaatttatttctttattcagttggggcttcatcttcggattcgctgttaaacagcagacaaaattggatgaaacaattctacttgaaaagggcacttatgcatttcacagtgatggcgaagcatttgacagtgatggcgaactttggattaacggagaaggaaagggaagaaatggcaaatattcctacggtgttggcgataccgtaggaattggcgtcaattcggccactcgacagatcattttcaccaaaaatggacttcgtttgg

SEQ ID NO: 54648 - DNA, 612 bp, Heterodera glycines
  misc_feature (222)..(222): n is a, c, g, or t
  Genomic contig location: Contig_ID=SeqID_502; Location=74..685; Strand=+
  SCN-specific regions: Sequence locations=1-529,551-612
atgccgtggccattgtccgcggttgcgcttcatcggtttagtgctttggcattgggcggtcgggcaaggtccgctaatgaccaccagcagcagcagcagcacaacgggttgcgggagaaagtgggccaaggccgggcacaatttggggaccgggaaaggcacgccgaactcggcaagaagttcagtctgttgaagaagtcgactagcaatgacggagcagcncatgggatggtcaacttttgtgttatctatcgaccatttctcgtgttcggctcgcaatcagtggacattcttttgttcatcagggtaattaattaattattaattgagcaattaatttttgatttttggcactttttcactctccagggccttttggaaggtcatttcaatgcaaaaacaatggacgaatatttggagaatggcaagcaaactgagaccaattcgtacttgttgaccactcatttgtcacttcgaaagctgaccattcaattgctgacagtgggagaacattttggatacaaatttcaatgtgaagaattaagaaaatgatgaaaactcataattgtaggctgttaaatttaatatgagttatctccggattttttgcta

SEQ ID NO: 54649 - DNA, 411 bp, Heterodera glycines
  Genomic contig location: Contig_ID=SeqID_502; Location=2390..2800; Strand=-
  SCN-specific regions: Sequence locations=1-411
atgttcctttcatttccaactgatcaccggcagcagttgttcccattcgtttctttgctttcccccggtgatcaaattgatgcaaattttggaccaaactttctctttgcgaacacataaataaggaagagacgaagaacgatcagacaaatttatcatgctcttttttatgattttcgaatatcatttcacttttctcgttaaacagcttttttattccagggacacaaaggaattccgcccttcgatacaaaaattgcaagtttatattagcgataaattgaaggactaaaaagttcacaaatggtcaaatatggacaaatatatggattagaaacctcaaaattccaaaatattcaatttttgcttaaacaaacataaaaaattccattaaactaaaacaaaaataaa

SEQ ID NO: 54650 - DNA, 695 bp, Heterodera glycines
  Genomic contig location: Contig_ID=SeqID_503; Location=13..707; Strand=+
  SCN-specific regions: Sequence locations=1-695
gctctcctttgggccgatgagaaatgccgtcagaatggcattgactgctcgggggacaatcgtcgtgccgtgcttggccctgctctgttccaaattcgttttccactcatccccaaagaggacttttcggaacaaattggtaagcattttaaatactttcatttaattaattgatttgttttttagtgccttccggcgttttgacaaatgacgaaatgtttgccgttttgctgtaccattcgagtcgcgaaattgcaacagaatgccaagctccgtgcgagctcaaatttgccaccattcggcgcaattacatttgcaagcggacttttttggtgaaaattgaacagttttctgcgcttccacgtgcctccgataagaattacgagccaattgacagcgccgtggtggacatcaaagggatccgatggcaattggcctattcgttttttttattccaagtgaacaaaaaatccggttactttcgcctttctctcacgtgcaaccaaaatgagaaaggtaatactcagctgagaaatcttaaagtgattaattgcgcaattaccaacacaattaagctgccgattggaagtgccattgttggacaatcacgcgaacaatggcacaacaaaaaacgggcaaaaaatgcgttgtctgggagagagatgacatttttcgtcgctgcaggccagacttaa

SEQ ID NO: 54651 - DNA, 1717 bp, Heterodera glycines
  Genomic contig location: Contig_ID=SeqID_503; Location=864..2580; Strand=-
  SCN-specific regions: Sequence locations=1-79,102-146,176-501,587 -589,611-756,778-868,891-1347,1372-1567,1643-1717
atgccaattctgcttttcgagtgcgttttcagatttttcgaaaaagtccattttttgcaggccaatgttgtcaagacggaacagcagcaccagcagcagcataatgaagaggacgggcaagtcgaatatggtaagtgaaaaaaaagtacattcatttattgtcatttcaaatatacgaattatgttggttttttaatttttaattttgaaaaaacttaaatgcgcttaaatctaaagtttttgaatttttcataaaatttctccgactctattcatcttgtaaaaggtttggggcttctacttttataatacatattcttacctatttgggagtttttatttatacttattaactaggtacctatttttatacctgttttggcaaaaaatcttaacaaaattgcaataaaatcaaaaaatatacccctaagaatcgaacagaaaattttttcaaaaaatacacccataagattggaaacttttcatgaaaatttattccccaaatttattatttttttattaacaaaatttttaatgtaaaatggtcaatatttttctaagtaaatattaaaatatttaaattattcgtttacaaagcaatagaaccaaaatttttcatctttgtttgctcttttccacaaaaaaatcgtcaataaatatttttatttacctatttttatacctatttcgggatttttttacctaaatttcccagccctactaattaatagcaataaaaggcaacaaaaaattaatttattttgttttaattgttgacaaaataattcaaaactcttgattaataaaaaaatttaatgacgaatttttaaatttatgtcccaatgatgtgcactttttttgattttgatttcaattcataaacacaaaaatgccgaaatgctaaaaactagagtagagcgggaccgggaattttgggcaaaaccgggaccttttcgggttgaaaaaccgggaatttttgggtgggaaacccgggactaatcccggtcccggttactcagttgtctgtgttttggtcccggtcccgctctactctactaaaaactaataatgctttgcccggtttcagttggccaactgactcggtttcaaaatgatcagaatactattttgggacgaattgtccaattggagacgcagcagcagcaaatggtcaatttgggcgtcactggacaatcggacagaaaaatacacaaaaataagaaaatgccgtcgccgaagtcagccgattgtgccataatccacaagacgttatttgcatgcgagtggtcaccgtgtcctcctccgcattgtacaaaccgttggccgggtccatcaattgctaaatcattttttaccattttatggtgccaaattattaacaaagttttagcatcaatgttttttttttacttttttttgaaattaacattttacaagagaaataatctaaagtgactttttagcatattaaaaattaaatttcaaattgccaaaatttgttaaagaaaaattaattaaaatactggcaaaaatttcaaatctcaagacaaaataatgaacaattttgaaatattaaaataattatatacgaaaatttgttgattttgacaaaaaatttttaaaaatattttatagaaaatttgaaaaatcctttttctggattattaacaggagaataatttgaagacaaatttaaacattttttagaaaaaataaa

SEQ ID NO: 54652 - DNA, 947 bp, Heterodera glycines
  Genomic contig location: Contig_ID=SeqID_503; Location=2940..3886; Strand=-
  SCN-specific regions: Sequence locations=1-232,254-466,489-500,522 -673,792-947
atggctgatccaatcgactcgaaatattttggttttgtgccagccactgaagagcagcagggtaatggggaaaatcacaataaaaaggaaatgcaattaaaataaatgattgaattcaagaacatacattaaaaaggggtaaaatatgccaaagggtacaaaatgagttttatgcaaaaaattctaaacgaaaggcagtttattgctatttttattttacaaaatttacgggttgaaaatctgtaataaaatgaataaagattttcaaaaaaaattccaccggcatcgcttatgatgatgatctcagcaaactcgctttatctttgaaatcctaaaaatgttcaaatggttgaaaatctaatatctaaatgattctcaaatgttttccgtcaatttttaaaatctgcttaaccataattggattggactacccagaaatctaaatttaagcaaacattaaaaactgagtttcatttaaatgggactttgccaaaacaggcaattctgctgatgtgttctgtttgggccaatttctgcccagtggcgccgtggagtcgtcgtcatcaatcggtgctgctggtgatcatcagcagcaaggacagcagcagcagcagaacacggcgatggtgggctaatttatattagaacccaaaaattgtggccaagaaaattgaaatatttaaaaaaaataaaaaatatatttttgcataagaaatatttcttaaaataaaaaaaaataaaaaattttaatcattgaaattattatgtttaaaatgaatattttatttttagagcccggaattttaaagattctgggcttgggtatgggcttagacaattgaccaggctgggcttccctgtcaactcgggtccggtcccaaattttcttggcgcccgccgggctcgggctttttccagaatttgtggaagtttatttataaaataaa

SEQ ID NO: 54653 - DNA, 1321 bp, Heterodera glycines
  Genomic contig location: Contig_ID=SeqID_503; Location=3984..5304; Strand=-
  SCN-specific regions: Sequence locations=1-872,894-936,1006-1098,1123- 1126,1181-1288
atgcctcctttaacagtacaatcagtaataattttttcattggcagataaaatcaaatctagccaggaacgcggaagacaattggtgcttggtcgacgtccgtggcattcaaaatttcgtccacaacggcacgatcctcccgggctctctccgccgctttgtccgatttgctttcgggcatatttgtcacaacgacagttctcagtcgtcgttcctcctcgaccgcgtcgacagccgcagcctgtgaatgaattaggacggaggcggtgcttaagagggagtgaagctgcttaataagaacttggcgtagtcgggaatggagttgtctgtgtcaatttctttggggatttgtagtgggtcaaggtcggataaaaatttttttggggcagtgttgtcagaaggaggagaaaaatttgccattctctttgccatcgattaggagaggagatgacaattttgaaggaatgacaattgttgagttgaagagtttttatagattttttggaattttcaggctttttggaaacaaatgatggcatcctttttctgtttccaaaacttgttaacaatcgcagaaaatttcaaaaatttaacccgagggcacttaacggcaccgccgaaccaacaattcctttggttttacaaaaatttgagtcaaaaagctcacaaatttgtcattttcatgaaaattcaaaaattacatttgtacattatatctttagtgtcaggatttaacaactcaagcaaaaacgtgaagcattgattaagaaaattcccgaattttaattaaagagtgcattttgctttatagattccctcccatcaatccgcttcattttttgagtcaaaattttgctggacacatttcatttttggtgatcccacaaattctttatggccactcatttttcaaatctatccaatttctttttttgcttattttatttgtaaaattatttttaggtataatttataaaatttaaatttagtttaaaacaaaaaaaactgatcactgatttgtgtgtcctgccaaaaattgtgacgcaaaagacccaattccgatcagcagcaggggcatttttcccatctttttgaaagttttaaaaaaatatttttaattaagggagtttaaaaagaaaactataaaccttttttgtcatttttaatgataaaaggataatatcatatgtaaaataatttcaattttctcattatgtacctctttaaatgagttcacaaatatttaattgagcataatatttattttgtttatttagcgcccttttagaaattttatatatttttttgttttttaaataaa

SEQ ID NO: 54654 - DNA, 667 bp, Heterodera glycines
  Genomic contig location: Contig_ID=SeqID_504; Location=21..687; Strand=+
  SCN-specific regions: Sequence locations=1-247,269-356,378-667
atgacacctgcacgggacctggactcaatcactcccgcactcgcagagcaagaacgccaacgcacattggttctccttggcctcccggaaagcaatggttttcgcccatcggaacgtgtacaggaggacaggaaagtcgccatcaaaattctggaccagcttgatgttgaggctgagccaaccgccgtcttttgcctcggccgctacgacccgcagcgaacaacaccgcgcccgctcagtggtcatgccaacacccacaccaccaacatgtggcacttgggggatggaagcgcgagcgtgctcgactccgttctcaacagaacatggcccgtctgttcgtccgccctgcgctgaccaaagaacaactcaagaaggaatacgaagagtgcgtcagaaaacgtcaacaaaactcagctccaatggcaccggcaagctcacagacaaatggcccgactcccgttgtcgaagatggaccaaaccaggaggaggccagcgacgacatttccaaaccgccggaggtttttgaccaaacaatcctcgtctgttatgaagcattaaactcattaccacccaccgacaaaattgttcacgaaatgcaatcgctcaaaaaacaattccctcatcttttcaacaaatagttctaccagacctccaacaatttcttcaa

SEQ ID NO: 54655 - DNA, 461 bp, Heterodera glycines
  Genomic contig location: Contig_ID=SeqID_504; Location=1239..1699; Strand=+
  SCN-specific regions: Sequence locations=1-247,270-271,293-437,459-461
atgccggaccaaatgagatttgggacgagaaaattggaggaaaaaggtggcaaaaaagagaggcggatgaatgagaggcacttgacgaatggcaccaaaaaaaggtaagacgaagagcatttctgtcgatcattcttactccatttcagaaggggaatcagccggcggcggtggactaggcgcataaagctataatttgaaaaatgcaagaaaatatgttttaatgaatcactaaaaaaatcaatggattaattttaaataaaaataaacagctattttttattataggtttttatgggcatttgaaaattgcatttaattttgtttgatacgttagcttacttcatttagcacgtcgctgatttcactcatgaacccgtcccaggcatcataagtggcgaaaaaggtgaccatacaaacgtcccatggctgtttggttttaaaatatttaattaaaagaa

SEQ ID NO: 54656 - DNA, 2083 bp, Heterodera glycines
  Genomic contig location: Contig_ID=SeqID_504; Location=2644..4726; Strand=-
  SCN-specific regions: Sequence locations=1-46,78-97,123-231,254 -398,427-447,479-1080,1103-1326,1371-1375,1397-1405,1442-1478,1522 -1601,1631-1731,1753-2083
atgggggtctgggtgagaaaagagaagggaattggtgagggatcagaaatttttgataaaaaaaattaaattatttacctcaaattttactatttttcttaagaaaaatttttgtttaaaaacttttcgatatccgaaaactttaaaatattaataattttgcgatttttctgcttaaaaatggaagccctattaatgaacatttagaaaatataaaaagtcaccattgtattttaatttaattcattaattttcaagaaatctttgcccttgtttggccttagccgatcggatgtttttgtcagcgcaaaaattaacattattcgacctgaatccgcaaagcaactgttcatgacttccgtcagtgatattgatgaacaacagtttcattctgtttctgaatatgcacaattttgtgtggagcagtgcgtggcgcaatttgatgggttttacctttattttatttttgtttattaaacatacaataaacttacataggattacccagaaaaaattgggcctcggaattccgatgtccgaaaatttttggatgcctcggaattccaatttacgaaaaatttggggcctcagaatggcatcccaggtgtagtagaaaactaccaatattggcgacaagcaaaaagtaaacaaattttcgttcgtccgtcaccacacaaatcagttacaaatgtatgtgtatttatttaatttgcttttcagctacattgatctgtgcatggtgcactatgtcaaggatttttgtaaaaacatctccaatacatgcacaaataatagaagagaccgtgaagaagtgtatggcgtgttagaacattattttttgggtatgtcaaagacgagaatattgaatcatttgatgattatgggataatgccttgacatttgcaccttggacttttgtgggccaccagccaaaaaaagatattagtggcccaagattccaaccaaaagacaaacctaagaaaatagttttatcatcaaatttaagaaattttatgcgctctgataatgaagcaaatccaaatggacccaaactgaaaaactttggaaaatgtcatttcgataaattagttggactgaaaaagattgtatagaaaaatacagacaggtcaaaagtattggatcaaaaaaaatttgttcatcttttttaaatccgattttctcaaaaaagaatggtggcacaaaagtcttataccccctttttggtggggacaagtaatggagcaaaatgtttaatcaccaaacacttcgttccaagttagcaggaaaatctttaaaaaatctctaagctaatttttactgctgatcaaaaatgtcttttataccaatttatttatttatttattgtcaataaagaaaaagtccacaaaagggaaaaatccgcttacattgaggccaaaccattaatttaaaaaatgtcctcaagaaagcgcaaaacaattaaaaacgagatcgccgccaaaaaataaaatataatatgaaatcaatacaaataaataaatagcgaccaaatcacttttagtttgaatggattaaaaattcgactttaatttttccggtctattttacgggaatagagatagttttaattttatttttaaattaatttaatgagtttatttcaatgagccttttatcgagttggttccaaattttagttacccgccccgcaaaaggtataaattttttgcctaatttatatttcgagttaagtctataaaagggaatgttaaagcgttcagaaggtttgaatatttcaaagggattaagatctgttcggccataaattattttatgagccatgaacagatcagacagctttcgcctgctttcaagtgtcggcagttgaaggtattctaatctttgttggtatggaatgggtggaaggctgcatttaaaaagaactcttttggtgaaatatttttgacatttttcaatttttttaatattttttagaagagatggattccaaacctcaggagcatattccaataacggtctaacataagttttgtacaaaataatccaaatcctagtagattttgatttaataacccgaaataaa

SEQ ID NO: 54657 - DNA, 864 bp, Heterodera glycines
  Genomic contig location: Contig_ID=SeqID_4491; Location=324..1187; Strand=-
  SCN-specific regions: Sequence locations=1-109,169-366,390-501,524 -525,554-585,609-658,681-698,726-864
atgtatgaacagttcacaattccattggaaataaataattgttccatttcacaatatcaaatgtcgaaagaccaaaaattgctatcggactcaaatattgcaccaaaagtaaaataaaaaaaataaataaaaaataataatttatcaccaaaaattaaataaataaatgaggggaagcaaaacttatgcttttttgttcaaaaataaaaaagttagtgtaattgacaagatgcattcatccaacttttttgtccattgtttgttttgccacccggcacattttgtcgccttgggcgaattttgctctttttttaattggttaggtacattcccttaattaagtcattaattctcgcttcaattctcttttctgaacactttcccaaaagtgcgtaattcgttcgatttgtccggctccaggactcagtggacaatccgtcagtagtcaatccgtcagtaagtgggcaatccgtcagtggataatccgtcagtaactaatccataagtaaatttatttttaaaatacccagatttatttaaaatcatgtgaaaattaatttaattcgctaaaaatctgaattaataatttgtgttattttaaaaaatatatgaaataaccatttttaaaagaattaaatgataatttctcgatatggtcaattaattgaaatataaagtaactagaaatgttaagaatctaaaaaaaatatatttattaaatttaacaatcattttttcaagatttttaatcattgctcaaacaaaaacttgctgacgaattgtccactgacggattacccactgacggattgtccttcactgacggattgtccttcactgacggattgtctactgacggattga

SEQ ID NO: 54658 - DNA, 561 bp, Heterodera glycines
  Genomic contig location: Contig_ID=SeqID_4492; Location=1749..2309; Strand=-
  SCN-specific regions: Sequence locations=1-153,175-314,357-488,510-561
  Gene Ontology: Mol. function=epoxide hydrolase activity
gccactaaacctgacaccgtcggcgtcgctttgaatgattctccgttgggtctgttggcttatattttagagaaattcgtatgttggacaaacccttcatttttgaaattggcagacggaggactcggaaagtgaattctttttttaaatttcttcgtttggattccatttttagaaaattcactcgagacgaccttttgacaattgtctcaatttactggttcaatggaaacattctctcctcgcaacgctattacaaagaacacttcgccagtgattcaaataccgaaaaactgtacaggtccaacgaatgcttataaattagttttttttgaattttattttttcattattttcagaaaatacgtcgctgtgcccacggcgtacgccgcctttccctacgatttgggcggtgttttgccccgtgaaatggtctctcgtcagtacaacctcacccaaatgaccctttttgaagacggaggtcatttcgcggcattcgaatgccccaaagaattgggcgaggacattatccgttttgcgcagggattgtccttggattga

SEQ ID NO: 54659 - DNA, 311 bp, Heterodera glycines
  Genomic contig location: Contig_ID=SeqID_4493; Location=78..388; Strand=-
  SCN-specific regions: Sequence locations=1-311
gtcgacttccctctgaacggcttcttcgggcggggcaatcccttcgtcgacaatctgtccatcgttccgttctctgtgaatgtgtcgaacaaagaattggctggtctgaaggacaggctgaccaaatgtcgaattggacatgaacagctggaggatgtgcatgactttgagtatggttttcccatcggagaattgatggaatggagggaccggtggctgaatgagtacgactggagagaagcggagaaaaagctgaacgcaatgggagaccatttccggacgcaaatcgaaggcttacaagtcggaattgg

SEQ ID NO: 54660 - DNA, 531 bp, Heterodera glycines
  Genomic contig location: Contig_ID=SeqID_23958; Location=197..727; Strand=-
  SCN-specific regions: Sequence locations=1-531
atgtcagacaaccgaaaagaagcggaggaaaagatggcaaaagcaatgtaaattaaaatgaatgctaattttgaattttaaattttgttttccttttttcagcttcatctccggcgattgttggctttgtgtcttcgatttgctgccaccttctcaacttggccttggaattgcgctgatcagccaccgatttgacttttacgtggacgaacacttcaaaacgcgcaaatgggcgctgaagtcttttcgaattggaagcaaaatcgaaaagaatggcacaaagaaaatggaaattgccaatttacgtggaaaagcattgccaattccgcaaatgcaattgccacgcaaagtcagtgtattcaaacgcatcgagatattgtaaattagcgattgtgtaagatttaggcaacatttcccattccatttccagtttcatcgaccacaatgccatcgcttttctccagcgttttcgtccacttttcaccacctgtccaattaatccagggcttccatttgttcttatttattaaa

SEQ ID NO: 54661 - DNA, 814 bp, Heterodera glycines
  Genomic contig location: Contig_ID=SeqID_23960; Location=45..858; Strand=-
  SCN-specific regions: Sequence locations=1-792
atgttttccgatttcagttggaagattggattgactggcaaaagtacggaatagcgccaatttgcttgacacgcacattatttgctgctcccgactctttgcacggcttaaacgcaacaatcgttggatgggaaatccaaggatgttggtgccatgcctttgtttagtgattaatgaccgagagagagactaaggggcaccgaaagactcgagactctcgagcatcattatggattttcctaattggggacacggtcctgcgagactctcgagtatcactaattcaattaactagctaattgattgaaaaaagttcagctgttgggaagaatattcatgatggaaacatacgccaacaaagtgaacaggtcgtgccattctgtgttaatttaatcttacaaattgcgtcctgatcattagtgatgttctaatcaaatatttttaatgagtcgaagaatcgggaccgagtgatcatgaaagcgatagctcaaaaatccgagacgacatcattattaattccttcttctaaaatttcgtcacttccaaaaaattcattattctttgcagcttggttttaaccttttttcttgtaaaaacattaataaacctaatttttttttcattataataatattcagagattcgaaaccgaaattctcgaacattgttaattcaaaaatctgagacgagacttgaagccgtgaccctcgagcatcgctaatgatcagggctctgatttatggataaaaaatataatttacaaaatttgattcaaattaatcaatttaattcaccaaattcggtttaaattaaa

SEQ ID NO: 54662 - DNA, 702 bp, Heterodera glycines
  Genomic contig location: Contig_ID=SeqID_23962; Location=142..843; Strand=+
  SCN-specific regions: Sequence locations=1-105,128-149,171-241,263 -466,488-702
atgaactgcagtgatgctgctgctgctgctgaagatgatgtttgtaaggagatgaagccattagggcagggaaaaatgaatttttatataaaattacgatttctgactgaaattttaaaaaatttcattgaaaatatgctttcaagacagaaaataatggtggaaaataatgggctattttcacgggttggccaccaaattgagttggcgtggaatgaatgtgccatcgccggcagcagcagaagataggaggaggaggaggcaaaaatgaaggaaatgatgccgaaaaagatggcaaaaaaaacgaattcattgttttcgagggcattttggtgggataaaaaaaataacagcaaatttggaatttaaaattcaaatatttgtttttgaaacatgttttttgggtgcttaatgatattcccgagctgattagagccttgaccgattgattgaaaggccgggatcagattataaatacataaatatttaacaaaattttggtaggtctgaagttcttaaggtttagaaatttaaatccgactgaatatcccgaaattcggaaaaacctgggaacaagacggacccggattttcgaaatagatgcagacaggatgtgccaaacaaaaagccctgattaacaggacgccgggcactattgtatttttcaaaaatataacgacccgaaaccggattaggacttta

SEQ ID NO: 54663 - DNA, 1014 bp, Heterodera glycines
  Genomic contig location: Contig_ID=SeqID_23964; Location=27..1040; Strand=+
  SCN-specific regions: Sequence locations=1-162,184-220,266-422,455 -533,555-979,1008-1014
atgattacgggaagcaggtgtgatgaggaacgtgattgttatcgtggcgaatactgtggcgatttggtaatttttgtaaacgctataaacccttaatatggctctgttttcgttaacgatcgcgctcttccgaaaatttcttaaaaaacttaaaatttctaagaatttcaataccaaattttgcgctacataaaaagtggcggccattcaatttttttacatttaattattcatgctttttattaaatttttgtttttacagtttccttaaaaccactcttttcctgttatttttattatcaccatattattcgaacaggtgccacaattcatattcgattactcttaatagaccccctttttgtgccatattaaattgcaaaatttctgtggaattttttttagcaaaaatccatcttaggtttatgaaattaaaaatatttgaatggctgcaactttttaagtagtgccgaaattttattatacaatacattttttagaaactttgttgtcttccacgtcgagctgcacaacctgatgaaccatcacaaccagttcggcctcaaccatcaccaggccaaaggactcgtgaacccagcgctgctggtctcaaaaaatagcgaaaatttccaaaaaaaattcctcaaaattttcacagcctactgttacaatgggcaacaatcctctgtgagatgcgactttcaaagcgattgcctggaaacacaaagttgtataaatgggttgtgctgtgttcggtcgggcagtgaatggaaaagtgagaaaaacgaaaaaaaaaaaatttggaaaattttttgaaaattttttttgaggcgcctgtggtggtgccatggcggtgtccaactgttttcaagatcgtagttgccatgacagtcttgtgtgcacttcatcggattactgttgcgaatgcccatatggacaaacaaccgggcaaatgcacacatgtaagcttttcgtttgcaaaaaaaaattaaaaaaattattttaaacaaatta

SEQ ID NO: 54664 - DNA, 99 bp, Heterodera glycines
  Genomic contig location: Contig_ID=SeqID_23965; Location=294..392; Strand=+
  SCN-specific regions: Sequence locations=1-99
atgccagtccaaatttcggtgcccgtccattgcgaattggcaggcggtgacgggctggacattgtgaatttggtcgctggattcccactcattttcacg

SEQ ID NO: 54665 - DNA, 467 bp, Heterodera glycines
  Genomic contig location: Contig_ID=SeqID_23966; Location=65..531; Strand=+
  SCN-specific regions: Sequence locations=1-42,64-88,151-196,224 -379,425-467
atgcaagtaccaattatgtgggatttttttaggtaatttaacgaattaaattttatttatttagactgaataatagttctgcttaaagaattatttttattaaataaaaaattaagtatagtataagatttatatattttttaaattattcctgcaacttgtttcgtcgataaatgcgaaaatttcaaaaatccataataattggaaaatttttcaaaaaataactatttatttgcttttttaatagtcgaacataagtcaaataaatttaaccaatttttttcgaaataacagatttttaaagaaagaaaaatcaaaaattcaaagaaatgattttttaatattcttttaaattgatgaataattattttcataaccgaattaattaattattaaaatttatttttcagaaaaatttttaattcagtcaagacgtaattgattagcttttttgagttttttgataa

SEQ ID NO: 54666 - DNA, 1056 bp, Heterodera glycines
  Genomic contig location: Contig_ID=SeqID_4495; Location=274..1329; Strand=+
  SCN-specific regions: Sequence locations=1-421,444-607,629-1013,1035 -1056
tttttgattcacttaattccttcctttctgaaaatttacaattgctctcccaacaaattatttgccccttgcaaagcctggcgaatttcaaatggaaaagtaatgggccaaaaacattgttatgccatgatcaccggggagggtatttggactatgaaaggtgggcgaatgttgaattttttaaatttatcattgaatgactcctaagtttaaaattgtggatttatttaaagcttatatggaactcgaatatgctctaagggcagtgaacaaagtgctgaaattcccttttacgccttcttccattggtggcacattgacattttcgtttacttctcccaccgtttcgtcactattccgccctttgcttggactaatcaagcacacaaacacggcgttctgattttgggtaatatttagcggttaattatattttagagattccattttatgtaagtctaaatgaatacacattttgtttttatctcgttgcattttcattccttggtcaatttaggaacatttatcattgaaaaggctgaaatttgccagcaaactttttccaatagagaaacaatcgacagattaatcgcatcactcgtcgattgctgtgtcgtctttaagtttggtaatttcacaaatgaccccctaatttgcattctaatattaataaatccctttttaaatgggtggttaatcaacatcgaaagtgaagtgaattcggactctgtcgacaatttggaatactttctgttctctttgcggaatgctttgcatgataatgttcacaaagatgccaaaagtgttatatttttgtcttttgtcggttcttattgggttttaaattgttcagttgtttggtatgactcagtgacaacggacgggaaattatcgtggcaaaatgcattgaatgccaacaatttgtgagtgtactttttgtggtgtaatagtttaaaattcgattttattcagacgatggggcaaaagtgtcgatgccttctacacaaattacgcctaggggaagaacacattcagcaaacggttcgaacttttctt

SEQ ID NO: 54667 - DNA, 610 bp, Heterodera glycines
  Genomic contig location: Contig_ID=SeqID_4496; Location=342..951; Strand=+
  SCN-specific regions: Sequence locations=1-610
atgggtgaaaatcacttttgtcttcaaaacgctgacctccaacccttttacgggtgctctgcggcttttggcaaagacgatggaagcgggacttctcgtgaagggcactggcgattcataagtgagttgggctgacgggcgaaaatccattttgacattttaaaatgatttcgctttggagtttggaatgagtcgagatgggtgtccgaatctgatcctcctagccgaaaagcccgaaaaagtattttatttgaaaaaaaaattcaaaattttttcttttttcaaaaaagggctaccatcacaactataatcgaattttcagactttttatttgcgacgattccgattgaggaaaaggacgagaaaatagagctacggtacgttcattcacttcactaattgcagcatttaagctgattattgctcggggcaaagttgtcattgttattcctttgcatttccgttttaaagcaacaacttcggaatgttcccccatctttcagtttcgattgttctcatccaattggtctcgttgtgacgatctccgatggcattgagtcgctccatttttgtcaacattcttttgacgacaatccgtccgatgaaacaa

SEQ ID NO: 54668 - DNA, 243 bp, Heterodera glycines
  Genomic contig location: Contig_ID=SeqID_4496; Location=1..243; Strand=+
  SCN-specific regions: Sequence locations=1-114,137-243
tgatggcggatggaattgcgtccaaccgatggaaatccttcgccgttacgctttgtccgttgccatttttgcccccggatggatttgtgaaaaattttccggccaaagtcatcgcatcctttttgacaacagttttcgtttttggaattcgttgagtacatttttgtatccccatgctttgcgacaacggaacttccgaaccagattttgcggttgccattcgcatcggaacgcccccaattg

SEQ ID NO: 54669 - DNA, 974 bp, Heterodera glycines
  Genomic contig location: Contig_ID=SeqID_4497; Location=2202..3175; Strand=-
  SCN-specific regions: Sequence locations=1-8,31-330,356-410,442-974
  Gene Ontology: Mol. function=ATP binding; Cellular component=Golgi apparatus; Biological process=embryogenesis and morphogenesis
tattaactaaggcaatgtcatctgattttggaaaccctctgaagaagttcaaactcgtgtttcttggtgaacaaagcggtacgttataaaaatttattgccatcttcattcttcctgtcctccttaaattaccgttaaatacaaaatgttaatgtcttaattttcagttggaaagacttctcttatcaccagatttatgtatgacagctttgacaatacgtaccaggccacaattgggatagattttctgagcaaaactatgtatcttgaggacagaacggtaaatgagttttccaattctaaactcgctttttaaggtcagacttcaactttgggatactgctggtcaagaacgctttcgttcgctcattccgtcgtacattagggactccacaggtggccaaaactcgaattttttaaaattaatttatattatttttagttgctgttgttgtttacgacattacaagtaagacttctcttgggaaatacaaaaatagaaatttaagtttcctactaagatatttaacaaattaatgcgtatcattatcattcatttttaaagccccgtaaaggtacacagagtaaaatggatgcatataagataaattttgaattgaattgatggcaccgctgtaaaattgttcagatgcgaattcctttcatcaaacgtccaaatggattgacgacgtgcgcaccgaacggggcagtgacgtcatcatcatgctcgtgggcaataaaactgatctcgcggacaaaaggttatgcaatttgccgttctactcaaatactttttaaactgataagaatttaattttcgttttctgagtttttattattacgccatttttagacaagtttcaacggaagagggcgagcagaaggcgaaggagctgaatgtgatgttcatcgagacatcggcaaaggctggttacaacgtgaagcaggtggaccaaccgaacgaacaacaatga

SEQ ID NO: 54670 - DNA, 124 bp, Heterodera glycines
  Genomic contig location: Contig_ID=SeqID_4498; Location=1..124; Strand=-
  SCN-specific regions: Sequence locations=1-78,101-124
ttttccataatccgttttttgttttttgctttttcccgaacgatcattgatcaaattaatacacttttagtattaactaaggcaatgtcatctgattttgaaaccctctgaagaagtcaaactc

SEQ ID NO: 54671 - DNA, 609 bp, Heterodera glycines
  Genomic contig location: Contig_ID=SeqID_23968; Location=205..813; Strand=+
  SCN-specific regions: Sequence locations=1-100,138-609
atgccgaacggaaagacgctgcgggagattagggaaatggaagagaagaaacatgaaattttgagccgctacgtcgagttggaggttgtttgggagcacgagatcaaccagaagctgaagaagaacaagcagatgagggagttttttgataactggaaggaccgctcgccaatcaaaatcagagacgcgtttcatggaggaagaacaggaccaatgaagctactccacacagcgaaaccaggccaaaaaatcagctacaaggacttcaccagcctctacgcgtttaccaactttacgaccgactatcccctcggccaccctaaaatcatcagtattccaccaaatgagcagacggtcaactggcgctctccatccgacaacccctacaaaggccttctcaaagtgctgattctacctccaaacaacaacatcaaagtcactgttatgcccataaaatttgatcaacgtttcctattcccgctctgtgaaaagtgtgccaaacacatcaccgcaaaatatcccaatggcctcaaagacaacgactactcatgcccgcacttcaaccctaacgaagcgccttcgtgtccacttgcacccatcttgagttaa

SEQ ID NO: 54672 - DNA, 223 bp, Heterodera glycines
  Genomic contig location: Contig_ID=SeqID_23968; Location=1062..1284; Strand=+
  SCN-specific regions: Sequence locations=1-44,67-131,153-223
atgctcacctacaagccgaaagaggagtttgtcgacgcaaataagtactcaaatgttgtcatctccctcttcactacatcaatggcgcgtctatacctttacgaaatgctcaaaagagtggccgacacccccggatgtgaaattctctactttgacacggacagcatcatctaccttcatcccgaggacaacggcccactcccgacagaaaagggacacctcg

SEQ ID NO: 54673 - DNA, 1099 bp, Heterodera glycines
  Genomic contig location: Contig_ID=SeqID_23970; Location=470..1568; Strand=+
  SCN-specific regions: Sequence locations=1-130,348-397,420-423,461 -1058,1087-1099
atgcggtccgcgacgcaatttcacggaatcttgaatgtggtcttggtcaaacgcatgatactaaataaataaattcagtttataaaatactatcattttctataaacctaactaaattcaaagataaatgtaatattaaaaatattaaaaaagtttttttaaaattaaaaaattgcaaaaacttattatctataattaaacataaattataatatagtatttaaaatatgataaaacttttttgaaacttttaaatatttgatgcaggcactaaaattaataatatatttaaatatgaaactttaaaattaataaaataacttgtaacaaatataaaaatataataacaatgaacgatctaaaacaaattaacaacagaaagcaacagcgaacaaggtttcataaaggatggaggatcacgagaaaaataaatatgtaaatttatataaaaaaaattaaagaatgacaacgacagcgccattcccgactacgcaaaactgcttattaagcagttgcactcgctgttggccaccgcttcgtctctagttcaatctcaagtgacggcgaatgacgcgattgaggaagaccgcagacagcgaaccgttgtcatcaccaatgtgccggagttccaatccgggaaagcgtcggagcgtggggaggcggacagagcactggtcaatttgattttggacacagtggacctcgatcaaacgccagtggtgttccgtgtcggcatgcgaacgcccaacagagcgagaccgctcaaaatggaatttcccacgcgacatgcggctcggcatgtgctcagaatgaagggcaaagctttggcgttgaatgctctacatggtgcgcgcatcagggaaagcatgaccaaggagcaattggccgaacgccggaaattaattgagcagtgcgcacagaaaagaaaagaagacgcgggagattggattatctacgcgaatcaggtcatcctgcgcagtgacattgacacaattcgtaaaaatttttaaattttcatgtcaaatcaccaaaaaatcatataaatttttacaaaaaaagtttttgctttttccggttggtagaaaatttttataaaaaa

SEQ ID NO: 54674 - DNA, 631 bp, Heterodera glycines
  Genomic contig location: Contig_ID=SeqID_23972; Location=1025..1655; Strand=+
  SCN-specific regions: Sequence locations=1-504,544-631
atgttggcagttggaggttggtgaaatatttttgacatttttcaatatttgtttgaatagatggattccaaatgttaaaaaatgccaaaatatgtgctaaataggtgctgaagccgaaataagtgcaaacgaaggaaattcatttgacgtttcatggcaaaattttgcaatgaataaaaattcagaaaaaagtcattgccaaaaaatgggggaaactaaaataaaaattaaccaaaatgatgaagaaaatgtagcgaacaaactcgcctcccatcgcggggttcgtcaactcgacgattcgtcaactcattccaaaaattacttcaaaaagcattttccattgcttttcatggcgatgaacaatttttaacactcatttagagcgattcgaatccctaacctcgaagtcgcataaaaccacgatcgcgtaacacaattactttttttaatatttaatatctgttgctgccttatgaaaaattgaaaaagttccaaatgcgttagaatatttattaaaaaagaaattttataattactttaaaacaaatgcattggaaggaaattaatgaagtttatgcaaaatttaattgttacaaaattctcccaataattaacaaactaatattaaata

SEQ ID NO: 54675 - DNA, 1075 bp, Heterodera glycines
  Genomic contig location: Contig_ID=SeqID_23974; Location=250..1324; Strand=-
  SCN-specific regions: Sequence locations=1-408,433-605,644-756,786 -876,900-956,978-1017,1053-1075
atgctacaccaattagtccaacgacaatgggtgcgtgctgaactgtcgcatcgacttgggcatctgtgtgaaaaaaaattgcagcctgactgtgtgccctcggcccaaggatttcgggtcggtgccatgagaagtgccaaagcaaaacgaggaaaacgaagaatgatcagagagagcagaggagagatgaacagccaattcgaaccactggtgatcagtgctaattgcctaccgattgaccgatacaatttatttgactggtcgtaagttttatttggcgaaaagatttgcgttaaaaccaaatggaaaaacaatgcttttgatgaaggtaatgcaacattttcattgttcaaattcattttggcaattttaatttcatattggctttcttacaagacaaataagatctataatttttatttgaaaaattcattcagactagttgtttacataaggcaaaaattgagaacttataactccaacagatttgaacaactaccaccccgattttcccagccaaaaatcagagtcccagccctaatttataggtttaattttgtaatttaagaaaattggggagcagtggtgccgataggtgtagccggaaaaaattattattttttaattttttaacatattttaactagtaagtcataatttaaagggacttttaggcaaaatatgtgaaaaatgaaaattcacgagataagatccgatgatgccgttagacgctgccagagccagaggcaaactgacattttttaatgataattaaaattaaaattggagataattaatttgtaagatttggtttttgtttttacgaaaattttcgcaatttttggaaaatttatcacaaaaaagcctaaaaagtttaaaattacattcacgaaaatattcacaatatcgaaatccagggcatttatgagagtgatggagtcaattatccacatttctaagtttgcttttcctgattgaatattaaatcaactcttgagaaagcctgcgtaatttgtgaaaaatttgaaatttttattttatttagaaaataagcatttaatctctgcctaataaa

SEQ ID NO: 54676 - DNA, 220 bp, Heterodera glycines
  Genomic contig location: Contig_ID=SeqID_23976; Location=1..220; Strand=-
  SCN-specific regions: Sequence locations=1-220
ccgggactcaaatgtcccgctcaggccaaaaattttttctatttccgggaaaaaatcgaaatttttccgaaaaaaataccagtcgatagagctcgaaaaactatgttttggaagtggtcttcgtttttctgggaaaattcgttaaaaattcttaaaatgcaaaaaccaaaaaaacgttttttaggcctagctcgaaaattttgagactctagaggtcccc

SEQ ID NO: 54677 - DNA, 619 bp, Heterodera glycines
  Genomic contig location: Contig_ID=SeqID_4499; Location=620..1238; Strand=+
  SCN-specific regions: Sequence locations=1-244,332-367,389-619
atgatgaataaatttgtgattctaacaatggcatttgcaattttggcattaaatttcattggaattgcaccggcgggaacagcagaaggccaacaaacaagcaaaacaggtaaaagattagtgcaaatttgctttatggaagtgcgtgccaaattgtgtgaatttaccgttttggcaatataaggcacaattcaattattattttgtttctagggctttatttaaatttttttggctgcaagcgaaaatttataaatttaattatttttaatttatttgatataacaattattaaattacgatttaaaatataaaaatataataataaattgaggatcaccaaaaataaaatagaagtataaatttgtttttaaactttgttttaaatggttttattcacgcaaatttaaaaagaaacaccgggtctaattaggcacgcctattaattagattacataaaatacaatggttattaatttattaaaaccaattaaattgatatatttattccctctcttccgcaggaagtggcatttcttccgcacatcgaagtgacgttggcactgcctatgcaatgattgcgaatgacacgacgccaaatgatgttgccacattttag

SEQ ID NO: 54678 - DNA, 1086 bp, Heterodera glycines
  Genomic contig location: Contig_ID=SeqID_4500; Location=1852..2937; Strand=+
  SCN-specific regions: Sequence locations=1-238,289-491,513-550,572 -926,949-972,997-1086
atggcggaaagtgacgaagaattttatttcgcccggcacattaaccgtatgaaagagcgtgacaaccagtcaccgtttttgcacaacacaattgtcaattgggagaagcagaaaccgtacgaatgggaccgtcagcaaatgcgcatttgggtgaaacggcactccactaatgaggcggctaatgagcgtgagcaattaggtgctaataatgtcaatcaaatgaccaaaaagcgtaaagatatttaattttattttatttaaaaattcaaaaaacatttagattaatttgctttgttttcgtttctgacaggaaattttttggatcacggtcacgattcacgggaccaattcagggtcacggtccacggttcacgggttttttcagtgacggcgcaccactagaatttagtgtctattttaagagcccggatttgtatggattttaaacttagcaaatctggcatcatttgaaagctctatgtgttctctatatttatatttcaaaatagaaatgaatgattcaaaaataaaaaagttatggcacacggcgccaaaaaagccaagaaaaagtcaatttttgaggtttttggccataacttttttgtaaactgacgaaattttttgaaattttgcagcaaaagatatcgaacgatactaagcgttttaccctcgtccatattttgcgattttttttttgcgatataccgggttctagtcatgagaataaaaaatttaaaaaaatgacgtccgtatcactggcgcataaagctgttacaaattgccaaaaaatttcaaaatgccaaaattgtttggtgtaaatgccaacaaaaaattttcaatttcctcatttgccaactacgcttttctgcagtgcatccgctttacccacttgcgaagcgcaacgcaaccaatgaacgtctggtgcggaatgtaagccatctgctgatgcttgacgcggcatttgaccgcgaggcgcgcgaactgtgccgacagttcgccgcgcgggtgccgttgcgcaattgggccgcaattgcgaagaacatggacgatgaagcgattaagaaatttgtggtccgcccattaaaa

SEQ ID NO: 54679 - DNA, 1228 bp, Heterodera glycines
  Genomic contig location: Contig_ID=SeqID_4501; Location=455..1682; Strand=+
  SCN-specific regions: Sequence locations=1-153,291-321,367-373,464 -660,683-686,710-926,985-1120,1142-1228
atgttgaacgcggtcaacaagttggagttggacagggccaaggaatgtgtgaagggcgcactgttcattcagctgttcattgagcaagtgttttcggaggaacaatcacaaaaattgcaagaggccaaaggtgccgtttatttatgttcatgcaaaaattatagaatttaaatttaaaaaaattaacaaaattaaatatttttaaagatttaattggttgaaagaaaagttttttatgaaaaattatagaatttaatttaaaaaataataaaataaaaatattttttaaagattttacctttcaaaactaaaaagagaattaaagaaaaaaaagaaaaaaaaattaaaaaaaagagaaaaaaaaaattgacagaaatattttgtatattttctttaaaaaataaaaaaataattttaattttaatttaaaataaaatatattatttgaaataattaataatttcgacaattattatgtttttcattttttagttttttacattagttgataatttaagttctcattcaataattttcttgaatttttttacaacaaataaaatattttggatttaaaattcatttcaattctttgaaattgtttgagccaaaaaagtgtatagataagcttcagttgcatattaacttttcaaggccttgaaaaaagttctgatttgtccttgaattttttggaatttaatttattttagacaacgttgacaaactcaaagatgagcttgcgcaattggagcgcaaatttcaagcatttaaagcccaacagcagaaagcggagagaggtgccaaagaagtcaaagaagcctacgaacggagacgaagaactcggcgcggcattggcaaaaaaagtggggaaaaagtgccgaaatcggcggccaaaaacagaggcaaagccaaaatggaagaagcgcatgatcaggatgatgatgatgattttgatgatgatgatggtagtaataacgatagtgaaagtgataccacggaaagtggtggtaatgaggaagaagctgaatcctcgtcggcaaagaacaaagggcgcagtgccaccagcaagtgggtcgaccgagcggtggtgggacggacgttagccaaaaagccattaaatggaaattttttgaaagaaaatattcataatttcgcccagaatgaaccaaatttttaatacttgatatcattcggtagccctaagagttttctattttcatggaaaata

SEQ ID NO: 54680 - DNA, 1231 bp, Heterodera glycines
  Genomic contig location: Contig_ID=SeqID_4501; Location=2001..3231; Strand=+
  SCN-specific regions: Sequence locations=1-39,61-731,756-765,794 -1135,1177-1231
atgtcgggaattacgccgaaacgaaaaacgaaggcgggcaaatcatcaaaatcatcaaaagaagatgaggaaaagcatgatgaaatgatgatggcatcggaagatgaagaaaaaatgatgaagaagcaaaaacaaaaacagtggaaaatgccgacaattcagccgcccccgtccgcccggcggaggagcagcaggccaagaaatggtatccaattattgagcgcggactttcaaaaaattcgggatcagttcgggattagataatttgacccgtaccgggtttcaggactggatttaatatcaggttttccaggacttctgcttgatccggatcccaaattttgatccggatgctggcccagaatgggtgaaagtaggataaaggataagagaggatccctaaatggggcgcccccgtatctcagtctgggaatcagagtcccgaggcctaaaaatgtcgaattttctgcaattgaataaatttagaaattgcaaaataaatgcaaataggttcactggctccctgaaaatgcgtcagtgaaaatttcaatgtcatcaaaacatgttctttggcttttcggggtcatttataacgaatccggtatccattttggccaattccaaagcccgggcctcgattcggggtcggggtttggaattcagaacaatgttcttatagcattttgcttttatactatgtacaaatattttccggtcatgggtacactcccaaaaaaaaaaaaaaaattaaaattggcagaattttgtttcaaaattttgaaattaaatttaatttatgtacccccccccccttcaaaaaaactcttttagcatcatcaacaagcagcagaaacaccaaccgccagcatgagccgttgagacaaattgatgaggactcgcgggagggggtacacagctcggacggcagtggcaccagcgccgccggcgctggccgtcgccggctgaccgaaaacgataatagcaacagcaattattatgttaatgagtggattgatcagcagccggaaggatatgatacctacaatgatcggatcagcaaattgcgtgccaaactccgagaggcggaggacgagtacaaaaagcaggagaaaggattgaagggaatgctcaagtgaaaattttgattattttaatttataaaaaatagaatttttagcatttgccataaaagatagcttacattaagccattaaaagtttcaaaaacaaaa

SEQ ID NO: 54681 - DNA, 638 bp, Heterodera glycines
  Genomic contig location: Contig_ID=SeqID_4501; Location=3468..4105; Strand=-
  SCN-specific regions: Sequence locations=1-276,304-400,432-534,593-638
atgtccgagacggggagtaaatttggtgctatgacgttagtcaaaaagccataaaatgaaaaaaaaatttgcttgaaagcaaccaaatttttttaattccttaattcgatagccctaagtattttcgattagcctgtaaaatttcaaaaagtttctttaagtttcaagaaggttatgatcaaaaatgttcaaaaaaaaacttcgttttttgagcttctcaagttaatgaattttgaaattttgtaatagaaaacacttagagctatcaaacgatatcattattttaaaaattggttatttggacgaagtttgaataattttctgtcaaccattttccatttgatggttttttgttgaacgtaccaacaccgtagattttcataaaaatggaaaaaaaatttacagaaattttttaaaacaaaaatgaaattcttagaaactcatttaagcacattttcattcgattttggagtgcaatagatgacattcgtaatgcttaaacccactgaaatctacaaaatattgggtttttagaaatattacttattttttagtttaaatttttatttattgtaaattttgaaaaaattttcagatgttacatttcaattagcgcaaaagtccgccgtatcttttga

SEQ ID NO: 54682 - DNA, 591 bp, Heterodera glycines
  Genomic contig location: Contig_ID=SeqID_4502; Location=769..1359; Strand=+
  SCN-specific regions: Sequence locations=1-160,182-440,485-496,518-591
atgaatgctgaattgcccgggactgaatcgagcagcaacgattcggccttctcggaaattgaactcgagaacaaaattgagtccgagattgtgcagaaaaacatacgcacttcgaaaacgccattgaaaatttcgacgcgacctgtaagggttgaagccaatttttggcattttgaaattttttaattcgtaaattaggatggtactgaatttgtctcaatttaggaggaaatttttttttacaatttttggaatttgttatgattaggagggattcggatttctatggacaaaagaaaaagaacaaaatttggaaaatgtggagataaaaaagcatcatagaaatatcaaaataagctaaaaattcgtttaacgtgatttttttgacgaaataagtgtgcaaaaaatggaaatccatataaatccggtccttgtcatggttttttttgaaaaattagaaatatttttaaaacaaatatttttagactcgattgaattaaaacattaaatcaaatgtccttttattaaatttgttttttagatgtttaattgttttttaaacagcttaccccttaaaaatttgtatttaaa

SEQ ID NO: 54683 - DNA, 1406 bp, Heterodera glycines
  Genomic contig location: Contig_ID=SeqID_23978; Location=95..1500; Strand=-
  SCN-specific regions: Sequence locations=1-1406
agagcttacaacggtttgccacagcatttgagcaacgaatacgccattaagtttctggttagagcgatgggcaatcctgagctcgcgttatacctcgagcttgtgagaacgccaggcatgaccctggaccacttcgtgtcacttgccgcgcgtgctgaatctacgcaaaaggcaacacaacgattttcgaggccggacaacagagaaaggacttggagaacgaacacaccgcaacatttttcccagacgaataatgggccctcaagaagcaattttgaggaacggggccagcaaatgcaaaaatttggaacccaatcaaaccgaagttggagttgcttcaactgtaacagcccaggacatttggccagagattgtccccaaggaaaaatttttcgcgcaattgagcgaactaactcttctacgacaattaatcaacaaggcaaacaacaaatgggttataatcggcagcaaatgcctgagcccaacgaaaacccaccaaatcggcactaccagcaaaagaattatttgaagcaaaattgcttagttctgcaagaggaacaagttcatcaaaacaatttcattgttggtgaattgaagcaggacctggaagatttttttgacgaaataaggaaatgcgcgacggaagacaaaaattcgaatttttcaaaagtcggaaaagtaatggcagttttggttgaagtttttggaacgaagacgaagacaatgctcgacggaggcgcacaaatttctgtaattgaggcaaagttcctctacaatttgataagggacaaaaaattggacgttcggaatttgagtgttttgaaagcggaaaatcgcatttccgatgcgaatggcaatcctttggaatgtttaggagttatttgtctgccgataaaacggcatgagaattcgagcgaggtcaaagtcgcgatgcatatcgccaaaccgtcgattggatttgaccttctttttggcacgaatgcgcttaatgaattgggctttaagatgtacgatgccatcagcgacactgtaattgattttgaaaaagtgaaccaaaataaaatcgattcgctcaccgtgatctacaaaacggtgttggaaccacgggccacgaaagtcatcgaatgtggcttgcctgaccaatatgaagggagagaagttttattgacatccgatcaagaaaacgatcagattcgtttggaaccaacattcgcgattggacgctgcaacagattcgcggtgataataatctatttttcgaataactaaggagaactagttatcatatttcagcccaatcatgcaatttcaaggaccatttggttctctgccgttgcagtcgccaccactagcattgatcggaccccaagtggtcccacctttgaaccttccgccaagacggagtg

SEQ ID NO: 54684 - DNA, 1170 bp, Heterodera glycines
  Genomic contig location: Contig_ID=SeqID_23979; Location=41..1210; Strand=-
  SCN-specific regions: Sequence locations=1-519,541-837,859-1170
atgtcatttgtgaactattctctggatagaatggaagaccaagtaactattgcaattgttgaaagaaatttattccaaaatataagcgctcctccaaattctaatgccccaatctcacttattgataaggttcaccaaggtgtaatacgtcttgaggatgctaccaaccgcagtttaagggtaattaataggagggcgactcaaaatactgatgccattaaccaaacaacagctgatatgaatgcaaacatggacacaattacgactaggttagatcaattggttgataaagtggatacacttgaatggtcagacaccaatgataacaggacatcactacaagggaattgcaccatggtaaggcgaactgtcttcgaacccgaagaggacgaagaaattcttaatgttctcactactatagacccatttgctagtcagcttccggcttgcagggatgagaacctaaccgcttttgataattgggcccaaaaattccgggacctcatagaatatgctggaacaacttggactgaaaaagaaaaattgggtagacttaaattttcgctcgaagggtcaattcggaaaatttttgacaaattaccgaacaataaaaaggatacggtggacaaagctttggatgccattagggaaaaattggactctcccgagcgtaaggaaatgtcaaaacgtgcattagtcacgtgtaaacaacgcgattccgaaacagttcgggaatttctttctagactttcaccacttgtctcttctgtctgtgcgggtcaggatgaaactcaaattcaatcccgacttaaagatgaatttttggaaagggttaaacctaatttaacatttctgattaggcttactggtgtcactaaaaaccaagactttgaggcagttttctctcaagctcaggaattagagcttcttttaaccaatactaatgaatccaatatttctgatcctctcaaattcgcggtccatgctttaaatcaggcacctgcgaatgcttcttggacaaataatggtgatcgttcatcaaatattaattcatgggtaccttcctatcctaataacgtgaataaccgtcaggttagatataaagaacgatcaagctctcaacagcagcaaggatttagtagaggaagggaacgaagtgggtcgaattag

SEQ ID NO: 54685 - DNA, 657 bp, Heterodera glycines
  Genomic contig location: Contig_ID=SeqID_23980; Location=172..828; Strand=-
  SCN-specific regions: Sequence locations=1-657
gttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacccttgaaaaaatcgatttttttt

SEQ ID NO: 54686 - DNA, 162 bp, Heterodera glycines
  Genomic contig location: Contig_ID=SeqID_23980; Location=1055..1216; Strand=+
  SCN-specific regions: Sequence locations=1-162
ccaacgcagaattaaagtacaggctatagggaagctattcccgaaggattcggtctccccataaatctgggcgcatcggttcggggggactgccccgaaaaaaaaaaatcgattttttcaagggtccgtttggggtactcaaacaattatggggagcaaaaa

SEQ ID NO: 54687 - DNA, 917 bp, Heterodera glycines
  Genomic contig location: Contig_ID=SeqID_23984; Location=751..1667; Strand=+
  SCN-specific regions: Sequence locations=1-219,243-253,276-437,472 -577,599-917
  Gene Ontology: Mol. function=orotidine-5'-phosphate decarboxylase activity; Biological process=UMP biosynthesis
atgcgtgccattggtggtgtcctcccccgtcgtgccgtcgacgaattccgtcggttgggcccaacaatttgcggacggcacactgaaccggcggttggcacaaattatggtggccaaacggaccaacgtttgcctggcggtcgactgcacacactgtgaccaaattttggaggcaaaaaaaaaactattttaatggcattaaaaataatggaaaatggcaaaaaaaaaaaaataataattttggtaagtcacgaccataaatccagttttaattttcaatctatttttttggtgaaaaatatacaaaaaaattaagtgttttttaaatcgacgttcaaaaacaagcacctttaaaacagacaaatgaatatccaaatttgaggcaggtatatctaaaaaaatttgaaaaattctcgccaatctccccgattcattgcaaattattattattattttttacaaataataatacactgatatgtcatgcatggttcatttttcagattgtttccgccgtcaaagaccatgtctgtgccgtgaaattgcaccacgacattgtggtggactttggcgctgaatttgtggccaaattgcacaaaatggccgatgagcaccaatttctgattgtggaggatcggttggtaaaacatctaaacaaatattaccgggaaaaccatgacaaattcttaccaagaaaaaaaaagtaccattttcccccgaaaaccctggcaaaatattatccccgataatttttttttatagaaaatttgcggacaccggcaaaacgatggaaatgcaattggccggcggtcggttgccggcggtggcggattgggccgacctcgtcaccgcgcacgccctgcccggcatggcgtccattttggcactgaaaccggtacattaaattgctgtaaaaa

SEQ ID NO: 54688 - DNA, 173 bp, Heterodera glycines
  Genomic contig location: Contig_ID=SeqID_23984; Location=1861..2033; Strand=+
  SCN-specific regions: Sequence locations=1-173
gcccaactcagcaccgacggggcgctgacggacggcgcttacgcggccaaatgtgcgcggattgggcgcgaatgtggggactaaattggtggccggattcatctgtcagcagcggtgcagcggagagagcaacgacgcaacagaacagcaacaatttttgcattggacacccg

SEQ ID NO: 54689 - DNA, 136 bp, Heterodera glycines
  Genomic contig location: Contig_ID=SeqID_23986; Location=23..158; Strand=-
  SCN-specific regions: Sequence locations=1-136
atgtccaaacaatttcttctgttggctttgctgcttttattgctcccaatcggcacattgcaagaatgttcttgggatgtggatctgtgtacgggcagttgctcaacaggatgtgaacaattaagtgaaccaaaag

SEQ ID NO: 54690 - DNA, 378 bp, Heterodera glycines
  Genomic contig location: Contig_ID=SeqID_23987; Location=192..569; Strand=+
  SCN-specific regions: Sequence locations=1-126,150-378
atgccacaacactcaatcatcaaatcattaccagtgccatccctccccacacccaaaaaaatgccacaaacaataaagcatcgcctgcgtcgtgcactgctcggcccatgttttgccgtcgttctcccaccaccaccaccaccaccaccgaatgctgttggtgccaaatttgtgccacctcctgtgccgctgatgtgcacttgcgacaccgttgtcgcaattgcgttggccccctcccggctgtcgtcgcgcatgttggccggcaaagatacaccggcgttgccacgccgtgcactcagcacgctggtccgtgccactgtctacgactacgagctgggcaaacgccgcaaactgtccgcctcaatgcgaaccgagtaa

SEQ ID NO: 54691 - DNA, 498 bp, Heterodera glycines
  Genomic contig location: Contig_ID=SeqID_4503; Location=2757..3254; Strand=-
  SCN-specific regions: Sequence locations=1-300,322-498
atgacttatttcgagtatttaggttagttcttttaaacagagaatttgggtccaaatgtgtaaaaccatgtaaaattttgtaagtagttaggaggtcaaaaatttttcttcgtttttcaagagtagctaatttaaaaaattggagccgttggtcatagggaatatatggaagacaacattttctgaaagcaattcgagtaaaatatttttgacatttttcaattttaataatatgtgattttagttgcggattccacgattcaggggaatattctagaagtggacgaatataactaacataaatatttttccaaactgaaattttctttgatttaataacacggaaaagtaaacgcatacggtagtaggcgttacgtgtactcccgtaagtccaaaaagccagttttaccggcccgttttttcaaaaaaaaacgagaccgggccgcccggtaaaagcacgtcgggcccgtccggtctactaaatacctattcaataaa

SEQ ID NO: 54692 - DNA, 1270 bp, Heterodera glycines
  Genomic contig location: Contig_ID=SeqID_4504; Location=201..1470; Strand=-
  SCN-specific regions: Sequence locations=1-410,432-1270
  Gene Ontology: Cellular component=mitochondrion; Biological process =polar body extrusion after meiotic divisions
aggctacgaatacggacaggcattcaaaggtgaacgggcgcccgcattccgcgccatttgacacgaaagtccctcaaggcatttaccggacttgcaacagcggtgagcgcggcaccctttactggaccggcaattgggtgaccttcttggactcgctgctccaaaccgcgctgctggccgaacgtgcagacactctccgactgccaacacgcgttcgctatttgcgcattgaccccacccggcatttggaatgtgtggaagagcgaggtacagcccagacaaagtgctgtcccattccgaaatgccttttaagatggcattcaagtggtggagctgcgcaatgacattgccaccaacggatgcatcgccgggggcgtcgaatgctgcgatttgacggcgcacactgtgcagcgaagaccccaaacggctggccaactgtttctggagaagctgtacttcgtcaagcacgtcgacaacaagtccgaactgtttagatattctaatgacaaactctcaaaatcatattgtccattctttgcagttcactcgctgattctccccgcgagcgtgaaattctggccgaatatcgcaatttgctgtactccatcattctgaatggacttcgccaatggagcaagtcgggcgtactggcacaaatcacgaacggagaacagttcgaacacgcgctgaaattgttggagggaaaggaggacattccgacggtggcggacgaagagcgaaagaggaaatttttggatgactcaaagtcagtgaatacgcgaattgattttccaaagaatgagtcatctctaaataggtgttcgttggtcaatgcgttggacgaacttttcaaccttccgacgaataaccccttgggggaggggcaagacaatgccaagaagttcgagcaggtcgccgtcaacaagctgagtgccttctacaagacattcgacaacgaccgctactggtcccaggctctgctgcacgatcgattttcaaaatcggcacaggtaaacggaggcgggagggtaggcaaaagcggcgctgatttgaggacatttgtatggaaaactcggccacacaccggaaccgcgcctgcggcgtcgaactgtcgtcgacggatgtgttgaaacattgtgtgaacgggtccaagtcgcacccgctgttggaaatcgaatggacgtgcgtcgggccgcacatggagcatcaactgtttctggagaagctgtacttcgtcaagcacgtcgacaacaagtctcgaactgtttag

SEQ ID NO: 54693 - DNA, 675 bp, Heterodera glycines
  misc_feature (27)..(27): n is a, c, g, or t
  Genomic contig location: Contig_ID=SeqID_23990; Location=291..965; Strand=-
  SCN-specific regions: Sequence locations=1-138,263-327,479-675
  Gene Ontology: Cellular component=ribonucleoprotein complex
atggatatttttgatcaaattttaganaatttaaataaactttacatgccaaaaaaaattccaaaaaagaataggacgggaggcggtgccaatgccaatgcaaatgtggcgggcggtggtgccaatgcaaatgtggcgggcggtggcggtggtgccaatgcaaatgtggcgggcggtggcgctggcggtggtgccaatgcaaatgtggcgggcgatggtggtggcggtggtgccaatggaggaaatgtggtgggcggtggtgccaatgccaacggggccaatgccaacctggcgggagacggaggaggtgccaatgcaaacgtgccgggcggtggcggtggtgccaatgcaaatgtggcgggcggtggcggtggtgccaatgcaaatgtggcgggcggtggtgccaatgcaaatgtggcgggtgatggtggtggcggtggtgccaatggaggaaatgtggtgggcggtggcggtggtgccaatgccaacggggccaatgccaacctggcgggagacggaggaggtgccaatgccaacgtggaggggggcgaaggcggcaacaatgcgaacggggccaatgccaacctagcgggagacggaagaggtgccaatggcaacgtggcggaaggcggtggtgccaatgccaacggtacaaaacttttacttatttcatag

SEQ ID NO: 54694 - DNA, 931 bp, Heterodera glycines
  Genomic contig location: Contig_ID=SeqID_23991; Location=235..1165; Strand=-
  SCN-specific regions: Sequence locations=1-65,88-931
atggcccagcaccgactgctcgaccaaattcccgaactgctcgcggatgtgcctgtgcctgattattgtgtgtttggtgaccaaccggtcggggaagagattggcgatggggcaaggttcgaaccggaccacgaattgactatcaatgcttttattggacccgctggaacaggtgagtcagcgaataattttttataccaaattcagggttgctttaatttctgtggcatttgtcaattttagtctttgttgtcaccaaagtttgaaacttagatttccaaaatctgacaaacaaaaattttttgctactaatagtaagtgttgactctgtctgggttactaaattaacgatatttaccaaaatccattcattgacggaccaattaaacctgctattttttactatttcttcgaaccatgtcgcaaacgaaggaccttctcttccaaataatctctgaagtgtttttagtttcgccgttgcacactgacccacggcataatttgttctgtcaaattcgaggccgaaaatttgttcgtctgatttctccccaaaatcggaaaggactttatttgtacgacgatttgatgagacagaataccagccaagtgcttattttgctctatttaaaaaattatattgcaaattcctttatttgttaggaaaattaaatcttttcgtttatgatttattccgcattttaggtcgatgtggaatgtcttgacttggagcagttccctgattttgcaaatgtccaatgctacgattctgttgtggaggccggtgaatgtttgttcattccccgcggatggtttcaccacgttcgcggttcgaatttttttcaaaaaaaagaaaaaccaaaaacttttcagcgttggagccaagcatttcaatcagcatttggtttgggcacgagtttacgtaaagaataaa

SEQ ID NO: 54695 - DNA, 234 bp, Heterodera glycines
  Genomic contig location: Contig_ID=SeqID_23991; Location=1..234; Strand=+
  SCN-specific regions: Sequence locations=1-150,173-234
ggtctacattcaattcgcagtgtttcgcccagccatcgattaacgttcatttccaactcattttgtctattgtttgcttcagtgtccgccattatccaacagtgacgtggaagaagattagaaatatacaagaaaaatttcaacgcaaaaatacattttatttagtgataatcgcaatcggtgacaatttttattaaaatataagcgttttctttaaacaaattttcattggtc

SEQ ID NO: 54696 - DNA, 1302 bp, Heterodera glycines
  Genomic contig location: Contig_ID=SeqID_23995; Location=379..1680; Strand=+
  SCN-specific regions: Sequence locations=1-753,776-1302
atggaattacaatccataacgctgggagtgaagttgttaaagtacgtgctccaacatctcaaactcaaaccaacacagacaacgatttggactgacagcttgtgttccgttgaacgaattaaggagcataagaaatgcgatcgatttttttcaaatcgattagcaaaaatacgtggacagtttgaagtcaaacatttggtcagtgcagataatcccgcggacgtggcatcacgcggcacaacaccaagagagttgagcagaaatttgttatggaagcatgacccaaaatggttatcagaagaaaaggccctgtggccaaaaccagcaaaggtttatcacccagatgaagagaagctcaggggaagtgcggaagatgaagaagtgaaaacagccgcagtcatgaatgaggtgcctttccaaccaaccattgatgtgaaccggtactccagctggaaaaaggccaaaaccgtgggtgcctatgtcttacgctggatacattcggtggcaaaaaacggatacaatggaaatttgttgccaattctgagcaaaatgggcccaaaaaagcacgggaaccaagacaagggcgtactgtcagtgcccgaattatgtgcatccgaacatttgctgatatgggaagcacaacaacaatttccaacggaggaaaaaacaaaggaaaatcttcgtgtgttcaaagacaaagaaatctggagatgccgaggacgcattggagaagcaacagtaaaggaggaaacgaaattcccgatcttcttgcctcctgaagcaagggccacaaaactcattgtgctggaagcacattggaaaatgaaacatccaagtcacagtactctgttggggtacataagggaaaagcactggatacccaaaggaagaaggttcatcagaaacacgatattgtctgagcgacacggatgtttgaattgccgcaaagagaggcttaaaccatatgcctatccacaaatgccaaacttgcccagtgaacgagttgcgatgataaggccatttgagaagacgggcgttgactattttggcccattaacaataaaaggcggagttaaagtctacatcgcactttatacctgtctcgtaatacgagcggttcatttggaagtggccgatgattgtacggcaacagaatttttgaggacctttcgaaggttcagctcacgccgcggcctcccaagccttatgtggtcagataatggcaccaattttattgctggagcagagtgcataaaagaggaatggagaagagaaatactggtggaaaccagccactcagga

SEQ ID NO: 54697 - DNA, 900 bp, Heterodera glycines
  Genomic contig location: Contig_ID=SeqID_23997; Location=281..1180; Strand=-
  SCN-specific regions: Sequence locations=1-16,39-369,391-900
ccccgccgtgaggcgggacagttccaaaaattttgtaccacattttactgtggaaagtccaagtactttattggccaattacgtgtcaatgagcacagtcgcctttggccagttgtgaaacggaaaatggaaatatcagatggggtgcgctcttttctaaaaattcctcttttcgtctaaccatccctcccttttgtgcactatttcgtttcaaaattgaatcatttttttttgtcttttgaaataaattgtgaaaaatatacgaaaaattattttcggttttaattatgctgtacaatgcttttaagccccgccgtgcggcggctccccttttgtgcactattttagtttttaaaattggttccggactttttggctttttgaaataaattgtgaaaaatatacgaaaattattttagcttttaattatgcagtacaatgcttttaagccccgccgtgaggcgggacagttccaaaattttgtaccacattttactgtggaaagtccaagtaccttattggacaactacgtgtcaatgagcacagtcgcctttggccagttgtggaacggaaaaatgggaatatcagatggggtgcgctcttttctaaaaattcctcttttcgtctaaccatccctcccttttgtgcactatttcgtttcaaaattgaatcattttttttggctttttgaaataaattgtgaaaaatatacgaaaattattttagcttttaattatgcagtacaatgcttttaagccccgccgtgaggcgggacagttccaaaattttgtaccacattttactgtggaaagtccaagtaccttattggacaactacgtgtcaatgagcacagtcgcctttggccagttgtggaacggaaaaatgggaatatcagatggg

SEQ ID NO: 54698 - DNA, 388 bp, Heterodera glycines
  Genomic contig location: Contig_ID=SeqID_23997; Location=424..811; Strand=+
  SCN-specific regions: Sequence locations=1-367
gcttaaaagcattgtactgcataattaaaagctaaaataattttcgtatatttttcacaatttatttcaaaaagccaaaaaaaatgattcaattttgaaacgaaatagtgcacaaaagggagggatggttagacgaaaagaggaatttttagaaaagagcgcaccccatctgatattcccatttttccgttccacaactggccaaaggcgactgtgctcattgacacgtagttgtccaataaggtacttggactttccacagtaaaatgtggtacaaaattttggaactgtcccgcctcacggcggggcttaaaagcattgtactgcataattaaaagctaaaataattttcgtatatttttcacaatttatttcaaaaagccaaaaa

SEQ ID NO: 54699 - DNA, 213 bp, Heterodera glycines
  Genomic contig location: Contig_ID=SeqID_23998; Location=38..250; Strand=-
  SCN-specific regions: Sequence locations=1-26,118-213
atgaaacgaaaatttttgttaattctaaaagagacggatgaaaacggaagggaaaaagacgagggaggagaagaagaagaggacgaagagagcgatgatgggaatggggaggaaaagcatccgccacctccgaaaaaggcacggctttccaccgaagcggaagaagaggtgccattgcctgcgttattattatgcaattattcatggcattga

SEQ ID NO: 54700 - DNA, 669 bp, Heterodera glycines
  Genomic contig location: Contig_ID=SeqID_23998; Location=415..1083; Strand=-
  SCN-specific regions: Sequence locations=1-669
  Gene Ontology: Mol. function=neurotransmitter:sodium symporter activity; Cellular component=ubiquitin ligase complex; Biological process=protein folding
atggccgtcactttgcacacaacggtgggcgacataaagttggaattgttttgtgaacgttgtcccaagtcttgcgaagtgagtgcgggggaatgcacaattcactcatccattttaaatgttttttcagaacttcttggcccattgcgcttccggttattacgacaattgcattttccaccgcaatatcaaaacgtttattgtccagactggcgacccgacaaatcgcggcaccggcggacaaagcatttgggacgcaccgtttgaagacgaattgcatgaggacctcaaagttggttggcattttgccaccaaataattaatttttttaccacagtacgatgcccgaggaatgatcggaatggcgagcaacggaccgaacacaaatcgttcccaatttttcatcacttacgaaaagcagccgacattggacctaaagcacactctgttcggcaagtcagtcgtgtcaaattttctataattattaagaaattggttttctgttgaccaactgttccgtttgtcttcagggtcattgacggatttgatgagcttgaagagttagagaacaccaaagtggacgcgaggtatcgcccggtggtggagcaacgaattcgaagcgtcacaatccatgcgaatccaatcgcggacggagcggcagaacaatga

SEQ ID NO: 54701 - DNA, 1134 bp, Heterodera glycines
  Genomic contig location: Contig_ID=SeqID_4505; Location=271..1404; Strand=-
  SCN-specific regions: Sequence locations=1-75,98-232,261-317,341 -928,951-1104
atggtgggtgaaaacattttattttttgggtcattggatacccatttcgccatgatgaagtttgcccgtgcatgcataaaattttttttttttattactctcaccgactgtaccggagttataattatggcattgacttttttttttgtgagacagtttagtcatcacaaattattgaatatttatttttcagaattttgtctctagggcaatctgtcaagttatggaagagaaataaaatttgaattataattattattcttttggtcagtttaccctaatctcaaattttgaatgatacaaatccttaatgatatgacaaacaaaaaacagaaatcaagccttaattcactaatcacaaagggctctttgcaaattcaaaaagcggaaggattttgcgaattcctcattaagctcacaggaaaggagaattttgaaatttttgataggctcctaacatggatttgtttttttaatccttttggctttcttaaacctgatcaattttataccaagtctattctcagactgagaagcttggagatctcttagcttcaaagatggaccatttccgaatttttaaggggtactgtaactgtattggcaaaccaaaaaagacaagtgagaataatctaaaggttcagaaaacactgggtttaccatgcgaatgtggctccttaggtacccgataaatccctgattttttaatggaagaaatcatcatggatagagataggtttattagcaaaaaacgaaatgaaactttcagtacaaatgactcacagcagcttattaacaaggagacctcacaggggaagctgaaggatttaatatttgaattattgaccgctcatccgagccatttccaatctgagtttttatgatcaaagccctcgggcaactctgtcaagaatgaagggacaggagctattaaaaaaaattatttaattgcagtcgaaagtgttaaaacagttcgattatcctcaagtgaacagtgagaacctttaatctttaaaacgaaccttgtcgtcaagcaaagctaaggttgagagccaagaggtgccaactatcactatttaacctatcattggtcatgtggattggataaaaaatttatataaatttataaataaa

SEQ ID NO: 54702 - DNA, 403 bp, Heterodera glycines
  misc_feature (7)..(7): n is a, c, g, or t
  misc_feature (16)..(16): n is a, c, g, or t
  Genomic contig location: Contig_ID=SeqID_4505; Location=4288..4690; Strand=-
  SCN-specific regions: Sequence locations=1-20,58-69,94-147,235 -250,273-403
atgcttnttcgaaatntaagtggaataatgaaaagaaaaaattaacttttaaaatatcgaataacagatgatatttattattgggttatttgatctacacgtgccatacattatcgacgaacttctgcatttttaaatcaagttttgttaatttcaaaaattaaacaaaaatttaaaaaaattataatgaatattatgattaatgaaatattaaaaattattttatgataatttgaatgataaaaggcaaagaaggcaaaattaaatatatagggttatattttcatccgattgagaacaatggtaaaatgattcaaaaatattttgctaaaattagattttcctcttgccacgggtaaataattctttccaagaatgaaaaagataatttatgaataataaa

SEQ ID NO: 54703 - DNA, 2326 bp, Heterodera glycines
  Genomic contig location: Contig_ID=SeqID_4506; Location=956..3281; Strand=+
  SCN-specific regions: Sequence locations=1-77,99-129,163-304,326 -1577,1600-1710,1789-1823,1845-1988,2055-2132,2156-2201,2225-2326
  Gene Ontology: Mol. function=transcription factor activity; Cellular component=nucleus; Biological process=transcription from Pol II promoter
atgactgatctcccgaaggagcggtgcacctcattccattctcgttccccaacacgcgcaaatcccactcgtcctcctggggatggattgccggcggcgtgccagcaaccatccggtgctaccagtgaaggtgctgatgtccagcccagaatatgaggaagggaacgagtgagaacgaggattggatttggggggaaaacggaataagccaaaatccgggccctggataaatggcctccccaaattggtaatcccttgggcgcccactagatcgaatacgcgtgcggggatgggcgagaaggagtaaaataataatataaatattggccaattacattaataataattccgccgcgttctgctctcggctctcgctcgccgattaactgcccgctcaactgaccccttatcgagagaatgctcccgattaaatagttggacttatggaacggaataaagatggggaaaagcggggataaatggtgtgagaaagagattgaacggatgtgataaattgcgccttacaatacccaatttaaagaattaaataatttgccacaaaatattcaaaatggcgaatgctttggcattttaattgagccagaggatgaggaggccgaaatagagcattactcactccattttgaaattcatgtgaaaccaatgggaaatgagtgccaaccgtcacaggcggatgaaaatgatcaaaatccaccggcggatcaaaatgatcaaaatccaccggcggatcaaaatgatcaaaatccaccggcggatcaaaatgatcaaaatccaccggcggatgaaaatgatcaaaatccaccggcggatcaaaatgatcaaaatccaccggcggatcaaaatgatcaaaatccaccggcggatcaaaatgatcaaaatccaccggcggatcaaaatgatcaaaatccaccggcggatgccgaagacaatcggacaatattccgaaaaatctcattaaaattgtacaggccaaacatggcacaggtgtacacggttaatttgggcaaaattgacccgcccgaattgtattttaaccgcacaatttttgtggccaaagaaaatgatttgaccaattatcatgccttattgtatgccctaatgcacaaaaatcaagaagattctgatcaatattatgatctgttgggctatgtgcaactgattaaaatcaaggacgaagaagaacaagaagcacacgccagctcacaatcagaaaagaaagtaaacgcaaaaagcgaacatttttaaatttgaatttggcattatgtcccaaaatcggattcgctcagttggacgctcaaggttgagcgccagcaagcttttccactacatatcacttttttatttgtcatccaaatccaacaatctttgtatcattcgaaagctcttcccatgctctattagcgttacaaaaagcgaaaagattttcatgcctgggaaaaaaaaattcaaaaatttcgacttttcgcaattttcatgtataaccttttttggtaattgtctaatcgcgactcaatagtttagaaattgcttgcttgtaaacatgttaagagctttcgataattatattattattattatgcaattttcagttcaataaataccaattgaaaattccaattaatcaaagtgcgcttttcaaacattgcattcataccttgacgttgcaaatttgttcttttgaaaaggtacatttattaatattgcaaattatttactaataaatgaaaattaaattttaaaaaataattgaaataattttaattttttgtatcttaaatttcgaaatatttcaatttactaccgaaaaataaattatcaaaaaacaataataatgtgtgctaatcacttaagatgctgtttttgcaaaaatgcgttaaaaacgaaaaatatacccttaagaatcgatcctaaaatttccaaaaataagcacccctaataaatgtaaattttcttaaaaattcatctccaaaatttattaaatttttgttgacaataatttttgattttaaaaattatttattcaatattaatttggcttaatttcgttacctttttgaataaatttgttcattttacacccataaatttgaggctttttagtgcctattttggctgtttttaaagcctaaaaatattagctctagtaatcacatccaaattatagaatgaaaatcacaatgaaaaaatggagaacgaagaagaaactgagccgaaagaatgcccaatttgttatgaatcatttgatgatgatgacaaattagcaatgaaattgcatgaggattatcaggctaataatctcaattaa

SEQ ID NO: 54704 - DNA, 763 bp, Heterodera glycines
  Genomic contig location: Contig_ID=SeqID_24000; Location=289..1051; Strand=-
  SCN-specific regions: Sequence locations=1-20,46-239,261-356,407 -413,436-763
atgccaaagcttctgacaaatttttgtgcattaattttaatttgtcaaattacatttttggcttcaacaaatccattggaagaaacgcctcaaaaaagcttagccaaaaagcgtcttaaaatccttgtttattcgcccacaattggatggagtcacatgcaatttatgggctcaattgcggacactttggtcggggcaggccatgacgtggtaaatcatatcgataattaaaaattggactatataatttaggaaatgaaaaattttattggcaagcattaattgtgcatataattgacatattttggggaaaaccgtaaataatgcctattttgtctttttgttttttatggctgaaattaaatattcaaaaatttcaataaatatattttaattagaattttttgcgaaataaataatttttgaagggaaaaatgatctaattgtgaacaatttcccagaaatttcacaaaatttagcacctttttcgcgttttgatgaacaaaagggccgaggcattgcccaaggaagtgtttaatgtgaccaatttacacaattttttgccaaattttgttcaaatgggcaaattagacatcaacaaattggacgacctcaaagagccattttacggcaaaagtttcaacacttttctcttccaaacggtttgtgatcatatgaaaaaaaatggaaaaatttgtaattaaacaaaaattacagaaattaaacgaacaatttggtaaaattctatgcgaaatttgccgag

SEQ ID NO: 54705 - DNA, 231 bp, Heterodera glycines
  Genomic contig location: Contig_ID=SeqID_24001; Location=421..651; Strand=-
  SCN-specific regions: Sequence locations=1-46,91-178
atgggggtctgggtgagaaaagagaagggaattggtgagggatcagaaatttttgataaaaataaattaaattatttattttcatttatagtatttgttcatatacataagtggtcaagtggctaaactttattactttcattattggtctcttcggttcaattccccgatggaacggaaaatttttttatattttctttaccattattttaattgaatttaattaataaa

SEQ ID NO: 54706 - DNA, 1107 bp, Heterodera glycines
  Genomic contig location: Contig_ID=SeqID_24002; Location=198..1304; Strand=-
  SCN-specific regions: Sequence locations=1-516,538-798,822-895,1004 -1013,1039-1107
  Gene Ontology: Biological process=N-linked glycosylation
atgcttcctgcccctttggtcggtttcattttgctgttagggcattttgtgtttgtttctgtcggttccaatttccacgtgctcaaaaaacggggatacgacgaaagcgaaagttacagcagtgaagaagagccagtgagcatgaatcacaacagttccaaagaatttgaagcgtaacgccaattttaagacgtacaagcgccacgggtatggcgggcgctttggtggcaaacgccaccgttacccaccggcgcatggcaagggacaccgcccgtcgacgtacgatggcttcccttacggcgattctccgcttcttccccaagtcatcgccgcccctcctatgcctttctcgcctttgcaattgccttccatttcgaaagcccaaagcgaccttggcgcattgcaagtcgcttctcctgttttggaaggctctccaccgaaagaatcgcctcctctcgacgcttcccaacctttgaacggcgccacggcaattcagtcgcctgctgcagcgcccgagacaaacataatgaattctttggcggcttctcctccattggcaacaccgcagcaattggcatccctttgggtgggcggaagaaagaaacggtcctttaaaggtgcgttgtcgcgttaattttgcgcaagccatgaaaacccaaaaaagaaacaattaaacagagccaaagacaaaaaaagcgaaagaacggaaagcgatcagagagaatgagccgcaggggacggagacaacactcgcagcggacacagaagagacgacggaaaagccgacaaagaaagcggcaaaggaaaagccaaaacaaagaatgatggaggaagtaagcgaacagcggcagaagagaagcattaattaactcaaaaattgaaatcacagaagggcgaaaaggaagcggagaaaaagaaaggaggagaagcaggcaaagaaggagagcaagtgggcaagacgaagaagaagcagcagcagaaggcggagaagcaggaaaagaagcggcacagaaaggaggaggaggaagaggaggaggaaagccttttgggcaaaaaggagcagcataacgccgagttcaagcagggcggcccgcaattccgcagcac

SEQ ID NO: 54707 - DNA, 128 bp, Heterodera glycines
  Genomic contig location: Contig_ID=SeqID_24006; Location=814..941; Strand=-
  SCN-specific regions: Sequence locations=1-26,57-128
atgcatatgcccattttagcggtaagattaaaactattaaaaaaaataattttattcaggcattaagattcacatttcattttgagagaattagctagtttggaatatagccaaccagaattaataaa

SEQ ID NO: 54708 - DNA, 886 bp, Heterodera glycines
  Genomic contig location: Contig_ID=SeqID_24007; Location=1..886; Strand=-
  SCN-specific regions: Sequence locations=1-34,56-72,94-110,132 -148,170-186,208-224,246-262,284-300,322-338,360-376,398-414,436 -452,474-490,512-528,550-566,588-604,626-642,664-680,702-718,740 -756,778-794,816-886
  Gene Ontology: Mol. function=structural constituent of bone; Cellular component=collagen type III; Biological process=histogenesis and organogenesis
ctccgggggattgtggttctccggccaaggacctgcccctccgggggattgtggttcaccggccaaggacctgcccctccgggggattgtggttcgccggccaaggacctgcccctccgggggattgtggttcaccggccaaggacctgcccctccgggggattgtggttcaccggccaaggacctgcccctccgggggattgtggttcaccggccaaggacctgcccctccgggggattgtggttcaccggccaaggacctgcccctccgggggattgtggttcaccggccaaggacctgcccctccgggggattgtggttcaccggccaaggacctgcccctccgggggattgtggttcaccggccaaggacctgcccctccgggggattgtggttcaccggccaaggacctgcccctccgggggattgtggttcaccggccaaggacctgcccctccgggggattgtggttcaccggccaaggacctgcccctccgggggattgtggttcaccggccaaggacctgcccctccgggggattgtggttcaccggccaaggacctgcccctccgggggattgtggttcaccggccaaggacctgcccctccgggggattgtggttcaccggccaaggacctgcccctccgggggattgtggttcaccggccaaggacctgcccctccgggggattgtggttcaccggccaaggacctgcccctccgggggattgtggttcaccggccaaggacctgcccctccgggggattgtggttcaccgggcaaggacctgcccctccgggggattgtggttcatcggacaaggacctgcccctccgggggaattgtggttaaccggccaagggacctgcccctccggggga

SEQ ID NO: 54709 - DNA, 91 bp, Heterodera glycines
  Genomic contig location: Contig_ID=SeqID_4507; Location=219..309; Strand=+
  SCN-specific regions: Sequence locations=1-91
atcactccccaagttcgcactgctctgttcggtcccaatcagaaccgccgcttcttcgactgatcggtcccttcgcttcgaccattccatt

SEQ ID NO: 54710 - DNA, 239 bp, Heterodera glycines
  Genomic contig location: Contig_ID=SeqID_4507; Location=801..1039; Strand=+
  SCN-specific regions: Sequence locations=1-239
atgggcgaagttcgctttcactccgattacgtttcctccaaccgcggaatcaccaaaatcatccaaattgtgctcggttttgtcgtctgttcggtgctttgttcgaattggtgtcaaattgcaaattaacgtggtaaaaacacacaaaacattttgaggtatggcgggtacagctgtttcggggagggccgcctcggttatgtgagcggattgaactttgtctgtttgatgattaacat

SEQ ID NO: 54711 - DNA, 1186 bp, Heterodera glycines
  Genomic contig location: Contig_ID=SeqID_4508; Location=306..1491; Strand=-
  SCN-specific regions: Sequence locations=1-23,45-569,591-744,773 -931,968-1186
atggaaaggcattttcatgttcaaaaagcatttcaaaaagaaaagcatttggcattatttgaaaatgcggtgagtttggcgttatgtcttccgtttgttttccgtccctcgtcagattggcaagtgcccttcggacattgtgcggttccctttgaagtcccattgaaagagcaaaaagatgatcagcacacagacccaaaaagcaaacaaaagtgatcaaatccaaggcgaaaggcaattagcaaaaggtaccgctgcgattatcatccaaatgttccagtaagagtactgtatcatgtaccataacagaaggacgatgccgacgagcagaagaagggcggcggcgacattgtacaattgttcaagtttcagtggacgaatgttgaacagattgagcaggaaaaggatgctcaaaagatcaacaaaaggcaataaaaatgaaaatggaacccaaaaacaaaaccaaacaaaacaatcggacactgacaaaaggaaaacaaaatcttatcagcttattaagacattgccaaggctcttatgcagtttaacccccataaattttttttcgtatttcatgattaaaatgccaattaataggttttcggggtcgctgatcacgaatccggcatccgtttcgaccaattccgaaccccggacccgaattcgaacaaaaatttgaaattccaaattttcaacaaaattcacatttactgcaaaaaatcaattaaaatgccacgaaatgtgtgagtaaaaaacaagaaattattggattctttcacaaggatatacaacgctaatttgggaccaaaagttaaaaaactgttcattgtgaaattttggagttcttccattttcggttttatttttggggattcggaatggtgacagccgttcaaaaacacagtgttggcccattacaccacagcaccaaccccccccccccccctctggttccccttccccctccactctaggaatttgaacaaaagaacggcacggcagcagcgattggtggatacaaaaggccttaaaattcacagcaagcaatggatggacaaaggacagaagactgagtggagggagcgacgaaagatggccaacgaggttgcaatggagaaatttcaattttaccaaataagcaatgccgattgaattaaagttttagtaaatattcaattataataaa

SEQ ID NO: 54712 - DNA, 453 bp, Heterodera glycines
  Genomic contig location: Contig_ID=SeqID_4508; Location=1083..1535; Strand=+
  SCN-specific regions: Sequence locations=1-365,387-399,421-453
catccttttcctgctcaatctgttcaacattcgtccactgaaacttgaacaattgtacaatgtcgccgccgcccttcttctgctcgtcggcatcgtccttctgttatggtacatgatacagtactcttactggaacatttggatgataatcgcagcggtaccttttgctaattgcctttcgccttggatttgatcacttttgtttgctttttgggtctgtgtgctgatcatctttttgctctttcaatgggacttcaaagggaaccgcacaatgtccgaagggcacttgccaatctgacgagggacggaaaacaaacggaagacataacgccaaactcaccgcattttcaaataatgccaaatgcttttctttttgaaatgctttttgaacatgaaaatgcctttccatttctttatttttcccgttcgaatgcttttcctctgccgtccttt

SEQ ID NO: 54713 - DNA, 850 bp, Heterodera glycines
  Genomic contig location: Contig_ID=SeqID_4508; Location=1495..2344; Strand=-
  SCN-specific regions: Sequence locations=1-146,168-408,431-566,588 -800,822-850
atgcttttggcaatgccaaaagctgtgcaattgccagtaaaagtacaaaatcgaacagaagaggacaaaacaaaagggcagaaggacggcgaaaggcgacgaatgggaagggacaaatggcagaaaaacttaacggagggaaagttggggaaaaagcagggaaatgggaccattgaggaaacagacggcacggaaagggtcgtggacagagaaaaggacgatcgcaacgaacagagtgggacacaacgccaaagcgaacatttgaaagggacgaagaaacaaacggtcaatggaaaatgtggcactcaaaaaccagcaaaatgagcaaaggacgaagagcaattgggttggagcgacgaaaggcgtaaaaagtggagaggaaaatggcaccgaagaggggccaaaggggcagagagaagggcagccaaagggacagcagaacagcggaaatgaccgcgtcgacgaacgcggacaaaacagccaaagcctaagtcattccgtcttgggagtgccgaattgggcacttaccacgacgcgttcattggctttgacattttggcacggatactccgcttcctcagaaagcaaagccttggaatactctgacatcagaagaaggaaaacggaacaaggctaggaggagcaaagttgggctaatcaaagcaaatcccaacaaaacgactgatttattcgagtgggggttgagagggaatacggatgaatgaatgagcaaaacgggcatttgctctcttcccgcgtcgttcggctgattttatctcatcggaggcgaaaatgggcggggacagaccaaaggacggcagaggaaaagcattcgaacgggaaaaataaa

SEQ ID NO: 54714 - DNA, 1130 bp, Heterodera glycines
  Genomic contig location: Contig_ID=SeqID_4508; Location=2378..3507; Strand=+
  SCN-specific regions: Sequence locations=1-928,951-1019,1042 -1049,1073-1130
atgaagggatacgccgaattatgtgagaagagaagcgattggcgcatagtcaactgatgatttgagaacacattcagatgtggccgacccctttctcagttgtgtttctgctgagaaacagcgattggagcaaaaacagtgagtgccatggacaaatccatggagagggcacgggaaagggttcgggaagaaatgtgggaaaggattcggggagcgtaaggggtaggacatggaatgtgccgcccctgtgcataattcagaaaatttaagcagcagccccccacaattttttgcgccaaaggtactcgctcggccgcttcgcggcctcgtactggtgccttcggccccccacaattttctgcgccaatccaccatcatttaatcactgggactcaacccaccaacattccaatcaacgggactcacccaccaacattccaatcaacgggactcaactctccagcattcaatcactgggactcaactctccagcattcaatcactgggactcaacccaccaacattccaatcaacgggactcaactctccagcatttcaatcactgggactcaacccaccaacattccaatcaaagggactcaacccaccaacattccaatcaacgggactcaaccctccagcatttcaatcactgggactcaactctccagcattcaatcactgggactcaactctccagcattcaatcactgggactcaacccaccaacattccaatcaacgggactcaactctccagcatttcaatcactgggactcaacccaccaacattccaatcaaagggactcaacccaccaacattccaatcaacgggactcaactctccagcattcaatcactgggactcagctctccagcattcaatcactgggactcaacccaccaacattccaatcaaagggactcaacccaccagcatttcaatcagtgggactcaacccaccaacattccaatcaacaggactcaaccctccagcattcaatcactgggactcaacccaccagcattccaatcactgggactcaacccaccagcattccaatcactggcactcaattctcctgcatttcaatcactggggctcaaccctctagcattcaatcactga

SEQ ID NO: 54715 - DNA, 1620 bp, Heterodera glycines
  Genomic contig location: Contig_ID=SeqID_24009; Location=95..1714; Strand=-
  SCN-specific regions: Sequence locations=1-307,329-415,437-741,764 -769,792-1003,1063-1217,1255-1620
  Gene Ontology: Mol. function=ATP binding; Biological process=signal transduction
cattgatgaactgatcgacgtgatccagggcaaccgggtgtacatcccctgcctacacatatacaacaaaattgaccagatcagccttgaggagatggaacgactcgcccggctgccgcacagcattgtgatcagttgcgagctgagcctgaacctggactacatgttggagaaggtgtgtgcaaactgccatcggagtgtaattttctgccaactttttggagactgaaagtgctaaacatggattttatattcggcattaaagggcaactgatccttacttttttcataacttctcaatttgcaattatttacaatttttaatcttctgttcatttgtttccagctttgggaatatctcgctttgctccgaatatacaccaaaaagcccggcaatgcgccagaccttggtaaattatgtttttcttaaattttactaaaccatccaaattttaagggcctgaagatggcataattctgcgcggtaattccacggtacagtcttttatttgtattaatgttttacttaattattgagttaacccccgagaattttgggacagggcgttccccttcgcccacaaatgataataaaaagaaattctcagaaaaaaaagattttttcaatgatttgatatcaatgaaatgttttattcttctaaagttttctttttgttggtactttttttgtcaatagaggtaaatttactgaatgattaattgcaccccacgaatttacaattttcttttttgaaaactgaaaggctccaatttaatttatttattttaaacaacatctaaaactctatacatcgtggcaagtaaatcatgcaaaagtgcccgtaaactttctttctgtgtgcccaggttgagcacgcgtgccatgcgctgcaccgcactttggccgcccaatttcgctatgccattgtgtgggggacgagcaccaaattcacaaacgcaccacaacgcgtcggcatccatcacaagctgcaccatgaggacgtcattcaaattatgaaaaagaattgaaattgtttcatattttattgtaaatgtattgtactgctcccgcggccgttgttgtttttgttccaagtgattttatcatttgttttcgtttggtaaattattttccacgttttatgtgagtgaaagcgcaaaggtcttttctacctagaaccattttgcttctttcatttctgtttgtgctttattccaaaataattttaaaaatttgtttttaatgtaataaaactagcaaaaatgtattgcgcaaatgccaaaaagtgttgtcgaccgttggtgaatcattcgcgtgccttttccatacatcagtggagggcattcaaggcatgtcgggagtcgaattggacaatggcaatttcatctaaaagccgagattttgagcaaattaaaaataactggccagccgaaacatgctacttgttgacattattaatattgtcgagaactgagtccactttccgccccctcaatttgacaatggcattttgaacaaaaaaaatgtttaagagatggcaggacgttgagcggcgcaacaattacattttcgacatctatcgaaagcaacaaaatgtgatgaaggaacccgagagcgga

SEQ ID NO: 54716 - DNA, 165 bp, Heterodera glycines
  Genomic contig location: Contig_ID=SeqID_24009; Location=328..492; Strand=+
  SCN-specific regions: Sequence locations=1-133,155-165
atgaaattgccattgtccaattcgactcccgacatgccttgaatgccctccactgatgtatggaaaaggcacgcgaatgattcaccaacggtcgacaacactttttggcatttgcgcaatacatttttgctagttttattacattaaaaacaaatttttaaaatt

SEQ ID NO: 54717 - DNA, 863 bp, Heterodera glycines
  Genomic contig location: Contig_ID=SeqID_24014; Location=1256..2118; Strand=-
  SCN-specific regions: Sequence locations=1-393,415-555,577-863
atgaacaacaaccataacgatgatgatgatgatgaggctttcggaggaggccaggctgagcaagcaggaactgcacgcggtgttcaatttctgcgaaattttgccacaactccaacagcaaggcttcattccggagaacaaacatgccaggtgtgcacgacacgaaaatgcgcaccataacgcatgggatgggaaattttgcacatttcgggcacgattgccaaagattttcggggattattctgccaagaaagtgccgaaaagtcagggcatgggaaaatgccaaaaaagccaatcgtactatagggagcgaagctgtctctgataggaaggatattcggcgtcggtgacccggttggaaatggtgccgagcgcgcaactgcatgggttcgggagtaccgaaaaaggccctcctatctccatgtgaggggcggtgggttctagtacaccgggtattcgagattgtcgagatcagtgtcccatcctcctgctgttcccctcgctgatttaatggcattaaagccagctaactagcacaactttttcagggatatatgcaaaaagctggtggacatgctgaagccgatgttcaggaaacgggcggcccagtctgcccatgcgtctgttgtgccgatgccgtcgaggccacgccggcacgttgccacggccacgctgttcttgcagcagcgaaagcgatgaattgatcaaagaaaatgatcaaaaacaaaaacaaaatatggagcatgatgaagagaaaaattgtttcgtccgtcgtttcgttcacgctgaatctcttcccataatccgaatgtttttttttcacaattctcttcaaaaccgtcccaatcaatcgtcataataaa

SEQ ID NO: 54718 - DNA, 998 bp, Heterodera glycines
  Genomic contig location: Contig_ID=SeqID_24015; Location=697..1694; Strand=+
  SCN-specific regions: Sequence locations=1-169,246-375,402-541,594 -599,621-814,837-998
atggttgcgcattatttagaatctaacgaaacttttttacgaaacttttactatctaacggtaccaagcatgttagtaagctaatgagttgagaaaagttatacgaatctttatcgaaaaactacatgagatggcttttagctgttttgtttagcatttatttatttggaaaaataataaaagtcattaatatgaaaaatttatgaaacaattataatttatttaatttatattttcatatttatgtatgatttccggtgacaaaggcaattattgctaatacataattaaaagtcaaaaaaatctttgaaaaagctgctctcaaaagagaatatctgtgacgttttctccgcaaatccacggcaacaattttgcaaaaaaaaattaaaaataaattatttgaagatattgaaaaattggaaatcatcagtgcgttattatgaagtattttaagagatttgtaactttcaattaaatattaaatgttgcattgtcggaggatttcggagcttatgggggcacgaattaaataaaatgaacgaaaaatattaaatttattaaatttttgaaagaaaattacaatttaaaatatacagaagataaatagaaatagaaaagaaggctatgattatggtggttatggttactgtacaagtcaccacacgcaaatggcagtcggaataattatggaatttgaaatgaaatagaacggatacggtggtggtgaattgtcagtcaactacagtatggagggctctggctgacaatgatgagggtggtacggtaaagccattttgtggttggtattatgattataataatgataaataataatacacgttttgcccgtcgggtgaacctgagatgcttccgggaaaatgcttctcgcgccgtcgccacagaagaggaaaagcgatggcacagaaagagagagagagagaggagaagcaaattgcccgtccagtgaatggttaagtggtaagaaaattatgcaaaaa

SEQ ID NO: 54719 - DNA, 1339 bp, Heterodera glycines
  Genomic contig location: Contig_ID=SeqID_24016; Location=117..1455; Strand=-
  SCN-specific regions: Sequence locations=1-189,212-1082,1104 -1202,1227-1262,1285-1339
atgcgaaagtgcacgccattcgatcgccgattctcatcggattgcccgtcgcttgcgactggttcagtcagtcagaattggccaggacagaattccttctatgttttaatggtatttattaaggaatatcaggacattagacggagttatgaccacaggctgccaactgtgaggttttagccaggcctaattttcaaaatgagcctatgtttcttggaaaaatcctcacaaattggtaatttttaagttggcagctttggaggtcggatttatattttctaaaactgccaattattggttaaaattaacttcagaccaaattcgcaataatggatttacgaatgcgatcgaattgcttcacgttgaccccgtcgcaatgggatttcacccgtgttttcatgtttcctataggtctgtaatttattcgtttccctttgtctcattttggtataaacaaatgcttttttggcatctgtctcattaatataaatcataattttccaattttaggcgttatatctatcgtcttcgcgtcatttcgacagagcaaagccttaattacccaaatcgcttcttcgcccatttgtcccatgtaattccctcggacccttcgctggcgtccctctccgaattcaattacagttggaccattccgccgacttttaacatcgaaagggcccaatttgtgtgcgacctcctgaaaagacctggacagaattttgcctcatttttcttacaccaaatgcgccaaaggataaataacaaagaatacaaatcagtgaccaggagacgtcaacttttgcagttgcaaatcaacaaaggtatggtgtaatattgcaaaaaaaaaagattttcggaggcctcggaacggaaccgccgagtcccaacccaaataagagacaaagacgaaccttatattttgtttttcacaacaatttttacggccctttttaaaatttttgggaacacaaaagtcgagctccgtcggaaaatgaaaaaaaccaatgcaaattttagaaatactagtactagagagtaaatggcaacctaattgcagatgcgattatacgtttcttattcggatattacataaaatattaatttctaccgcaggtgaaccctatcatgattttactgattgtgaggacgaagcgcagttttataacctggactttgttgggcatggtttcatgaggcaacaggtaattattatttttgttttataatgaaaaatcaatttctgtaggtatcgcgaggaaaagttaaagaaaatttgttcaaaaagttaggcaagggcataaggattcgtggcaatcatataaattatgaagaaaataaa

SEQ ID NO: 54720 - DNA, 1211 bp, Heterodera glycines
  Genomic contig location: Contig_ID=SeqID_24017; Location=810..2020; Strand=+
  SCN-specific regions: Sequence locations=1-380,419-751,773-1043,1073 -1211
atgacaataaaagcattctttatttttgttcgtgaaatttggccaattttttctgaaaacattcgccacttgggctttaacgatggtgatcatttggacaatttgcgtcgtcaaatttcgccaacaattctcactgatctgaatcagttgaattcaatctattcctttgatcggttgccctctgcgtttggtgatggttttgatgggccaatttctgctggccaagcattgtccaaatggttgcactctccgagaaaagatggacaacccaagcgattgcgttgctataattacaacgaacaagcgaacactgattggatcaacaatttcaaggaggtgtggtccggggggggggggggggtggacaaaacgtagcccgcaaatttttattttaattaaaaaaattatttaaaatttagttacctagcctaaatcaaaaaaaaatagataaattcgaaaaaaattattaagaaaattcaaggaaatgtaaaaaagtcgtttttttatttttctggaaattcagaaaattagtttttatacgagacggcgacgttttaggggcgtacccggtctgtggatggcattctgagttattttctgaaacccgaccccaaaaaagttataaatcgaaaatttctgaaaaattccgaattttatcaaaaatttcggaaatcggaattcagtgccatccctggtgtggccataattcgacaaatcactgattgttgttttccaatcaaattgtttagcattttcttcgtgccaatgccatttcttccgtcagttaccaaattcatttttctgttcctgcgccgtcaatgccaatggtgccgtttgaattggtgaacgaatggacaaaggaaaagctgacattggccaaaacaaatgaatgggacatcgattggataatgaaacgatgcaaaattattggggagaccgcggcggtttattgggaagacggaaattgggacaacaattgtaataatgtgtccattcgtctttttatttgttccaattgcattgggtgagcaattaaaaaaggcatttaattttgtttaaataattaaaatttcgcttaatttaggccattgtctccgccaccgaaagaagaagacgaagcaggacaaagcagcgaaaaaggggcgtcgtctgctgacaaaatgagtgacggacaaaagaacaaaaacagtgatcagccgcagaagaaatga

SEQ ID NO: 54721 - DNA, 1056 bp, Heterodera glycines
  Genomic contig location: Contig_ID=SeqID_24018; Location=457..1512; Strand=-
  SCN-specific regions: Sequence locations=1-220,254-472,494-1056
atgggggggggggggggttagcacctattttggcactttcgaattttagcaacctattttggcctttttcagaaattttatagcaaaaatgcaataaaaacgaaaaatacacccctatgaatctatcccaaaaatttctgagaaaatatacccctaaaaattaaccaaaatttcagtaaatataaccctaagaaaggaaaaattttccgaaaattcgtctccaaaatttatttatttattttcttgaccagttgcaattgtgcgagcgaaattgattaaaaaattagtcacttttggaattttagtgcataaagacactggatttttccaatttttaacacctattttcgcaactatttttgcattttgggcgtttttagcacctattttgcacttttttggcacctattttagtacctatttcaggatttttagcacctaaaaatccggtctctactaatgaacgaccaattttttgtttagttttctcggacaacaaagtgcttctgtcgcattatgacagaattttgtttggcgccaatttgaaaagggatgaggacgacccaattgtacaccttttgctcgccgatgtgatcatttttgtccgatgggtggaggaaaagttgggactgacgcggcggcgttcaatcgccaccaaacgcatcgaaaaaagttgggagacgcgaatagaactttttgagggcttttacgacaaaatttgggaagaggacgagagaaaggtgcgccaattgggagaagtggtgacaggattattagacaagttgaagcagtgcctggagaaggacacgacgaaagtgttggaggacgaattatgggcacagataatggagaagggaaatgcgaaaacgattgacatggaaaagcgacgggcgtacgaaaagtggaagcgatcactgcattgggacataattggaacactgatcagagaagagccggcatttgccgatcgcatgaaaaacggtgcaaattttacacatttattagggcaatgttgatttaaattaatgaaaaaagcccgaaatatttaaaaataaa

SEQ ID NO: 54722 - DNA, 1110 bp, Heterodera glycines
  Genomic contig location: Contig_ID=SeqID_4511; Location=1703..2812; Strand=+
  SCN-specific regions: Sequence locations=1-10,32-345,393-465,523 -637,659-785,807-888,910-1019,1041-1110
atgacccgttttgggccagtgaaccaaagggccagtatttcgccgccccgtttggttgcgccggagttcgtcgtgctacaaattgggcaagctgctgtaagcagccaacaatcgcaacaaattccagaaaatgtccatttgattaacaaagaagagggggaactttcggattctgggggtgaatcatcagatgaaattcaatttgttgcaaatgtccccgctcgcggacaaaatccatccgcagcttctgagcaacgccgggcccaatcttcagtgccgagaatggcttggaaccgacgcccaccactttctgtcagctattatgtttttaatggggtgcaatagaatttattatttatgaaatatttttttacttaaatttattaaaaattgtgctcatttaaagcgacgttccttcggcattggacaccaaaggcagcaatatcgtcacattttgccagtatgtaaaatttaatttaatctattaaaagaattttaatatgtcaaatttaatttaaataactgatggaaaattttgaaaaaggtccgcatttataatggaaaaaataaaaaatttgtagaaatgtactctaaaatcgattaaagaaatcctctttttttaaatactgatttatgtaatatttttgattatttacattctctctttcgttaaatttttgttattacaataaataattcatgcccttcttattaaataagtgcctttttcttttagccggtccgtatcacgcccggaggtcctcctcagccactttttccgccaattgttcaacctgttcagccatctgttccgctaaacgttccgtcgccattatcagtatgaatagaattttctgtccaaacttaatttctttgctgattagctatggaaaaagaaacacaaaaaagcattttctccgtacaattttgctttaactgactaaattaatacaaaattcatatttggatgttttggtatataatgcatattgcacatatgtatttttgcagtttatacagcattttaaaatttcttaattacttcgagtgccaaaagaatccaattataatttattaactggtcattggactcccgtttgaactttctta

SEQ ID NO: 54723 - DNA, 708 bp, Heterodera glycines
  Genomic contig location: Contig_ID=SeqID_4511; Location=3554..4261; Strand=-
  SCN-specific regions: Sequence locations=1-272,294-373,401-650,692-708
atgaaaagtaaaattttaaaaaaatttggtcggtttttagcaagtttttttaataaacagtacattgatactttagaaaaccatacaaatttattaaattaaaagcaatatttaatgttttttagtaaaagaatccaatgaaccctcgagacccggattttcttcaaaaaattgaaaaaaaatgtggccatttttggtagatttttttctaaatagtaaattgctaatttcgaaccgaggcattttttaaagccatatgcgcgtaaaaatgcaattattaaagattaaataaaagcccaatgaaccttaaaacccctaaatttgttcaaaaatgcaaaaaaaaaattgaccgatttttgcaaaaattgagcagaaatttaacaaacaaaactaaaagaaattgtactgtttgacacaatggtgtggtgaagaaggtggagatggcggttttgggataacaaaagtagaattggattttgaatgaatattttcagcgagatttggaggaatagccgatgaaattggaggagggggaacagaaaaggccgattggggaaaagttgaggaagaattttggggaaaagaaagggccgaagaagggaaaaaacgacgtgctggtggagtgcggccaaggtttgagtggcttgaatgtccaaaaaatgaaataaatagtataacaaataaaagaagttgaatatcaacaataaa

SEQ ID NO: 54724 - DNA, 1669 bp, Heterodera glycines
  Genomic contig location: Contig_ID=SeqID_24020; Location=84..1752; Strand=+
  SCN-specific regions: Sequence locations=1-1,28-141,165-196,253 -253,343-348,412-425,455-491,519-735,768-776,820-1191,1217-1230,1268 -1391,1522-1568,1611-1669
atgtaccgccccagtcaaactccccgcctgacactgtcatcggcgcgggtcgccgggccaccgggtggcccgacttaacaccaaaatggacaccctttcgggcgcactcccgttttaccgattaagtaaggaatcgatgaaagtagtggtatttcactggcgccttgcggctcccacttatgctacacctctcatgattcttcacaaagtcagactagagtcaagctcaacagggtcttctttccccgctaaatttgccaagcccgttcccttggctgtggtttcgctagatagtagatagggacagtgggaatctcgttgatccattcgtgcgcgtcggtagttagccgacgaggcatttggctaccttaagagagtcatagttactcccgccgtttacccgcgcttaatcaagtttccttggcttaacattcagagcactgggcagaaatcagacacggtcaacgtccacaaggaccatccgtctcctctgttttaattagacagtcggattccccgagttcgtgccagttctaaactggtcgttcagcgccaaccgaagtgcataccctgacgagcatacacgcagctgaagcgctccacaagcagctctcaccactagtccacgcaccatccccgaaagaacagcacacagccacgggcaaaagccgcctgtttcacgcaacagcccggctgacccgacctttagagccaattcttttcccgaagttacgaatctaatttgccgacttcccttacctacattattctatcgactagaggctgttcaccttggagacctgctgcggatatcggtacgatcaggcaggagatcaaatagctccctcgcatttcaagggccgtgtggagcgcacgagacacacaggaaccgcggtgcttacgggcgcacatccctatctcaggctgagccacttccaggcacgcacaccctaaaccagaaaagagaactctggctcggactccacacgacgtctgcgagttcatttgcgttaccgcgcaaaacagctcttgcgaaccgtcatttccctagcctggcgtgggaatgttaacccacttccctttcggcaaccggatggaccaactgcgcaagcacagaaaagtcgtcatccgtagtgtgttacggcgttagccggtgccttaggatcggctgacccacattcaactgctgttcacgtggaacccttctccacttcagtcttcaaggatctcacttgaatatttgctactaccaccaagatctgcactggtggaagctccggccgggcccacgcccaaagccttcaacgcaaccaccacgaccctcctacacgtcatggccagactacgcgacaagcacgtgtacaagccaatgacggtggagtataggtggcccgctccagcgccatccattttcagggctagttgattcggcaggtgagttgttacacactccttagcggattccgacttccatggccaccgtcctgctgtctatatcaaccaacaccttttatggggtctaatgagcgggaactttggcaccttaaatccacgtttggttcatcccacatcgccagttctgcttaccaaaaatggcccacttggagctcaaacattcaacgcctgggtacagagtcaagcaaccctggcttcatacccatttagagtt

SEQ ID NO: 54725 - DNA, 823 bp, Heterodera glycines
  Genomic contig location: Contig_ID=SeqID_24021; Location=447..1269; Strand=-
  SCN-specific regions: Sequence locations=1-117,156-278,308-823
atggccgtcttcgatgatggcattgccgccgggcaccagcaaggacagccccggcaccaatcgacagcaacgggggcggaggacgtgctcatgtacgaccacccgttcaacgacgggtattttattcaaatttttaaattctattttatttttttggccgggccaagccgaagaaaccgtttttccaattttaaccgttttctcagaatttggttgtttgttttttttggtagtgtatcacaatgagaaaaaattggtaaaatttgcagccattccgtacttttttcaaataaaatattttcccttacatttttgcctatgtgtaacggagtcccttaaaattggacaatttgtaaccgagttttttcgcatgaaaaatcgcaagcgaggcctaaattcgcatttttctcataattttgggccgttaaatttatttattccgatcttttttagcaatttcccaaaatttttcgtatactgaatttcgttttccagcaggcctttgaacagaaaaaaatattcaaaaagcggattccgaggacttatttttttcatcgcccctaaaactgtatccaatgcattttgcaaaattaaacttctttaaattttatgggcggattttaaaaaaaagattatgctgtttcggaaggcgtcgctggggaggattttcaaaaattaacgtgcccagacatttgcgcctgtgtctaaaatcgggttcaaactgatttttttcaatccctgatagtctaaatagcattttataactgtaaatttttgaaaaatcgtcaattattcaaacagcagaattaatgttcctaataaa

SEQ ID NO: 54726 - DNA, 282 bp, Heterodera glycines
  Genomic contig location: Contig_ID=SeqID_24021; Location=2326..2607; Strand=-
  SCN-specific regions: Sequence locations=1-282
gtgatgaagcattgcattcggtatggatgcggttggaacagctttggaagacaatgcccgatgaagaacaaatgcgaaaattgttggaacacaattttgtgtcaaattggcttctcgacacaggaaaaatcgacgaaatgaagcgggtcagtttggtgaaatttggtttcaaataaaattcccatgcctcaggaccgtgaagaacaacaaggagaaattggagaccagcgggagacggacgaagatagcaatggagaagaagaacaattcgattttgaataa

SEQ ID NO: 54727 - DNA, 366 bp, Heterodera glycines
  Genomic contig location: Contig_ID=SeqID_24022; Location=329..694; Strand=-
  SCN-specific regions: Sequence locations=1-13,35-81,103-210,303-366
atgagcgaaccgatgcttcttttcttcttaaaagtcgctgccaaatcaaatttggccagaatagaacttctcaatggtgttgtcctggagaaagttggagtaatgcgatgtaagtgttttttttgcgattggtgtatataaaaaatggggtccacttcatttccctcccccccccctgtatcagttcacccccagctcggttccccaaagaaatttttttttaaatttgctaatttagaaattttttaagaaaaaaatcttagaaagtttatataagaaaattttctttaaaaaaaatttttcgggaaattttcagcgattttttgaattttttttttaattttcaaacctaaaaatcttaataaa

SEQ ID NO: 54728 - DNA, 273 bp, Heterodera glycines
  Genomic contig location: Contig_ID=SeqID_24025; Location=460..732; Strand=-
  SCN-specific regions: Sequence locations=1-66,88-180,202-273
atgcagatagtttggattacggtatgaattttccgtaatttaatccatcactccaatttaagttgatttccattaatcattggaaaagttaattacggacggagtgagaaattgattttgcaggtcgaggccatgactattaaagcatgtaaatgaaggaaattaattgttaattcgtgacatttgtaacacagttttcagagagtctctgcctttttatgccaaacatttgacagtaaaatattccgataaaatttttctcagttcaataaa

SEQ ID NO: 54729 - DNA, 892 bp, Heterodera glycines
  Genomic contig location: Contig_ID=SeqID_24026; Location=692..1583; Strand=-
  SCN-specific regions: Sequence locations=1-101,164-190,232-289,398 -527,566-785,807-840
atgtccggcccaatttgggcttcgatcagtgacacggccaaagatttgttgcgccaacttttgtgtgtggacacaaacaaacgcacaacgccagaaaaggcaaattttataaaaaaaaatttaaatatttttattcaattttattttatttttaataatttttcctttttggtcacaattttttcaatggaaaattattaaattcattttttattatttattctttaatttggccactaattagtcgtaataaataataaacacatggtttttcaaattacaaaattccaattttattttttattttaaattatttttcaaattaaaaagtgcattttctcacaaatgttaatttatttttaattaaatactaattataataatataaatttaataacaatttgctgtctgtcacagtgtcttcggcacgattggttcaagaagagtgtggccccgcgagtgcacttgggcgacaccattgagaacattcgccgatttaatgcccgccgaagactaaaggcccgttcatttttaaatagataattttttctttttttaaattaatgaaaatgaatttttcatttttcagcttttttttttggacaaattttacccctcattttggaagtagtttgtggaatttcaacttttccataattttttttgacctatttttaagtaattttaatcccacataactaactaattaaattcgccatatgttacagggatattaattacacggttccatatgtttaattatcctgaaagttgtattccgaaaatctttttcaaaaggttttcccaagaataccttatttccttcatataaggcctaacaatttataaaatttcataatattttataccaattttttgtttataaaataaa

SEQ ID NO: 54730 - DNA, 983 bp, Heterodera glycines
  Genomic contig location: Contig_ID=SeqID_24028; Location=129..1111; Strand=-
  SCN-specific regions: Sequence locations=1-239,261-321,351-386,431 -443,475-596,618-852,875-983
  Gene Ontology: Mol. function=ubiquitin-specific protease activity; Cellular component=nucleus; Biological process=pathogenesis
gaattgttggatccgggcaaaggattttacgacaaagatgaggacaaagtcacattggccattgatgtcattgtggatgagccaaaaactgagaaaattatttccgatccaaacaaatccaacggcacactttcgatggaaattgaaaaactatcggaatttgcacgagaaatcgtttggagtgaacgtaaaagtgaaactgtgtacataaagggaatgccatggaaaatattggcagaaattgaaaagaaaaatgaaagcactgagaaatggttgggcttttatcttttgtgcgatgcttctaaaaaaggtttgcttatcaaattatataatagaaatataattattttgtctataaaattggtgtaattaattattgaaaaaacttatgtaagcagtaatttttaacataaaattaaaagtgattttttaaaggaaatgcgttaaaatataaatttgattattatttaatttgctttaagatggaaattggagccgcaaatgttcgggaacacttcgaattgtctcgcaaaagaacggtgtggaggattttaagaaagaactcgatgaaacagtttttaacaatgaatcgaagtcttgggggaacaatttcatttcatttgtggtgagtggaaattaattagttaatttacattttaatattgtaatggcaaattaaggaattaatggacccaagcaaagggttgtacaacaaagacgaggacaacgtcaccttggcaattgattttacatgtgaatagcgtaaacatttcgagatggattgaaaagtgaaaagaaggaaatcagcaggatgagaagagagtcttggagggcacaaaattttcttggtgcttaaattttatattttttttatgttttgtaaagtattttggtttcataaagcaacatattacaatgatagggatggatatgcagaaaaatgccaaaatagttgccaaaaaattggaaaaaatgtcaataaa

SEQ ID NO: 54731 - DNA, 1004 bp, Heterodera glycines
  Genomic contig location: Contig_ID=SeqID_4513; Location=68..1071; Strand=-
  SCN-specific regions: Sequence locations=1-298,325-717,741-746,771 -1004
atggcgaataaatttttactcgttcctcaagaaatttatcgtggtctcacctccgtgtctgacacgggtgatcttaatctggatgctgttagacacgatttgaatcgagccaggggtgagcgaacaaatccctcaacaaaaaatgtcaattacaaccaacaacttaggcgatatttgaaaatgaggagggatcttgcggacagaccagccaaagttgagctcaccaaaggaatcagtgtactgatgaggagaggtggtgaagatgaagatggtgaggttgtggacactacaccccgaccccctgctccaccaccaccacctccatcgccagggagacgcactccgcgtggaccccctcctccaccgactgggagacgctctccctctggaccaactcctcctcgtccctccccacccggaagtcctccgccccgtcctgaacgcccccaaagaccaagtagagcttctcggagaggtggtcgtctggagaaatggcggaaaagtcgatacaatatacagcaacggcagccggtggtgcgggaccttctagcggaagcagctgctgccccattgcccgaaagtgacgatgaagatgactatatgctggagagtggattcgcgttgccagcgccgtcacaatattatggcgatttgcctgtgctgcccgacaacgcgaacgaaattgaggagatggacactgctcagcacaggattgccaccagaagaaaattacaaaaggatgaggcaaatgataatgatgatgatgatttacgacgcaaaagatttttggtttatcaccgttcacctccacggctcacatccccgcctcgtttgaaaacaaaaattgaaccaagaccacctccaccgcgtcctaccgccaagagagaaaaacaacaggcaaagctggattggaagaaaaaccaacaccctactccagcgcctcgggcgaaaagagagccagaacttaagctggacccgcggccatccacgtctaggcaagccgg

SEQ ID NO: 54732 - DNA, 1434 bp, Heterodera glycines
  Genomic contig location: Contig_ID=SeqID_4513; Location=2171..3604; Strand=-
  SCN-specific regions: Sequence locations=1-58,80-345,367-438,460 -849,871-1137,1160-1434
atgtcaatgcttttcatgcagatgataaagccttcatccgctgatgattataagctttctgtgatgacaatgaatgaacaactgcttaaaaagcatatagtttttatcaccattgagttggaaaagggctcaatctctattcttgtggcagatttaaagtataaaatcgaacaaaaaattggtattccacccgaaagacaaaccttgagatgcaaaaaaccatatggcattccgtgttctggtgaaatttcgcataatgaacccgttttcttgtcgttggacgaatttgaaatttcagtgtggaatccacacaaaaagcacactgtttgggtgaacagcgcggacgctgtgagagttttgaagaagaagatccaagttgtgatcagcattgaccccgcaagacaaaccttgtaccaattcgatcttgctgagctggaaagtgccattggagagaaaattaatgaacgagtactggttgatgcaacggacgagaaacaagaaccgagaaaaattgaacgagcaatgagaaatgtaaatggtgctttgattgatgaagtggccagtcataaaacaatgagcgaatatggcattgaggaaaaggcaaatatttatgtatcagtggatggatttgaaatcttggtgcaatatgaagaggagaaaattggcaaaaacggtgttgtgaaattgaaatcgaacccctactacatttatcgggtgaactccaccgacactgtggcaagtttgaagcgcacgatcacgaatcaggttaacaattttcaccctagtcgtgctatttcggcatatgaactgacagtgagacttggcagccattatgacattgcgcttgaggacaacaaaacaatgaaagattgtggcattggaagacttggaaccgtttacgcttctacttttgaatttgaaatttgtgtttggtatggtggcaaaccgtacaccattgtggtgaacaagggaaacactgtgcagacactgaagcagaaaatcaaaggcataattggcattccgcccgagcgtcaaacactgagacgtaaccttccaactgccaaagtgcttgaggacaataaaaaaacaatggaattttatgtcattgaaaaaggtacaatcgttttcttggccttggatgaatttgtcattcatgtgaattatttgttggagcaaacacacaaaaaaggtctgaaacttaaagaattgaaaaaggagaacacgcgcaatgtttgggtgaacagcgaggacactgtggcaattttgaagcataaaattgatgccatgatgtcatggattgacgtatttcactacgaattcatcagtggccacgaatgccttactgcctccgggggtgatgagaatgtgaaaacagtgaaacaatgtggcatcgaagaaggacacacctttaaagtgaaggaaatgaagttatga

SEQ ID NO: 54733 - DNA, 607 bp, Heterodera glycines
  Genomic contig location: Contig_ID=SeqID_24033; Location=1170..1776; Strand=+
  SCN-specific regions: Sequence locations=1-202,238-585
atggcacaaaatgatgacggcacaaatggcacaattttgtcgaataaatcggccccaaattcgatggatttcgcgtcgttgacttccgaaaatgagtcgctgcttaatgtgttggtcggttgtgctatgatggcactttcctcactttgtttggctgccaattcgctggtcgttaaggttttctgtgcgctttcaaagtcaatttaaatttaaacattttattgtttccttttttagaccattgttatggacaaaaatttgcggcgccaaaacagttacaaatttatgttggcactttgtctcgtcgactgttctcaatcggtcgtacattttatcaccggatttttcacaattgatcagagcaatttcgaccagtttctttccgaagtgattatcgtttacattataattgttttttctacgattccttaaattgaggcgctcggagtcatcgcaacgccaagttacgtgttctacgcaattgtcacaattgtcttggccatccatcgtttgacggtgatcagctcgtccgtgtacttggaagagcttctgttttccacgattggcgttaaagtgaaatagcagaaaataattaattatatattta

SEQ ID NO: 54734 - DNA, 863 bp, Heterodera glycines
  Genomic contig location: Contig_ID=SeqID_24034; Location=23..885; Strand=-
  SCN-specific regions: Sequence locations=1-95,117-324,346-462,485-863
atgctcaaggacaccatccgtgagatgtctttggacgacttcaaccgtcgtcaaattcgccaattggccccgtcaatgctaaacgattgtcaatctctcatctctgtcactttctatggccccatttaccccgaatttccgcctgatgacagtgccaatgcgtcggatggccaagcaattaccaaatggctgttcttgcctcgtcctgacaatttgatgaaggagctgacaatatgcattgaggattcagcggtggagcagcaatggttggcagccgtggaacaaatcaaagcggtatttaattgatgtccaatttaatttgttattttaatgttttatctttttaggcattttccaatgcttcttctcctgtttacttcgacattactgtttactttccgccgccgtcttcgctttctgccgttgtgccatttaaactgaccaacgaaatgactggagagaaattggaaatgtacaaagaagatgtagaagaagatttaagttgtttttccctcattcgttgtccaattgcgcccgatgataagagagagcagatgattaaggaattggacaaacgatggaatcgaattaacatttttctcatcggcgatgggtgattgattaacaattttaaaaatccaaatgcttatttttgtttttcttttcagtcttctcgacggtttcccgggggcgagtggcgatcagaaagagcagaagaaatgaatcgatggttgattgattgatgtgattatgattacctatgcgatctaaatgttgggcttagccatttaaatgttgttgtatttgatttttttacaaatccataaaaacgaattaggctttgtcaatattttgtaaataaa

SEQ ID NO: 54735 - DNA, 912 bp, Heterodera glycines
  misc_feature (907)..(907): n is a, c, g, or t
  Genomic contig location: Contig_ID=SeqID_24038; Location=1..912; Strand=-
  SCN-specific regions: Sequence locations=1-92,119-271,297-742,765-912
atggcttcaataaacgatttagattatgttcgagattatgattatgtttatgatttagattttgatgaagttgaagaatgtgttgagattttagatcaagaaaatgaaagaaatattaggaattatgatgtgtttgaagagcataactatgctaagagacaaagatttgtggatggtggtcccagtcagggatcaatgaatttggatgctgaggttgcggggtcatcccgtatgactgacagtcaatttgaagataggagacttgagaatttgcgaaagaaaagagagagagataggattagatggcataataagtcacaagaatccagaaatgtgcgcttagaacagatgagaaatagaaattgtaatgcaatagcagatgaatctgtagcacaaagacggatgcgtttagaacaaatgagaaatagaaattgtgttgcaatagcagatgaatctgtagtacaaagacaaattcgtttagaacaaatgagaaatagaaattgtgttgcaatagcaagtgcatctgtttttgagcgacagttgcgcttagaacaagatagaattagacatagagtaattagacaaggtgtagttaatgtttacgcagcaggatctcatgagaatgctaatgaacatagacttagccaaatgaatatgcgatgtgaattttgtgatgcattgcattttgttgaagagaaagtgattggacgcggtaattcattcaaggattgctgccactatggtaaagtttttgtccctgaaattcccgaacaggattttcctgaggaattaagggatttgttcatgaaatttgatgcgagacatataaatgtttttgagaatattagacacttgaatagtagtgtgtcgaatggttctatgaatccgcttagatatagatatccanaataa

SEQ ID NO: 54736 - DNA, 934 bp, Heterodera glycines
  Genomic contig location: Contig_ID=SeqID_4515; Location=804..1737; Strand=-
  SCN-specific regions: Sequence locations=1-139,161-207,244-416,438 -556,647-695,721-887,910-934
atggtgacgggaatgccaaatgatggcggcgagttcagtcagtccaaatcgccctccacaccgctgctatcacatcgccaacagcaatatcgccaagaaggtcggttccatgatatactggtttttgtcatgatagcataatgttgacaagaaaaggaaacctctttctttttactgatattattcttgctgttagcttcagtcttcaaattttatttttttaaattttttaaaatatttaatgtactaattacattaaaagcttcaagaatggcctattcaatactaaatctttaaattttttcaccagaaagctctaaatggtaagtacgctcattaaaaaattgataaaaaatctttttaacgcttattttttcattaatatgcaaattaaggctttttaattgcgctttaaaaatatgcttatatttttgtttcccaaagccttttttgaccattttgaccagtgatatgcttcgaaaattttaaattctgtctctttttaaatttaaaagatcgaaatgattttgggattaaaaatggacaaaagatttagaaaattttaatttaaataatggataacatttttaatttttattattaaaaaatgaacataatttttcattcttcttatttttaaatttaagcttctcgggatcggctcaacaaatatgcgagtgccgagtcaagtccataccagcaacaacagcagcaaagggtcgacgattatatgacgggaatggcgacatcgacaacgacggcattcgcgatgaacaacaatggcacgaccacgggaggaggaggaaaagcatcgtcacgaagagcgagcagggacagcggagagttgatcgcaggaggcaatctgatcaaccacttcaaaaatttagtgcaggtgattgttaaatgaatatccatttcctattaaaaaaataaa

SEQ ID NO: 54737 - DNA, 2419 bp, Heterodera glycines
  Genomic contig location: Contig_ID=SeqID_4516; Location=567..2985; Strand=-
  SCN-specific regions: Sequence locations=1-444,467-471,534-769,791 -933,955-1095,1124-1173,1200-1744,1780-2013,2042-2193,2216-2419
  Gene Ontology: Biological process=signal transduction
atgggtcgtcatgatgatctgtggtctttgttctacatgttggtcgaatttctcaacggttcgttaccgtggcggaggataaaggacaaagacgaagttggccggatgaaggaagaagctgacattcgtgaattgctcagtggaaagtaaaaaattttctcaattttattatagaactttgaaatttaaaaaaaaacaatgttaaaaaaggttttcatccccggcccgagtcatggaatggaacaacgaatgtcttatatagcgatttttattttccgtgcccaaacaatggccatccttagtttcataggctacaacaaaaattattcttaaataagctgaataattaatttattttttacaaattagagttaaagcctaagaaactgagggtattttttgattgagcctataacctggaatagagcctatttttctgcatttggaaaaatttcttttacctttttcgacttttttattttaagaaaataaaaaaaaacattgttttttctaataaaataatatttaattatgtttacagcccaccagaattgcatcattttgctgatcatctaaagggcttgggctactcagacgagccggactatgaactgttggagaactgtttgcaagtcgccatgaaaaggcttggcatcggcattaatgatcctttcggttagcaattatataattaatcgtttaaaaatatcttttctaacggataaaattttgaaattcattagattaaaaatttgctttttgagttatcccccctcaaaaatgtcatatccctgacaaatcaaaacaccttctatggtaatttttaggcgcaaattaagaagatattgtccaaactgtaaaatactacatagtttatctattatttcaccctttgattttgtatatattcgaaaaaatcctgaaaaatatttatagaaaaatgctttcatttttcgggatcatgacgtttttttaaggaggggggcataaatgaaaaataccagaattaattaaaacattaaataatccctaactttttaattacccattatcaaaacagttatgttaaatatttcaattgaccattatcaaaacatttataattaattaattattttaatatgcctatttccaaaacgttcaaatttaattcttgtcaaatagccaacatatttgaacatttattttttatttaaagattgggagaacaactacgtgaatatccatgacaacaatcgccaaaccgttggcttacaacaggcgattggggatggtaaaatgaccagcaaaatgggcggacgctcacacaccacggcagtacgcgagcatgggccagccggggagaaggccaaccgaggcctggacacacaggtccaataaaaaaagaaggaaaagcattgacaaaatgccaaatgcgaaaattttcagaaaattattaccaaagcctagtgatgttaaagaccgaaagttttccgagaccaagacttgtccacgacatttaaatgaatatctttttttaacttgtaaaaaatgttccaaaaactgataccgcaatctcgagaccgacaaaaaagaaccccgagacctttctcgagtcgaaacttgggacgagactcacgagcatcactactagagcctgaaatattaaattaaaagttttttttgcggttggaattccgtttttttctaatccataggctttaaacaaaacacagtatgctcctttgtctaactgtcaaaattcaataataaaagataaaaacaaatgcaatttgcattttaggcaccggtaaccgatgaacagatgacgcgcgaggactgtgacgagcaaacgggcaatttttatgcccaaaatgtggcagctgcgccgcacaatgactcatcacatgggcgggacgaagcaaagccgaagtacaaacggcaagagtttatgaggtgagtagagaacaaaattgttcatatttaaatatcagacggatagataaacagttttaatgaggtatcattataagcaattaattttttgaatattattaaattacgaaattaatttaccaccatagagaagtgaagagaatcactacagccttggcattaaacattcgggaaattaaccgcggtagctaataggctaaaatattttgactgcaaaatttcaaacatttcagaaaaactgaaacaagttataaaagtcttaaaaattttcaatttctggtcttcaatgattacaaaatctagtactgtcaagcatcaccaattaccgcaacttcgacatcgtgtgattacaaaagtgatttgaattgttgtagggcaaagatcgatcacccgaacgtgcaaagcagtgccgcagcgatcagtgcggtcaatgaacggtccaaaaggtgcccagccagtccgccagaccagtggggaggtcgcg

SEQ ID NO: 54738 - DNA, 727 bp, Heterodera glycines
  Genomic contig location: Contig_ID=SeqID_24040; Location=15..741; Strand=-
  SCN-specific regions: Sequence locations=1-207,230-344,366-511,540-727
atggcgaaggagcaaaagagacaaacgttggccgaactgatcgcaatggaaagtgaagcgcaatcactcgcgaagggcacttccatggcgcaactgatcgaaatggaacgcattgatcggggagagtttgagcaatttgtgggggaaatgaacgaaaatgaatatttgattggtgaagtgttcgagcagcagcaacagaataaaatggcaaagcagcacagcatggttagcacggggagttgaggacgaacagctgagactgaccgtttgagtcttaggacatttacaatgaatgagtcgggcgggttggcattcgctgacggaacctaacagctaagggaatgaaaacttccaaaattttaaagctaaggatttgtggtaatttgccccagaaaagttacctttttttcttcgagttgtaatgcttttttcaagattttttgataaaatgtgttttaagtaaatggggcaattatgccgggatgtgttaattcatttttaaataagcagcataaattaattatttaatattaaattaagaatgagaagaagggaatgttcaaaaaaatggtaaaaatgttcagcaaaaacaaagataaaatgaaagtccaagaagaaaatcaactgggaagagaagtaccgaaatttgaacagtttaaaagagacagacccggcaaatggcacaattatggagaaattgcaatgcacattaaggagggtcagtcag

SEQ ID NO: 54739 - DNA, 363 bp, Heterodera glycines
  Genomic contig location: Contig_ID=SeqID_24041; Location=359..721; Strand=-
  SCN-specific regions: Sequence locations=1-143,165-309,348-363
atggctttggaaatttgtgcatttgacaaccaaccaaccttcacattgtttttggccgtagtaacctgctctattaaaattggaccagatttaccaattatctgcggatggataattgtgcagaaaaggacggacgacctgctgccgtcagcttttactgctgctcacaggttaattcgacttgttaatcccatttttctggatttgctgttcaattttggattttggtttaatttgcagatcacttttttgaacaaaaatataattacaaaaaattcgcaattaatgtgggacgtggaaataatagttctctcatagagcagaaattttattttataaaatcataacaaattcactaataaa

SEQ ID NO: 54740 - DNA, 1528 bp, Heterodera glycines
  Genomic contig location: Contig_ID=SeqID_24047; Location=5..1532; Strand=-
  SCN-specific regions: Sequence locations=1-346,368-513,535-972,994 -1073,1095-1279,1301-1327,1349-1439,1481-1528
atgattctgtacgtttttcacatttcttctcaacatttacccttttccttctcttttttgttttagtctgttcgttgtgccattgtttgtcgggtttgtcggatgttgtgccattctttggctttattgggaccgcttcaaaaaaccaaaaaagaaaatgtaaaaaaataaacaaatttcaaaacgtcgatttaatttttcagtttcatctccgccgactgttggctttgtgtgttcggtttgattacgccttcacaacttggccacggaattgcgatgatcagtcaccgttttgacatttacgtggacgaacacttcaagacgcgcagatggacattggcacttattcaaattcacagcaaaattggaaagaatggcaccaaggaaatggaaattgtcactgatggtggagaagcattgccaattccgcaaattgaaatgccacgcaaagtcatcggtttcgaacggatcaacatcttgtaaaattggcgaatatgctaaaaaattatacaaattttccctatttattttcagtttcattgaccgaaatgccatcacttttctccgccgtttttgccagcttttcaccaattgtccaattaatttgaccatcgacccgtactacaatgaccgcattttggagtcgattttgcgcaacatttggccaatgctcggaaaaaacatttatggcttggaattatctgcggatgtttttcgccgtttgcggcaattcgtcccgtcaattctcaacgattttccatcacttcgtgttttctccatttctgtcgccgatcacttcatcgaatttccggccggtgacaatgccatggcatcgaatggacaagccgtggccaaatggcttttcactccacttcaaagcaatgtgccaaaagtgttccaatgcgcattggaaatggatctcgggaatttggcgtcgaatattgaagacttcaaagcggtgattttcaataatttatttggctttttacattcttttgggtttcgtttaaaaattttatgcccaaattggtccatctcaaccgtaaaagttctctcatctttttgttttttttgtcctcctcccaactgtaaaattgtcattcatttcgttttttcccacattttaggcttttgccaatgcttcttcccccgtcaatttcattgtcatcattcggtttattccttcatccgttgctttcttcgttcttgtgccttttgatctgaccaacgaattgactcgggagcaattgacactgaaaagaattgacaatagcgacgacgactgtctgctgctgttggtccgttgtccaattgcgcgagatgcgagcaaatgggcaaaatgggaggaggaagcgattgattgggaaatttattatcaatggaacagaattgacattcacattttttatgaggaacaaatcggagacgggtcagtgaatgatttttcaaaaattcttatttataatagtttttctattttcaggcttctcgcgcaattcccggcccaagtgatcagcagcagaagtga

SEQ ID NO: 54741 - DNA, 758 bp, Heterodera glycines
  Genomic contig location: Contig_ID=SeqID_24048; Location=386..1143; Strand=-
  SCN-specific regions: Sequence locations=1-596,618-723,745-758
atgacttccaattctactgatggttggggatgtaacaacagtgggtggggtcaaagccaagcaaaaatgacttccaattctgctgctgatggttggggatgtaacaacagtgcgttgcgtccgaaccaagcaaaaatgacttccaattctgctgctgatggttggggatgtaacaacagtgcgttgcgtccgaaccaagcaaaaatgacttccaattctgctgctgatggttggggatgtaacaacagtgcgttgcgtccgaaccaagcaaaaatgacttccaattctactgacggttggggatgtaacaacaatggctgggctccgagccaagcaaaaatgaccaattctactgatggttcgggatgtaacaacagtgtgaggggtccgcgcgaattttctcggagtttcagtggacgcccaggatttaatcgccaacctgtggttttcttttgtgttgtaaatttcggcacttcatcttatttctttagcctctaatgaacaagttgcctccaattcctccgtccacaatacttttcgtcgacggcattgaaaataagaacaagaaattgccattgctttctgtcgaagaggtttgctgtttaataatcgatttatatagtagtacacatgaacaaaatgggtcggtacactcagtttcaaaaacattaccaaaattcgaaaaagcgaattttcagtatctgtttgctgattgtgatccgaatgatagcaataaggtttttaatccgagtgtttga

SEQ ID NO: 54742 - DNA, 402 bp, Heterodera glycines
  Genomic contig location: Contig_ID=SeqID_4517; Location=829..1230; Strand=+
  SCN-specific regions: Sequence locations=1-336,359-367,389-402
atggacatcatgcacaaagcaatgattttggcctgctttggtaagtgtaattttcgttcgacaaaaataccgtattcaatgggaaattgagaccaaaaaaaacttatagtattctcgttgctgttgccattcgtcagtactgcaacaaaagttaattcttggtacagtaaccagtggtggtcaccagcagaagaaagcggaagcattgaggatgaaaaagtgagaaaatggtgaatgggtgtacaggagagacgggtgccacgcttcgaatcccgaatgtttttttcgtccggaaaaagtgccgctttctttttggccaaccgaccttttcctcaacccttgccaaaaccctgtttttcacaatgccataaaaatttttacaaaaatttacaaaagtaagaa

SEQ ID NO: 54743 - DNA, 2247 bp, Heterodera glycines
  Genomic contig location: Contig_ID=SeqID_4518; Location=1000..3246; Strand=+
  SCN-specific regions: Sequence locations=1-241,265-740,762-873,897 -968,991-1472,1519-1618,1669-2146,2168-2247
atgagattcttcgaatgtcttatctcaattagcacttttcatttgtcaggcattttgacccaacctgtgttgaaattgcatctgatgaatgtgatggacgattactgcaccggctatcagacatactgtagcaaactgaagccgtacctgaagcagaacctggactttgtgcagcagagattggccaactcagcggccgatgacccctattggcaaggggttagtgaaaaaatcggaaagaatggcaaaatttttattttattcaccattcaggtaaagcgggcctatctgcaaatgaccggcgtttggcatggctttagcgatgcgcagtttaacgtgtccattgacttttcactgaacccaattttgatggtaattaattaagtaattaacacagagcagcattaattattaatgaaactaataagaatttaacgcgatcaatagcataaggttgatggataatttaaggagtcagtgttttaatcagtaggacaaatgtttgtttgtatgctttttcttatttttatgcgcatatgcaattaagaaaggagctcactaatagcatttctgggctaatatctgcaattaaccgaaccgagatgctcaattagtccaaaatgattcacattttgattatgtgttcagcttaatgcgcatggcgatttctacgagttggagaccaaattcaacagaagcaaagacccgcgagacgaagccactggcggaagatgctcgggactggtcaaagtgagtttgtttcaaaaaaaattatgcccaaaagagtttgacattttctaacaccattttacatgccgatccgcaaccacggcaattttaatttccgtatttttcaaaatagacgcagttcaaaattctaaggaagtcaaatgtcctacatgaattggttaaagttttaattacctttatagaaattttaaaaatttagtatgtttttttaaatttcatttcccattttggggtgggaaattccctccatgctccgccccgcccctttcttcattatggacctgattcagtaccaatttaatcgagaattgactaaaagaccgagagacaaaacatttctcgacacgacactatcaagcgttctctattgagacgaatacgttgaattattttacagtaggaaagaacagtttccccattttgaagattgcgcctaacaatgccgacattctgttctcccaagtcacaatgtgcggctttgaaagccttcttcgtgtgctaaaactgtacaaatttggttacggtaggctttttaaatagaatttagtccgatccgggtcaattagcgaatatctggcacaaaagcttgaatcaaaagcttttaacacacaaagaaccacctattattaagaccgcgcactgtaccctggccacacgactaccatatccagctacccaggcctattgtattcagccgacgattttgcactgatgagctccggattggtaaaccaaaaatttggaaatcttttaaaaaatttgctttttaggctatccttgagacgacaatgaaaattttcaacaacacacttttgaacgaaataaaaccagacggagtggtgggttaattaagcgctggggctaattcaaatgtaaaaaatttcaactgtccaaatttttaaaaaataaacctctaaaattgactttttgacaattacaataaactcaaaaaaaaattctgtccgcgtcgacactgtaagaatttttccggtggcgtttcagcactttccatgctttgccaataaaatttttcttagggagtctattggttcggcatttaagaaatttttaattttgattttttggaaaaataaacatgacgcccggtatcagaattcaggctaaacggcttttaaaaatccaataactgggcttagaatctcgctaaaaccggatttggcccggtaatccaagcccggaatgttttcacagctcgaggaaatggtagggtcggaacgcaatatctcaggaaaattgccaaaattggcgagggctgccatactttgattaattcaatctgctttatcagcttcattgttgggtacgagcaattgttgccaatcaaatggcacggacagcgcgcgagtggtgccacattttcaagcggttcaattcgggcacgtacaacaaccagtggctgatcgttgactacaacaagttcaaaccgtacaccgaattgcctgaccatggcctattttatgtgctcgagcaaatgcc

SEQ ID NO: 54744 - DNA, 2825 bp, Heterodera glycines
  misc_feature (47)..(47): n is a, c, g, or t
  misc_feature (71)..(71): n is a, c, g, or t
  misc_feature (129)..(129): n is a, c, g, or t
  Genomic contig location: Contig_ID=SeqID_4519; Location=1..2825; Strand=+
  SCN-specific regions: Sequence locations=1-7,47-299,334-644,676 -844,866-873,895-941,965-1180,1231-1327,1350-1548,1571-1599,1629 -1645,1691-1979,2001-2102,2238-2825
caaaaagtttaaaaaataaattttttaaattaaaatttcttaaatanccctcaggggcaacgaattttatnggttcagctggaaaagttgtccacgcgcaaaaaattttgccagggaccaacacaaagntggtggacgtggacagtctgaccaaactgatgcggtgagtatcatggaaaactgtgacaaaaaaaagctttttggcatttttttgaggggtttcgttttcatccgatggcattttgctttttatttggccgaaaaaaaagaaattacacaaaatattgcaaaacatccacaattttaaaaaataaaatttaaatttgaaatattctcctcctccgtcagttataacgattacacccgcgacccgtacagccgttgcaattgcacgcctccgtacactgcagaggcgggtcagtgcaaaaacaaatgggaaaatttgtttaattgaaaattgacaaaatttttttttgaatttagcaatttctgcccgaggcgatttgaacccggcaaatggcaccttcgaaatacccggcatgggacacgtcaaccacgcggcacttgattataaagtcggcatggattagcatataacgcttaatggttttaaatttttttcgaaattctgaggttttccattcttttatatatatatatatattttttttttttgcaaaatttgatattcgcttttttaaatgaattctaagaaccgggataagaatcgcaaactcgggatttgagtcggtaacccaatcccggattttttcgatcccgactttattctcataaaatttaattagtctttgatttaccaaaatagtccaatgttgagcatctgaaagtttttaaaatttttgcacctttttcataacattttccccacttttagtagccaatttctgttaaatctatgccattttagtcaacccaatgattattttgtaattttcattaaatttttccccgcagggcaccggctacaaaatgttcaaaaaattgcaattccgcgcatggagcggaccaacttatgacgatgtgcccgtgtttgattggcttgaatgcgatttggcaaatttaaaagaatgaaatgccaaatttcgacgatagcgaataatttatgtttgaacatagttcgactcacaatattaatactatttttatgcaaatttggctgattttaatttctaaaattttaataatttaccttttttaataaatttttttgtttttggcgtgcggtcgatgccccggtcgggttaagctggtaatgtttttcccccacaaaagtcaaatcgtacgccggcactcatccggtccaatccaaagtcattttgacaaaagatatgacgatttttttgtcgaacatagtacgaattgaggcagtacaagttggcctagtatgaattggcttttccgaaaatgatttaccattcaaaacagcaaaaaatcattagaaagttaaagtgccatttcttaaaattcgcgacctcaatacctaacgctcggaattgtttttctttgttttttaaaatttttatcgaaaaaaccaatgggatcactccaatgatggcgaaattaaagatggtgctggacattaataataataaaataattaaaaattaggcactcacaatgaaagtatttaaaatttcatatttttttcatttttaacatatattttattgactcaaaaacacacacaatgagcacaagcacaccgaacacatcactcacaacattcgacgacaaattacagcagaccaaagtgacgacaaaatggcatcgcaattaatgattgtaaaattggaattgggaatgaaagtctcgactggacttgagttcaggcctggggttttccaggtccaagtttaggccatttttcgacaacctgggtttttctgaaccttccagaaatccagctcctgatcaatctggaaatccttgtggttcagttccaacatggaacccaagtttttgttacttttttgaagaacattttgtcatttacacccgtaaattagagggtttttagtgcctattttggttttaggatctaaaccctacctgttttggcagtttttagcaccatcatccctactaatcaattaataaaataaatgctgtgtaaattaattaacatttgtaaatgcatataaataattaatcaatttaataacttaaatgcagtgcaattaattaatattataaatgcaattgaactaattaatgaacggatcacttttaagcattgtttggcaattcactcagttcaaaagtggaagagttgagcagaaagtgtgcgcaattggagaaaggacagaatattgtaaacggtcagggtcgttttcgtaccgccgttttcgtacgagttcatgtacaagcgtcagattcaattagaaaaacttaagaactaatagaaccaaaatctatcattttttgtttcccattcataaaattttgtagaaaattcataactttaaaaaaataacaaaatccgggactaaataggtcgcatctcatagtttaggaaaataccagcgagaaaattgttaaggttttcgggactgacattggcattggcataattgtgatcagtttttaaaatttttgcaccttttttcataacattttccccacttttagtgccaatttctgttaaatccatgccattttagtcaacccaatgattattttgtaattttcattaatttttccccgcagggcaccggctacaaaatgttcaaaaaattgcaattccgcgcatggagcggaccaacttatgacgatgtgcccgtgtttgattggcttgaattcgattt

SEQ ID NO: 54745 - DNA, 929 bp, Heterodera glycines
  Genomic contig location: Contig_ID=SeqID_24049; Location=143..1071; Strand=+
  SCN-specific regions: Sequence locations=1-309,331-752,774-894,916-929
atgttgattttgatccccttcaagtggattggttcacattttctcaagaattgcacgttcaatatggtggttataacatctggcgcggatttccttatcaaagaggggcaggtgttggttcagtgtttagaagtttcatgcgatttcttttacctattggataacaaattggttcatcaattgcacggcagggactagaaagcggaaatcgagtgttaacaaatgtattgggaggtaaagatctaaaggagtcactcgtaagtgagggtaaaacgaggcttaaaactctcctggaaaaggcagcaaataatattgaaaaacaaaaaggacaggggtttgattttaaacgttataaaaatgaaccaacacaaaaagttgggaaaaccaggcgaaaaaatataaataaactccaatctccagttgggccaccattggtatcattccatgaactcaaccattggaatgagacctgtagacgtaacctttgcaaatgctgaagaattgagaaaaaaactatacaatgaagcagctaaaaaccctagaggaaatcccaaatttcatgttggagatcgggtccgaattgaaaaacacaaacacgtgttccaaaaaggttatttgccccggttcaccaatgaaatatttactattacggaagtacattctgagagatcacctattgtttacaaaataagcgacgataataatgaaattattaagggatggttttatgcaaatgatttatgtagaatttttgaaaatgataataaattgtatgacattgaaagaattttgtcaaaaaagaaaagaaaaggtgttgaacatgcgttggtaaaatggaaggggtatagtccccaatttaatagctgggttccattaagttcaattactgtgaaaaatatataaaaactcttaaaaaactttttttttta

SEQ ID NO: 54746 - DNA, 1081 bp, Heterodera glycines
  Genomic contig location: Contig_ID=SeqID_24050; Location=472..1552; Strand=+
  SCN-specific regions: Sequence locations=1-268,290-988,1014-1081
gccataagtacgcctgctccgcctacgagctgtgcagcgacgacttcaacgtgttgaaatggactgctgccgcggttggctcacggacggactttctcggcacgaaggagcgcatcgaacagggcaatttcttcagggtcggactttgaattcttataattaaactaattaaaccaatgccattgtacaaaatcgcaaacagtttaatttacgaatttcgcataatttgtttaatattcttccaaaaatagactcatcgaattttgacaaaattttttgaaggttataaatgtgggatttgcatcagcgaaaaaaaattcgaaagtcggctccgaaattttttttttccaaatagcaaattttttgagttttctctgcaaaaaaaagcctgagaaacctgataagatttcttattttctcaaaaaaattttttcaggatgttctcgacaaggcattggccatcaacccggaggagtacactgtgagtcagaataatgggattggtccaacgactttctctctctctttttgttttttttgctcattgccccataaaattgccccgtcttttcgccatgcacgcagtcttcttttcctcttcagctgcttcacatgcgcggcaggctcgtcctctcggtggcttctctgtcgtggattgaacggaaggcggccaccgtccttttcggcccgccgcccgaagtttcactcaacgaggcgatcagagtgggtgcagcagcactgccaaattagtggtcggaaatgcttttgggcttctcaaactcttcctccaccgcatgccgtgccaaaaacgcgtttaatggtttcccacccccttgaaggacttcacggcggtgttggagttggcgccggattggctggagaacactctcttcctggccaaggcgtatttggccaacagcgacagggaaagtgcggtgcaccatttgaaacagctgatcgattcctaccagcagaacgaaaacgacaaggaccagcccgaggcactgaaggaggccaaggcgctgctcaagaagcacgggagaaaatgacctcaatgaaaatcacccatagatcttcttaa

SEQ ID NO: 54747 - DNA, 268 bp, Heterodera glycines
  Genomic contig location: Contig_ID=SeqID_24053; Location=1532..1799; Strand=+
  SCN-specific regions: Sequence locations=1-177,220-268
atgcatttcatacccgtggagattgatttaaaaaactggccacaactttgcttaaaaagcgataaatgttacatttggcatcgtttgataggtttgataacctcagaattaaaaagaaaatccacagatcccggcttttctgtccgacttaaactcccggccccgacaactcaattcataattaattgtaatttcgaatattcgcttaaatatttactattctgcagcttgattgtattgcagcgggggaatatattaaagaataata

SEQ ID NO: 54748 - DNA, 558 bp, Heterodera glycines
  Genomic contig location: Contig_ID=SeqID_24054; Location=261..818; Strand=+
  SCN-specific regions: Sequence locations=1-38,60-214,284-287,309 -318,340-349,438-527,553-558
atgaatctggcgcaaattctgtggaaaatattttttcgaatttttaattttataattttcttgtaattttacttacttgaaaaaacttctttcacatgttttaatgtgcgtaatgtgatcatggatgatgcttgttgtgcaatgttgtcaatttgtgcagcgttcagtctcgggggaagctgaatatttttatggaagctcaaaaatttagcagtaataatttcaaataaaaaaatcgattaatttcattaatttatttttgaataaaaattttgaattattaggattaagaaaatataatttggggccaacttttatttcaaaattcagccaaaatgccaggcaaatgtatttttagtatataaaatttatttttaaaaaattgaatttttcgattaattaatataggaaataatattttttatttaaaataaattggttttacatatttaacgctaaaattagcttcaggcctcattttctgctgctggttaatcggctcatcattatctttggagaaagcgttcttaaatattaattaacattataatttgttta

SEQ ID NO: 54749 - DNA, 311 bp, Heterodera glycines
  Genomic contig location: Contig_ID=SeqID_24054; Location=834..1144; Strand=-
  SCN-specific regions: Sequence locations=1-4,42-67,89-142,208-311
atggaaataatatttatttgtaataaaaatttgaaaattaagtcgactaactgtgctacaaatggtcaaggaactcaaactgttaaaacagcagatgcaacccatgatgaagctggaaaaattgtaaaacattagaacaaagaaattttgaattttatcataattaaataataaaaattaattttaatttaaaaaatgataaatttagtcgcgtgattcatcatcaagttccgatgaagatgactcaacaactgcagcctcaaaatgctactgaatgaagcaaatgtaaaaattttcaaaaaattaataaa

SEQ ID NO: 54750 - DNA, 1088 bp, Heterodera glycines
  Genomic contig location: Contig_ID=SeqID_24055; Location=715..1802; Strand=+
  SCN-specific regions: Sequence locations=1-166,188-312,349-385,407 -810,832-897,919-1088
  Gene Ontology: Mol. function=structural constituent of cytoskeleton; Cellular component=cytoskeleton; Biological process=muscle contraction
atggagattgtccgagttttggagagtgccaaggatcggctgatcatcgaacgggctcaactttgcgcgacggagatggagcgcgtgttggccatttgcaaacggcgcaaggcggaattgcagcacattttggagcagtgccgcatttgggagcagttgcgctcctcaattgaactttggcttgctgatggtcggtttggagtttgaccataattgcgtcaaggctttctttagcgagtgatcgcctttgttttgggttgctcgtcgtcgaattgtcagatggcgaattgacagaacaactcgaactgtgcgagcagctggtggacgagctgaacagctggaaaagcaaattgcaggagctgaacagaatatccaatcagtgagaaaatggacagacaaatggacaatttggcgaatcgtttagacaattggacacccaccgaagggacaatggtcacaatttgtcgcatcaaagcagcaaactgaacgcccaatggaccaaattcaacgaccaattgcgaattcgccgcgccgttttggaggcagccaaacgatcgcggcacgactttcagacggcacttggacatttccaacaatggctcaacaaaatgaacatggaaatgcgcaaactgaacgaagagacggacaacctgcaacgactgaaggacaccgcgcgacggagggaatggttggcccaggaaaaggtggcaatagtcaaatgacaataagaaggcaccaaagcgataatataagaaaattaaaataagcggatacggtaattaccgtaaacgccagaggatgaacagtaattataaaaaacatttttaggaggcccgcgtggaaatcgacgcgcaccgcgagattatggaatcggtgcggcgcatgggacggaaacttatggaggagcagcaacgcgaactgagctcatcggcaggagaagagacaccgccgccgagtgggaacagaacgacggagcaaatgaaaagtcaagtggaaatggtggagaacgaatggcagtcgctgttggaacaggcgaaaagtgtgcgggacagattggaaaatgcgcaggaagaatgcgaacggttaac

SEQ ID NO: 54751 - DNA, 528 bp, Heterodera glycines
  Genomic contig location: Contig_ID=SeqID_24056; Location=175..702; Strand=+
  SCN-specific regions: Sequence locations=1-1,24-528
atgaggaaatcagttggccaaagaaatcagccaaacgttggcagtaataagcgcttaaatcaattagcaaatgatagaaacaagcagcagcagatgaagccggtgaatattgagcaacaacaattagttaatgttatgcaaaacaacgtgcagcagcagcagaaaaagcgtttggatgggcatagaaattaccatcaaaatgtcaagcgctggcaagcaactgctggagaaaaccagcatgtgaatggcaaacgtgccaaaacggtaaacaacaatggcaacaaacgaatgccaaaattcaccgaagacaaaaagcgccgcttgaaaacagttcatcacgtcaaatttgatgatgaaaaactgcaacatgtcggcaacctcaaacacaatgaagatatggctactaagaaggctgaaaatgccaaaaagcacagacacacaatgccagcagcaaaaagtggcgacacttttacagcacacgaagagcaaccattgagtttgctggataataatccaccagtgaacgag

SEQ ID NO: 54752 - DNA, 906 bp, Heterodera glycines
  Genomic contig location: Contig_ID=SeqID_505; Location=410..1315; Strand=-
  SCN-specific regions: Sequence locations=1-324,346-401,423-906
gatgtcgttggcatcggttccggtgcgtttgccaacgttttccgcgcccgtgaattgataacggcggcgccggccgaacgctaccgccacgtggcactcaaacggattaatgtgagtttcaaaaatatgttttttgtaaatttgtaaacctcctagccatgaaaggatttccgttttttttttgttgcttaaaaaaccgtagtaaaaattttcaacccacagtatttgatttgttggtcctctcgtttttgccccgattggtcacgcctcgacataattttgtatttcgcgcttcatttttgtattctttggcgttatgtgttctctttattagcccacaatatttcaaaaatttcattaaatttcaaaaaaaaaagtcatgctcttctgatcgtttgaccgaaaattttttcaaaatttaacgattttttttgaaaattggaggctaatagagaacccataacgtttgctcaaatgaaaccaaattggatcggttcaaaaaagcatgaatgggggcttgtgctacaaaaaccgttactcttggggtcggggtcactttggcgcacgttataaattggggtgcgccaaaatggccgcgccaaagtgggcggttcccttactcttgggccttgtttttcgatggattttttttttttttaattccgttttttcagctgtcagccatcgaaaaggagaaccagctgatgtacgaatcggtgctgaacgaggtggacattttcaagtcgctttcccacaccaacattgtcaaatgcttctactcattcaccgaagtttcgccccattcggtgggcctctgggggctttcaaaaaaaaaattttttttttccagggtgtcaaatatttggtgctcgtgttggagtatgtcaatggtggtgacctggagac

SEQ ID NO: 54753 - DNA, 1051 bp, Heterodera glycines
  Genomic contig location: Contig_ID=SeqID_506; Location=3874..4924; Strand=+
  SCN-specific regions: Sequence locations=1-26,72-382,404-676,701 -1008,1030-1051
atgtcggttggtctctcattcccttcacagcgacaacaacaacaacaacaaacaatcagcaacgacgacaattgcgcaacgcttcaacacagcacatccatcgcccgtgcacacgttgactccgatcacttctgctgctgctgctgctctccaatcaacacaatgggcttcctcttctacatgttcgtggctgcggttgcgttcggcggtggagcggtgggtttgggggtggggggaattcgcgttgttgctgctttttctgaatccaatcaaatttgtatccattccaaaatgtattgtttgtccttaaaacaatggacaaaatttctcgggattgagctttcaagcagggtaaattcgagactcataaaagcacggaaaatgcatttggcttatttatgtgttttttgctggtgtgagacgaaaccaaattttagaatccaaaaattgattttgagccttttcagaagtgccattaacatatacaacgttcagtttgaccaatttcggacccgaaaacccaaaatttcattgttccatgactagtaaaatggtttagttggcccgcttttgcctccgttcgtgttcattttgtgtctaatttgttcccattttcttttcagtactgtggcatgatttacaccaccaaacgggccagggcatcggcgggcggcggctccaagaaggacaagaagcagaaagcgtcgaagagctccagcggtgaacaatgatcgactcgaggacggccccgcggatgaacgaacgatggaattcgagcaacaaacgcttctccccttctaactgctgctgatcccccaatatgacgctgtttcccccctccccccaaattatatcatttgtatgtgctttatcaccctctgatctgttgtccgtgataagctttatgcgctgtccatatcagtgatcaaatcgttgtaattgttgtaatgatatatgtatgtatgtcctatatattgtatttgtatgtgctccaatgcaacacccaatcattatgtgtacataatatatgttgtatgaatgtattcggaca

SEQ ID NO: 54754 - DNA, 1082 bp, Heterodera glycines
  Genomic contig location: Contig_ID=SeqID_506; Location=5276..6357; Strand=-
  SCN-specific regions: Sequence locations=1-73,95-230,252-515,537 -565,591-690,712-866,888-889,912-1082
atgggaatggtcaacagtttcaaagaggtgtgtggccatatttccgtaaaatattttgcttaattgccatttgctttttgtttcacattgtttaggcatttcttcgtgccaccactcctgtcggctacacatttcgacttgaactttatgattcaacggaaattgtcacgccatttgaagtgatgaacgaacggaccaacgaaatgctgacatttgagaaagaaggaaacgatgaaattgtggatgaagatagtcaatttactgatgctgtttggctgttgaagcgatgcccaattggggggacggcgacgattcagtgggaggacagaaagtcggacaaattgaacaaagtcgatattcgtctttatggaaattgcattgggtgcgtggcaaccgtgtcccggcatttgcgtttttgtccaaaaatcgggttttttcaatccctgcttgctgatcgcctaaaacaagcgatacaaagtgatcgtatctgatcatttgatcgtcaatgaatttatgatattaaaattttcaaagagcagagttaatgctctctaataagtgagaagactgtgttttaattttaatgatctttagatcagggattgaaaaaaaaaattaaatttgattccgatttttttgacaaaggcgcaaatgtcggggttccgtggcaacggcatttttgtttcgtttaaagtcattcaaatttcacttaatattcaggccattgtctccactaaaggcgggccaaatgaacgcaaaaaatcatccgaaaatgaatcccgagcccagcggacagcagaagaaaaagtgaaagaattattaggaaatgacaaatgattgatcataggaatggaaattgatctgataatttttccttatatttatttgttgcttctttcatttgaatacatttaggtaatttgtctggatttttggaacttttacgcagaaaatcttttttgtctttagaaattcattgtctaatgttctattttttgtgctttacttttgcctaatttttcaggacttttttgcatttcttacgtacgttttttgacgattttttatgactaaaaattaaa

SEQ ID NO: 54755 - DNA, 120 bp, Heterodera glycines
  Genomic contig location: Contig_ID=SeqID_4520; Location=1727..1846; Strand=+
  SCN-specific regions: Sequence locations=1-120
ttcgaatttaaaaattccttcgcttttcccaatgtccccacttttccttctgctcagtgcttttgctttgactgcgtttagcctttttcctccttcgttcgctgccaaagatgcgcaaca

SEQ ID NO: 54756 - DNA, 719 bp, Heterodera glycines
  Genomic contig location: Contig_ID=SeqID_24059; Location=308..1026; Strand=-
  SCN-specific regions: Sequence locations=1-117,143-212,243-309,337 -339,361-528,568-719
atggccaagaaaccccaagaacgccgttcccaaaaattttttgataaaattattctggttggatatttaattcccaatttttgggctgatgaggttcgatttcgaaagacgaattcaatttcatttcttggcattggaattcaaaaattaattagtcctccattgccaatgggcagggccggattagaacggatccaatcaatgcaaatatctttaaatatttaagaaattttttaaattaacttccaattttttaatttagaccaattagcgtgttataggatgagccagcccattttccgggagccgttttaaaaatttaattttttttttaaacattttccaattttttagccccctcagcaacatccggttcagtccggtgagtgagctgcctcgtctggagcgttggttccgctccgacccgaaccccacacgccagaaactgttgtcctacgcgaacattctgaacgcggctgcctaccgacgggcgaacaacaaagtcacttatcaggtgggtagggagtgaatttaaaattgaatttaaaattttaatttaaaaattttcagcaaatttgcaattggttcgccaaccaacgccgtacccaccagcgggcagtcgcctcgcgccagtcatcctccgccgctttgcaccaaattcaaaatgttgccaacggtgcacaacgcccgacccaagcattggcaatgctgccgcttaa

SEQ ID NO: 54757 - DNA, 446 bp, Heterodera glycines
  Genomic contig location: Contig_ID=SeqID_24060; Location=606..1051; Strand=+
  SCN-specific regions: Sequence locations=1-446
atgtccaatgaggcggaaaaggagtttacattggcgggaaacccgaaggcaccggctctccacgtggtacttgactggatccaccgatcatggcaggaaatttccaaagaagtgatcatcaaatcatttgagggttcagttgaaaaagaaaacggaaaaattcctgaatttttagtctgtgggttgacaacgccattggacggaacaggagatgaaaaaatagcttgcttcaagccgaaaggggcaattggatcgataggaaccaaacttttgcgcgagtttagagcaactgaaactatgaaagatgggcgaaatgatcacgaagaagccggcttatctgatgatgatgtgatgtgagttggatcaagtcggagatgaggatgaaattcttatttgttagcgttttttactgttatttttgaaaaaaaattgatacaattttccaa

SEQ ID NO: 54758 - DNA, 1616 bp, Heterodera glycines
  Genomic contig location: Contig_ID=SeqID_24061; Location=582..2197; Strand=-
  SCN-specific regions: Sequence locations=1-43,65-81,124-182,205 -291,321-495,518-598,626-967,999-1168,1201-1306,1328-1328,1356 -1377,1417-1561,1583-1616
atgcaattccgtcgcctgatcactgtgctgcagctgctgctggcgttgttcgtcgttgtgttggcattgtgtgccaatttttgttacggaatggaaggaaaaaataaagatttacaaaaaacagcgatttctaactctaagcagaaaaactcggtaacttccttgttttgctacccccctcgaaaaattttaaatttcaaaaaatcatagatattttgttaaacctatgaccagatgtcatcaaatgtcaaaacaagcactattttcgtgatcagtgaccttgaaaaccccaaaatatgaatttttaaaattttccgaggggagggaaggtagcaaaacacggaagcacctaatttccaacagcagcagagtgggaatggttttaacaatgccggaactcatcagacgccaaagtcaaccaaggatttatcgtcaaactatgtcaaccctgtttttgcaccgacagcaacttatccaaataataattctcgcttttctgaaactctcgaccatattttctcccagcagaagtagagtcggggagacatgaatttttaatttgaatcaaacggaacaccaaaatttatttaaaaaaacttttagtttttatgatgattttttatggaggaataatgtccaataagcaaatggagccctttgtaactttttaaatttgctctctttttttgacaatttttcattgtaaatctttaattttagttgttattttctttcttatggctatccgtctattttttaaattctctctgtatttttttatttttctattttatttgttgtttatgcatatttaacatatttatatacaaaagtgtgcataaaagaaagtattttgacgagaaagtacaaaaataaaaaaagtgactgaaaaaaactattttttctgtaaagcctattttaaatacaatgttcaatagccacttacaaaacaaaaaaaaaattgagaaaatatgaattttctaaaattttaaatttcaaaaatcattttgatcaatccttaaaataagtttttttctaaatctaattgggacaaattcacagatgccccccaattcgcgaattacattaaaatagaccaaaaagcgcaaaactttttcatctttttcggacaaaattcgattaagcattaagttaaccatgaagaaagatatttaaaaattttaaaatttaaaattttttccatttaatttccggtagaatatttgccaaccctaatattcaagcataattatttgtatatttggcgtaaaatcaatcttttacaaatattaatcgcaatgatggaaaataaataattttccctctccatttttttataattataaaaattttatgaacaaataaatgttgttcgccaaaatattatttttcaatattattataattttttatatagaaaatgatggaattttcggagttggagcaaatgaaaacgacgatttgtttatgaaatatggcaacaggcatcttcaacgaaatcgcagaatttgggaaaacgaaaagccacccaaaacgatggaaaggaggcaaaagcaagaaaagtgaaagaggaacagcagcaacccgataatgaagttcaattagggaaaattaaa

SEQ ID NO: 54759 - DNA, 700 bp, Heterodera glycines
  Genomic contig location: Contig_ID=SeqID_24062; Location=210..909; Strand=-
  SCN-specific regions: Sequence locations=1-167,384-398,420-421,444 -640,679-700
atgttttttaattttctcagttggttattttattatatttgtcaatgttttttttgacacaactaaaaatttatttacattttaatctcaaaaattttattatgctttttgatagttcagttcaaacacagtaatttcaaccaattataaaaactttcctgaattcgtttattaatttttaaataattattagcattattcttttttataacaaatgatttttacataaacttttggcataattattattctttgtaattattttctttctttatataattataatcatataaaatattattgaataattttctcaatatgctttttttatattttctttattcagtaaaattattattttatagtttatctttttatattatgtcttttgtgaatatatctttttaaagtatgaaaaagtaaagaattattgttttttattagaaattaccaaaaaaaaattttagctgagtttttttattttctagattgattatattttgtttctataaaaaaatatgataaatttaatactttaatcaatttagatatcattagtgccatgccatacgatagctctatataatttgatatttttttctaaaaaaagtccaaataatgattaaatttttgtcgaaacattattaattagaagaataattttttttttattattttgctattttatatgaacaataaa

SEQ ID NO: 54760 - DNA, 114 bp, Heterodera glycines
  Genomic contig location: Contig_ID=SeqID_24063; Location=601..714; Strand=+
  SCN-specific regions: Sequence locations=1-114
ttgtttcgacaatattattactcataccttttcacaagcttatcaatagcgtacctccttcaaattccgaatcctcttccccgtttaaattgcttgggataaaaaaatccgatt

SEQ ID NO: 54761 - DNA, 1000 bp, Heterodera glycines
  Genomic contig location: Contig_ID=SeqID_24064; Location=111..1110; Strand=-
  SCN-specific regions: Sequence locations=1-151,173-439,500-809,831 -1000
ctaattgatatcattgaattgactgaaatgcgacgaactcacgcagttttgcatttggtaatgaagaaaaaacttttattcagtggaaatgatcagttaagaatttggagttattccaatgcttatccgatcaatcgcggcaagatctttgaaaaagaaataaaaatggatattctggctctaaaacaatgcttactgatttgtcctaatgaatggcccattcatttagacggaaaagaccaaatttttttctatgcaaaaaggaatggaaacataaaggtataaattagtagaattaattggtcatttatgtgtcaacacttaattcagataattcttaaacaaaatgtaataaaatcaaaaaatcacccctaaaaattgatccgaaaaattacctcccccccaagaattggaaaactttctcaaaaattcctctcccaaatttatttattttttcttgacaaaatttttaatttaatttttttaaatttttttttttggtaagatgtcaatgtttctaagaaaaactcataatatttaaattattcgtttacacagcaataatccaaaatttaacctttttgtttgctttttaactgccagaaaattgtttgtaaaaatttttttacctatttttatggctattttgttaccgattttaaggattttcggatacagaaatacaataaaatcaaaatacaccttaagaatcgagtcgaaaatttcaaaaaatacactcctaacaattggaaaattttatcaaaaattcagaatttaatattttctttcttgaaaaaacttttattatgcttattattttattggaataattttataatccttaaagtttattttggtccggtaattgttctcactttccattttcagttgttgggcaccgctaccgtacagttattgcgcgaaacttatgaatataatactgtcattgacttctcagacttagcccaaggagcacggttttataagcgtcatgagaacg

SEQ ID NO: 54762 - DNA, 1931 bp, Heterodera glycines
  Genomic contig location: Contig_ID=SeqID_24065; Location=1..1931; Strand=+
  SCN-specific regions: Sequence locations=1-17,39-241,264-377,399 -517,550-576,619-636,659-947,970-1101,1139-1173,1196-1199,1236 -1425,1447-1449,1472-1557,1579-1625,1648-1676,1701-1931
  Gene Ontology: Biological process=embryogenesis and morphogenesis
caaattttacattaaggattaaattattaaaatattttcattagtgtgaaggcggagtcacgatggcatgtgtgctgggccaatgcgagtgcaaattgggcttccaaccggttcgctctttaagccaaaagtcatggcactatttaaaattaattgttgttcatcattttggaacaatgatcatcggtacccgagctgtgagcgaagatgcactttggaggaggtaaggacaatttgattgttaattatataatattattattggtttttttttttgcagttttgttacttactcaaaaaaaacaagggcttatttgacgaaatttttctcgaagatataataaaaacacaaaatttctccatttaaattgaacttttcacaatggtaaactttaaatattagcatttttcggattttgtgttcctattttttatgcctatttaggcgcctaattcgagatttttctagcctaaaaattgagtctctaatttctataaacaaatttattgttgattgataaaattattttattaacattatttttttttggtaatatcagggattttattggggtgataatttttaaaatttattattttttgaatttttttttaaatgatcaggtgcccgtgattgatcgatgtttgaaaaaagttgaacttggagagcgttgtatgagcagcaaacaatgtggcgatgcggcagccgagtgccgttttggcatctgtcagtgcctttgcaccttcaaacagacggtcagtgccaaacttagaatccggtaaaagattatgtggaaacatgaaaatgggtgggatcacatgtggaaaatcccatcttttttacgattccgtaaaaacccggtcggtgttaatccgaattccattgtgaaatggaaaaagcctaaaatacatttttcaaccaaataaaagattctagagattttagagaattttttctcttttgtttatgattgattacccactaccaatttgagcgcttcggtgagatttgctttctgatttatgacaattgaatattttttcgaatattaccaagttttccattagaaaatgaattttcgttcgaaatttccaataaagaatttttagaatttatttaattagaatttatttaataggtttgctagagaaaatagtcaaactgaaagttttttctgctcagaaagttctttttgaagataaaaaaaaatttaattcataaattttttttttatcatactttaagaaaggcgggggcaggggataaacgagctgatccaagctaagagtgataagaaacagagaataaaccaaaggcatgaaacatttttttttcagggaccataattatttattaaattagcttaaaacaaaatttactttcttccgaatttattttttcccgcgtttaggagagaaaattgtaagaacgggaaatggaaaaaagcatatgggaaataaaaatcattaaagggaagagatgcaccgtgacccacggtcacgattcacggtaccaattcaaggttattccgtgaaaaatttacactggataaaattgaatatttatgaaataaattttgttttcatagagaaatttggtcattttttgggcaaagtttgctaagaaacaaagcaaaattatcttttgaacaaaacccacctaccaatattgtgcgaaaaacaaataaaaagcaaagtttcaaggatgaccccagttaaataaaaaactcattaaaattttttttaattcgctcaaataaagttaatttgcgcaaaatcagtttaaacaaatcccatttgcaaatttgcccttgaaatattttcagaatattttgggcggacccccgcgctgcaccaatccggacgacccactcggcttcagcaatattctgacacgcgttgagcaaatcttccaaaatcggcaaaggagt

SEQ ID NO: 54763 - DNA, 600 bp, Heterodera glycines
  Genomic contig location: Contig_ID=SeqID_24065; Location=1392..1991; Strand=-
  SCN-specific regions: Sequence locations=1-344,367-413,435-520,543 -545,567-600
atgtcggctcgcaaatgtcctctgccgctgattgccttctcatccctcactaaagccggcactcctttgccgattttggaagatttgctcaacgcgtgtcagaatattgctgaagccgagtgggtcgtccggattggtgcagcgcgggggtccgcccaaaatattctgaaaatatttcaagggcaaatttgcaaatgggatttgtttaaactgattttgcgcaaattaactttatttgagcgaattaaaaaaaattttaatgagttttttatttaactggggtcatccttgaaactttgctttttatttgtttttcgcacaatattggtaggtgggttttgttcaaaagataattttgctttgtttcttagcaaactttgcccaaaaaatgaccaaatttctctatgaaaacaaaatttatttcataaatattcaattttatccagtgtaaatttttcacggaataaccttgaattggtaccgtgaatcgtgaccgtgggtcacggtgcatctcttccctttaatgatttttatttcccatatgcttttttccatttcccgttcttacaattttctctcctaaacgcgggaaaaaataaa

SEQ ID NO: 54764 - DNA, 545 bp, Heterodera glycines
  Genomic contig location: Contig_ID=SeqID_24066; Location=417..961; Strand=+
  SCN-specific regions: Sequence locations=1-545
atgcttaaaggatgtctgtacgttatcttagtgctgattgctgttagtttgattcggttgggcaaatgttagaggcgatttaagccttttggcccttaatttctcctgaaaacttagaaaattcaacataactctgcctaaaagacatatttctgttcgcaaaataaacagaaatgtgaaaaaagatttattctttcttatttagtttgttttatctgtttatttttggtagttgttgagattttgttcgtttttatcaagtgtctctattttaaattaacaccccatttttgaaaaaaaatcgtaaaacttttttccgtcatcatttcggtttctcactttcagaatcttaatattttcagaattgctacgtacagtcaaaaattcagctcgatcggttcatgggaagtggtcaaactcccaaaaaacagggtgtctttattttaaattaacacagtgtagaagctttttctaagcaaatgctaaacaattggatgcattggaaaaaatgagcttctaaattttgttttagattttagactaaa

SEQ ID NO: 54765 - DNA, 61 bp, Heterodera glycines
  Genomic contig location: Contig_ID=SeqID_24066; Location=184..244; Strand=+
  SCN-specific regions: Sequence locations=1-61
agacatccattttcaacaagacgcgccttcgcggagacaagacgtagagcaatcattcaaa

SEQ ID NO: 54766 - DNA, 913 bp, Heterodera glycines
  Genomic contig location: Contig_ID=SeqID_24068; Location=2..914; Strand=-
  SCN-specific regions: Sequence locations=1-127,150-264,286-546,576-913
atgaatccaattgacgccataatattgaatgcccactatgggctaaaacacccgcaaacaaagttgaacatcacccttaacgaggcaattgcacttggactttatgacccagtcacccgacaatttctcaataacaatgagcagatggattattgggattccttagcattccattcgccaaacactgtccacctctacgtcaaatttggggctataaaagtgacaccgatggacttggatcatgcactgaagtgtaagtgggcgaaaaagtttctaaatacctaaataggattttcggcccaaaatgcgaatttaactaattttaaaaatggtttcgttttggccaaattttagatttagtgcgaccttaacaattcttggtacttgttaattatcttttcaaaaaaatttttgagaataaacttcttttttggtttttagcgtcggaaaacccgattctgacatctattttggttccgcgtttgaatttgggccaaaatagataccagaatcggatttccgaacctaaaatccctaaaagttttctttaaaaaataaaaaaaaattttttttttgaaaatctgtaaaaaagtacccaataattttcaatgtttcctgggtttcattaaacattccaattttctttatcacctatacaattttgtttaacaatatttcccattaagattttttggaccggtacgtcggagtgttccgccttttggaataccaaatttctctgccggaggccctcaaatacggctacattgaaattcgcaagccacaaccgacatttgcattgacgttgaccgattgcatcgaacagaattggataaacagagaaactggactgttcattgcccgtcccgaagaaccgcatggatttggcgaagccaatgcgtttcaatggtga

SEQ ID NO: 54767 - DNA, 996 bp, Heterodera glycines
  Genomic contig location: Contig_ID=SeqID_24069; Location=1166..2161; Strand=-
  SCN-specific regions: Sequence locations=1-76,104-169,191-305,327 -570,592-668,691-915,938-996
  Gene Ontology: Mol. function=ATP binding; Biological process=protein amino acid phosphorylation
ggctatgatgcatcagcagatatttggagtgtcgcctgtatggtcagttgtttttgtgataatttattaccattagtaaatttcttcactaaaaaaggctttcgaattggcgaccggcgattatttattcgaaccgcacagcggtgagaatgacaagattcgtttgaattactgttggttttctttttaaggcggaacttacagcagggacgaagaccatttggcacatataatcggtgcttttttgttcatttttaggcaatcgtaacgaattgagggcattaattttcggtttctgctttaattaattaaaaaaggaatggtttccgcatttgacttttgctacaaataattaagcccaatcattggtttatttttggattaacagaactgttgggcagcatccctccgactgttttcaaaaagggtgaacattggcgagaattctttcataaggtaaagagactttcggaattcgaatttaaaaaagatggaatttgcagactggtcgattgctccatattccgaatctgaagccctggtctctgcttgaggtgaatttttctaaaatccatttttaaaatgaagaaaacttcaggtccttactcagaaataccagtggcctttcgaccaagccagatcatttgctgcatttttggttcctatgcttaactatgagtgagtcttttgttttcaacatttacattattagctgcagtctaaccaattccaaggcgttggtcacaaaaccttaaggcctcttatttaggggccggaggaaagaaatatgactttttgatgaaattagtaaaaaaaaatttcaaaaaaaattcccggattgctgtgtttgggggcgggagtgtctccccctcattccctttggcaagctcgctttcatttgtaatttactatttaatttgttttttcagaccgtctgaacgcgccactgcagggcaatgtttggagcataattggctcaagaacatagatgaataa

SEQ ID NO: 54768 - DNA, 104 bp, Heterodera glycines
  Genomic contig location: Contig_ID=SeqID_24070; Location=650..753; Strand=-
  SCN-specific regions: Sequence locations=1-104
acagcacgccttcttctccttgttggcactggtggaggaggacagtgtgatgttgtgctggctgttgattggcaccatccggtccggtggcacttgtctgtgcc

SEQ ID NO: 54769 - DNA, 535 bp, Heterodera glycines
  Genomic contig location: Contig_ID=SeqID_24075; Location=424..958; Strand=-
  SCN-specific regions: Sequence locations=1-25,48-69,99-313,356-535
atgattgcttccgcgttctttcgagtgaaaagaaaggccaataaattactgtaggttgcaaaaatactagaattttcatgtttttaaatccttctgtaaaggactacgggtacagtacagccattagttcggctattctttttctattagccaaattgttcctcaaatcggtaatgtgacccttggttttaccgtaatcaatcaaacaattatacagtaacatatcccttttaccataatgagacataaggcagtttactgtaaagcactttgtactgtgcgactaatatgtcctaatgcatgtgataaacacaatttttttttattattaccatttatttttatttaatatttacagtaacggctctaagaaactctaccgtaatcccaggagagaataaaaattaattgtaaggcaatcattattttcgcaccagcaaaacgccttcagcagtgtgatcactttgttggacacgtacacggaccggcattgcactgcgctcccatccatggtagtccaccaacaaataataaa

SEQ ID NO: 54770 - DNA, 1679 bp, Heterodera glycines
  Genomic contig location: Contig_ID=SeqID_24075; Location=1084..2762; Strand=+
  SCN-specific regions: Sequence locations=1-350,372-975,1001-1112,1135- 1143,1393-1464,1503-1679
atgttgtccgccggtggccgtgccgcaatgcttggcctggagaagagtccaccgccagtgcttgtcacccttcaagtgcagcccgggcgcgaattttccatcggcgccgtcacgcttgtcaaggaggagcaatggcacaatgacctgcttggccaggtcatccccctcccacttttttgtggatgaaaagccaaaaattgcaatgtaaaaaatcgatttacctccaaaaatgaggtctctattttaaagattagccctaattagtatataggggcgaagccttattttttttatctctctctcctaataatgacgacaataattcaagggaggggattgtaattttaggaaatatggtaaatttttggcatgcaaaaattctaaaattttcgttaaaagatttcggggaggggactgtatttaaggaaacacggtaaattttcggcaagcaaatatgccaagattcctcgtcattgcctagttttgctagcttgaatttggtgtccatactcacatattttttttcaaattaaaaaaaaacgccaaaggaatgatttgcgaatttcaaaaatttttgattttggtcaaaatttttattgaaatatcatttggccaataatttgtttggcccaccgttttcagaaaccgttttgtgtgcgcaagaatggcgtctgcgttgcgcaacgctttccgcaaccgtctaattcaatccggactgaagcggaaaagtcgggcaaaaacatcaattccagcattgcgggcgacaagttgccattcccagtggccggcgaaccgtcccaaatgcgtgtgatggcattggccggttccggggctcaggtgggaaaaacgaaaaaattgaataaatttctaccgtaattaaaatgactaggtacggtaacaagaatattttggatgggtgtttttttttgatcttgcccaaaatttatttgctcaatttttcatatttttttgaggaaaaaaaataaaatttattttttttcagtccataaaaatttttttttagttttttatggtgaaattatgattaatccttaattaaatgaactgcttcggtgttaacagatagccccttaaattttcgaaaaataataactttaattttaaaagagaatgaaaatcgtgaattttagtaaaattaattcttttaaaagaatattcattttcttttaaataattaaaaaaaaaataataataatttattgtgatttaatattaggaagaatttatttcaaaataataaattaattaattttcagaaataataaaatattaattttatttatgatttatttttagaaaatattttatctaaaaaattaattgattttcgtcgaatttaatttagaaaaagaatttaaaaataaattaattgttcatcatcaaaattattataattatgaaaaatgatttgatttacatgctcaatatttaaaaaaaaaaccaaaaagatttttatttacattttcatttttaattatgttcagagcacattggacattgagggtgttgttgcgacgccgaacgactatgtgttcgtggtccactacttcagcccggacaacccgccaattgttgtcgatgtactcatccaaaatgaacattttggcgacgcgttgttccactactgtccgtccatgagcggatgccggacaattgtg

SEQ ID NO: 54771 - DNA, 678 bp, Heterodera glycines
  Genomic contig location: Contig_ID=SeqID_24076; Location=257..934; Strand=+
  SCN-specific regions: Sequence locations=1-128,152-156,198-498,532 -650,672-678
atgacgctgacccacaaaatgtccagcccacgaaatgtccaagtttcgaatttgagtttttttattattcagatgggcctaaggttaggcaaggggtaatataaagggtatattcgtattcagcgaccccgaaaaccctaaaaatcctaaattagactcattttgttattataaattttgaaaaattttggacatttcgtgggtttttactcttttggacatttcgtggcttggacactttgtgggggcgccaaacatgatattcaatatcagaaaactgatgtcattatgccaaaaaccccgctaattcaaaatttttggtaatttgatctcttgttttccattcgttttttatctctttgaattaaataacaataaagtaataacattcaagcatttataaagcattacgaatggattccgaggaaaattcgccaattcacttatcttaaacacctgccggactccattatcaagtcaggaaaacaaaacttacgcaaaaaagtgaatttgcaaatctatttttaaaagaaaaattatggaatgtcaaatgtgcagcaaaagacaatgtgataaagacgagcatatgcaatttataacatcagcagggggcgcataccgaacataagattaaattaattaatgaatttaaacaaacaacacacaaaaaatccataa

SEQ ID NO: 54772 - DNA, 248 bp, Heterodera glycines
  Genomic contig location: Contig_ID=SeqID_24076; Location=262..509; Strand=-
  SCN-specific regions: Sequence locations=1-56,98-102,126-248
tggcgcccccacaaagtgtccaagccacgaaatgtccaaaagagtaaaaacccacgaaatgtccaaaatttttcaaaatttataataacaaaatgagtctaatttaggatttttagggttttcggggtcgctgaatacgaatataccctttatattaccccttgcctaaccttaggcccatctgaataataaaaaaactcaaattcgaaacttggacatttcgtgggctggacattttgtgggtcagc

SEQ ID NO: 54773 - DNA, 194 bp, Heterodera glycines
  Genomic contig location: Contig_ID=SeqID_24080; Location=92..285; Strand=-
  SCN-specific regions: Sequence locations=1-194
aaaagtttggcattccgcttgaaagacaaaaattggctcatttgtataaaccagacgatgtttccgatagaacagaatttagttttggtgactgtcaaacaatgtacttctataacattgtaaaaggcgataccatttttgtgtcggaagtgtttgaaatttccgtaaattaccaattctccattcctaataat

SEQ ID NO: 54774 - DNA, 2559 bp, Heterodera glycines
  misc_feature (2542)..(2542): n is a, c, g, or t
  misc_feature (2554)..(2554): n is a, c, g, or t
  misc_feature (2558)..(2558): n is a, c, g, or t
  Genomic contig location: Contig_ID=SeqID_4526; Location=652..3210; Strand=-
  SCN-specific regions: Sequence locations=1-400,422-739,761-884,915 -2559
atgagtcatcaatgtggagaaaagttttgtcgcctatgtaaacaatttcacgtaaaagaggaagacgacgagaatccctgcagtagctgttttatccaacctcttaaacaacaaaaaatcaaaccgtaccggatcatagcttacgatttcgaggcaacacaggacaaaaaagttggaaatagtttcgaacacgaagtcaactttgcagcggctaccgtcatctgcaccaattgtattaataatggagaatggaaaaactcactagagggaaaacaatgtgctatatgtggccccaaccgtacaattacattctcaccatttgattacaaagagacaacagtagatcaaaaaattgtcacccagcaaactctacgggaatttgtccaatggctactatttgaacaaaataaaaaatacccaactgtagcctttgcacactttgggggtcgctacgacatgacaatgatcatcaaggaagttattgcacaaggtacaatttttaatattcatagattatatattttttaaggtgttcacgatccacaaattatcaaacaaggaaatcgtctttatgaactcaaaattaaggataatgagcatgccccactaacaattttccatgacagctacaatttgatgcctatcaaattatcgggtctcatcaaatcatttggactcaaaattcaagtgattaattttcataaaaattatcaattttttttgttttaggataaacaacactttccacacatgtttaacaaatcatctaattatgaaaatgttcttactaatttaccgccgcgcgaagaatactgtcccaatcaaaagaaaaaaactgatctgcaaaagttcaacgaatggtacaacaccaattatgaccaacactttgatttaaaagaaaaattgcccgaatactgctgcaacgacgtcaaaattctcacccacgccctcgtcgagttgcgccgggaattcaaacaattaacacaaagagaaggaaatcatagaggaattgacattctttggcaagcaatgaccatagccagcgcctgcgtcaaaaactttgcccttaatcatttgagatccaactctctagctatagtcccggagaaaggctacaccccacaacaaaaccaaagtgcactggccaacaaatttcttgactggtactctcacataaacaacgttcatgtacaaacggccagttcccgctacggagaatatatgtttaaacgtgaagggcagatataccaagtggacggctacattaaaggcacaaatgggcagcgggacaaaataattgaagtgaatggttgtttatggcatgggtgtgaggagtgttttgatgatatggatgaagagacgaggatgccaaacgggaagacactgggggagattaggctaagggaacagaggaaacatgaaatacttaggcggtacgtcgacttggaggtggtatgggagcacgagatcaataaacaaatgaagagagacaaagagatgagggagtatttcgaaaactggaaggattgttcacctatcaaaataagagaagcatttcacggaggacggacaggaccaatgaaactaatccacacagcaaaaccggggcagaaaatcagctacaaggacttcaccagcctctacccgtttaccaacttctctacaaaatatcccctagggcatccaaaaattatttctttcacgaccaatgagcaaacggtcaattggcgttctccaactgacaacccctacaaaggattacttaaaattcttctccaaccaccagacaacaacgtcaaagttactgtaatgccaataaagtttgatgagcgcctgctattccctctctgtgaaaaatgcgccaaagttattagcaacaaatacccaaaaggtctcaaagacgacaactactcctgcccccacgtcaacaccaacgaccgcgccttcgtatcaacttgtactcatcttgaattaaatgcatcattggaggctggctataccgtcagaaaactttttcatgtcctacaatacgaccaatggagtgacaatgtcttcaagtcctacgtgagcgaaatgatggccttgaagatacacgctactggctatccatcatggtgtaataatgaagaggagaagagaaaattcattgatgagtgctggagaaaatttagaattaaaatagaggataacaaaatgaaggctgaccccggaaaacgatacattgccaagctttgcctcaactcactctggggccgcttctccatgcgaaatctcctctcaaaagcaataattgacaacgacgaatgcctgatccgccaatactctgacgataaaaagattgaactaattgatgtcgagctaatggacgaagacaacgacgtgtatatgctcacctataaacctaaggaagaatttgtcgacgaaaacaagtactcaaatgtcgtcatttccctcttcactacttcaatggcgcgactatacctctacgaagctctgaaaaaggtcgctgacgctcctggctgtgaaattctttactacgatnccgccagtgttntttnt

SEQ ID NO: 54775 - DNA, 562 bp, Heterodera glycines
  Genomic contig location: Contig_ID=SeqID_4527; Location=284..845; Strand=-
  SCN-specific regions: Sequence locations=1-562
atgccgaccaaatttgcgagtgagtgggagtagttacccccccagattttgggggtgacaattcagtcccgtcgtttcagtcccaggcaattcagtcccgtagttttagtcccaggcaagtcagtaccagaccaattaagtccgacccatgcctattagagttttttttctgttttgcatgactgagctagtagtacatcaaaatgttacgcttgactgatttcataacaattagctcctgcctattattaaatttacacatgtgtatttgtagtaattatctctcgtacattatgcatgaccaattttatgaaaattattcaaaatgttatgcttcggtgatttcatagtaattatttatgttacaattgctctcaaattccattttttacagtgacctattttgctctggttaccgtcatcaaaataattattgctgccctctattgagagtataaatagacgagcattcccaaccaaaagtccatttctcccattcattcaaaaaaaaaaattttcaatcccactccactttacattattctctgaaaacaaaaataaa

SEQ ID NO: 54776 - DNA, 1519 bp, Heterodera glycines
  Genomic contig location: Contig_ID=SeqID_4527; Location=943..2461; Strand=-
  SCN-specific regions: Sequence locations=1-100,160-231,262-451,481 -733,795-823,847-915,952-1010,1047-1084,1107-1519
atcagcatccatattccgaccatcgacaaattcgagaaaaatatgatgatcaatgaccacgtcatgcaggtaaatttggtggtactttaattagttatggttttatataattaatttatttaaaaatatatttatttgtttttaatttaaaataattatggaagggaccccaccggacctaattggtcttctgttttattaaaagatttgccgaaaataaagctaatttgcatataaatttttaaaatattaattaaatttcttttccattttccgtaaaattccgctttctcaatttatttctgtcatatttttcaaaaaaatatgtgaatttttaggatgagggaagggataaatttgatatttctaattttccaaactttttaggattgaggtgaggggattaatatggaatttctcattttcatggatataattcaatcataaatcttaaaccaatttttaatattttaatgaattctcaagttgtttcctattcttaacggatttttttttaaattttcaaaggtatttttttaatttttggctctctttcaataattttatatctctttccatagattcgcaatatccatgtgaacttggacaatctgcaacccgaaaccgaattggatctgagcgacacaagccatatcagatcaggagttggtcaatacatatcggccaaatttctagcccaacagatcagcacgtaaaaactcgcagaaataacaaattaatgtaaaaaaatttttctaaaaataaaaataaattaatcatatttttaaatttttgatgaaaattggagaaaagagattaatggaaaatttttttttaataaatttacatcgaaatgccaaaaaaatgattttggccacttcttgcaatacttattagaattcgtttttttaaaagcattgataaagtgcctatttttctgtaaaaataaatccagacccaaaaaacctagttccaaaaaatgcctaggcctctgccctttgtgctaaaagtttataaatttcataatttttttttttttaattttaggcgaatcaaaaatacgcagatgaatgaggagggatcaagagaaagaggaagtgtagcgcgaatgattgctatgatggaaaaattaatttttaaactgaccattttctggcattatgcttttgtgccatttatgcataaaatcgaattggaatacggaattttttcatttttttatgctgctcgagaccgagaatcccacctttctcctgtcgagacttgtctcccaaagcagcatttcatcttatcatcaataaacttattgaattttaaccttcggcgtctatcgccggggagcagctcgtccccgcccccctcgccggaacgaaaatttcatgattcttattatgaattcaaaggaattaaagtgggccaaaaatcgcaaaatgcttatttcgaaaaaaatttctcaaattgatcatggacaattaaaaacaaagcatttgaatattttaagaagcgtgttttgaataaa

SEQ ID NO: 54777 - DNA, 96 bp, Heterodera glycines
  Genomic contig location: Contig_ID=SeqID_24081; Location=317..412; Strand=+
  SCN-specific regions: Sequence locations=1-96
ataaagtcaacgtagaagcctcaaaccaagtggaaaatgcttttttatgcttaatatatcgaaactagtgcgcaaaaaaaggcatatgcctcagaa

SEQ ID NO: 54778 - DNA, 507 bp, Heterodera glycines
  Genomic contig location: Contig_ID=SeqID_24082; Location=141..647; Strand=+
  SCN-specific regions: Sequence locations=1-299,333-357,380-507
atgacacacgtatttttcgatcccgagtcggttgattggtcatcttttttcacttcacaacatgggaggggacagaagcaatactttgtcgggagcaagtaccagcggggattcggtttcctcggtaatgtggcacgtttcttgacccctattgcgaggaatattgcctcgagtgcaggacatgaggggctcgccgcggggcagagagttctgagtgacatcgctcagggccgtgatttaagggatgccgtcagggaacattcaagacaggggttgactaaccttaccgacaagttacaacaatgtgggaaaggaaaaaaggccctgatcactaataagatcgaaaacgggtatttgatcagttaagtttcatctaaaggtataaatagaacaaataacacaaataattaaaaaatgtcaactcttacgaaaatagacaaggcgagtgaggatggtctcgaggggggcctttcgctgtttgatatcccccgacgaacgttgcaatta

SEQ ID NO: 54779 - DNA, 1060 bp, Heterodera glycines
  Genomic contig location: Contig_ID=SeqID_24084; Location=531..1590; Strand=+
  SCN-specific regions: Sequence locations=1-21,43-84,108-335,357 -432,454-482,504-1033,1057-1060
atgcaaagttttacatggaaacaaaaacattccattttcagttacattgaccattccgtcatcgcttttctccgctccaatcatcaaatttttgacaaaggcaccaatttgcggttgtggatgtcttcttcgcagaccacggatgaccagccgatttgggaagttttcgtccgtgaaatatggccaatcttttcgacaaacattcgccacttgggttttatcggcgatgaacaattggacaatttgagtcgtctcatttcaccggcaattctcactgatctccatcagttgaattcaatcaattccggtgatttgttgcctgatgtgatcggtgattttgatgggccaaatgcaactgctggtcaaattctggccaaatggctgcatactcctagaaaagacgggcaaccgaagcaattgcgttgtcgtgatcaaacttcaggaacggttgcatgggtcaacaatttcaaggaggtaaaatgaactgacaagttttaataatctgttctcgatttggttccaattttagggccttctgcgtgccaccacttcagccgactacaaaattcagtttattgttgctccgccatcaatgtcaatggtgccatttgaattgacgaacggacgaaccaacgaaaagctgacaatgaccaaatcaagcgaaaatgcatgggccagccaatggataattaagcgatgccaaattggggagacggcggcggtgcaatgggaagatgaaaattggaacgatttgagcactgtccaatttatgatttttggcaataattgtatagggtgagtaacaaaaagcttttgactttgcctaaacaatttaaatttcgttaatctaggccattatctcctccagaagaagcgggacaaagcagcgaaaaagggacgtcttctgacaaatgagtgacggacaaaagagcaaaacaacaacagtgatcagcagaagaaatgaattaattaattgagaaatgatacgtcataatttatcagtgataaaaagtattttatgaaaatatcacaaatatgtataatatgtgcatatatttaa

SEQ ID NO: 54780 - DNA, 895 bp, Heterodera glycines
  Genomic contig location: Contig_ID=SeqID_24085; Location=503..1397; Strand=-
  SCN-specific regions: Sequence locations=1-35,649-895
atggatgagttgggtatggatgttgggtctatggatgagttgggtttggatgagttgggtttggatgagttgggtatggatgagttgggtatggatgagttgggtatggatgagttgggtctatggatgagttgggtatggatgagttgggtctatggatgagttgggtatggatgagttgggtatggatgagttgggtctatggatgagttgggtatggatgagttgggtatggatgagttgggtatggatgagttgggtatggatgagttgggtctatggatgagttgggtatggatgagttgggtatggatgagttgggtatggatgagttgggtctatggatgagttgggtatggatgagttgggtatggatgagttgggtctatggatgagttgggtatggatgagttgggtatggatgagttgggtctatggatgagttgggtatggatgagttgggtctatggatgagttgggtatggatgagttgggtctatggatgagttgggtctatggatgagttgggtatggatgagttgggtatggatgttgggtctatggatgagttgggtttggatgagttgggtttggatgagttgggtatggatgttgggtatggatgagttgggtatggatgagttgggtctatggatgagttgggtctatggatgagttgggtatggatgagttgggtctatggatgagttgggggtgactccttttaagtagcgcaaaatgcccatggcaaccaaattttgcaggaacgcaacccccgtcgtgaggacatgtcgaccacgcaggactggccaagtgtttggcccaccgcgcagtccttccgttcatcggtggtgccgttgcccgtccgcatgggcttccgccgtaggccggaacg

SEQ ID NO: 54781 - DNA, 1280 bp, Heterodera glycines; identical to SEQ ID NO: 24086
  Genomic contig location: Contig_ID=SeqID_24086; Location=1..1280; Strand=+
  SCN-specific regions: Sequence locations=1-24,46-173,208-304,326 -727,749-897,919-1015,1037-1280
  Gene Ontology: Mol. function=ATP binding; Cellular component =cytoplasm; Biological process=protein biosynthesis

SEQ ID NO: 54782 - DNA, 138 bp, Heterodera glycines; identical to SEQ ID NO: 50950
  Genomic contig location: Contig_ID=SeqID_24087; Location=342..479; Strand=-
  SCN-specific regions: Sequence locations=1-138

SEQ ID NO: 54783 - DNA, 751 bp, Heterodera glycines
  Genomic contig location: Contig_ID=SeqID_24088; Location=533..1283; Strand=-
  SCN-specific regions: Sequence locations=1-379,401-550,573-682,704-751
atggaccaactctcgcgcctgtacatgttgggcatcgctttgtgcgctctgttccttatcggttgcctctttaatttactgatgtgctgtttgggtcgtagacgaaccgctgccgagacaggcggcggcagtgcggcactgcaaatgccattcagaacgaagcggggccgacgacaccacccggcgcaacagaaagtggtgaaaaagaaattgcaaaaatcgaaaacgaagtgccacacgaaaaaatgggctggtgccacataaagttttttgtttttggtaagatcactagcaaaaatttcgcctaatttgattgtccgttttcacgtttactcattgtacgtaattcggcagtcattagatccgtttcaactttggccttcaaattttaaattttgattaaaattgaatgaaagcattaacttttgctttactgaaattggccaatgctttgagatgagtgccgtcggtggtcactcctcccacacaacgctcacttcctcgctgtacggaggcgtcgcaaatgaggcgaaaaatggaaatgggagcaaagcacagcagcaacagcagcaagtgggcttttggataagcgaagacggacaacggaacggagggcggcacaattggtcaattggaacaccataatgataatcctaattagaaccataataataataaatgccataaattaattattttgcagaatacgccccgatggtgtccagcttttacgaaggactgccaaacataa

SEQ ID NO: 54784 - DNA, 1458 bp, Heterodera glycines
  Genomic contig location: Contig_ID=SeqID_24089; Location=24..1481; Strand=-
  SCN-specific regions: Sequence locations=1-319,341-408,430-532,554 -786,808-1458
  Gene Ontology: Mol. function=endoribonuclease activity; Biological process=myoblast fusion
acgctcactctccgcttcttcgacctgatcaacgatggcaacatccaacaattgcgtgtgctgatcgattcgctggatgccgacgagctgaacattttgctgcggtggacggttgatccagtggagcgcgacaacacccgatcacgatcagctctttggagtgcctttttacgacaacacaccgaaattgttgatctcttggtagtgaaatgaacaattttatccgtcggcactaattttgtatggcattttcagttggagaagggcgccgatccggatgagccagtggctgaccaagtgaacaacataaacacgagtgagtgggtggtgttgatgatgaaatcgttgttaccatgcatctaattcgggtccctggattcggctcggaattggtcgaaacggataccggaaaataattatatttttgcttgctctgaaaataatggtgtttccccatttgtgcagatatgacgcctcttttccttgctgtccgccatgccaatttgccgctgtgccgtgtgctggtcgcgcgtggtgccaacattgacttgggcacggactttgccacaacgccgctgatgcacgcttgcaaaagatcgcaaacggaaattggtagagagacgaaattttgaaaaaatacgtaattttttcccgtcatttttccccccacagtcacatttcttgtcgagaatggtgccaacatcaatctgcagaatggtgatggggcaacagcactgatgtacgcgtgttacacgggaaatgtaaggaaaaatttccattggtgaaatgttttccaacatttttccatttgaattcaggtggacattgtgcgcttgttgctgacacatggtgcaaatgtcgagcaaatggatttcgaaggtgggttttacagcagtactcaaaaatgtaatgaaattgtctctaattttcaggatactttccgcttattgacgcagccattggcggcagtttggaggtgtgccgtctgctggtggaagagtgggccgcagatgtcaaccaacaaaccgttcaagagcgatacactcctgtgatttgcgctgccagtaaaggacatttggccatcggtgggagagaattgtggcaaagtgccaaaaatgtaatctccctaattttcagtgaatttcctcgtcgaacatggcgccgaccttcaacatgttgacgtggagggacacaatgctttgatgtgggcagtgatcaaagggaagacggaagtggcgcggcatttggtggccatcggcgcggacattaaccaacggaacattgaaggtgagcagcagcggaagtggccaaattgttgtgctaacgagcgttttattcgcccatttcaggcaaacgggcacaggatttcgcggaagagagcggaaatgccgaaatggtggccatttttcgtacgacggcgacggacaatgggcgacacgcggcggagggcaccgaaga

SEQ ID NO: 54785 - DNA, 101 bp, Heterodera glycines
  Genomic contig location: Contig_ID=SeqID_24090; Location=1002..1102; Strand=+
  SCN-specific regions: Sequence locations=1-101
atgcctcctttaacagtacaatcagtaataattttttcattggcagataaaatcaaatctagccaggaattaatccgtgttggctcattcgtggccaaaac

SEQ ID NO: 54786 - DNA, 1746 bp, Heterodera glycines
  Genomic contig location: Contig_ID=SeqID_4528; Location=1..1746; Strand=-
  SCN-specific regions: Sequence locations=1-396,442-465,505-560,609 -1016,1038-1114,1136-1621,1657-1746
  Gene Ontology: Mol. function=transporter activity; Cellular component= mitochondrial membrane; Biological process=mitochondrial transport
ggtggaaaagaaacgacgcgccaaatgcgttggcttttggccggcgcttcggctggccttgcggtcgatttgagcctttacccattggacacaatcaaagtattacgcctttttttatttttggtttttttttgttccaattttcttagcctcccccccccttcccccttacgttctctttgttggctttcaatttgctattctttcggctttttaaaaatctccataaaaattttttcaaacaattgccgaaattccctccggctatacttggacaacgtaatgccaaatacctcgtatatgatcaatccaatttctttcagaccaggatgcaaagcaaagccgggttcagggcatcgggcggtttccgcaacatttaccgaggggcaccggcggtaattttctaaaaaaaaaaaaaatttttttttgaaaatttaatttgtcactgtctctcattgtcaggtggctgtgggctcggctcccggctcggcactgtttttcatcacatattgcaatggcaaggaaatgcttgcgcaacgaattggcacatcaattccatgtaaaattaattttttttttttttggtagaaataattttttaaaaatttctctgaggggaaatgacgcgggaataaatgaaatgtacccattttgccgaccgttaaaaatatttcatccgcccaatttggtattatctttgtttgacagtgccattggtggacgcactgagcgcaacatttggcgaattggtcgcgtgtttggtccgtgtgccgaccgaaattgtgaagcagcgcagtcagacgagccgggccagcggactgttacaaattgtcaccgaattgtaccgaacacggggaggcatcagaggcttttacaaaggtgagagcagcgttggttgacttggagatggatattttagcaaatttgaaaaaaaaacgaccagaatggcaaaaaatagtcatttttttgcgaaaacggttacaaattcctgcaaaacccacctcctattcgggatttctaaaaaagaaagaaaactacacccctaaaaatattttttgaattcagccctccccccccgaagccaagggtctggcacgcccatggcaggtcccctccaagggtttttcgggaaattttcaattctgctggacattacccttgataaggtggtataatgtgtgcgacgccctcaaaaattttggcaatcgaaattttttcaacggctcaaaaaatttcggcattcgtaattcttagtccaaaaatgttgaaaatctgcattgccgacacatcgctctggtacacattttttaaggttatgtgagcaccgtggcccgagaaattccattctccttcatcgaattcccactttgggagtggctgaagcgtcgtgtggcccatcggatgggccattgttcgccgttggcatccgccgcctgcggcagtttggccgggctgacggccgcggcactcacaacgtgatttcaatttaacaaaaaaatgaagaaaaaaaaaacaaatttgaagcagattttataaaatttttgcatttccctaacttattgcggaatactccccctaaattcgatcccctgaaataaagccccccccccttcgagtggggtaaaaaatatatttttgaatgttttaaaaaaatttccggcttggaattgatcaattttggtaaaacgagttgattttttacagaaaagatttccaaaaaaatggctcaatttgtgtggctcaaat

SEQ ID NO: 54787 - DNA, 1331 bp, Heterodera glycines
  Genomic contig location: Contig_ID=SeqID_4529; Location=533..1863; Strand=-
  SCN-specific regions: Sequence locations=1-273,298-364,387-515,553 -781,804-946,991-1331
atgtcacctccgcctttctacatttttaaatcaccaatggttgtgatgcgatcgtttgatttgatgcgaaggcttatcaacccgttcaaccgtttatggtacagttggtacgactcggcctacgacatgaacaaatttatggacggtgcagttcaggtagaaaaaaaacgaaaaattgttcaaaaagtgaatacaatttttttctttttaaaatcttattaggtttttctatagaaagtttcgtttttttagagaaaaaaaaaatcttaccggaaaaatttaaaaaataataattttgtgcgggaatttccattgtacgaactgctatgacactgatcaaattacctacatggaattttaaacctaaaaaagccaaaattttaaatacaccccaaatttcactcatttcttgtagccccagatcatttcattaaaaaattctggcgatttcaaaattctgatttagcatttttggattttccggagatagcgaaaccacaattagagccaaatagtttattatttaatttattttcaaataaaaaaaaattaggcggcactgctcgcggcgctcaatctgcgcgaacggcggtttgacaaatttcgcgaaattgcgaccgaacaattaacggtttacatgcgccaacggattccgaaaatgcccgcggatttgttggaccaacgactgcagttcaaacgacaccatgtggtcaacgggttcatccacacgtcagcctatgctcaccgggctgtccatgaaagtgcgtttattgttagtcagtccttttttaaaatttgtttgagggttaccaattggaaaagtgcgcaaaattaggggccaaaatccggcacttgtctgctctggaacagcttcctccctcctccggaatgatttaaaaattttgaaaaaaacagtaattcatcataaaaatttggaaaacgctagaaaaaaaatttgttttttttaaattttatattaaaaaaataaaagagtgaaatcacagtttttggaaatggaccaattttggacccttagaaaccccattttacacaaaaatctacaacaactttgattttttaaacccataaattgaacgcaggttagtctgattgtgagttactttttccgaatcaaatttatcgaaattttataggctaatatagattcacttaggtcctatcgaatgacaaagattgttggttcaattggaacaacagtaaacagagttataccacaaaaatcggattggggcccagttgactcacaatcagccgtaattatgagtcaataaaaattaagcaaaatttccatgaattttttttaaaataaa

SEQ ID NO: 54788 - DNA, 1354 bp, Heterodera glycines
  Genomic contig location: Contig_ID=SeqID_4529; Location=2753..4106; Strand=-
  SCN-specific regions: Sequence locations=1-1044,1066-1140,1162-1354
atgagcaaacttggtacggcacagtgctttgttgcagacccacgctgggagatcaactcggacattgtgtggacggacgacaactcggggttattaacacggctgtttggggtcaatgcatttttaaacttcgaaaacgcaaaattatatattttaccatgaaaacaggggtggagtagctgtttgctatattgcgagagtgaaaaattgtatgacaaaaagaatttgttaacaaacatggttgttttatcccaccgggatcgtttcggcgccgatgttttggtgccatatttttcagaccctccgattcttatccaaaaaaaaacataatttttttaccaaaaagtttgaacaaaataacatataaaatgaacaatgcttgtttgttggaatacactaaatgtgcaccaaatggatttttgtgactaatttaacagtgatttaactagtatttttgatccatgcctaaaatatatctttgttttagacataaacctcgcattgaaattcccccatgcctatatggccagcaaaaaccatggcgaacggaggacggcactgaggaggcggtgaacgaatgtgtggcactcagttacaggccattccgaaagcgaattgagataaaattggcggacgaaggacttacggtggggcacatttatgggcatgggacgggggcatttgtgattcgatttaagtcttggttttcttttatataatgagatttttttgaaaattcctacaaaaattgtgtcctagttttgtttgttattaaaagcaatattttctacatttttaggacgaaattctggacaattttacgcctccaattgttgtctctgaacttgttgcaaaccgtaaagactgtgcatcgatgtaccgaattcgaacaaatatccacaaagtaattttgaaattttagaattttgagaggggagcaccccaaaatcacgccgctagaaatttttgaaaatattttcaaaaatttctagcggcgtgatttcggcggcgggattttgtcctgttcccttttgagagaccattttcatggttcattcattcatttggattcggaatttataacctctcatttttgtcagtgcatttggtgtttcttacattttttaaagggattacagcaaatgatcattaccgatgccaaattgctgcgggcagagactgaaaaacgatttgatcagtgggaaggtaaggctgctattgatggcattctttaaaggggttcgccatgacagaatttccatacgaaagtccaatgatcttggtcaaattttgaaaactttgccgagggtggtgcgccggaacaccccttatgcatgtatatgattctaataaa

SEQ ID NO: 54789 - DNA, 319 bp, Heterodera glycines
  Genomic contig location: Contig_ID=SeqID_4530; Location=716..1034; Strand=+
  SCN-specific regions: Sequence locations=1-264,307-319
atgccaaattgcccattcctttatttggtgtggaacaggtcaacacgttcaattcggccaaggaccgaagcaacaattgatcgtcccacaccaattaaaacagtgagtgttcccagtttaaaaaaccgtccctgttttcagggtcaggaaccagaagctttttaggtcataggtttcaaacaattccctatatactgaaagtcaaactggtaaatttttgtaaaaaggggccttggaatggaaaaaatttggttgaaaaatcggttttttttttaattttttcaacttttttttattctttttaaagacattttgccaa

SEQ ID NO: 54790 - DNA, 1919 bp, Heterodera glycines
  Genomic contig location: Contig_ID=SeqID_4530; Location=1189..3107; Strand=+
  SCN-specific regions: Sequence locations=1-83,105-118,154-789,822 -1464,1503-1919
atgcaccggcgttcccgatctcggtcgagatcaagagcccccgaaggtaaaacattttcctttaaaaatatacgtcttaactcactaaatttcaaagaaaattactcttccgttacatattttttgttcaatttacagaccattctctgattgaagcatttgagccggctccaccaatgcattcccgacagagtttacaggttaaattgtcgtcatacaaatatttttgtagggtcaaatggaaacatgcaaatttttgtgtccaattttccttatctctgttttgtgatctattgattttggagttgactctctgcatttttcttatctgttttttgcactccgattacaatatttaccatcacattgggtggtccattttgcatattaattatccccccccccctaatcattggtttttttgtggttggggccctagcgctgcgcctcccccacaattacaccattaactggtggagttcgacatttgaaaaaaaagcttttgcctgtatccaaggaaaaacctttggtctgaatccaggtacaatcgaactcaagtatgaatttcgcaaatatttggatctgcgcatgtaactaaaaccacaaaaaaaaaaattattttcttgcctcttgaaaatgttttgggttttgcaaattgatttttttgaaatttaaacatcgtattaaatacaatactgttaccatatatttttgttcagcaaaccagacaacgattgttggcaactcggttcaacccgcccttgaaccaacaaaatactccgatgcaggtttttaaaaaaaaattttttttttttttttttgcaaatttgcaattcgtgccaataatttcagcgccataatgggcctgctaatgtgatgcgaaattcattgggtcaatcggcacctgcccacaggagcgttcaacggcctaccgatccgagaactcaggcgtgggcaccccgtccaaatttgtcggccaaccgggcatctgaccaagcaatggccaaccaacggtgccctgacgactcggtaaatgcacgaactcaacaaattcaggtcggtgcggttagaaaattcgaactttgtcatatttttcaacatcggtttaggcaaataatccaatgatgccaaccaaccgaagcaatttgtcattgaatcagccaaatgttacgccggtacaggtttgcaataggaatgagcaattcctgaaattgcatggttgtaaatttttagcgtcagaatgggccatcaaatgtcgcacaaatgttggcggcccgtcgagctggagctgttacgccgaatcaggcacttttttttaatacaaaattcggttaattgtaagctaaaaatcatttccatttttttgaggttaatgttttagggcttttcggtgtcaaatgatacgatttgacatccattttgacccgaccctttcgaaccccgaaccttgacttgaacaaatttaaattttcaacaaaatcaaaaaacttgttgaaatggatgtcggaattgaattttccaaccttgaaatttttttgttttgttttgaatgggtggcccaccatcgacactattaccaatcctccgaaaccatttttttgatttgtctatataaattatagcgactggcaacaaattccaccagcagaatcgggggacaatcgtctcaattggggcccttccagcaaatgaaaatgcgaatgaactggagcatgcgaccgccctccgggcttgcagttagcacgccggtccaaccacgtccaattgggcaggcaaacaacagcagtacgtcgatgctgcgtcaattcccaatccgaggtggacgcggacaaccgcagcaacagcaaatgcgtcgcgcgccaccgccagggaattgtgatgtgccatcgccaccgcaggtggatattgttgaacaataa

SEQ ID NO: 54791 - DNA, 879 bp, Heterodera glycines
  Genomic contig location: Contig_ID=SeqID_4531; Location=206..1084; Strand=+
  SCN-specific regions: Sequence locations=1-148,170-231,263-726,755 -787,811-836,859-879
atgcctttggcggatgaagaggacaatgtgttgccacatgttcgtttcaattatgacttttttatgctcaatttttgccatccaaaaattaatatttccagagtttgttgcccgattatgagaatagcagtgagaacaacaaccccgaaaacaacaacagcggcggcggaggaggtgcaacaacgacgccaaatgcaccgcagcgacggcacgtcattcattcggatgacagcgacgacgatgacgaggatgatgaagatgaggcagacgattatcggggcggcaattctggcacacatgcacaggtgtgttgtgaaatgagctggctctattctatacagggatcgaagtgggataagcagatcccgcgcgagattttgcgggatataccagtccgtaatcctgcatttttttggcaatgcataattaatctcacgggatcaccataccattccacaaaaattttgaatccttatctcgcaataaaagcaataaatctgaaatttgcgatctctaattcaatatttttaagaaaaaaaactataaatgcggaagggtggcatttttttttttttttgaaaaaacgtgtttccaatttttttttatttgtttttcagccgacagcaaaacggggacgcattgagacgacgtataacttcaacaccacaaccatcgtcaacaacagcaacaatgacatgcatttgttcgatatgccaagcacttcggcggccgccgccgctgctgttgctgctgacaatgaacaacaacaaatgctggcgatgatgcccagcagcagcagcagtagcagcaattgggtggacacacaaaatgcactggcaaatgacatgtaatataaatattaattagacaaataattaa

SEQ ID NO: 54792 - DNA, 891 bp, Heterodera glycines
  misc_feature (440)..(440): n is a, c, g, or t
  Genomic contig location: Contig_ID=SeqID_24092; Location=343..1233; Strand=+
  SCN-specific regions: Sequence locations=1-29,60-72,116-366,388 -391,425-543,588-669,699-792,814-829,865-891
atgaaggtaatttttggaaatttctggaaattattattaataaaaacattggagtttagattcggtttctacaaatttatcaaaaatttcaaatttttctttaaaaaatttatatccaaaatttcaaatgccaacaccgctttaaatgttgaggttaccggtagcccaaccgttctttacaatacaaattcagtaccggcatcgccggcggttgggctactgtaacacggcaccgtatcaactctcatctataaattttttaaggattcgtccgaaattgtgctggcatttggccggcttgaatcatccgcactgtcatcagctcattccattggatttgttggctgtttgggcgacctattgtttggcgctcagcaattgcttaggtttgaaaaattaaaaaatttcaaaaaaaaatttttttgaaatttctagcctgngcttcgagttcgtccaatgagcttacactggtctggttgcacaatgggaccaccgaaagcattttctgcaggcaaagcggcgcccaaaaatgaggtgggttagaaaaaaaaaaactaaaaaatggtaaaataatttaaaaaaattttccccaggtggacgagctgaagaaagcggaagatcttgagggccaaaagattgaggaaaaatcaccccaaaaagccaagtgggaaaaatatctataatttaaaaatttttttgttttccctaaccaaaattttttagttttttttggtcaatttttttagaaaatttacggaaactgatgagccgttgaaaatactttgctcagtcaaaatccataaaattcataaaaaactaattttgcttcttttttttttaaattttaatttaaagtttattattctctgaattctttaaaaaatttttgta

SEQ ID NO: 54793 - DNA, 943 bp, Heterodera glycines
  Genomic contig location: Contig_ID=SeqID_24092; Location=1746..2688; Strand=-
  SCN-specific regions: Sequence locations=1-170,213-567,589-856,879 -900,927-943
atgaggacattttcattttctaagatctggcccctccaaataaggacaaatcttagaaataaggacacttggcagccctgttttagagcagaaagttagcgccttcgcatgactcgttataaaactgccataaagggctaaaaataaaaaatgccaaaaatgatcacttcaaaaaatttatatatttatgaaaatccaaaatatttaaaaaacgaggacgatatagtattaattaagctttcactgcagattggacttaagagttggcgctttttttaaatttcacatcacgtctttttgttttatttcaatggttttaaaaacaccataatgagtttttttcaaaatatagttggaattagaaaccgaaaacacgaagcaatattatgttcttaattacaggtttacaatggttgcgtcaatacgattcaggaagaaatagaaagactttgcaatcaagtggttgtaagtttttttacgtttcgccgccaaattaaataaacttgggttttttagaaattgatcgaaattttgcatacaaaagattttttgtaaataatttcagttgacaagggaacattccgagctgtgagtgggaaaatgcatataagctatataccattggatagagcggggtcgacttgtattgtgaatttttaattttagcggtgcattccgcctgcttcaaaagttacagggcctcaaaatttgaaaatttggtgcttcagggtctcatgtttccacttgttaatcgcttgtatcatccattctttactccgactttacgatgagcaaaacacgttgattttcatcaaagaaatattctaacacggcctaatcatataataatacgtactttcaataatctatgaaatgttaattactgatgtgattattgtcatatttttggcatttttattaaatgaaatattgactcaataaa

SEQ ID NO: 54794 - DNA, 1449 bp, Heterodera glycines
  Genomic contig location: Contig_ID=SeqID_24093; Location=474..1922; Strand=+
  SCN-specific regions: Sequence locations=1-26,48-683,705-1174,1198 -1421,1443-1449
gcagatgctgaacatcccactgatgctgctgttgtggacaacttcgagacgcgcgctcgccgcttcttcgacctgatcaacgacggcaacatccaacaacttcgtgtgctgatcgatgcgctggacgccgacgagctgaacattttgctgcggtggatggttgatccagtggagcgcgactacacccgatcacgatcagctctttggagtgccttttttcgacaacacatcgacattgttgatctcttggtagtgatcaaacaaatttatcacggcactaattttgtatggcattttcagttggagaagggcgccgatccgaatgagccggtggttggccgtgagaacgacattaacacgagtgggtggtgttgttgatgaaatcttttttaccatgcagttttttggtgtcattcagtgatcacgaatccggcggcaccatttcgaccagctccgaacttcgttatctgacaataaaaattggattttttttcttcgaatttggtcaaggattcgaatcggaattggtcgaaattcggatgccggagagtttggcaaaaaactgatcacaaatctgacatccatttttgaacaattccggaacacgaattcgaacaaaaagtcgaaagttcaaattttcgaatttcacaaatttcgtctaaaaaatttaaatgatcttttgttgctggatggtgactttcagtttgttactgtgtatttaacccttttcaagaatttgaactttcgactttttgttagaattcgggtcggaattggtcaaaatacggatgccagagattaattatatgtttgtctgtcttggacataatgttgtttccccatttgtgtgcagacttgacgcctcttttcgttgctgccctccatgcacattttccgctgtgccgtgtgctcgtcgaccgtggtgccaacgtggacttgggatcggactttgccacaacgccgctgatgatggcttgcaaaagatcgcaaatggaaattggtagaccaaaaatttgaaaaatgcgtaattttttccgtcattttttccacaacagtcgcatttctcatcgagaatggtgccgacatcaatctgcagaatggtgacggcgaaacggcattgatgatcgcctgttcaagggcaaatgtaggggaaaatttttcattggcaaaatgttttccaacatttccatttgaattcacaggtggacattgtgcgcttgttgctgtcacacggcgcaaatgtggagcaaacggattacgaaggtgggttttacagcactcaaaaatgccatgccacggattttgtctctctaaatttcaggattccgtttcgcacttaagaacgctgccaatgagggccatttggaggtgtgccgtctgctggtggaggagtgggccgcagatgtgaaccaatcaatcatccaagatcgaaccactgcactgatttga

SEQ ID NO: 54795 - DNA, 481 bp, Heterodera glycines
  Genomic contig location: Contig_ID=SeqID_24095; Location=273..753; Strand=+
  SCN-specific regions: Sequence locations=1-4,26-174,196-219,241-481
atggttaaatttataaaaaatttttggggtgtgttaaacatatgaccatgactgtaaccgcaatttaatttacaattattttcgtcagttaattttggctttttaacaaatgctttttatttttgtgaaattttctttttctcagcactgattatcggagtgcgttcaagcgtgagtttggcttggtcaagaaattgttgcgcattggaagcacgacaacagtgcccattgtcagtgccaatgttgtccatgttaattccaatagtcggcagcaacgctttcgttctcaacattcgccagcgattgtctgtgctgcacactaacgatgcctaattgactaattaaaattgttagatggactatacaatttcacattagacctctttttttgtcttcctcaactgagcttacaacttttacttcattgatttttcaggaagtaaaaaaaaagcaatttattgacgaattaaacaatagacaa

SEQ ID NO: 54796 - DNA, 494 bp, Heterodera glycines
  Genomic contig location: Contig_ID=SeqID_24095; Location=777..1270; Strand=-
  SCN-specific regions: Sequence locations=1-494
atgagccacccagcaatttggaagggggtaagtgattttaagagtatttctgagatatttttatacaaatttaaagctgacaaatgggacaattggcatgctttaaacaacggatggccaacggaggagacggacgaacaaaaggaaagggtgaaaatttggttttttggaatttttatccttttttgtatttttaattggtttaattaaattcagagtccaagcaaatgggtgctcgagttgttccaagggatgcgcaattttttgtctgacaaagtgaccaaaaagtttacagaacgctgaacggaatttcgattggatcagctcaaatggagggaataacagaccatatttattgaaagaaggaattattggatcagtaattttaacatttttatcgtttttttttgtcattttgatgatctactctgttaattttcaaaaatgcttttattattaaactatcgtattgaacggatcctcttacaaataaa

SEQ ID NO: 54797 - DNA, 65 bp, Heterodera glycines
  Genomic contig location: Contig_ID=SeqID_24096; Location=523..587; Strand=+
  SCN-specific regions: Sequence locations=1-65
aaactgatcagaagcgcaccaaactttgcagggatactgaaaggaagagaaataacctattttaa

SEQ ID NO: 54798 - DNA, 1296 bp, Heterodera glycines
  Genomic contig location: Contig_ID=SeqID_24097; Location=567..1862; Strand=-
  SCN-specific regions: Sequence locations=1-138,209-331,353-357,402 -437,460-472,499-595,631-769,791-803,825-1012,1046-1185,1224-1296
gtttataaaattgcactttatggatgcgacagggctgttgagtcacaagattggcaacatttgaccatagactcaatattacgcttgacaatcgccgcttatgcttttgtttcgctcatttatatcatccaacggttgtaaaaaaaaaaactaattttataataaaaaatgtaaattattaatgattattatttaataatgaaattttctgcaaagtttcagttcatatgtcggcaatttacgagcaacttttgatcggattaccagaaacacaataaattttgtgtttggtgtgatttggttccgctttcttttgctaaaggctctttttataattgaggcaaattatacaacaacaaaaaaaaattaattaattgtattaaatgtattatttatttattcagcaattttgtcgtgatcaaaccgatgtagactccgttatcaagaatttttgccctccatacatgtaaatttttaagggaataattttttgatatatttttaaggaaattaggaattcttgtaattatttactcataattgagaaaatgctaaatataaagccgaagtgttggagttaagaagtttttttttcttagggctttattaaaaattaaaaaactgtacatatttttttcatgcctcgaaattttacaaataaattcaaccgcttgaagccaagtccccccaccagcctaaaaaatgttttaattgccgaccctaagaataataaaaaaatataacataatggtaatgaatttggtggagatttttagttatttaatttttattatgcagattttgtttcgctgaaaaatgcacgagatcgcttcttaggggtctattttctgtgtttattgcattttttttaattttaggcataacaccaacattttggtatttcatcattatttacccactattttgggttttttcgctagtgtttttttgcaaatttttcggttattttttttaccacttttgagtaattgtttttttttgctccaggtcctatttattattttaaaaatttatatttattttagcaaaaatggcttcagttgcagcaaaacatcgttgcacaaagagcagcacatttggtatcgtcttcattatggtcttttaaaatcggcaattgtcacctgtgcatccgaactcattcccgttcttctcgttgcccattggtaaaaaaaaatacaaatttttttaaaaaaattatttttgaggatcgcatgtggacaagcaaaaaagattgcccaacaaagtttgacagaccggatgatgaacaagaaaaaa

SEQ ID NO: 54799 - DNA, 199 bp, Heterodera glycines
  Genomic contig location: Contig_ID=SeqID_24099; Location=289..487; Strand=-
  SCN-specific regions: Sequence locations=1-114,139-199
atgcaaacgtaatttctctgaaaataagtctcttattttttgaggatacgattgttttattattatcgattttataggcctattgggtataaaaatatcatataatttcagaactttatttaaaaattctttatatttctgttcaacggtgaacactgagtttattgataaatcaattcgattttcaagtaacgcctga

SEQ ID NO: 54800 - DNA, 465 bp, Heterodera glycines
  Genomic contig location: Contig_ID=SeqID_24100; Location=130..594; Strand=+
  SCN-specific regions: Sequence locations=1-120,142-264,286-327,349-440
atggtagcagcgacgagtcagagaagagaaaatagtaaggaaattgaagagaaaattttatttttttattcaaaacaatttaatgattaaaagaggtacaacagtgattagaagcggtacaaaagtgattaaaaaacgtacaaaagtgattaaaagaggtacaaaagtgattcaaagaggtacatcagtgattaaaagaggtacaaaagtgaaaagaggtataaaagtgattaaaagaggtacaacagtgattagaagaggtacaaaagtgattaaaaaacgtacaaaagtgattaaaagaggtacaaaagtgattcaaagaggtacaaaagtgattaaaaaacgtacaaaagtgattaaaagaggtacaaaagtgattcaaagaggtacatcagtgatgagaagaggtacaacaaatggcagaagaggtacaaaaatgcattaataatttttaaaaattgtaaa

SEQ ID NO: 54801 - DNA, 1351 bp, Heterodera glycines
  Genomic contig location: Contig_ID=SeqID_4533; Location=455..1805; Strand=+
  SCN-specific regions: Sequence locations=1-696,718-1299,1344-1351
atgcgagcgctccggctgcaacttccacatggcgcaggcattgttcagaaaagcgaggagcttgggcatttttcatttatttgccgaaaacaatgccgaagcactgggtcaaagaaaatcggttcacaaaacattcaggtaggtattttcattagcaagtctttttttcaaaatcagatcagtcctctctttggcactcattcctccactttacattcgccaagcatttacaaccattatcaatgaagcccgcttggagttcaaggatggctggcgtattttggcaaaaactacattggtgccactcaattcgagattgaccatggagcggaggcatttgaaccaaatgcagatgtaggacgcttatttcttcgacgcactcgaagcacaactcgtaaattcaaatattttgtcatgaaatttatgaaaatttttatcaattttagcgttcagtgtgtcccgggcgtccataatgacaggcagtggaccaatacaattcggactgcattcgccataaccatcaactccgacgatcccattttccgaagagagcatcttgcagcttattcgacgttgggaacacgccattgtccgtcctccccgcttccccatatcgttttggaatgtgcacaccagggctcaaatggcacttgaacgaacaaataacggcatggaagccgcacacgtccaattcgcagtataaaaaatattttcagaaaacatttttattttttggtattttcagctagagctcaaccaccatccatcattgagtgacttcattgctgcgttcacaaaggacatcgacaaacaactggacatcggacgcgcagaacagctccagaaaagtagaaaacgaaacggtacaagtagtataaggccacaaatgtggtggtaaattttacccccacattctgcccttcgcagcgcgccggcggtcgccccctccctccccattgtgggagagtgttgtgcccttcgcagcgcgcgccggcggtcgccccctccctccccattgtgggagagtgttgtgcccttcgcagcgcgcgccggcggtcgccccctccctccccattgtgggagagtgttgtgcccttcgcagcgcgcaccggcggtcgccccctccctccccattgtgggagagtgttgtgcccttcgcagcgcgcaccggcggtcgccccctccctcaccattgtgggagagtgttgtgcccttcgcagcgcgcttaaccccttttttttgcacgagttgcgctcaaatattacacaaaactatgcgagctataatttaattagtcgcaattatttaattttgtaagattgaatttttattaaatatatttagatataga

SEQ ID NO: 54802 - DNA, 463 bp, Heterodera glycines
  Genomic contig location: Contig_ID=SeqID_4534; Location=341..803; Strand=-
  SCN-specific regions: Sequence locations=1-59,91-132,154-196,218-463
atggaagggtgttctttaattgagtcatttcgtcatgaagacttaaaatttggctttacaaaatataaaactaaattttattttaaaaatcctttcataattaatgctgaggaaaattttaaagatatcctcacatcgttaattgaagaaaaatataaaaatgagcaaggcaaattcagaagcattttgaagctttcttttggttttgaatcattttattgccctcttcgataccctagcgaaaacacggccgaggctttgttccaacacgtattattaaaagaagaacaatattcacttttttatcctttggatggtgttataacactagaagtaactataatcccagatgtctacagtaattcaagaaattgattttattaagaataatttaacaaaaaattggaaaatagccgggaatatacttaaacgatcaaataatcttgaaatctttgcaaataaa

SEQ ID NO: 54803 - DNA, 1459 bp, Heterodera glycines
  Genomic contig location: Contig_ID=SeqID_4534; Location=835..2293; Strand=-
  SCN-specific regions: Sequence locations=1-966,1026-1057,1079 -1220,1242-1400,1422-1459
atgaacacaatccgcgacattaagaatattgaattggtttgtggtagtcgaatttttgtggttcgtgctaaaattgcaagtgttgggtctacggaatacaatgtaaataaaaccaaatagaaaacatatcttgatttttaggcttgcatctcttgtcgtaaggggaagtgtaactgtggtatggagaaggtaaagtcttcatttttgagattgtcgctcttggatgatacagacgttttttgggggtgttgcttttttcggtgtgaaaaatgtagaaaagagtgacggaatggtatgaaaaatgtttaaacacaaaaatttatttttttaggaaaaggttaaaaacttggttgggaccatttgtactttgaaggttaatgtgagtgtgaaagaatatggtggtaagaagggaatttattatactttgattgatatttatgaaatttgatttgttttgtctataaatgaaatgtggatgcctcccgaagggttgttgaagaagtaattaaagatataattaggttaactaatgaggccaaagacttttcattttctgctcataataccatggttgaagctcaaattattaaggataggaattcgggaaaatctgaaatcatattttggcatgaaaaactattaaacggagttagaaaaatacattcacaatttgataaaataaaaaatgaggaaaagaatataaaaatattaaaaaaggcatggaaaaatgtctagacagaaaggacccagtgatgtgccaagaattagccgaagatgccaaacaatcaatagaaatagctaaaaaatataggcatgaaattggacagacttatcgtaactcttattcacagccagatttaggaattggagatatggccaataaaataaaagaaataatgcgagaaaatcaaataaaatttgaaaagccaagaccctcagcagaatttagagacgaattcattgcatataaaatataataaaaatatataaaagaaaaacagaaaaataaaaaataaaaaatagaaaagctaattccattttgttggaagctgctaaaagagagacagagagagcatggcgagatgtcgttgtgctatcggatgatgtaagcgattttgccaagtcttctcgagaaactcttaatcgtgcaataaaatcaagagaaaaagctccttacgctaatggtgttcgggaattgtatcttaaaatgtccgattcaatttgggaaattttcaaattcctggaacaaatcaatttggagtcagaaaaagctgaatctgcgtggcgtgagttcgaaagatgcaaaacttttgaccaggcaacaaagcttgaggaacaatctcaaaattctttaacagaagcccgaagattacattttgagtcccgaagggtgcaaagccaaatgttaaattatgaaaataggctccaaacaattgtttgggagcatatgggtatataa

SEQ ID NO: 54804 - DNA, 753 bp, Heterodera glycines
  Genomic contig location: Contig_ID=SeqID_4535; Location=873..1625; Strand=+
  SCN-specific regions: Sequence locations=1-355,391-753
atgcggattttaatccttagcattgtgcatacggatttatctgcggataacgatttatctgcagatagttagcattgtgcataccagcatgactgacaaaaatttcgtggtaaataattagtgcataagccaatttgtagtgattctcgacaatggagggatttatcggacggatttgagaccataacgggggctgatcagttcgaaaaactgaaaatttccattagacagtaaattaaaaaaaatttatccttccataataggcagaagcaaggaatggttctcatcgcttataacattctatcaatctttcactgtatttaggcaaaccctttccaatataagcactaatggcatttttatttatcaaaaataatagtaaaaaaatatgcaaaaatatttctttgaattaaagctgacaacattggcaaattggggcggaaactgtattatgccacagtgcaaaaacagaaagtttgtgttcgagaacatcaaagtgaccggtgtgacggcattttgtgtgggatcaatcaaaattatggcgacacggcgataattaaaaatgtgaagatcggtggcggctcaacaaatgtgtgcagcttgttcaaaggaaatgatcaacagaaacagccttcggtgattcacaactacaaagtcggagaagcgggcgacgggaagaattgtgtcgtttcgggcagctcaagcggctaatggaaaaagtgatcggagagagagagagagattggatttaca

SEQ ID NO: 54805 - DNA, 170 bp, Heterodera glycines
  Genomic contig location: Contig_ID=SeqID_4535; Location=2562..2731; Strand=+
  SCN-specific regions: Sequence locations=1-170
atgcttttcctctcttttccgtccctcgtcctccgccaaattcgcccttctttctgtcgctgcttttcctttctgctgatgttagccatgctttttgatctgatcagcagcggtcgatcacttccactgggcccaaccaacgaaagggttttcttctccaacgcattacg

SEQ ID NO: 54806 - DNA, 449 bp, Heterodera glycines
  Genomic contig location: Contig_ID=SeqID_24102; Location=344..792; Strand=-
  SCN-specific regions: Sequence locations=1-449
atgacattccaatcactgaaaatcaacccatcagcatttcaatctctgagactcaattctcaggctttccaatcgctggagctcaacccaccagcatttcaatcgctggaactcaacccaccagcattccaaacaatggacttaaatctccggaattctaaacactgggactcaatccaccagcattcaatcactgggactcaacccaccaacattccaatcaacgggactcaatccaccagcattcaatcactgggactcaacccaccaacattcaagtcactgggactcaacccaccaacattccaatcaacgggactcaacccaccaacatttcaatcactgggactcaatccaccaacattccaatcaacgggactcaatccaccagcattcaatcactgggactcaacccaccaacattccaatcgcctggactcaacccacca

SEQ ID NO: 54807 - DNA, 70 bp, Heterodera glycines
  Genomic contig location: Contig_ID=SeqID_24103; Location=717..786; Strand=+
  SCN-specific regions: Sequence locations=1-13,35-70
atgattgaaattatttcatttttggtttattttgtcttaatatttttttcgccaacaccggacgacgaag

SEQ ID NO: 54808 - DNA, 70 bp, Heterodera glycines
  Genomic contig location: Contig_ID=SeqID_24104; Location=747..816; Strand=+
  SCN-specific regions: Sequence locations=1-70
gtatacatttgagacaattgggcaggacaagaaaagaatgaagttgatgcctcatgaaactcggaattga

SEQ ID NO: 54809 - DNA, 174 bp, Heterodera glycines
  Genomic contig location: Contig_ID=SeqID_24105; Location=1942..2115; Strand=+
  SCN-specific regions: Sequence locations=1-102,126-174
atggacttaaaaaatgaggtagaaatcagtaagaaaataaaaaattaaggagaatgtaaataaattcttataactttcattacaaaaaaatatattacagacataaaatataaagtaaatatactcttgggagtactaacaaataagatgaaaaattaaatcaaatcataaaca

SEQ ID NO: 54810 - DNA, 365 bp, Heterodera glycines
  Genomic contig location: Contig_ID=SeqID_24109; Location=871..1235; Strand=-
  SCN-specific regions: Sequence locations=1-178,201-334,355-365
atggcggcaattgagacgaaaaacggaaacattcaaccgaataatcggcagaatgactcagcggaatttttgagatttaaccctccggcgatttttatcatttcttcggatgacgaagaaacaaacggaaagaaaggggcgacggagggaatggcaccggcggaaggcgaaacggcacggaaaagggaaaaaggaacagctgagaactgagaagcattgctttaaacgcacccattgatctcacttgacagaacagcttttcctgtgcacaaccaaacatttgtttattttttgcctttttccatttattttaattttattttcacttttttaaatttatttatttatttattttgcgaaataaa

SEQ ID NO: 54811 - DNA, 358 bp, Heterodera glycines
  Genomic contig location: Contig_ID=SeqID_4536; Location=186..543; Strand=-
  SCN-specific regions: Sequence locations=1-358
atggcggctggttgttggcacaacggcattcgcccgaccgacagtatgaaccaggccataccttacagtaagaaattttgaaaaattatccattcaaaattgattcccaaatatgcttacagcttcgcactgacggttctaaacaaaagaggaagttgagttgtttcagataataaaatgctaattttttgatcattttaggtaacgttttggcgggtcgggagttatttcggctccaaatgcaataaaaaaaattttaattgtccatcaattttagaaaattgatatcttttgaaggagctagactttctcttgtagcctggaaaattcaaaaatttcgatatgaaaaaaaaataaa

SEQ ID NO: 54812 - DNA, 2946 bp, Heterodera glycines
  Genomic contig location: Contig_ID=SeqID_4536; Location=34..2979; Strand=+
  SCN-specific regions: Sequence locations=1-673,723-826,900-1017,1039 -1256,1280-1292,1322-1695,1721-1945,1967-2092,2115-2645,2667-2946
atggcaaaaccattcctcccaaacagagatcaatcctggcgagtctggctgtacacaggttggttttacaataatttgttattgaacttcacaatttaacaatttattttggacataaaggaaattatatattaccaaagagaacgaaaaactttatttttttttcatatcgaaatttttgaattttccaggctacaagagaaagtctagctccttcaaaagatatcaattttctaaaattgatggacaattaaaattttttttattgcatttggagccgaaataactcccgacccgccaaaacgttacctaaaatgatcaaaaaattagcattttattatctgaaacaactcaacttcctcttttgtttagaaccgtcagtgcgaagctgtaagcatatttgggaatcaattttgaatggataatttttcaaaatttcttactgtaaggtatggcctggttcatactgtcggtcgggcgaatgccgttgtgccaacaaccagccgccatttcgaacccgggatggccttgtctgtcttaactacggcttttgtcccctgaatggtaacaacccaaagtttcgaattgaaaatcaggtaaaatttgaacaattcttatgctaaaggaatttatgctttgaaattttcaggtccaacaatgttatggtaaatacaattaaattaaattttaatttaaaaaaaaatattttaagatttaattaacgcgtaggtaaaatatttaggtggcgcagatgctacttgtgaggccattggtgccttggcatatgactgcatatgcgacagtgaagattgcactgtaaaaatggaataaaaataaaaatcaaaatttttaaaaatactttaaaaaataatttatacaaaataatattaaatttaattgttgaataaatttcttcaggttaataacccaatcagtttctgttgtccgtcaaggggtaatgctaatattttttgctacttaagggttatgccacccctcaaaattggtcaaaaattttcaaaatttctttgggtttcaaggatgctgatcaagattttgagaattcagggctttggataatttaacccggatgaatccttttgccgttttcattgtttaaattttcagcttttgcttgtattcaaccacctaatgagggctttacacccccgggcggtggatcaagtttgaatcactggtaccatgatccgatcacaggtaagcttaaaaagcattgtgccgaaatcccaaagcccaaattttattttaaaataaaatagaattctacatcgattattttaattattttccatttatttatgtcaaatgacccctccaattattatattttaaatctaattcaatctatcaaaatagaatttaaggcgagtgccgcgaacttaagtaccagggatacggaggaaatgcgaacaattttgccaccaaagaccattgcgaagtagcttttatctcatttacggtatttacccaattttaaaattttttagagttattgtaaacaaagtgagtgctttttttgttgaagtaagaaaaattaaattttcagcttgcagccgaggccttcctctgtatagggaccgtaccatgggtgttaaacaagagccagtatactgtcagggtgctgacaatggttgtacaagtccaaactatgtgggatttgcaaatttgaaatacaaaatttaaaattattttaaaatttgaaggtttgcacggcaatgggcacccttcaacagtgctgtccaactttcagttacctaattaggtgtaataaaaaaaaacaaaaattattaagtgcatatttgttcacgaaatggtgcaattccaaccgaagtgtacaacactgccggtggccttcctacagaatatttcgatgttggagtgccggacggtagcgaaaagttaccgtatttcctataataagccccctggggttttattttttgaacccccttccccccaggaggggggctttatttcagggagggagcactaattgaggggggggggggctttatttgtcaacctctctaaagaggggtattcagggggctctaatttaggaaatacagtattgaaaataaaattaaaaatcatgaaatttcatatttttttaaacttttctaaggaagcggtcaaacatatccacgattttattatgatgccagagagggaagatgcattcaattttctgtgcgttttgctcattttttttgttattttttttcttgggatttatttcactgcttcagtttcttggccaaggcggtaacttcaacaatttcttgtcccaagatcattgtgaaaaattctgctcaagaagtacagaaaatttttagactaagattttacattaactaaaaaattttgaagtatttcagttatatgtgttaaaataagttgtaaaaaaggcattgagtatttttaaatcattcccattaaacaaaaatattccatgaaaatattttcggtataggttagcgctagagctgctcgagactctcactctctactctcgttgttgatcaattctcgttctcgggtctcagggtcatttatcagtctcggctcaagagtctcggaaaattttgaggctcaagcagccttagtgtagagcacgatgggtgtgcttgttgtaaagggaaagtgcgggacggatcaatttggcaaattcgctaattcaaaatttactactaattaaatttcgtctttttttgccctgatcatagtctaatgccaacgacaattaaattcagtcttatgcagtgccggcgagccgttgaaggacagtagcggtgagcgaaacatggaatgttcgccgaccggaagtggcaccaattcgtgcccgtcaacacacagttgcgagtcaaccaccggctcaacaacatttggtggaatttgctgtccacggactcaatatgtttgcaa

SEQ ID NO: 54813 - DNA, 4327 bp, Heterodera glycines
  Genomic contig location: Contig_ID=SeqID_4537; Location=1..4327; Strand=+
  SCN-specific regions: Sequence locations=1-232,254-360,382-509,532 -672,694-897,948-981,1028-1382,1419-1616,1643-1778,1847-1908,1930 -1979,2052-2130,2181-2352,2374-2533,2555-2574,2596-2883,2906 -3234,3256-3367,3425-3429,...
  SCN-specific regions: Sequence locations=...3451-3791,3813-3865,3889 -4327
tgcagaaaaagcatgaataaaattattttacttatggatttgcaaaatgcatcttatactatcactgtttcgagatttcgaataagtgtgtaaacttggggacccgtgcccggtttttttgaattgtcgggtttttattgggtttgcctgaattattattttcacttaatagacataagatttgatataaaaatgcataaaattgacaattgttggtgactcatcagaaataggaacaaaatttacaatttggttccggcatcgcctatcggcaccgccgatcctctcgtgtttttttttttgttgttaaaacatacagtaaaaaataaataattgtaaaaaagtaacgtatataaatgctgaattaaaattatttctcctagaaaaggcagaataggtaaaatcacacaaattcaatcatatgctataaacttttattccaatttttgagttttcgcgatagaaatcctgtcttctttacaaaaaagcaaatagtgtatttttatgtcaatcatttttcttttatttcttggccaatttgcggtccaaattcattgtttaatttcggccttaataattatttttcgtttaaaaaaaggataaaaacgtatgctttattaagcacttgccagacattttcattcaatgggtgtgacggcaattccaacaattttgctacacaacaggactgcaaggattactgtcgagttgagaggtagattttaccatcatttaagagaagaaaatttttatcccggcgaaaaaatgtttcactgtcgagcgggataattagttaacgaaaaacgaaatcaaaagtctgacttatggccaagacctcgaaaaaatccactttcggaccgcaaatgtcgggacacttaattttttgactttttttgcatttaaattaattagataatgtgttaaaaaattctttaaaaatattatttccttttcagctgtccggacggtggcgaagttggcaaaaaaaaaaaaattaaaaaatacattattaaaatttaaaaaaaaaccaggtttggaaagagcccaacggcgctgtgcgcccatgcacaacaaatcggcaatgcccttccacacactactgtacccctgttactgtattttcgggcaccgtataccaaacaaaatcactgtgttgtccatccaaaaattttgtttgctcacaaccaaaggttaaggaaaataactttttttactggaattcttacaaaaattttaggaccaaggtgttagatgtagcagtacccgaatcacacgacattttttcaatgctgacacaaaaacttgtcaaccatttgagtataacggatgcgagggtaaaaaccacacaattcaataattatttttaacgtgaaatttaatcgattaaaaaattaattaataattaaagaaaaattaaaggtaatcggaataattttgccacacaaaagtcgtgccaaaattactgcttgagtgaagcttgctctccgggtactgttgtggccagagactcagacaggtggattcgggaaccattttttttaaaccgaaatttttgttttataaatttcaacctaaatttttagttttataaatttcgtagagcttttagaaaacccataaaataaaatttaattaattattaggcttattcaatgcacaaatcctggtggaacaggacgggttagtggcggttgtcctgatggatactcatgcttcagcaggtccttcttcaaatccaactatccgatagttcagctacatttttcaaaaaatgcatcaaataaaagtttttaaaaaaatttatatgatgaaaaattattcccataaaaaaatttatttttaaaatgacattttttgcttttcaacccgaattttattatataaaagccgacaaaattgtttttttttaaatttatgatcagaattggactgaattaaagagtctgatcgaaatttattaacagtggcaagagaatttgtaaaaattaatatgaattttattttttaataactaaattcttatttaaaaataaataaattcttatttttttgtttaagccttatgcccagctggctcttcaccgttcatttccgcattgtcactacagcctatgcaatgcactccaagtgatatattttaattacaaaagaattttaaattcatttttttaataaaaaaagagtttaattacaaaattcaactttcaacttgtttttcatttttagttcaatcattaaaaagaatttttaattgttttttgtccaaaaatctcaaaatttttgttgctttttccaagtttttgaagaattttttaagaggtcggacataatcggtgcattttttaattgaattttggtaattaattcttcaaaaatgccggaataagggcgaaatgtccagaatttgaacataggtatgtgcacatcatatttatttgcctcttctgaagcattaaaaataattggcattaattaaaatgtcagagaatttaatttcgctcaaaacaataaaatcgcagtcttatgcgaaacaaaataaaatgtttttctgatagatgtggatggctcttgtcctggaaatttcttctgttggttttccactacaacgtcatcagtgaacgcgttttattgttgccgttcgccggaaagcagcatcgacacgggatgtatggaagaatgtggtgctaggtcgtttgataaatccgccaatttagtttttcgacaaaaaatggcataactttgcttaaaggtaatcaaattttacattcttggtataattcgatagccaagttttttctctattagcctgcataattcaaaaaaaattggtcaactttggaaaagttgcatgaaaaaaagtactatttctgccataactatgttaaatttggtaattttatttgaacttaagcaagctaatagagaaaaagatgggctatcgaaaggtaccaagaatgtaaaatttgattgcctttaatcaaagttatgccatgttttgtaagcatagacaaaaacagtaaataggtgacatataggaaaatgattatatcaatgttaattaagtgaatgaattttagaataattatcaatttcaaataccctaattcattttcctaatatattaaatagagattttttaaagaaatcgttatataacgttctttttaatatcataaattgaaaaaaaaacatttatagtgccatacattcattttcattatgaaattatttcattttcagtaaatattaggaaaaaattaacttagattgtcctccacaacttgtgccggtgcctggcgaaggcgctacaccctacagatattgctctccgtcggcaccaattaacgatggcattcaggtccgagacatattatatttataatagtattttttaatgtttaaattgtatttttaataaaataatcacatataataatacatatttgaaaaagggatgcggtataaacagacattgccaatactcaacaacactcgaacgctacatttgttgcggacttgagagcgatgtccgactaccaagtagccggggggatttatcggtggggggcaattcggtttccgcttttaggaaaccataacttttttcttttctttgatgacttataagactaaaaaaagttatgacatacggcgccaaaaagccaagtaaaagtcaattttttgagcttttttggccataacttttttgtaaagcgacccaattttttactaataaacagaaaattaagaaaaaaaatggaaaatgaatgattctctttaaaattctacttaaaatttttaaaatttaacagaaatctctagtgaaaggacatcttttttttctgaaacaagttgtcaccagaaattttaattttgtttttaaaaatatgctgtattcttggaaagcttaatattttcaaattacctgtaaattgtttggtacaaatgttgattatgcttggcaatgcaaatgtccgtgcctgcggcgcaaatagtgcgcgaaaaatttaaaaaaaaagctgtctcattaagtattttaaattgaatgcatagtgaattttcagatgtatgtccgcctcaaccagcaaatcttgttcccgttgaattggccggtaactaccgtacctgtaatccatacgccaggtccggcaccccacaggtcagtgattcctttcttcttatttattttcttcacattattttaacgcgtttttaaatcaagaatttttgaatttttaaggcctgcccagagaattctgcatgtctgtacacaggccaagacaatggctttatatgttgccgagtgcagctgcaaagttcgcccttt

SEQ ID NO: 54814 - DNA, 399 bp, Heterodera glycines
  Genomic contig location: Contig_ID=SeqID_24112; Location=198..596; Strand=-
  SCN-specific regions: Sequence locations=1-65,87-180,221-399
atggataattatgcattggctgttcagctggataaggaggacaaatggccatattttgcactagttcatcaaaatttaaaactgaatcagtatccacgcttaggcagtataatttcagtaccaaaagtggaaaagcttgaatattttagttcttcgaattatgagttatactcacaaaacccaaaagaggaaagtgggactatttataatattataaaaagtgtaagaaatgagataaaagcaattgatgtcgattttaatgtatatgatgatgagagtaatgatagcataaaccagcgattctttccgcatcaaattggaccggatctacaaaatctggaccttgtagatgaagcatgggcgcagataactggattcaaaattcaaaatccgctagaa

SEQ ID NO: 54815 - DNA, 430 bp, Heterodera glycines
  Genomic contig location: Contig_ID=SeqID_24113; Location=525..954; Strand=+
  SCN-specific regions: Sequence locations=1-221,243-430
atgaatttttatatttttttccaagactttccaggttttcaagacatttttagttttcagatcaaccagaaggagtgaccagatcatgaattaatacaaatgttgtattagcattattttttgtcagatcttatcaagtacacaaaattaagtgtctccaaatttgaagttataattttaaacgccgaatttgtgcgaattttcatgaaaaaatgcaccaatagtttttcttctacatatttctcaattttttttgtggttcttaatctttataagggcacacatccatctcaaaattcgtctacattaacgcaaaaaaaacagtctaccagcgaaaatcagtctttgatgatcatacagaatgccttcaatgcgctcaattttggttttgatttcctcgatggtgttgcttggaagaagatcactgaat

SEQ ID NO: 54816 - DNA, 397 bp, Heterodera glycines
  Genomic contig location: Contig_ID=SeqID_24114; Location=538..934; Strand=-
  SCN-specific regions: Sequence locations=1-145,168-212,235-307,352-397
atgccgcaggtaatgaaaaaagtcattttcggtgataatatgttaaaaattagagaccgagatttccgaatctgcagtgccgggctgactttttcaggagctaccggtttcctggccatgcctctcaaaaaccggtcaaaccggattttcaaatttctggacccgggaccggtttacgggttagtcgaaattataaattttcacatgtttatttaggaaaaacccccaaaatttcatcaattttatgtagaaaatcagtgcacacaaaatgtcaccgccgaaaattcgtcgggatataatgtcaccgaaaaaaaaaaaatttaagaaaatttaaaaaattttagtttttttgagcacccagcagcgcctatcgacatcctatgaaaaaattaataaa

SEQ ID NO: 54817 - DNA, 383 bp, Heterodera glycines
  Genomic contig location: Contig_ID=SeqID_24115; Location=754..1136; Strand=-
  SCN-specific regions: Sequence locations=1-383
atggcacttgaacagaggaagatgtacgaaaaacggagagccgagagaaatgcagagaaggagcggatgcgttgggaactaccacgcggaatggctccgagaaaggtgcattatgccacgcatcgagggatcaacaaaaggcggaaatggcaccgtggacggcaccttaatgagagccaaactgggcggaagtaccgacatccacgtgcccatgacatttctccgctacggcaaccaaatggcgccacaaccgaattgctggccccaagttcggagatggaaggacaaattgggaatgacaagcagacacgggaggagagccaaataaaggagcccgtacagtcccagcgacgaaccaaggccaaagatccgctggacgaaca

SEQ ID NO: 54818 - DNA, 708 bp, Heterodera glycines
  Genomic contig location: Contig_ID=SeqID_24115; Location=1283..1990; Strand=-
  SCN-specific regions: Sequence locations=1-681,703-708
atgcgaaaagtcgaaaatctcttgaaggggagggatggtctcgcgcgcccggcccgagtacacccaaaagcaaaaactcttgtgcgagcgattaaccttttgtaccctctagaaattaacccttctgcggaggacgaagtcagtcaaattcaagtgactgccattatggattctccaagtgctgtgatgcaaggcatgtacttgcaatctgtcacaatggagtccagtttgcctccagggacggtgatgcaggattctcaaatcgtcacgacagaatcgagtctatctccagtcagagggaggaatgagcggcaaccaaggaaggagagaattcgaaagagacagtcgaccgaagacgtcagaggcaagcgcaaaccaaagacgaatgggccatatgatccactgcgcccgggcaactacagaattcctcgccgaaacccgttctttccgtcacaagttgcgtacaatgagcaaacacgcacgtatcgacgacgacgggggaggacgattgatctttcgggattgaggaagttgttcgctggattgggcggcactgaatttgtgagacgagagctgcaagagaaggctaacccggctctaagagaagaaaggctgcgaaaagataaagtcaaattcatggaagatgacgcgaggcgcgtcgctgagagtgaaagaaaggcagcacaggagaaagtggaaaaatcatga

SEQ ID NO: 54819 - DNA, 672 bp, Heterodera glycines
  Genomic contig location: Contig_ID=SeqID_24116; Location=718..1389; Strand=+
  SCN-specific regions: Sequence locations=1-354,376-414,436-462,484-672
atggccgaacattcggaagacaaattggacgaaactgaacgcatttttgaaattgcaagagtaatgtggaaagcgatcaaaaagcatgacaaagtgcgaaaaagggatgtaataagtcaaaaaaaaattgaaaaacatttacagaatgccgtgggcattgtgccgcggttgcgcttcatcggtttagtgctttggcatttggcggttcggcaaagtccgctaattgaccagcagcagcagcagcacaacggggcaccactgctggagttcactgccaaaatgaggccgaacattgacccgcatgacccaacggaatggcaaacgatgctttggcatttcgaccaaaatttggcgaacgcagcgatggatgcggaggaaggccaaaaagaggcgaatgaggggggaattgaggacggaaaatgggagggggaggaagagcaaaatgatggggaagaaatcaaattgctgagagaattgggggagaaagtgggccaaggccgggcacaatttggggaccgggaaaggcacgccgaactcggcaaaaagttcagtctgttgaagaagtcgactagcaacgacggagcagcccatgggatggtcaacttttgtgttatctatcgagcatttctcgtgttcggctcacaatcagtggacattcttttgttcatcagg

SEQ ID NO: 54820 - DNA, 778 bp, Heterodera glycines
  Genomic contig location: Contig_ID=SeqID_24117; Location=1..778; Strand=-
  SCN-specific regions: Sequence locations=1-778
  Gene Ontology: Biological process=body morphogenesis (sensu Nematoda)
gtgatcgccggccaggtgtacgaatggagctccaacataatcccattccaaatttggggcggcgatagtcagttttatttttttgttactttttcgagagtctcgtctcgttaattgcttttcccaaactgtttgatgcacctccccaatttagcaaagtttcaaaatctgatcagaaggggcattaaaatgtgcgtgcatcgattattccgccgtaattgcctcccccccccctttctcccgcttttcaggtgggaggagtcgacctgcttacggttccgcgagaatgttcaggcaacagatgcgattagatatgtgctagagcggggcgacaggtctgatcagagagcgataaggaaattgatcggagaatggaagagaaagagtattagctgatcagagaagaagacatgattgatcactaggcactgatcagaggagtagcaagggaagtgatcaccgtctcggataactccgatagttctccatgttgggctcattctgtttgatcagcagcgtgtgatcaatgtatgaaatccctgctcattttagctgcttcactgagtacatcggtcgcaatggcggcttccaggacattatcatcggctcggaatgtgccgaggtttcgtgttggtgccaatggcaaaatttaatggttggcacttcctctgaccatgtaggaatatgtggtggcacacgaaacggggcacgccctgggctattggcacacgcattaaggggatcagtgccgtaaaaaaccaaaatagataattgcttg

SEQ ID NO: 54821 - DNA, 661 bp, Heterodera glycines
  Genomic contig location: Contig_ID=SeqID_24119; Location=716..1376; Strand=+
  SCN-specific regions: Sequence locations=1-219,241-353,375-377,403-661
gtgatgatattgtgttgttgaaggagggcacaagagtttgtggctctggtggaattttgggtatcgataaattgtccgaaaaagagggaattacaattggtttttaaaggaaatgtgccacttctacaaaacaaatcttacttccaagtgcacatccatcagtcgggtaggccaaaattccactaaaattgaattgtttttttttgatgccaaaacaaattcaggaatttggggaatcggattgggcaccagaaaaactgatctttcaaaggcaccaattgcggacactgcgtggatgttgctaaatgatggcacaattttaatggacaatgaaattgttgggaaagtggagcagcccattggagaaggggaaacaattgtaaaaatatttatttttcaaatccccttaaaaaaggcgaataattaaagaaaatttcccattttcatggcgtcgcatttgaccatgttgagctgcacttctacagggggtggcgtgccgatttggactggtccgatcaaagcgtccgatgttggactcgttttctacccgtgtttgtgcattgatgagaattgtgttttggatatctgcttcagtgcggctaaatttagcccaaaagcgccattgggctatcaggagataatgtctgaacagacattgctt

SEQ ID NO: 54822 - DNA, 1776 bp, Heterodera glycines
  Genomic contig location: Contig_ID=SeqID_24120; Location=82..1857; Strand=+
  SCN-specific regions: Sequence locations=1-239,261-410,432-741,763 -913,935-1074,1096-1504,1526-1776
atggcaacaaatcggctggacgtcctcgccttggtgggtctttgtttaggatgattagccagccaaatgtcttctcttgcgttttttggttacatggcattttacgcgttaaaattgccaaaccgattttaatgactcctttaaaagccatgtaaagacgcataaatcaaagaaaactcaaaattgccaattttacaagaaatccgcttattttcaggtgatttctgtcccgactcccgcccgatggttcctccgctggtcattttctgcacttacttcttggaccactgcaaaacatacatgccgtacagggacttgtaccaaattgaggggtaattctttaacgaaacgggcaaaaagaaatttggagggcaaattgatgaccatttgattattttgggccttaaattgaaaatttccaaggaaaacattggttccgataggtgccataagtaaaaattgcattttcgacaaatcattagtggaatttcatcatttttagaagccccgctgaagtggaggccgtcacaaagcaatttctcgccgcaaacaaaagctacccgaaattggtacaaatttacaaattatactaattattatttgcccctttttaggacgcttttcctcccgctgtcatttccgcttgtgtcaacaaatttttgatgcaaatccgcgacccgttgatcccctattcatatggcaaggagatttgtgcacttttggaccgctgtttggccatcgatgggcccattttggagggatttgccggcattgtcgaggatttgccagtggtaagtgtttccatttgctgacttttttagacctattcccattaaaaggcgcacatggacacgttgggtcacttgtgtcgccattggaatcgtctggtcgcgaattcggtgagaaaatcgtccaaaatttttgcatgaaattcactgacattcgtaattatgccataaaattcgttggcccaattttccactggggttttcattttgagacttttcttccatttcatttggttatggggcaaattttatggtccaaattgctctttcctgaattttcagcatttggcaaaattctttctactgacaatgagtcatgcatgcgttatttaaaaaattttatgtccattgaatttttggcataatttcctagtttgattgtcgaacccttaaaattcggacaactctgacaattattgaaaattgtttaagttcggtctgctgaccatcgacgcgctgtcagttccgcttggtccgctcgttttcggctccgctcgccctgactgtccgccgctgctgcgccaccgctgcgtcagtgccatggcccaattgcttcggtttggcaacgacgacttctggaccgacacttctgtccgcacactgaccaccagcagcagtgggggcacgccaattgtgcgcaatccgtcgcaacgctcggcacggagtgcggtggtggcggacggcggcggcggaacgccacagcagcccaattttggtaatactaattcattttgaaaaatggagtacgtggtcggtacccacattctattatttcagaaacctaaagtccaattggtttaaaaagatgacatttgaaagataagactcaatcgcattccattagcagataccgctaatgcttgattattcgcaaatctacacggtcagcaactaacatgtttatcttgaaatttgcgaaaaagctatcgaatatgatcaaaaattcaaattttgataaaaaaaaaacagataattcgcttctaattaa

SEQ ID NO: 54823 - DNA, 598 bp, Heterodera glycines
  Genomic contig location: Contig_ID=SeqID_24121; Location=237..834; Strand=-
  SCN-specific regions: Sequence locations=1-463,485-574
atgttggtttttgagaaaaatgaatggcttccttccgcgtcggctaatgacacaaaaaaggtgggataaaaaatggggggataactaacaataaatagggctcggaaaatacggatacaaaaaaaatcacgaaatatggccataatgccccaaaatattgaaaaaatgtggaattgaaatatggacataaatcgcgaaatattatagaaaataatggaaaatatggatattgaaatccatcatagaagcttcaaaccaagctataaatatgtttttcaggcagcctagtcacagtccaggaaaaaagttgggatttccatacaattccgaaccctaacaataaatgtggtggtgctgatttctattaaaaatttcagcagtttgttctaacaccggtttttgaacgaactcatgaaaagaaaagaactcaaccatcgacgacggtaactgttcagcaacagttgaggaacacaaaaaacaaaattggacaaagtcatggcacaacaactgcaaaaagcacacagcaggttaagttgggaagatgaaagaaatttttttaactaaaaaataattcttttccttaaatacaaaaattaaa

SEQ ID NO: 54824 - DNA, 3080 bp, Heterodera glycines
  misc_feature (1291)..(1291): n is a, c, g, or t
  Genomic contig location: Contig_ID=SeqID_4539; Location=494..3573; Strand=-
  SCN-specific regions: Sequence locations=1-234,272-489,512-632,663 -1037,1090-1236,1281-1542,1564-1599,1644-1711,1766-1913,1945 -2164,2186-2315,2397-2456,2514-2746,2768-2869,2906-2963,3005-3080
gtctattaacaaactaactcttccaaggtcacacatgtggtgaatttggtgaaaaggattatcgcctttttcttctcacatgttggactttgtgcattggttcgtcttttttgactatcctctatctaatggggttaacaatttttattgtttttaggtgataggatatgccatgttaggtgccgttgttttccgtgccgttgaaggcccacatgaggtggataattaatccacttaataatttaaaaaataaaatttaatatttaaaataccatttcatactgttttcagcgttacatccaaagtgagattactggagctcggaggtgcttttacaatttgttgaattaacaatcaattaattcaaattcataaacaggcatgctgttgacgtggcatggaatgcgacatttcgtgtgaacaaattagacaagacggaatgggaacggatagtgtacgagcaggtaaaataaaaacaaaaatgccaacaatttataaatttaaaaaaattcagacaaaatttttcaaacggaggtgcctttgggccatccatcgaggctatgacggcaaagagtttggccgtgcagctcaatggacattcactggctcatttctctattctctatcggtagaaaataaaaatataattaattattaaatatgaagtatgccagtgaaattttttgagtcttaagatggaattataacattaaagcgaaagttttgaagtcaatcaatttatttcttaatgcgtaggtcaaaccctaattaacttcaagaattctcctaaaaattgatacccaccagggaagtgtgccgaggcactcaaaatctcaaaaaccgaaattccaacggctgaaaaattttagtaatcggaattccgacagttcaaaaaatttcggaatctaatttcgaatccaaaaaggtcggaaatcgggattccgacacattattaatgagtgaaacgttttttgggccaattaattaatttacctgatcgtaatgacgtaaagttggcatatttaggtgacatcatcatttatattcaattacattattaaaaatagtaataaaaaaattttttataaagatcatcacaacaattggatatggcaatacatctgcaaaaacttatttcggcaaaacactgaccattctgtttgcaatcattggcatcccattgatgctgctgttcctcacaaacattggcgatgtgatggcaaaaatttttaggtgaaaattaaaaaatataaatttttaaaaatggaataaaaaattttgtttccatatnttaaattaggtttctatatgctcgctcaattcgtcttaaatacaccatcattttgtggcacaagcgtcgtcaagcggcaaaaattcgacgtgctaattcttgggttgccagctgacccgttcaaatcatccatgtaaggaaaagtgatattgataattaattgctccagttctaaatatttttgttccctttaaatttaaattatatagcttaaaattggaataataaaaaagttaataaaatggcattcgataaataaaaataaataaatagttgtagccaaatatatttcattaattattctgatcaaaaatttaacttaaaaattaattaaagatatcttatttaaaaagagagaaaatatattttcatttttttcacatagaataagtctcaaaaaattgatctctgcgcaatatcataaaaaatattttattatttattaaaaattaattattcaaaatttataaatatctgcgcttttttaacaacagatttgagcacattgcgcttccagcaacaggacgaatgctcgttggagtcaattggccccagtggtgccaatacactgccggtcaatggcggttttgtcactggcgcagcagccgatgttaatgaggtgataaaattgaaaattaataatattttttattgttcaattcttagctattagcagccagagcccatttggtccaacttgaagtcaaggaaagcgtcgaagcccaacttcagcggatatcggtgatcatttatgacgtggattatgagaaaatttttggcaacatttcaaactcttagttttagtgatgtatattaattaatacatatttaaccgctttaatagcccaaaaaggacaaagctataaactaattaaactctaatttatatgtattgaaaaaaatcattaattattgaaagtttcaacaaaaggtgcccctctcgttggttttgctgacaatgcttgcctatctggtgactggcgccattctcttctgtctgtgggaggagtgagttgaaacaaacataatttttattaattaaatatatttaattaaatttttaaaataaataatatatataattcaataataactttataaaattcttcagatggacctttctggacagtttttatttttgttacatatcattgacaacaattggtaaaattattatattttttaatattttattattttttaattatatatttgtttttaaggctttggcgacaaatttcctggcgaagcggttggcagtgacaaggaagcgcaggagaagctggtcatcacaaggtcgtgccaaatatagacgacgactggaattttgaaagaaaaaaaaactcggattgaaggggcttggcaatggacttttaacgaattactggaacaaaaaactgttccaccgtttcttaagtactgtatttcctgaaatagagcccctgaggcctttatttttcaaccacccctcaaaaaggggctttatttcaggggggacactatttcagagggggggggggctgtataataggaaatacggtaatgtaaggaaaacgcagccaaaatttctccgatctctaaaaaatatatatatatatattaattgattttttagcatttatttgttggccggaatggctttgctggccatgtgcttcaacctcgcacaggcaaaaaaaaacaattaaaaaaacaattttttaattttaaaatgttttttcaggaagaagtagtgaacaaagttgcatggttggccaacaagttcaggacgagagaagaagaatatgag

SEQ ID NO: 54825 - DNA, 2841 bp, Heterodera glycines; identical to SEQ ID NO: 4541
  Genomic contig location: Contig_ID=SeqID_4541; Location=1..2841; Strand=+
  SCN-specific regions: Sequence locations=1-75,129-304,367-488,536 -743,771-878,954-1149,1299-1329,1379-1393,1415-1572,1595-1768,1825 -1927,1963-2055,2170-2675,2730-2841
  Gene Ontology: Mol. function=protein kinase activity; Cellular component=mitochondrial outer membrane; Biological process=signal transduction

SEQ ID NO: 54826 - DNA, 308 bp, Heterodera glycines
  Genomic contig location: Contig_ID=SeqID_24124; Location=797..1104; Strand=+
  SCN-specific regions: Sequence locations=1-62,90-102,137-153,261 -261,293-308
atggcccacttggagctcaaacattcaacgcctgggttcagagtcaagcaaccctggcttcatacccatttagagtttgagaataggttaaggacatttcgtccccaagtcctctaatcattcgctttaccgagtataactgcttaacgagctccagctatcctgggggaaacttcggagggaaccagctactagatggttcgattagtctttcgcccctatacccaagtcagacgatcgatttgcacgtcagaatcgcttcggacttccaccagagtttcctctggcttcatcctgctcaggaatag

SEQ ID NO: 54827 - DNA, 1260 bp, Heterodera glycines
  Genomic contig location: Contig_ID=SeqID_24128; Location=96..1355; Strand=-
  SCN-specific regions: Sequence locations=1-31,54-287,325-436,507 -572,614-764,790-886,910-1260
atgcctgaagacagcaaaacgatcgaaaacaagttcaatgaattatttaaaaatggagagcagcgcacatttgaatttcaaacggtgttcaaaaaggaactgctctacgtgattataaataatgtcacagttaacacccaacagaaacggcaacttccggtttgggccgcgaattacatccgggtgagtacaactgctgctggatgctgggatattagtcaaaaaagcatcaaatggaaaattttggacgaaacattatttattattattcatacaataacttccctcaaaatgaaaatcaaattttaaattttattcatgttttcggtagctccaaatgttttctattatactgcaaaatttcaaaaaaaattcattaggtttcgaaaaaagttatgacctgacaaacaaaaaaaaaccaagtttttttttgaacatattttaacaaaataaaaagaaatgaatttaaattatttatttcattcattttttatctaaatattttaccgtttttaagctcgaaggaaatgttacagcatttggcgacccggattatttatatattgaccaggtaattaatatattaattatttatttttaaaagattttaaatcgatcaaataactttagctgagtggcaagatgaaaatcatcagcggcaaaatcgaaaacactgatccgaatgaggtaaaatatttatggcaaaaatgtacaaaaaaaaaagatataaatatatacaatttctctaatattctaaatgaaaaaactttaaaaattttgttaaaagcaatccacgaatgtttcggaagaatacagtactacttaaattgaccgtaacattcccagtcaaatgggttaaggcaaaacataccaaaaaaaaatccccaattatttttttaaataaaatatcgatttttttttggtttttgccatgacaaaattgttttgtaattttttttatcatagctcaatttaccaagtcaaaattccttgtcgataaaatatcaaaattcataaaattttcatttttaggcctaagaatttttcattttttccaagatttttctggtcaaaaccaaaatgctttctaaaaatataaaagtgctgaacgatttcacaataaaattgccgaccttgttcaattatggcgattctgtcgagctgtacgcgaaacgagaaaaagtcgccaaacatgaagacaacaaccgcaacaattttacgttcattttcatgcacgagtcgctggacgaaattcaatga

SEQ ID NO: 54828 - DNA, 523 bp, Heterodera glycines
  Genomic contig location: Contig_ID=SeqID_24128; Location=1385..1907; Strand=+
  SCN-specific regions: Sequence locations=1-6,29-101,123-128,151 -151,184-523
atgtattttttaggaaatttgtattttgaaaaaagcaatgtgcctggattccatgctggacctggacaaaaacccaagaaaatacaggttgcaggaaaatggcctggacctggactttgatcaaagaaaaatccaggcctggatccaggcccagcaggcagatagatctctagtatttttaagatttttttttcagcaaattgtatattttggtgctagattatttgggttcaataaaaatcaaccatccaagagcagattttggatgccgttaaaattctcgagaatagaacccggacgagtcgggttcctggaatggagcccggatttttctgagtcccaaactgagtacatttgattgaacccagattttttctgggttcctacataccggatacatttttcaaaaaaaaactttgtctaaatcattactaagacaaaatccagtacaaatcagaacccggttcaacctcaaggatcaacaaccaagagttcttttacgtataatacatgccatgctgaa

SEQ ID NO: 54829 - DNA, 534 bp, Heterodera glycines
  Genomic contig location: Contig_ID=SeqID_24130; Location=178..711; Strand=-
  SCN-specific regions: Sequence locations=1-139,161-201,274-409,432-534
atgaacaaggaagaatggaataatgaatggaaagttcaaaaaatctttcgtgaaaaacacgactaccttaaaaccattaaagaaatagatgaaattctcgatacattaaaagacgtaaatttggaggtaaaaaggagattaaaattacttaaagaaaaatcatcttcagactcagacccggaagatgaatcaaatgattatgaacatgaaaatgaagacgaagttgaagaacaagaagaagaaaaggaatatgaaagtgacaatgaagacgaatcgccagaactttccttgaatgaccaaatacaccatgatcgtataccatttgtcaattaccgatcaagattaaagcttccaccccaaacgcttacgcattttaatggcaaattctcccaatggcccagtttctgggatgacttcaaatcctcagtggacaatgacccaaatttagaaaatatacaaaaactcaaataccttcgagggctcttacatgatgaaccgtacagaatagtgtcaccgtatccccttaccaataaa

SEQ ID NO: 54830 - DNA, 442 bp, Heterodera glycines
  Genomic contig location: Contig_ID=SeqID_4542; Location=433..874; Strand=+
  SCN-specific regions: Sequence locations=1-288,310-442
atgtctacatcggaatcaaaaaatggtaaaaatctcaattcctcccttaacattaacaatctttcacctacagcaccggacgaaggcgactgcgaaatgcccgatgaacgtgttctacacctcgagtgctttgagagcggtgattatgatgtaaataattgttgaaaattccatttttttccctcaattttaatccatttcagatgatggaattgtacggaccggaccgtgctaaagaaatgctgatcgacttgcgcgactatgcagaggcgcacggaatgccatgtaaacatgtgaagatgctgttgtacaaactggacaaaggactgatcaaatggaagggaaccaagccatgaaatggatgatgagtgatcagatattttggtgacaggacgaaggggggatgattgaactcattggtgatggatgtgatttaaaaaaa

SEQ ID NO: 54831 - DNA, 614 bp, Heterodera glycines
  Genomic contig location: Contig_ID=SeqID_4542; Location=3281..3894; Strand=-
  SCN-specific regions: Sequence locations=1-160,182-354,376-417,439-614
ggtgcgacttttggtcgtaaatcggagtcaaattttgatggttttagttccaactttgttggcttctgaggctctctctttgcggtaggacgcgatggtggtggttcaatttttgctttcgcacgaggcgggagcggaagccggggaggtgaaggtgggtaatgaaccctgtattttttgtgttccgaatcatcatcatatgcttcgtccttttttaattttcttctgatggcaatcctctgctgagcagtgtccatatgctcaatttcacgttgagcattgtagggcagcataggcaagtcgccatagtattgtgttggcgctggcagcgctaacccactctccaacatataatcatcatctgtatcactttccggtaagggggcagcagctgcttccgcaagaaggtcccgcacaactggttgccgtcgttgtatatcatttcgccttttctcccactgctccaaacgaccatctctccgcgatgccctagtcggtctgggaggacgttgtgggcgaggcggaggacttcctggcggggatggagcgcgacccggaggacttggtgggcgccgatgacctctcttaggcggcggtggtggatgtggtggagg

SEQ ID NO: 54832 - DNA, 979 bp, Heterodera glycines
  Genomic contig location: Contig_ID=SeqID_4542; Location=1524..2502; Strand=+
  SCN-specific regions: Sequence locations=1-188,212-927,949-979
atggcagatgccatgcaggacggcgcacgttggaagaaggcgaaaacagcaatcaatgtgctcggcaacctccttttggcggaatcgttagacaacacttccgctaatgacacttcgctgaaaaatgataccgtagacatcaaaaaagaagaagcaaatgtggaggaagaaaaggtgcaggaagagcccaaagaaaaagaggaaaacaaggaggaccttggagacattgacaaaaccctcgatgagttcttcaacagtattaaagcatccacttcaaacatgtagaccatcattgtgtgtaaaaatgttaaacacccaagcattcaacgataaagacattggctttaaattaccatttggtctaattatttcgggcccatcgtcgtcgggaaaaactcaatttctgctaaaattcattgccgaatcggaccatttaatcaccccaaggcctgtatcgatgctctattgttttggtgaaatgaatgcggcggtgcctgtacttcaaaaggcgggagtcgatgtgtacgcgggagtcccatccgaggaattaatcaaacgtatcccgaagccccttttgctcattcttgacgatctgatgttgtccatcgatgagagatacctatccgatttgttcactaaaaaggctcatcatcaccaatttgcagtggtgtttgtcacacaaaatttgtttgagcgcaagataaaagtggcccgtctttccgctcagtacttggtactgatgcgggccccaaattcgttgctgtccatccgcaacattggcgttcagctctttccgcgtcagcttgacttttttcttgacgcataccgcaaggcgaccgcccggccctatggctatttgttgattgacatgcatgcatcgtcagacccatcgctgcgccttcgcacaaatatatttaaggatgaacaggaggaagatgaaggcacagtcgtgttcattcccaaaaatggagcggcataa

SEQ ID NO: 54833 - DNA, 1731 bp, Heterodera glycines
  Genomic contig location: Contig_ID=SeqID_4542; Location=2924..4654; Strand=+
  SCN-specific regions: Sequence locations=1-303,329-533,555-596,618 -790,812-1156,1178-1348,1381-1731
  Gene Ontology: Mol. function=pre-mRNA splicing factor activity; Cellular component=nuclear matrix; Biological process=chromatin -mediated maintenance of transcription
atggcgaataaatttttacttgtccctcaagaaatttaccgaggtctgacctcaatgtcggacacgggcgatattaatttggatgccgttaggcgtgacttagaccgcgccagggtcgaacgaacacatccttctcgcaaaaatgtcaactacaaccagcagcttaggcgatatttaaaaatgcggcaagagttaacagacaaaccggccaaagttgagctcaccaaagggataagcgtgctgttgaggcgaggcgctgaagatgaggagggtgaagttgtggacactccaccccggcctcccgctcctcctccaccacctccgccgcctgggcgacgtccatggcgtgggccaattcctccaccacatccaccaccgccgcctaagagaggtcatcggcgcccaccaagtcctccgggtcgcgctccatccccgccaggaagtcctccgcctcgcccacaacgtcctcccagaccgactagggcatcgcggagagatggtcgtttggagcagtgggagaaaaggcgaaatgatatacaacgacggcaaccagttgtgcgggaccttcttgcggaagcagctgctgcccccttaccggaaagtgatacagatgatgattatatgttggagagtgggttagcgctgccagcgccaacacaatactatggcgacttgcctatgctgccctacaatgctcaacgtgaaattgagcatatggacactgctcagcagaggattgccatcagaagaaaattaaaaaaggacgaagcatatgatgatgattcggaacacaaaaaatacagggttcattacccaccttcacctccccggcttccgctcccgcctcgtgcgaaagcaaaaattgaaccaccaccatcgcgtcctaccgcaaagagagagcctcagaagccaacaaagttggaactaaaaccatcaaaatttgactccgatttacgaccaaaagtcgcaccgccacctcggccgaaaaaagaacctgaattcccgcttgaccctcggccatccacatccaggcaggctgtacacttgcctccagcacccaaaattataccaaaacctgaaccgacaaagaggcctgtgccataccgtatcccgaaaagagagccaaaaatagttgaacaacagccacagccgctgcaacaaccccttcctgcttctgccgtcgaagaagaaatgcccaccgttcctccgcctaggcgggggaccaaacgccactaccccgtaaatggtgagaatgatggtgaggtgcgcattagaaaacgggtgaggcaaccgagaagggtgagagtacagtactcgcctgaaccgggcccatcaacttctgcacaaagtgatgaacaacagcaacaacaacaacgtgaactgtttgccatcccgtcaaatcagctgaccatgactcagcgggtggaacgactgtacatcaaatgcaaccattatgcggatcgtatgggcgttcggggaaatacaattaacacagcaaacggcaaaccgttggcgcatagcaatttgcgaatggccctcaagtatataatagaccggagagcgggccgccccaccattaaaccacctggagcgaacctattggaagagcggcttaggaaggacccaattttgtattcatggacggctccgccaaagagaccgtcacagagcaaaaccacccggacggaacggacaatcaagaaggaatttcgcccgaaaaaatggagctga

SEQ ID NO: 54834 - DNA, 1196 bp, Heterodera glycines
  Genomic contig location: Contig_ID=SeqID_4543; Location=253..1448; Strand=+
  SCN-specific regions: Sequence locations=1-572,594-981,1003-1162,1187- 1196
atggacggctcctccaaagaaaacagcacagagcacaaccaccaggacggcaccgaaaatcaagaaggaatttcgcccgaaaaagtggagttgatcaactccacgcttgacaagctgtacaacgacccatcctccccagcggcgttcgcaggtgttacagcgctgtggaaagaggcgcgaaaaaagttgaaaaatttacggaaaaaggatgtgcagcattatttggaggggcaccgcacctacactctgatgcgcccccgaagggtgcgctttccaagagccaaaactgttgcggctgggttcatgaccgatgttcaagtggatttggccgattttcaggcgcttttgcgccacaatcggggtcaccgatacctgcttgttgcggttgatgtgctgtccaaacgcctgtttgttgtaccgctgaaaaacaagagagccgacgagatgttggaggcattcagacaactcatcgaccaaatgccaatggtcccacatcgcatcttctccgacaaaggcacagaattcaagaacagattgctgaaggaattcttcgatgagcaggaaattgagaaacatgagccagtgcattcatctgtcaaggcatccgttgctgagcgggccatccggaatgtgaagcagagattgtaccgctattttgcggaaaaggagacgctgaattgggtggatgcagtacagaaaattgtggatggaattaacaacgctccgtctcgtgttcacggaatgcgccccaacgatgtcaacttttcaaatgcgcaaaaggtgtggaagcgactgtacggacaccctactcttcaaaagcggacgccacgcttccgtaacgaccagtttgtacgcatgagcagagagaaggggcaatttgagaagggatatttgccaaattacggggacgaaatcctggagattgacgaggtgttgaaagcggtgcgcccgattcggtacaaactgagggatgaacacggggagaaattcaagggcagcttctatgagcaggagctggcgcgcgtcagaaaagatgcggagacgagctaccgcatcgagaaggtttacagaaagagaaaactgtcggatgggtccaccgagatgcttgtgaaatttataggatatcccaatcgggaatggattaatgagtctcagcttgtataaaagcatatgtattttttcattttgttgaaaaa

SEQ ID NO: 54835 - DNA, 423 bp, Heterodera glycines
  Genomic contig location: Contig_ID=SeqID_24136; Location=1285..1707; Strand=+
  SCN-specific regions: Sequence locations=1-232,397-423
atgtccaaaagtgcggtgaccaccgtcaccgaatggtcgcctttctttgggaattgcgacaaaagtttggcgtgcgccggcactcgctgccgtgccaaagccattcgatcggtcgctgtgacccgaatccgtggcgacgtcgtcgtggcggacgacgccaactgcgaggagaaaaaatacttggaggaacggctgacgttcaaacgaagacgagtcgaagtcagtggaattggggacgaagcggagggaatggcactgattggagacgaagcggagggaatggcaccgattggagatgaagcggagggaatggcaccgattggagacgaagcggagaaaatggcaccgattggagatgaagcggagggaatggcaccgattggagacgaagcggagaaaatggcaccgattggagagagatag

SEQ ID NO: 54836 - DNA, 324 bp, Heterodera glycines
  misc_feature (47)..(47): n is a, c, g, or t
  Genomic contig location: Contig_ID=SeqID_24136; Location=1632..1955; Strand=-
  SCN-specific regions: Sequence locations=1-324
atgttaagacgaaaatgtgccgacaatggaaatggacaacaaaaaancgatgggacaaagttcacaaagtggtcaaaacattggtgggaattggcaactcaaaaatgggcaaatcggtggtgacagttaagcaaacattggctaatgccaacaacggcacaagagaatgccaatgacagccgtacaaacaacacaagcgaattggcttcagtaaacaggcaatttgccattccttccactccgtcgtcctatctctctccaatcggtgccattttctccgcttcgtctccaatcggtgccattccctccgcttcatctccaatc

SEQ ID NO: 54837 - DNA, 1315 bp, Heterodera glycines
  Genomic contig location: Contig_ID=SeqID_24136; Location=118..1432; Strand=-
  SCN-specific regions: Sequence locations=1-455,672-1262,1285-1315
ccacgacgacgtcgccacggattcgggtcacagcgaccgatcgaatggctttggcacggcagcgagtgccggcgcacgccaaacttttgtcgcaattcccaaagaaaggcgaccattcggtgacggtggtcaccgcacttttggacattggcagggaccggtggagacaatacggacggacacttcgccaataccaccaattcatgcgcaacctgctccaacttcgcgtgccaatggtaatggcaaattcaaaaaaaaaacgaagaaccgaaaataggaagtgtgcaattccaatttcattttcatactcattatttgttcacagattgtcattgtggatgaaaagtcagcagagtttgtgcacagagaacgcgcacggattaattggggacaatggacaaaagtgaaataattattattaagcaaatgataatttgataaaatagtatgtgcagtaaattaattaatattatttttatttttttagatgaaataattatattaaatatttattattgttattaacaagcaacattattttaattataattaatcaaattatttgttgttatagaaatgaagaattttattaatattctttgccttaatcattgtttatttaatttttaaataatttattttaattaattaatttttctttttttaattttgattaggtcgtccaattatcacttgatcaattgcccttggccatcttccaaaagcgcatttcccttctgatggactccgaattggccaattggccctccgattgggacttgtccatgcgaagtcaccccgaggcgactcaggccgaatatgtggtggtcgtcaactccaagccgtactttctggcccaagcggcggtcggcgcattctccctaggcattacataaaatgttcagacagacaatccgtttggcaccgaattcttcgtttggctggacgccggctacgggcacggggaccgcgccattttcccgccctcgtgggaatggcgtccaacattcccgcgcggcaaaatgtccgtgatcaaagtgagccgccactcattaggcatgcctaatcactctcttcagttaacgccgcccagggatttgttgtcacgctattcgctgaagcaactctatcgggtgggagcacaaaagccttggtccgctgctggtcagcggcatttcccccactttagcaggacgtggcggtgctaagcggcggatttttggcgggcgaccgacgagcggtgacgcaattgcacagagaacatcaccggatgtttttggaactgttggagaagggacgagtggacgatgaccaa

SEQ ID NO: 54838 - DNA, 214 bp, Heterodera glycines
  Genomic contig location: Contig_ID=SeqID_24138; Location=563..776; Strand=+
  SCN-specific regions: Sequence locations=1-13,35-214
gttaatggagaaaagaatgtttgattatttttgtcagagagcagctgcggaatggctgacgaatttgccaagccgaaatttgacggcaaaatcttccaaaaccccgacagcttcacaacatggaaaaacccgccttcggcaggagacccgagaagttggcgggacttcattaaatggaaatgggatgcaaagagcacgaaactgcccaatttga

SEQ ID NO: 54839 - DNA, 282 bp, Heterodera glycines
  Genomic contig location: Contig_ID=SeqID_24140; Location=1700..1981; Strand=+
  SCN-specific regions: Sequence locations=1-282
  Gene Ontology: Cellular component=cytosolic ribosome (sensu Eukarya); Biological process=protein biosynthesis
tcaacaaataatattcatttttcgcatttaacaaaatcaacaacagtggccgatcggtggatggtcaggtcacacatcaaaaagatacggacgcaaaaatcgtaaccgatcagaacagacgcaccgcggggcccatcgtcgatttgatgttcaacgagcgcacattttgccaattcttcttcagcaacgagacgaggaagttgacgcccagcgaaatgttcgagaccagttcgtcctgcgacatctcaacatgaccaattgcaaccgccagacagagcacct

SEQ ID NO: 54840 - DNA, 462 bp, Heterodera glycines
  Genomic contig location: Contig_ID=SeqID_4544; Location=927..1388; Strand=+
  SCN-specific regions: Sequence locations=1-79,108-209,232-363,399-462
atgttcaatttcttttttctgctgatcttcgcttcttctgcccaaaattcgtttcaacaaaatgtaaaataaattcgacattattttgtttaatattttatttttttgtcaaggaacatttttgccattcactccatggtaccaatgtctgtgttgagtgtggcccatttgcgacggacaaacaaaaatgtaaatgaaatgaaacatagaaaaataatataataaataattggaggacgatctcggatcatttcaaatcgttgtcaaataattttaaagattgtgacaattgatcccatacattgacaagggaagtctcgagacagacccccccccccccccctcctccttcgtccattttacggggggggggagcaaaagaggggggggggggggggtgaagaactgataacatcaccaactgttatatcagccatctgatcaaaagctgtcatgtctaaa

SEQ ID NO: 54841 - DNA, 1148 bp, Heterodera glycines
  Genomic contig location: Contig_ID=SeqID_4545; Location=79..1226; Strand=+
  SCN-specific regions: Sequence locations=1-163,186-369,394-966,1003 -1040,1091-1148
atgcctttgaaagtgccgcactctccgccactccaatcgctggtcattaacaattcttcgggagcggaagaagcgagaaaaggaatgccaattgctgtagtggtaagtcgttaatacattaccatcaattaaaaaaccaaaaaaatttaatttctattcactgaaaaatgagaactaaatttaattggttgtaactaatcacaataaaaagaattactgttggatgagctgttaaattttgttagtttttgaatatttaagaatgcatcgttgtcaaaaaaagtcgaattacacaaaaatgaacagcagcgaccggcgaagaaattgaaccatacgcaagccatgggacatcatgataaagtgcagcactttaattacataatttaaaaacgattggatatttttcagccaacaaatatcagcgtcgccaataattcaagcagtgattttatgattttaatttgcgtattttaattaaaaacaaattatttatcagaaaataatgggacatcgcccaccaatgttcttgtgaccagcaaaaatacaactgatggtgagtgttatacctatttacgttttatttttatcaatttgtgagcaattgttgaatccgataacttttcaaatgctttccaaataattttcaacattgtagtcattgtttgatccacaaaaacaaaaaaaattaattagactttttaatgaacaggtgattacttgcgcgtgcttttccctccgtcaccaatgcctttgaaagtgccgcactctccgccactccaatcgctggtcattaacaattcttcgggagcggaagaagcgaaaaaagtaatgccaattgctttagtggtatttacgaatatttcctcatctttgaaattgtaatatgtaattaattttcaacagcagcgaccggcgacgaaattgaacaatacgcaaccaatgagccaacatgatcaagtgcagcactttaattatatattttaaaatcaattgaatatttttcagccaaaaactgttcgcgtcgccaaaaaatcaagcagtaatttttatgattaaaaatttcgtatttaaaaaaattaatcatttattagtgaataatgggaccacattaatggctaatgccctgctgatcagtaagaattcaactg

SEQ ID NO: 54842 - DNA, 1261 bp, Heterodera glycines
  Genomic contig location: Contig_ID=SeqID_4546; Location=879..2139; Strand=+
  SCN-specific regions: Sequence locations=1-142,164-642,720-1019,1048 -1157,1179-1261
atgttatttgctgaatctgatcttttcccgcgttttggcattgtctattacgagacaaaaatcatccgtaggcaacttaccttcgggaatgggtatgacaaaaaaaactatttatttagattcagggacaagaattcccggctttaaaatttatattaattttgaactaatacttttatcttttgcttctcggtcttttctctgtctggctttactatgacttatttattccactaattatttgtcaatttgactttcaaattaaaggacgattggagttggtctttttacatctgatcacttttatttctattcgagcggtggtgttgtttttggtcacaacatcggtggcttcggaggatttcctccgtttggagagggcgacaccatcggttgtggagtcaacttaacttccaaggaaattatgtacacaaccaacggcaaacgattgagtgagtaaaaatattatgctattcgagaatctcggtctcgactgtggcattgtctcggcttaatttttgagataaatctgggacctttttatgatcattttatgttttaaaaagcatcactctagtcacattatgcgatcgggttttatattaaaaataatcactttgattaaaaggcaccaaatcattgaaaaaattatcataattattatataaaattttctaacttaatttatgggatttttttgtataaaaataaaaatttaagagagttcggaaactccataattaattttatcatgataatcatcttcagaataaaagaatgtttgttttgctatttcagacacatcaaatatgttcgtcgtcatcaaagacatgctgctgccggcagtttttatgcattcagttggagatacaattgaggcgaacttcgagccgaatttgcaattgcctaatccctgagcaaatcatacgaagatgggaattaaaattacacaattgtaatttttcaatacaatccaaacattggataaattcatttcggcaaatgccattcgtcttttctttttaaaaaaatattgaaatattaaatgttatatctgcgacagcgatttttaggtttgtgaatgactttttttttaattgaagagttttttgtgatccgattgtgccaatagatgaaatcccgatcttatgatacttaaatcaaagaatttatgtaagtgttaaatggctcctctaattgcgaaatatgcaacaaaaaaaaagtcacgtgtagattgcgaaatcgatggggaaattgcgaa

SEQ ID NO: 54843 - DNA, 1422 bp, Heterodera glycines
  Genomic contig location: Contig_ID=SeqID_4546; Location=3621..5042; Strand=+
  SCN-specific regions: Sequence locations=1-278,300-324,361-684,707 -905,931-1036,1084-1181,1203-1219,1285-1292,1314-1422
atgaaattttggcgtttgacatttatttttatattttcgttcatacaaaaatccacatcaaatgctacgactgaaattcaggcgaagtgtatgttttaaatttatcaatttcactaattaagatagagacaaacgttttggtaaattattaaaaatttgaaattcaccgctttgcatgccgacaggcgcctccaaagggaaaaattggcactgtttctttttagtaggattataaattgtacgcactaaaaatgccaactatgcgcatatccatcaaatgaaaaatgcccagaacaaaactgccaaaaatagctttgaaccatcaaaaaatgtttaaaaattcaaaattaattttaaaaacatcaaaacaatagataaaagcattttttatattgaatttttttaacgcttaaaaattactttttttatttaaacattttttccaaaattcttacaaaaactcaaaatttttcggttttgaggatgtgtttttttaaatcccaaaagtataataaggtggattttccgcttctttttttcaatttttttttgttaacatttacaaattggatgaaatatgatctaaaacgaaaaatggcaaaatataaaaaatcttgcaaaaccaactttttataattctacttattggattttgagtcaaaatctttttttttgaatttcgggatgaatattaaaaagaagtgaattttatggaccaactgcgtttaatttttaacaaataaaaaatcaatttactttagtaatgttctattttttaaaatttgatctctaatggcctaatcatcccattatttttcagactcaaattttggttcagtgataagtcaatttatggagaatcgtgagaaaattgatcaaatttttgcggatttggtaatttaaaatgttttttgttatatctttttcattggacagaaaaaagagaaagaaaaaagaaaggagcaaatgctttctgaagaagaaccgctgcaaattgtaagtcaatgaatacgacgtttaacttattgacaaatcgaaatttaaaaaaaattaatttctttttatcattttcatttttatttagattagagatacaataacaattgactaccaatggaacacttcggactgtcaaagtgatcgtatgattttgattccaacaattattaaagtcaaacattatggaaaaaagaaaggtaaatccggatggaaatatcggaaatatttttaaaatgttaaatctttttttaattaaaaatttaaaaacataaaatttattattttgaatctaaaactgtcaaccttttttccccaggtcttcgcattgttcgttttgcctttgtgtttccccctcaaaatattggagcagtttattttgaagtgaaaattgtaaaattacaaagggaaatgaggtaaaagtaa

SEQ ID NO: 54844 - DNA, 1667 bp, Heterodera glycines
  misc_feature (1159)..(1160): n is a, c, g, or t
  Genomic contig location: Contig_ID=SeqID_24143; Location=654..2320; Strand=+
  SCN-specific regions: Sequence locations=1-570,592-673,696-1081,1126 -1222,1244-1441,1479-1667
  Gene Ontology: Mol. function=inositol/phosphatidylinositol kinase activity; Cellular component=1-phosphatidylinositol 3-kinase complex; Biological process=regulation of cell cycle
atggtattcaggtacaaaaagtccttccacgaagcctgtcggtcggacttcgcctccctcggcctcccattggacgactgtgtgcacagttcattgctgattttcaacgaattgcttcgcatcgccgattacgaatatgagcaaattcggattcaccattcggtggacgggccaattgtgcagttgggcagtcgcgcggattcaatcattggccaaaacccaatcggatggcttatcgtgaaaatccggcctgccaccgtggagtcgagcacttcgcgcactttgatcatcgattgttttttctcagaggcaaatttgtttggtcccttgcccttttaattattagcaaaaatgattgcacacttatccataaacatgtcattttcccttaggttgtcaagcgttgtatggatgcattgcccagcaaatccgcccattgccaggcaattctgctcgaaattctgccccgattggccaacttcaccgactcctccaattcgcacccattccaaaatgtgcaggaggcggctgatcattttatcgccatcaacaacaaattcccccaagcgcttctgacccttggccttttgtcattaaaccgtccgcttgaaatgcgcactcgaattccacggatttttcaaattcttattcaacacatgcaaaccgcggtcaacaagttagttcattctgttttaatagagtttcaatttttgatgattttcgtcaccttttgaaaactaaaaaatttggtcctttgctctgaagttgacgccgtaagaaattttaaaatatacttcgaataggtcgagaaatcagtctttttttaaatttaaaatcgaagtatacataaatcttaaattcggtaacattgttttgtaaagagcaagctcaaataattaaagcataaaattttaaacggttggaaatttgcctaattttcagaaaaaagcaaatgccaatgctcgactttcattgtttgtcgctgcttattcagtctcaaaagagccatttgtgcgaaagagttcgcgagtcgctgccacttatgttttccacgggtatttcagagggacttatccaagtaaaaaatgggtgaaaatatccaaaaatttaattattttttaggctctccatgtcacaattgaacacattccggagctannagccgatgtttttgacgggttaatggatcatttgtaccaattacttatggtaggtactgacttgcattgaaagaaattccacattttggtttatattatttaaggatcgtcctcgtcccagcaaattggctcctccaacgcctccacccattccaattggtcccattcagccgaaaaacatcccacaaacccaattggctctcaaaacactcggcgaattcaacttttcccggcactctcttcagatgtttttgcgttatgttgctctcgtaaatcattttaaaaattattcaattaaaaccaaattttaagggctatttgacaagtgattccacgaaaattcggctcacttccgtgtttagttgtggcgaaatgttgaaaccattcgtggacatttacgagcatgtacaaacggagcaaaaggcggaactgtactcattgatccgtaatgtgttggaatgtcttgtcaagacggcaattgttgacacaggtcccgtcattggatag

SEQ ID NO: 54845 - DNA, 49 bp, Heterodera glycines; identical to SEQ ID NO: 51181
  Genomic contig location: Contig_ID=SeqID_24145; Location=597..645; Strand=-
  SCN-specific regions: Sequence locations=1-49

SEQ ID NO: 54846 - DNA, 140 bp, Heterodera glycines
  Genomic contig location: Contig_ID=SeqID_24147; Location=627..766; Strand=-
  SCN-specific regions: Sequence locations=1-45,67-140
atggaccccactcgccgggggtgtgttattttttactgtaatttgttaatttatttttaatttttagtgcccccggcgaggagctaagctctgaagatttggcggcacttcccgcgttaccagggctcctcgcattttaa

SEQ ID NO: 54847 - DNA, 101 bp, Heterodera glycines
  Genomic contig location: Contig_ID=SeqID_24148; Location=4..104; Strand=+
  SCN-specific regions: Sequence locations=1-101
agcaatcgaacgctaacggacgacctaatgtcattaaaatccccgaaggagagaatttaattaaatccattccttcgggggaccgtgccgggtgccgcggg

SEQ ID NO: 54848 - DNA, 1508 bp, Heterodera glycines
  Genomic contig location: Contig_ID=SeqID_24149; Location=122..1629; Strand=-
  SCN-specific regions: Sequence locations=1-70,93-132,154-461,483 -501,527-588,628-665,687-710,740-756,790-1036,1058-1508
atgcgcgaccaaaaagagcgaaagtatggcggtgacggaggcggggcaggccaaatgctgactttgctgacttctgcttctgctgatgctgcgcatgtcaaatccctcgccgctggcggagattcggtttttgctccccccgggggatttgggacggagggaaagggaaaagagaaaaggttggccaaagcgacaacaattaatgcacaaaacactcctcactcacccaacaaacagcgcaaatcgcttaaactaagctcattacccttttggaagtccataaataaatggggaaactttcatatggaggagtaaaagcagagaaagtgaggaaaaaaaaagaaaagagagaaaacttaaataatgggcacgacttactttgataagcgtggggcggggaaggagaataatggcaaaaacgggggtcaaattcattttttgttcattcaatttaagcggattaaatttttaaaaattgaatttgcatgagattaaaaagcctttaaaaataattttttttttttttgctttattatttacagacagtgcttggcataatataataagcgatttggacatcataattccaatatttttgtaaaaaattagttaaaaatttaataatttggtgttttattattcaaaatctgttaacaaatcacatacaaaatttcaaaaattttcccggcggcgcctatcggcactgccggccccccaattcccaaaacttttttggaaaaagcacgccgcaaaaacattattaatttttaaattttgaataaaatttttcaaaatgctgatttacgaaattttcagttgacaggccttcgtttttacgctaataaaatattgttttaagtcaatttttcatgtttttattgcgtttccttcacgcaaatattagttttagaaaaatcttatttttggggtcagaatcttagtttttaggccattttgtcttattttgaaaaaaaaacttgggaactctgatctcttgaaaagcagcaaaatgcttataaattagcagagtcccatttttgtgacaataaaaatgtttgtcttttcgagtttcctctcattgtaaaaaaatttctaacataattacctattcttctctttaatcattcgaaaaaccgtcaaattgtgttaattgtctcaaaaatgaaccgacggtaagcatttcaaaaattaaatccatttccctgttatttttatcgaaatttcagctgggtgtgtaacgatgttttgatggatctcttcccattttttggtcgtcttcaactcggcctcaaattggcgctgctttcaccgcgtttcaatgcgcttgtggacaaacatttcgatggaaagaacgaattcacaatttggagatggattggatttcgcaagaacaatggcacagcagcgtcagaattatctgtgctcatcgattatgccaattctgtacaatttccttggctcgaccttccgctgccacacaaaattcgcttcaaacaccttcagattga

SEQ ID NO: 54849 - DNA, 205 bp, Heterodera glycines
  Genomic contig location: Contig_ID=SeqID_24150; Location=574..778; Strand=+
  SCN-specific regions: Sequence locations=1-205
atggcgctcctgggtggatcccctccacactgccgggaccactggaccaaggagagtccaagtccgtcggtgaagggccaaggagagcccgagggaccggtcttccgagggaggcggaatgtgatgccagaaggaacggagtgtgggagaaagtgggataaaggacctgagagaacctctaaaagaggcgcccgtagctcagttg

SEQ ID NO: 54850 - DNA, 572 bp, Heterodera glycines
  Genomic contig location: Contig_ID=SeqID_24151; Location=558..1129; Strand=-
  SCN-specific regions: Sequence locations=1-178,215-373,411-445,484 -532,570-572
atggcaagggttgaaggaaattttttgcaaaacaatgttacgcaatatatctcgaatgatttggagattgctagcgtaaacacatacaaaattaatttaaacaattgctggtaatagtcttaaataaattaattatctactaaaaaagataaaaatctaccctaattatgcaaaactcatttaatatttaatttttataatttgaataattttaccaaattatcattgatataaattgaaaatctaagaaaaaattttgaagtataaaattcactcaatttgataatttaaaatacacgaacaaataacataatttacaaaactataataccatagtttttcatatttacgtaataaaaaaatcgaatgaaataattatatataaagtccaaaattttttaattgaaaatggatttattaataaaaactgataatactatagacgattttaaagtataattatttaatgttaattatataattgttacagcttttgcaagaaataaaaaagtttgactcggaagttatcgggaaatatatgattaattaaattccaaaatgttaataataaa

SEQ ID NO: 54851 - DNA, 759 bp, Heterodera glycines
  Genomic contig location: Contig_ID=SeqID_4547; Location=329..1087; Strand=+
  SCN-specific regions: Sequence locations=1-82,132-277,344-447,552 -670,704-759
atggcatgcgccgcaattgcagcgcataatttgggctttgataacacacgggtcaaactgattgtcgatccaatgtattaccataattaagatttattgttttaaattttaataataaattgattaattaaggcttcacaattggcacattattgagtgtgaaattggtggcgagaatggcttccggacgagaacacgtcgagaatttgcggcccaacatggcggagtgagcagtggcgagaacacacttttggcatttttgtcaagcataaaaggcaattaattaaatatttaaatgtattattttattaattttattttttaaaaattatttcaattaattctgaaatcgatttgcagagactttgtacaagccgcccggtgtcaacatttgttagtccaatttttacaaccgatgtgttaagataatgtgatcatttacctttcattattattttttattttaattatttaattttaaaagttataaagcatcaatttttattaaaaaaaagatttttaaaaaaatttaaatagaaatgaattaaattcgccaaattttccatttaattcttttaactcgctcttttcgtctttgaaattttcttttgcatttttgcacatttcagtttttgaacaattttttccgtttttttttgtgcttcggctcattaaaaaaattatatttttttatatttttaatctcaaagcattatttataaagcatataaaatacctttttataaagcattttatgaa

SEQ ID NO: 54852 - DNA, 1131 bp, Heterodera glycines
  Genomic contig location: Contig_ID=SeqID_4547; Location=1103..2233; Strand=-
  SCN-specific regions: Sequence locations=1-188,220-331,365-612,642 -871,952-987,1010-1131
atgatgatgatgagctctgctgctatgctttttgtgatgatcactttggcattgatcagctttggctgttcaatcggagctgtcaaatcggagggcgacgacgagtcgggcgcagtgcgccacagccatgaattgatcaggtgtgaaatgtggcatttttaagtctctaacataattaacacaatcagaaataatatagttttaatttaaaaatttattgattttgatctttttttattaccactttaatggttgattatttattttatttttttggtcatttgaaatctatgaaaaattcattgtgagaaaaaaatatttctcgtttttctttaaaataagattttaaattttttttaaaaatccgaccgaataaattccacaactttttagcccgtacaaattcgggcccctaaattatttatacataagtcatattttgctaaatttataaattcacaaaatcaattttagtcgtattaaacgctacggctatgggtacaacagctacggatatggcggaggctgcgcatggtcagttatgcctaataaattggctaattagtaaatctttcattttagtgcccccgtgccggtgacgtcatcatgctacagctgtggcagcggcggcggcggctatggctattcttcgtaccaacctgtgccaccaccaccgcctcccatgcagccatcgtattcctcttgcgcaacatgtggcggtgggtacggcgggtacggtggcggcttgtcaggctacagtagcagctggaacaacggtgggagcgcgtccaggtaaacgttcttttttctcattttttatcaaaaattggcaatttaaacaaagattcattaaaaattgattaagcaatgctttatataaaaaaatttattttaaaatcgtaaaattaaaattttgcaaaaatatttttcaattttttaaattaattttttcaatcattttcatttaattatgatttgaaaaaatcattttttgcagctcatggaataactacggcagctcctcttccatgtcagttggcaatggcggcggttacggatacggcggcggaatgtgctcagtgtgtggccgaaaacgcaaataaaaaactttatcattttactgaaaataaa

SEQ ID NO: 54853 - DNA, 490 bp, Heterodera glycines
  Genomic contig location: Contig_ID=SeqID_4548; Location=304..793; Strand=+
  SCN-specific regions: Sequence locations=1-52,95-218,249-296,318-490
atggttgacattggagaaccaccctcactcaacactcgcctcgtcgacgaatcaccaaacacaaaacaacaaattaaatttctttttgttcccatcacattggccaatttggagaacggcgatgatcatcgtcatcacctttttgctaaatttgtattaatgataatgatgatgaccgcattttggtgagaaaattgcaaattttgacgaattcctcgaattaattaaaaaaaaaaataataataataggaacattgtttgagtattttgtgcaaaataataagaaattttatgacaaaatcaaaattccaattccaactgaaatattctgcatttttttaaatcatttttttcaaattttgagaaatgtttacttggaaatgtcgtcaaattaaagcaaatgatgcgtcattaagcataattaagaaggcaaacttgaactaaaggaaaatgccaaatacaatataagaagcggttttaaaaaataata

SEQ ID NO: 54854 - DNA, 1529 bp, Heterodera glycines
  Genomic contig location: Contig_ID=SeqID_4548; Location=1217..2745; Strand=-
  SCN-specific regions: Sequence locations=1-1,28-85,108-403,425 -492,514-774,814-878,900-906,928-939,997-1015,1037-1189,1211 -1344,1372-1398,1427-1529
atgctgctgctggtgctactgctgctggtaggtggccacaagccgtgtgaccttcaatggccggggcagcaagtttcaatgtcactttttattgtgatgaaaaactctccgctttttttgtccaaattggcggaacacctcccattattctcttaatttggcggggggaaaggatggagccaaaattggattggacagtttgtccttgacgagaaaatggtcggtgtagtaggctcttctgtggggttcatcaaaaaagcgttccacattcttattccccctcacacatcacatgcttatacaaattgcttcattttgccgttggtgtcaagactctcgacaatcaccgcgcccgcctttgtcgcccaattttggacccgatggacctcgagactcttgaggacggcggccatcactttcgttcggcagtgcgcaagaaccagaaccatggccttccattccccccccccacccgttcagcatcagcgaattcggtgaattccaaatttagaaatgagatatgggagaagaatgtggcgaagctgcacaaaatgcaaaaagtgtcatcaatcatttaatcatttaacaccggaaagattggcgggagggggcgtaaaataatcattttccatttttcgtgcaaattgaaaattgagaatgctctgccgctgatgcccacgcaaaattttgttcactatgatggaaccgatggatgaaaattagaattttgtgcaaatgccgagaaaatattaaaaatccaaaaatgatcatttgattaaataaattaaatttaaaaataatttttcaaaatttctgaatttttaattcttctaggatttctcagcctcagtttcatttgttcatattggctcccatttaaataatataaaaattggcttccattttaataattagctttcaaaattaccaaataaatgcttatttttaaattttgtgtatttaaaattatttttttaaacattaatttctttttttgaaatcagaagaatattttatgtttaattcatttgatcttttttcagtttacactaaaactccctctgattgtttctgatcagctcatatttttgctcatttcgtttttttcgatcatcaaatggatgggacaggtaaggtacagcatttgctgttaatttggtaattaaagaaggttttacgattttgtgacaatagtaataaaaatttgatttgtgcgcgccggccgaacaaaacaaaacgaaaaaaatggacaaaaaaatattacgaataaatgaatggaaaaatgaaaaatgggagcaaaaacagaacattactaacgaaaaagattaatgaagttgaattttgtaaaaaaaaaaaattaaattaatattactttgggtttttttttgttcgaatttgaaaaactttggaaaatggaaaaaattattcacaaattaatattggttactaataatgtatttttaagaactttattattcaaatggacccgaaaatatcgagacccgtttaaattttgagtaaataataaa

SEQ ID NO: 54855 - DNA, 961 bp, Heterodera glycines
  Genomic contig location: Contig_ID=SeqID_4549; Location=491..1451; Strand=+
  SCN-specific regions: Sequence locations=1-34,56-290,314-678,711 -713,735-798,823-961
atggtaacccaggcgaacagggacctgctggttcgccaggggagccaggcaagcctggtgcacctggttatccgggccagaatgggccacgtggaccgcccggaccagccggaccaaatggcgagccaggaaaacctggccaaccaggacaaaacggagagcctggcgtactccggtgaattttcagcatttgcaattttcattattaattttttcattcattcagctatggaccggtcaaggttggccctccgggaccgcaaggaccgcccggctatccaggagggaacggagaaccaggacagcctggcccacaaggctatcctggggagcagggacagcccggagctggaggtccgtcaggatcgcctggaactccgggagaaccgggcggccaaggagagcccggagcgcacggcgaaaagggacactgcggtaggtttttttgtggatttggcagaaaatttttcaatattcaagggtctgatttttcggcattgatacgatcactgatcaattgatttttgattaattttttgtgtgttcagatcattgtcctcctcctcgcactgctcctggctattgagcagaagcgaaagagacggcgagaagctgatcagagtggaaaaccaaaaagaaatgcaatcaaaaattgttttgcccttggattattcatggaataaaaaattttgtttaaaaaattatttaatctgcaaaatttacaaaaaatgaaatttaaatcctcgcttattaatgcaatcgctgcatggcgagaaagtaacatttttctatttttttcctgaaaaatagtttctaaaattcttttgcttttgttagcttgtttactttgttttagagaatgagaagaagattagcaaagactgaaatcaaatatttaaaatgtttacgaacaaagaaaaactaaattttataaaaattcgaatcaaaaatttaaagtaaa

SEQ ID NO: 54856 - DNA, 2505 bp, Heterodera glycines
  Genomic contig location: Contig_ID=SeqID_4549; Location=1462..3966; Strand=-
  SCN-specific regions: Sequence locations=1-224,289-400,447-632,654 -685,707-710,732-848,873-948,986-1062,1084-1238,1278-1288,1311 -1445,1505-1710,1750-1886,1931-1945,1967-2173,2216-2279,2301 -2348,2370-2505
atggcaattgctcccaattcttcctcgacttctttgctaaatgattcattaatacattgggtcgtttttttgaattccatcgaactctgtgttttgtttgcgtcttttctgatttcggcattcaacctaattttgctctccaacacggcattgcttcatccaaatttgaaatgcattcttttggttcaaagcgcagtcattggattggtacgaatattctactgataaaaatataataaatattattattttggatttaattttataaagcttaataataaatataatgtcatcagtagggatgtcaaaaatatgtacaaaaagtggtcaaaatatgtacataaatatgttaaaaaaagcccgaaatatgaagaaaaaaacaaaatatgtatcaaatatgtaaataaatatttaaaaattgttatttttttggaaaaataattattcgtagagggtaagataggcaccacaaaatgtaacctaattaggcttatgatcatcttttagtatttaaaattaatttttggtattttttaggggtagattttcaaaaaaattttttttgttattttttcacaagaaatttctagaaattttcaaaaattctcaaaatattttaaaaagtcacacgatttttgttcgtaaacacaaaaatgaaagtgtttttcctactatttagagcatggagaagccagggaaaaaatatgtatttacaaaattttctttttattcagtatgaatgctttcgtttcatttttgtgttgtccaaatttgtctttgccgacgcgttttaccatggagcagtccccgtgcaaattgtccaaatggcattaattccgattcgcaataaaatgggccacgttttggtggccgaacgtgtgtttgccacaattaactttcgaaaatatacggagaatcgcagcaccaccaaacagttcgcaatttgctggattggcattttggtatttttgaaaaataattatttgactaaattttagggagtgaatattcagttaaatcaaatctgaaatttaaaaaaaagcatattgcctaaaaacaattgaaattaataagattttgaaacaaaatttaactgatttgatgcttctaaacaatgaaaaagaggattgtcagaatgaatgacttgaaattttgtaggaaaacagtttttagtagggattatcagcgtacaaaatttcgaagtttttcaatcacgtatcaatttttcaaaaatccgtttctgtttaaaaacttgaaaaatcaagtcaaaaatgtagtgcttttttggttttagaaacatactgattttgaaaaaataaaaaattaagctgtaaaaaattataaaattttgcaggggtagcgcttatgccttcgtattttcttgtgaaatttcaagttacgctgacaacaacaaaattaattgtctaaataaagaaattttagtgaatataattcttatttttattttttttaaattaaaaataattttttaagaattaaatttgacatataaatcatacagcgttttaaatgataaaataaaaaaaaatctttgaaattaatttgttttgatttcaattctctgtccattgcagttgggcatttcaatttggaatatgtatgttcagcgaggtgatttttacttcatcaatttgaccacttttgtcaccagttgcattttcttcgctttgggatttgctgaaattttggtaattaaaatttaattatatatttttttaaattttaattggataatttgccaacaaattaagtccatgactgctcttcatttgtacaatttgcgaaaatatcaaagtgagattaactttacgctgaatgaacgctttcaggtcagtaaatgcgactaaaagattagttaaaattccataatttttatttatattattaaattattattaactattatattggaaaaatattagtgaaaattcaatttttacaatgttttagttgtctgaaaatattcgcactgcaaaacaattggcgccaacaattttacaccattttttgaatggccaatgcgttaaatgtagtgacttttctaatttattttggttttttggacaaggattatcagcagagttttgcctatatgttaatggcattgcaaaataccattagctgctcatgcattgaaatcactgttattacgtaaaattttaaatttttataaaaaaataatttaaaaaaatatcgagtgcgtttggacgcactaatcacaagattttctccacgctaatgaatcaatcatttaggccaattaatttttaaaaattattcagccatcacccaatgattaaacgtaaagccgtcgtttggctgaagaatttcttttcttttgtgaagccttcgtctgtggccgattcttcagtgccaattgcattgcaaaatgggcaaagtttggtggatattcgtggacaaaaattgctgacggaatcggagatgcaaatttatttcaaaaagctcgaagaagcatggaaatga

SEQ ID NO: 54857 - DNA, 560 bp, Heterodera glycines
  Genomic contig location: Contig_ID=SeqID_4549; Location=1942..2501; Strand=+
  SCN-specific regions: Sequence locations=1-59,81-95,140-276,316-521
atggtgtaaaattgttggcgccaattgttttgcagtgcgaatattttcagacaactaaaacattgtaaaaattgaattttcactaatatttttccaatataatagttaataataatttaataatataaataaaaattatggaattttaactaatcttttagtcgcatttactgacctgaaagcgttcattcagcgtaaagttaatctcactttgatattttcgcaaattgtacaaatgaagagcagtcatggacttaatttgttggcaaattatccaattaaaatttaaaaaaatatataattaaattttaattaccaaaatttcagcaaatcccaaagcgaagaaaatgcaactggtgacaaaagtggtcaaattgatgaagtaaaaatcacctcgctgaacatacatattccaaattgaaatgcccaactgcaatggacagagaattgaaatcaaaacaaattaatttcaaagatttttttttattttatcatttaaaacgctgtatgatttatatgtcaaatttaattcttaaaaaattatttttaatttaaaaaaa

SEQ ID NO: 54858 - DNA, 327 bp, Heterodera glycines
  Genomic contig location: Contig_ID=SeqID_24152; Location=1153..1479; Strand=-
  SCN-specific regions: Sequence locations=1-211,233-248,271-327
atggctaatgaaattactgagagctacgctgaacttatcgatactccgcctgctaaagtattgtattgctactctgagatgaaccaatcagtcattgagctgatgaagcgcggaatcgagacacataatggcgttccggatcaagcactgatccagaatcagccgaaaccattgcttgtgcttgatgatttgatgcttaatgtagggaatgattttttggatttgctgttcacacgcggttcccacaattggaatgtcagcgttatttttgtcacccaaagcctgcacggacgtaatattaagaccgcaagggcgaacagtcattag

SEQ ID NO: 54859 - DNA, 508 bp, Heterodera glycines
  Genomic contig location: Contig_ID=SeqID_24153; Location=17..524; Strand=-
  SCN-specific regions: Sequence locations=1-440,463-508
  Gene Ontology: Mol. function=ATP-binding cassette (ABC) transporter activity; Cellular component=nucleus; Biological process=chromosome organization and biogenesis (sensu Eukarya)
atgaatgagaggattgaggaaatcagcactgaaatagccaaatctaacgcattcgtcatggaagccaaagtgggttttatttaaaaattcaatgcttcgtttttatttgcaggaaaaggtcaaaaaagcgcaacaaaagttagagacgtacaacaacgaagtgcgctcgcaggagaagcaaatccgtgtgaaaactgccgaaattgaggacttgaagaagcgcgttcgccatttggaagccaaaatcgagtcaaaaacacgggacagggaggaagcactgaaaaatgcgaaggatttcgagaaaagagcccaacagttggagaaggcgcacaattggatagccgaggaacggaaacacttcgccgtggagggcacggcgtacgattttcgcaattacagcttcgaaatgggcaagcgcgagtacgacgagcgcaagacgcgcagcaaagacttgctgagaacggtgaacccaaaggcgatggaatcattggcaacggcggagaaagag

SEQ ID NO: 54860 - DNA, 968 bp, Heterodera glycines
  Genomic contig location: Contig_ID=SeqID_24154; Location=1..968; Strand=-
  SCN-specific regions: Sequence locations=1-106,128-620,642-692,714-968
  Gene Ontology: Mol. function=ATP-binding cassette (ABC) transporter activity; Cellular component=nucleus; Biological process=transport
ttttcagcaaaagttacgcgcccttaactttgatccgcacttggaccaccagcttgagcaggagcgtgttcaattggccagagaaagagggcaatgtgcgcaagaattggaccggtttgaggccaggtattcattccatgaccgtgcttactctacaattccaaatttttctcaagaaatttcaaactgcgctttgactatacaatgccttacaacggattcgaccggaacaaagtgaagggcgtcgttgctaaactgtttaaaatgaacgaacaaagatatgccacggcattggaagtcgttgcgggtggtcgggtgagtcttttgaaattaattttgccaaaaaaacgataaaaattattttgattgtatccttctctcttttttgagctgtttcacgttgtgatcgacaaagtgaagaccggcgaggatttgcttaaggcggggctgccccgtcgggtgacaatgcttccgctggacaaaatcagtgcaaatgttctcgaccagcggctaattgggcaggcaaaacgaatggtgggcgaggagaacgtgttcttccccggagagctgatcgaatacgaacgggaaattgagctggccattctcagcgtttttggcaattgcctggtgaaaactctccacttgctcgttgcgtgtttcttgaattgagtgtttgtcaagatttgcggggacatggaccaggccaagcagctgacattcgaccgggccataaactgtcgtacagtgacattgtccggtgaggatttcaagccgaccggtgtgctgactggcggattccggaagccggacgcgtcaattttgactgcgctcaacgaaatcagtggacaatatgaacggatccgagagcttgaccaccgaattggcgcaattgaaagtgattgctttcccgatgttgtcagtattttggaaggaattttcaggggaactcgcaagactgaggcccctcc

SEQ ID NO: 54861 - DNA, 885 bp, Heterodera glycines
  Genomic contig location: Contig_ID=SeqID_24155; Location=45..929; Strand=-
  SCN-specific regions: Sequence locations=1-788,849-854,876-885
atgcgcctgattcggcgcgatattaagaagcgcgccaagttcgacatgttcaagctcaaaccgattgccagagtcaacaagtgcgccatctcagcgttctttgtcgctggactgaacgacgagctggttggtccacatcacgttcgtgccctggccaaagcacacaatggccccaaccagctctaccagttccagggtggtcacaacagcccgcgaccggccaatttcttcgttcaggctttgcagtttgtgcgcgtaatgattgggatgttgccgctgcaactcgatagcccgatgtcgtcacccgaaaagccacaacggacgcccgtcgttctgcacaacccgctggagccgggggtgtcgatcgagacggtgcacaagatgaccatcaaggagctcaaggcgtgcatcgaccgcgcaggcttcagcgacgtcacgtgcattgaaaaggcagaactggttgaactcgtgctcaagctgtacgctcgctgggcgcggctcaatccgcacgaagcggcgagccatggccccgctaccacctcttcaccgccggtgagctcacattccacaaactcgccaacgatggcggacctgccacggtctggctcgactcgcgaactcgactcgccgtcctctgtggacaagggacgaagacacagcgagggcagtctggagaccgtcgaggagttccccgacgtgcagcgcgccttcttcccagccatgacaagctcctgctccagcattatgtcggacgctgagctcacccaggcgctcggccatcgcacaagcggcgaagatgatgaggatgacgacgacgacgacgaagaagacgtcgacggttacgacgaacagcgagaagaaagcgaggtggaagagcacgtatga

SEQ ID NO: 54862 - DNA, 339 bp, Heterodera glycines
  Genomic contig location: Contig_ID=SeqID_24156; Location=110..448; Strand=-
  SCN-specific regions: Sequence locations=1-339
atgtggtcgatgatcaaagagggctacgaagggctggtcatgacggtcattcgaccgcttcgtgccacgtacacacctgctgaccttggtccaaagcgtgcaatgttgcgagatgtggtgatgcagcgcacagacatgaagctgaagaaccccggcggctacacgctcgaatgcagttggtggcgaccgaagacggatcggagcgagaagacgccgtgcattgtcatcttgcacggcaacagttcgtgtcgcttgggaggtctcgagatcgtcagctacgcgattccagcaggattcagtgcgtttgccctcgacttttcaggctcagggctgtcggag

SEQ ID NO: 54863 - DNA, 812 bp, Heterodera glycines
  Genomic contig location: Contig_ID=SeqID_24157; Location=119..930; Strand=+
  SCN-specific regions: Sequence locations=1-26,48-229,251-292,315 -782,804-812
  Gene Ontology: Mol. function=DNA-directed RNA polymerase III activity; Cellular component=DNA-directed RNA polymerase III complex; Biological process=regulation of transcription from Pol III promoter
atgagcattcgcaccattgagctgtgcgtgtccattttggaggaccattttggcttttatgtgtcagcggttggtgccgttctgttgcgccagcagttgccctttgtactgcttgcgaaggagttgcatggacgggttcgacccggcgaggtgcataaatgaattctttcaatttggcacgattttgtaaatccgttgacaataaattcactcgggttaggccttcaacttaatttaaaaaattttttttgtcagactcaaaatatagggggttggctgggttatcttgtggtaaatttaaaataaaaaattttcacaccgcaaaatttataattcagatgaagcgttccatcgccatcctggaccaacacaatctgctcaggtgcggattcaccatggattctgacaaattagctcattttaatgggaaaaaatcgttccccccgacgaaaaatttattttttttcaaattttgtaacttaaaaaaaagcctcgaaatttccaaaccctcgctcgtcactttagagcagtacattgcaatttgatgatggttttccatttgatcatcgcctctcattttcagttttgagtcgcccgcgcgtgccggtgccgtcgtcctctacacagtgttggccccgcgtgtgctgaatttggtccgtgccccgcgtgccattctcaccgtcaaaacgctgtacagcagcggtgccatggaggcaatctttgaggacgtgttggcccaggggcggaccagctgctctcagtgcattcgacgggtggccaaatgcatggtggacaacctgccgatggacaag

SEQ ID NO: 54864 - DNA, 1499 bp, Heterodera glycines
  Genomic contig location: Contig_ID=SeqID_24158; Location=190..1688; Strand=-
  SCN-specific regions: Sequence locations=1-437,459-764,786-1088,1110 -1401,1423-1499
atgcatcgcgaaatccgcgaaacaatgcatatgcaactgcacagatgcagtgacagttggtgtggtcctagcgacccaatttacgggcggtgcaagaaggggttcccagccccttactcaaaatgtacgattttgcgcccggacaggcccgcgatgtatttccggccttcaccaactgatggtggtgcccaattagaggtaaacggcctaatatacgacaactcacatgtcgtgccgtataatccttatattctgctacgttaccgagtacaccataatgtactgtttgcatatggtaacaaagcaaatattaaatacgcactcaagtacccttttaaagggccaggacattgttatgtcgagtgcaaacaagagtccggcaataaaatcggaattgatgagccggctcaatatgccaagatgaacttccgtggtgcaacggaagcatatgccattgttcattcactgccatttgccaaactttcacatcaggttgtcaaacttagcatccatatgcctaatcaacaaccgattgtgtacagggcttttcagctggtgagcaaagctcaacaaatccagcaaggcaaactgccagagacgcaatgttctgcctattggaaacaatggcaaaatgaatggaagcatgatccgaagctcaaggacatgctttttgaaaaagtccctgagcattttatatgggcaaaggacaaatggaacaaaaggaaatataacctaacaaagagaccaccaatcggtcgaattgtccctgttccacccaaggatccggaaaggttcgcgctctattcacttatgcgccactttcccggtgaccctgaccatcttaaaatggtaaatggtcagccttgtacctctttcactgatgctgcaataaggcacggtcttcttgaggatgacaaaatctgggataaaacactcgctgaggcagcgttgtcacgatggcctgatcaaatgaggtggctcttcatgagcatcctcgtttatggccagcccagtaatgccgtcgaattgtggaacaagtacaaagaccaaatgtactttcctcaaggcattaccacatcggcacaacgccaagcagcagagcttgaagccctagccgacattgattggcggctgcacagctgctttaacttaagctctgtgcattttggcttgccagacccgccaaactcaattgccaaaaatacaaatgcggcaattaatgagtttttctttggcgatgatgatttgaatttgcctccagggcaaccaaatcctcgtccacagccaaatacccctccgccacttaacagcgaccaacagaaggtctttgatgctgttttgttggcaatacagtcaaaccctagggattcgactgtcccccgccgtttcttcatatacggcgatggaggcacaggaaagacattcctgtttggccaaattattaggcgcttgcgaaaggccccatacacctacaaagtgcttgctacggcatccactgg

SEQ ID NO: 54865 - DNA, 366 bp, Heterodera glycines
  Genomic contig location: Contig_ID=SeqID_24159; Location=188..553; Strand=-
  SCN-specific regions: Sequence locations=1-366
atgaaccgacggtaaggaattattttgaaaaattaaaattttcgtttccaatttttcagttggatttgtgcggatgtttggatggacattctcccatcttttgaccgtgctcaactcggactcaaaatggcattgctttccgaccgtttcgactttttagtggacaaacattttgatggaaaaagcgaattgataatttggaatgacattacaattcgaaagggcatggaggatgaggaaaaaattggagcaaaagcgaaactatttatgcaaatcaaggacaataaggacaaatttgtggaatttccgatgccggaccatccgttgccaaacaaaatccgatttatggaccttatgattatgtaa

SEQ ID NO: 54866 - DNA, 613 bp, Heterodera glycines
  Genomic contig location: Contig_ID=SeqID_24160; Location=1272..1884; Strand=+
  SCN-specific regions: Sequence locations=1-204,227-399,422-427,457 -563,585-589,611-613
atgattttcggtgccattctcctttccggtctcgcattgtggtggctcatttgcttcttgttcctctgctttttcccttactgctttcgtccgattcgacgtcttaccacgaaacgccgttgtgggactcattctggcacttctaaccctttggccgattcctcaattcttcgccgtccgtcaaacaccaaaagtggcgttgctcgtccgcctccttcgtttgctcttccattcagtcggcccttcgctcattccgtaagttcaatgtgaacattttatcgtattttcaccttgtcacccttcaggccaatttatcgtctgtttctgtctcggccgtctgatcatcctcaaaagcacattctcgggtgggaattccacatttcacacttttaattgtccttatttttttaatttaaattttctgactttcatttatttttcttttcattatttcagtcgctgttaacaccgccttgtgtcaatcgatctgaacttttcctctgagcttttccggccgctctttgccacttccacttaatctcttccatttcttgcattttcactttaaattaattaataattttcgccttttttaatttataatttgttaata

SEQ ID NO: 54867 - DNA, 607 bp, Heterodera glycines
  Genomic contig location: Contig_ID=SeqID_24161; Location=993..1599; Strand=-
  SCN-specific regions: Sequence locations=1-154,180-406,439-443,465-607
atgcggcgtgttgactccatttcactgttctcggaggacgcgaactacttggagtttttggacaccatcaaatacaacgaggagatgacagttgatgtaagtaatgacattaaaaattattgaaattagaaaggtaaaatatggcgaaatacggataaaaaaatatataaaaattaaaacatggacaaaatgtaacacaggtcttacaatcagtaaaaaatcattagccatcgtacaaatcttttttcttagaatactggtaattttgtcatttaatgacaaaaataaaaatctgtcaaaatacataatttttgccgaaaaaggttaaaaaacaagaaataagcgcccaatctatgtcataagttttttgcataaaattattcttccgaatataatgttcgatttgttaaaaaaattaaaaattaattttatatattacctgtttttgcttttaagaagcttatgaatctgcataagctcatactgcagaagcattcacctaacgacgaggcagcagggcgaattcgaacgacggaagttgaggtcagcggggagccgatgcttcattctgatcacgttccaggcgagtgattacaaaattaataaa

SEQ ID NO: 54868 - DNA, 954 bp, Heterodera glycines
  Genomic contig location: Contig_ID=SeqID_24162; Location=24..977; Strand=-
  SCN-specific regions: Sequence locations=1-99,225-469,491-745,767 -826,848-954
  Gene Ontology: Mol. function=zinc ion binding; Cellular component =nucleus; Biological process=regulation of transcription, DNA -dependent
atggaagcaaagggaaaggagcaaaaagcatacaaaatgagcacaaaaagaggcacaaaaaatggggaaaatgggcaaaaatggcacaaaaattgggacgaagaagaggaggaggatgaagaagaagaggaagaagaagaggatgaagatgaggaggaggaagaggaggatgaagaagatgaggaggaagaggaagaagaagaatacgaagaggaggaggaggatgagtcatcaacggaagagattggcacaagtgagtcggccaaagtgccattcgtaggccaccgaaccggggagcattggcaccccaaaaatggggggggggatagtcgggaggatccgcaatgaaagccacggatagaaatgagaccaaatgccgactgacgcacagttttatgcccccgggcgcaaggcgaagtgatcaaaaaaagatgaaaaaagagtacaaattatttcgaaattcttctttaactggaaaggtttttaagaaataagtttgaattagtgatcgtagcagaagagcctgcctggataaagcattaaagttttaatgattaacaaatgacggggaccaaataaaggggaaaaagcattgaaaggattggcattcagaaacaaagaaacaatcatcggcaaaacagcagaagtcttcgccgtacttttgggacaccaaaatgcggaaatacgaaaatgaatttccaacgaaaatgaacgcagttttagacaaagccaccgtcgttggcacggcccaaagcaaaacgaaaagtggcaaaagtaaagggaatttttggcaccaaatccgaaaaggaaattgaccaattcagatatttcttggggaaagggtaaagggtcatcgatgctgcagcttctttacaattcccgttgttgacgacacaaaaaaacaaatttttagggcggaaaaaccgtacaaatcggaaaaattcgaattggtaa

SEQ ID NO: 54869 - DNA, 286 bp, Heterodera glycines
  Genomic contig location: Contig_ID=SeqID_24163; Location=61..346; Strand=-
  SCN-specific regions: Sequence locations=1-237,259-286
atggatttgtgcataatggatgcactgaaagatcaaaacgatggataccgttacttattggtctgtattgatgtgcttagtcgacgcatttttaccgccgaatctgagtctaaaaagaatgaacatatgatcgaggcgtttgaaagggtgttcaaaaaggcaaatgttctgcccaacaaactgtacagtgatgctgggctagaatttcaagcaaagcgtatgttagactattggaaaaagaaggacattataaagcatgtgatgtattccccacatctgcatgcag

SEQ ID NO: 54870 - DNA, 272 bp, Heterodera glycines
  Genomic contig location: Contig_ID=SeqID_4551; Location=655..926; Strand=+
  SCN-specific regions: Sequence locations=1-84,106-272
ccaatctgtgtcattttgcgaaccaacaagtcaaaggcaatttgcgcttgtccgattcccatccaattcaacgctcattaaccgaacttggcctcatcacttatgtgctcgaatctgttgtttattacatcggtaaaaggcgcaacaaaaaaaacattttgacacattttatgataaaaattgtttattaactcaatatttttatttatttagccggtatgattgatgaagaattgtttctgatgcaggacattgagaatgcaattgtacaa

SEQ ID NO: 54871 - DNA, 1010 bp, Heterodera glycines
  Genomic contig location: Contig_ID=SeqID_4552; Location=445..1454; Strand=+
  SCN-specific regions: Sequence locations=1-256,289-304,347-475,504 -543,571-641,699-724,746-792,837-1010
gaacccgatttgcatttgatccggcgcatttccatcccaaccctggagacctatgtgaacaaatttgggggcatggcccaatttcggagtgcgtttgccacccaaaagatgttcaagctgaggatgaccgacatccgggagcaggacttcttggagccggccatcattcattacattgcggagcatgtccatccgagtttagaagtgagtacaagtactggctgacgttgtttttctgtccttttcctttcacccgaaatttaaaaaaatattttttaaaataaattaccattgcacaaaaatgaataaattaattaaaaaagaaataattgtaaatactatatttctaattcatcaaaaagcacgcctcctaattatgcgatttctaaaacaaaaatacaaccccctaaaaacgagtttttgaattcaacccccccccctccctcccgaagccaagggtctggctattcccttgataaataaataaattttttgtttattttcagccagccgctactggtctcgagaattccatgtcaagactgggtgggtttggggctggtggatagacagatatgctaaacacctctaattgtgttgcttttttctatcctaaagttaattgaaaattttcgaaactgaaaattattaatgtgtttttttttaatttctcattttattttatttttttaaataatgttttcgccccgtgcaggtcaactgtttgacaaagtgtgcactgaaaagggtgtgcatgtgaacacggattatatcatcttgggaaagtaagtgattaattacaaatactaattttatattttaattatttattttttgtccattaattgcttgtactaattgcaattactaatacaattagttaattaattgttttttaaacaatttagcgtttgtgaagtgatggaaaatttgttggcaatgaccgccaccattgcgcgttcgagtcggtcctatgcaattggacttcgtggtgcggataatgaggttga

SEQ ID NO: 54872 - DNA, 567 bp, Heterodera glycines
  Genomic contig location: Contig_ID=SeqID_4553; Location=212..778; Strand=+
  SCN-specific regions: Sequence locations=1-1,25-76,275-567
atgccggtgccgccgcccgactcggcggcagtgggcgagccggaccggatgaccatcagcagtgaggagcaaaatgtaaaaattaacaaaaaaataaaaaataccaaattcattttcaacaaaaatttttagcaaaaaataaataaaggaaaaaattaacaaatatttatatttatttttaattaatattttaaatttttaaaactaaaaaattaatgaaaaaataaaataaaaatatttctatacaaaaattaattttaattttgttttatttgtaacggatgaaaattaacagcgttttttaagggtgtgaaaaatatgtcaaaaaagaggcgaccacatccggcacagctgaaaaagtcggtgctcctctcgatcgccaatggcacagaaaatgacggcggcacaaagtcgccccggcatggctcaatgcttcgccgtttctcccgcgcagcttcattcaaaaaagctcgtgcgttaacataatacagataaaatggattggcggaaaatcatcagaaatcgcaaaaaacgcaaaaattgggcacaaagcacgacaaaatgaca

SEQ ID NO: 54873 - DNA, 350 bp, Heterodera glycines
  Genomic contig location: Contig_ID=SeqID_4553; Location=1767..2116; Strand=+
  SCN-specific regions: Sequence locations=1-214,239-350
caactccgtctcagcaatgttcaaaaagctataacttttttctttgttggccaaacttaacaatcatggtatcgttcgaaagccctagatgtttagaagatatttataagctatttctcagtgattaatcagctctcaaaaaagttgtcagtttaaaaccgcaaaaaaggcagaattttcaaagttttttatttctatctttttttatagttcgaaattttttgtaatttttagtaggctaatagagcctgtgaagagctttcgaatgatatcaagattgtttgattcggtcaaaaacttcaagagttatattgactcaaagttggctcagacggagttggcccgttccg

SEQ ID NO: 54874 - DNA, 430 bp, Heterodera glycines
  Genomic contig location: Contig_ID=SeqID_4553; Location=800..1229; Strand=-
  SCN-specific regions: Sequence locations=1-34,56-430
atgattttgcaatgcaggaaaggggtcagttgcgtctgagccaagcttaatacatcataacttttttcaggctggccaaattttataaatttggtatcattcgaaagctctacatgtttagaagcttttgataagttatttctaagcgattgaacaacttataaaaaagtcgaaacatgaacactaccaaaaagtcagaatttttgcatattttaatttataacttttttatatgtcagtatatctttgtgatttttaggaagccgatagagcttgttaagagctttcgaatgataccaattttgttggatttggtcaacaaagaaaaaagttatgatgctctaaacttggctcagacgcaactggcccgtttcgtttaccaggccaatgtgccaaattttagaggagggagaataaattaattaataaa

SEQ ID NO: 54875 - DNA, 390 bp, Heterodera glycines
  Genomic contig location: Contig_ID=SeqID_4554; Location=139..528; Strand=-
  SCN-specific regions: Sequence locations=1-172,194-228,254-390
atgcgtccatctgtgaaaagcaaggcttactccatgtaagacaataggaaaattgtggaaatttcatgaaatttggaaattagaaaattttttttggaaaaaatggtaaaatatatttttttgtagaattagcatacggtagtcattaaatgacaattagccaaattaattataaaaatgactaaatgctttattattgcagaatttggcattggcaattagattaacaaatttaatttttatttttttaaatggcaaaaattgaatttttgtagaatttggcctactgtagcttttgctgcaatgtcatttcgaatggccgatgctttgtatgggttcagattgcatatggtcaccgatgggaagggagcgttttcaaatttgagctaa

SEQ ID NO: 54876 - DNA, 1435 bp, Heterodera glycines
  Genomic contig location: Contig_ID=SeqID_4554; Location=519..1953; Strand=+
  SCN-specific regions: Sequence locations=1-98,138-211,233-377,399 -509,531-748,770-850,872-947,978-1096,1143-1435
atggacgcattggaaaatgtgttgcaggagaccggaagaagtgagggcgttgcggcagcgattagcaccgataatggtccgtccgttagccatttattgggataaaatttgcaattttaaaataaaatttggcaaaatatctttgtttaattgttattttatagtgaagaaggcacgccgagaattgaaaaggcatcagctgaacagacgagaaaagaagggggaggaggagaagcagcaaaagaaaccgagcagcagttcaccaacagcagcgagcacagattggcgtgaaatggcattggccattcaccggcgatatttgcaggtgttttttaggctaattgtttttggagcaaattatccaagtttcaacaatttttaacataattagaaaaatataattgaatgttatgagactaatcccaaaattttgcaaaaattattatatgattatgatagaattgccatcatgaatttaccgtatactgtgcttttgaaaaggtgtacgccacttgctactgtgaggtcagccgactgtcatctgtgcgcaaacagggcagttgctacgccgcttacaaagtgtgtgccgaagttttgtcgtaaattttattatttttttgacatttttagggataaaattttggagtttcgtaaaaaaaaaatcttttttcgataattactatgccaaattcagaaccgtgtcactgtgcgctttctggacaataccaacagcaacaatggctctgatcagcagcagcagcatatgcattatttttatcctaccaaatgcttgtgccaattggactggatggccaaagcgatttggccatgttttccatgtaaaaaaattgaatttttacaaaattatgattgggttgattttttggatttattacagtacacgattttatgcaagtttgatttatgcaacccactctaaactctttagaatgaaatgtttttaaattaattacaaaaatcataaccttaattatcatcgtcataatttttttttgcaaagcgcagacaacacgtggaaggagcatatttgtgtggagtgtgttgatgaccatgggtctgtttgcacctttttccctaataaaataagtaattaataatatttaaacgattatttaattattcaaggcattgtccaatgcgtttcctcgactaccgtacaacaaatggcgagggcaacaacggtggtgggtaccgtaaatctcgacaatcggccgcctcctcctcacatcgaacgtacgctattgaaatgctggacgaaaacatggacatttgtgtgtgccatcgggagtacaaccattgtgtggctaacaatttggacggcgaaattcccgaaataatgccgggcgatgacctgaacctgttgaatatcagccatctgactgaagtcggttggcacattccattgttggcataa

SEQ ID NO: 54877 - DNA, 465 bp, Heterodera glycines
  misc_feature (438)..(438): n is a, c, g, or t
  misc_feature (449)..(449): n is a, c, g, or t
  misc_feature (457)..(457): n is a, c, g, or t
  Genomic contig location: Contig_ID=SeqID_24164; Location=284..748; Strand=-
  SCN-specific regions: Sequence locations=1-106,137-301,323-368,403-465
atgtcgaacaagggaatgagtttcctgggtgcagcagtgttcagcttgttatttgtgttgatggtcaatgaaaattgggcggcgtctactgatgatgatgaggaggtaattaaaattttggtacaaaataaatacatggatgttagttagttgacttttttcacttatttaaaacagtacggaattaagtttgtagggagaccgtgtggaaagtttaataaatcaaaaagattagtgcttattaatgaaatggaaaggaaccataattctttttataataattccaaaaatggataactccataatcacttaaaaaatggtaaccaaaagggcgaacgtgtggaaccgttttattaccgatgtgcgacatttttataaattttataatgaaaaatataaataccatcccggttcttttagcctaattattggccacanggtggagtggngctgacgnttttgtga

SEQ ID NO: 54878 - DNA, 1219 bp, Heterodera glycines
  Genomic contig location: Contig_ID=SeqID_24165; Location=45..1263; Strand=+
  SCN-specific regions: Sequence locations=1-404,426-759,781-1219
  Gene Ontology: Mol. function=oxoglutarate dehydrogenase (lipoamide) activity; Cellular component=mitochondrion; Biological process =embryogenesis and morphogenesis
cagccgactcatcgtccgccgtcctccgcgctcagcgctgagccgttcatgaacgccacgtcaggtgtgtacattgagcaaatgtacgagagttggcagctcgaccgtggctctgtccacagatcatgggacgcgtttttcaccaatgtcaacgcgggcgccgcgccgggccaggctttccaggtttaattttgttggcttttttgacgggtttaccgagctatttgctttggtggatgaaagaattcggtggggtctgattttttcgctactgtttttggtggtggcgttggaaccgaattgcgaatccattttttgttgctaaaagtcctcaaatatggggacatttggaagaaatttgaaccattgtcgaattcacttccaatttgaagaaacattgtcagttttttggggctttgaagtttttcaacggaacgtttctttaaccaaaatgaaatgtcaaactcattgtcagccccattttttccttgtgccaagaaatacccaatttttactaagttttttttacacaaattttttttccaggctcccccgtcagtcccgtcgcttagcaccgttccgcacgccacggttgtgccgcgtgacatgcgcgaggtgcagccgcaaacagcaggccaagtgatcccggccgatgaactgacacgtgccatcaatgaccatctcaaaatccaagtattgatcaggagtttccaggtctgtttttataaatcgcaattcaatgtaaacaaatcgaaaaagttggtccaaaatccccaaaataagccattttgggagtccaaatctgtaaataaatttctgcacaccggaccgcttgattaggttaaatctaaactcaaatcccgaatacaattttttggtttccatgtagagtattgtaacagaaatactgtcgtttttatttataccttggttgtggctgtctccgttctcttagcttaattgtaaaacattcacgatccgggcatgtgaagggtaacaattttttcgaattaagactcgtggccacaacattgccgatttggacccgctgggcatcaacagtgcggacttggatgacacaatcccgcgcgagttggagctggacttttacggcttcactgagcaggacatggaccgcgaattcttgttgccacccaccacattcatcgggggcgaacgcgccacattgtcgttgcgcgaaatttacaaacgacttaag

SEQ ID NO: 54879 - DNA, 1211 bp, Heterodera glycines
  Genomic contig location: Contig_ID=SeqID_24166; Location=21..1231; Strand=+
  SCN-specific regions: Sequence locations=1-632,656-1211
gtatttggacgtccaagtgatcaatttcctgcgccgaaatcgccgcctgttcagcaccaacatctcgctgcagttcaaccttctgattacggaatttcgcgcttggcaagcgatggcacggcacatttggcccctgttgaggaacggactccgcacgctggtcagcctgaagcgcaaacaactggcactgatgcgcaaacacgtgtcgccaaccgtcctcttcgactatccgaaccttgtcgaaatcctcaccccgattttgcccgaacgtccgaccgttgacaacaccaattatgctgctgatacatcggcccgtgacctgtacatgtggctgcacatgtcgcgccctgacggtcgtccgaaggtgttcaaattgaccaaatggaacaatggatgggaccaattcgtcaacgatttgtgctcggtgagatttgtggtggatcaatcgatggggacggatttttcaatttttcactgaccttttttgggtttttattgcagttcacacgacgataaaataattggacaattttaataataactttttctagaagcatccaaataaaacattcttggtatcattcgatagcccaaagtgtcctttattagcctgcaaaatttcaaagaatttcattatatttcaaaaaagttgtaaccagaaaacttcaaaaaaaatgaattttctgtacatttttgaccattactttttgaattttgaatgaattttttaaaatcaacttaggactaatagaggactctttggactatcaaatgatgccaagaatgttgaatttgaatgcttccaaaaaaagttatgctgtattaaaactgtcaaatgtttttatgatcgtatgaactgcaacagagtcccttttttgatcattaatctgcaactgatctgatcgcatttccttttcacagtcattcactgcagcgtccgtcccggtcaactacatggtgctcacttcgttcgaattcaactacaccaggagtgaagaaatggtcaacattcggacggaggaaaggctgacgctgatgagcaatgtgcatccaaatccagctgtgggtggcgttgtgtccttggtgaagattctgcgctgtccggtggagttcagtaacgctgccatggtgtcctggcttcgcatggcgcgcgtgagcaacgaacgtcccccgaattgggtgaccattggcttctcggatgacgaaattgg

SEQ ID NO: 54880 - DNA, 704 bp, Heterodera glycines
  misc_feature (625)..(625): n is a, c, g, or t
  misc_feature (662)..(662): n is a, c, g, or t
  Genomic contig location: Contig_ID=SeqID_24168; Location=233..936; Strand=+
  SCN-specific regions: Sequence locations=1-213,253-636,659-704
atggccccgctccaggaccctccgacaagtccagacccggatacctggcttttgcaaaatcttgccccactatctggaaccgggtttttaaaaatccaatacccggttcgcaacccggtaggtccgggtccaactttgcacaaaaacacactagtaagaatgggcttctgggccaaattttgttgacaaaagtctaaggaatgaaaatttgtgtaaaattaatatttactttaataaatgtatttataaaatgtgtctgtggtctagtggttagcctctagggttcattaacttcctttctctggttcaattcgctcgcatagcccccagtttttgccaaaacatccgggcgcggggcctaccttaattattcaatgaaaaaaagaagattaataaacattttcagcaagcaaatttttgttttaaggtctcaattaaaattgcttaaagaaaaagagcttaaaaaaatgtttgaccaaaaaatggagcaaattcagaaatggaaaaccaatgcatttctggcaaagactgaaatggaagaacgccacgaattggaggcgcaattacgcaaaattcaaacacaaaaagccgcacaaatcgaatgctgctgcctgccaaaatccanatcagccccagcacttctttcacataaatttttgaantttggcatccagttgcaaaacattggcgtacagttcatctaa

SEQ ID NO: 54881 - DNA, 363 bp, Heterodera glycines
  misc_feature (301)..(301): n is a, c, g, or t
  Genomic contig location: Contig_ID=SeqID_24169; Location=18..380; Strand=-
  SCN-specific regions: Sequence locations=1-113,148-319,342-363
atgcgaaaaatgaaatggataaaaatgagaaagaaagcatttcatatgaaatggaaattaattcagggaacatatcgaactgtcagttcagcaaaaattctcaatagtattacaaaaatatatattaaaataacttaataaaaatatgctatatggaataataatttgaagaaaaatccaaataattcatcatctgtcgagcgggtccgaacccatgcaaatggtcattaaatgagggaaatagacctgtgcgtatcccggtgccaatcaatgccgaagatattttttcgagatcccgcgngattattggatgtgcttttaaatataactattttttacattttgaaccaaaaatttattaaa

SEQ ID NO: 54882 - DNA, 1177 bp, Heterodera glycines
  Genomic contig location: Contig_ID=SeqID_24170; Location=208..1384; Strand=+
  SCN-specific regions: Sequence locations=1-397,434-445,468-1177
atgccaggacaacataataatattaatgaaatgaattgcttcgtaacccgtaatattgagttaataattcaacagcaacaacttaaagaagaagtagaaggactcaaaacagaaaaaaatcgactattgatggagacacaacgaattttaactgatcaaacaaaacatattgaaaaaaatgacaagctgatggacaagtgcatcaaattgcaagacaaaaacattgaattacaactacaaaacaacaatgcattacgggaacacatcgagataaagcagaatactgaatcattggtaaagaaaagagagatttggaggaagaaatattgaggatgcacggatcagaaaacagggaccaagaaagtatttgcgctttgtgctatgtcagacaggtcacaataataataaatattaaaaacaaaagaataattttggctactttagcgcaattatgtttgtattccttgtggtcactttgcgctttgtaaccgatgcgctgaagtggtagcaatcgaaggtacctgtcctttttgtcgtgaacaacttgatggagtgtttaaaatttttagctcgtaatgataatacgatcgttaaatacccgaacttatgttgttaaattacatgtttataaagtgattatgatttccaatgcatattgaattgttaaagcttcaccagaattaacaaactaatcataaaatctcttatgttacggtggcctaatggttagtcttccagattgtgaacaaatgttcggttccccaagaagctggcacatttaaaaattatttactttaaggagggacaaatagttaagatgagggggaaaaattatcgataaaaatggggtgggggacaaatggtcgacaaaggacaaatggtcgacaaccgaaaaatgggacaaatggtcgacaacggacaaatggtcgacagaatcgggggcaaaaggattaaggccatttgagctccagtgaacactggcgctcaaatggccggccagagcgctgggactgaaatgtcccggcgctcagatggccaccaaaacggggtcttacactactgactgcagcgaaaagagcacaccaacaagatttgaaaccatcatgattaatcaaaaaatctaaaaaaagagttatgtttagtttgtgtacttactttaactacctacctattaata

SEQ ID NO: 54883 - DNA, 444 bp, Heterodera glycines
  Genomic contig location: Contig_ID=SeqID_24172; Location=1930..2373; Strand=-
  SCN-specific regions: Sequence locations=1-61,84-366,388-444
atgtttgtgatcggacaaaatactcctatgagttgctcctatttaagtagctctctacccttccaactatcaaaaatggaacttgaacaattttttgaactacccatctttcacgccgacgattctcttcagtcggctttgtctccagccaactttgtgccaacagacaccgtcccctttggtccaaatgtcgatgaagtgccggaactgggtcccaacctgcacgaccaggtagtggaggtggcagaagacgtggtttcgctgcgtattcttctgaccccggcggccaaaagcgcgtcgactgccaccaataatatctcgttaagtgggttgggtttgccaaggaccccaatgattgaacatgtgttgatgatttggtaatttgatttctggatcatctgtcttcagccccctacttcatagtcgttgtcaggagtcaataaa

SEQ ID NO: 54884 - DNA, 901 bp, Heterodera glycines; identical to SEQ ID NO: 4555
  Genomic contig location: Contig_ID=SeqID_4555; Location=1..901; Strand=+
  SCN-specific regions: Sequence locations=1-676,698-901
  Gene Ontology: Mol. function=ATP-binding cassette (ABC) transporter activity; Cellular component=membrane; Biological process=transport

SEQ ID NO: 54885 - DNA, 315 bp, Heterodera glycines
  Genomic contig location: Contig_ID=SeqID_4556; Location=2363..2677; Strand=-
  SCN-specific regions: Sequence locations=1-315
atggaatccgttgagacggcgtgtggacagcgtccgtttggatgtgcgtcagctgttcatcgccaccctggcaatgatcattctgctgtttcttctgcccaccatcatcgtttacttcgtcgtgttcggcacagtgagtcaaaaatgatggaaatttgaaaattgccaacaaatttactttttagctttggctgttcgtcgactccgtctgtcgattgctaaggcatttggcgcggacaattcgtcaaacactgataaaattgtgaacgatagcaaattgtccaattttgtaaatcgaaaaaatagttaaataaa

SEQ ID NO: 54886 - DNA, 1729 bp, Heterodera glycines
  misc_feature (951)..(951): n is a, c, g, or t
  Genomic contig location: Contig_ID=SeqID_4556; Location=437..2165; Strand=+
  SCN-specific regions: Sequence locations=1-58,84-365,415-781,803 -1087,1110-1177,1199-1237,1259-1354,1376-1729
  Gene Ontology: Mol. function=xenobiotic-transporting ATPase activity; Cellular component=mitochondrion; Biological process=transport
tcgttgctgaagcgttcgctgattgacaattggcgaaaccccggcctcacccgagccaaactcttccagaagctcatcatgggcgtgttcatcggactgttgtacatgaacacacagttgaacggtgtcggcgttggcaatttgaacggggccatgttttagtgagttttttttgtttgtctcttccacttgttacagtattttgtcaagagtacatttttgtaggttaagcgatgctatgaaaaacatatcatttttcaaagttttcgtccttttttccatttttttggaaattttttttgtatatctttcctgaaatcatttgttttcattactcattactagagtttttttgtaaccattacaaaaaaaactatttaaattgtaaaaaatgaatttaaagaatttttattagcaaaaaactctaagaattaagaaaatcattttcccacatttttttctttgtttattttttgggatttattccattttttctttttcaataaccccaatgtcacatcgttttcccctccttctgaagtatcatcgctgaactgacctactccacgctgttcggtgtgctcacctttttccccgccgactttccgctgctcgcccgggaataccacgacggattgtactgctcgggcgcctattttgtcgctcggtccgcctcctatttgccgctgttcaccatcgacggcattctgatggtgaccattgcctattggctgatcggactggtgcccaccgtgggccgctttctgatcactttaggtaagccgtgggggaggggaaggagtcaaggacgtattccaacagggtggggttgagttgggtgatataaacggagcaacagaggggcaaaaaggtcgtcgtcacgctgatatcccaaacgttggcattttcttagtctcctggtagtaagtctccgcgtgagaaatgggtganaacctattcctttacactgtccggacaatcggtcaatggacaaaccgtaaatggacagttcgtcaagttattttattttcttgatcaaaatcaaaaaatatgcgagtgtacgattttttaatgcttggttttttacaacatttctaattacttgacaattcaattaaatttatcattatatagaaaacatgtttaaatttacaaaaatcttgtgtttttattgctgacggattgtcggggagccttcaaaatccatgcgtttcgggaatgttcaaatataggctttatgtttttcatttgccattttgattatgtgctctcctccgccaggcatttccttcctcgtcgagcagtcggccgttgcgtttggcgttatgttgtccgccgtgtgcccttcttaccccgtcgccgtctccgtggccggcccaattctcaccattctgtcgctgaccggcggactgtacgccaacgttggctcgctgccgtacttcatcagttgggtccgtgccaaactcctaaaatctgagtccacgcccccattttgtcgctgtttcaggtccagtatttgtcctggttccgctacggcttcgaggcgttcgccatctctcaatggagcggtgcgtttggcgacgacgaagcgcacgttcgttcggtgctcgccgctttctccttccgcccggaggccttttacacggatttgggcgcgatggcactgttcatcggcatgttctatctcatcggctttttcggcctgcttttccgcgtccgaagggcgcgc

SEQ ID NO: 54887 - DNA, 2378 bp, Heterodera glycines
  Genomic contig location: Contig_ID=SeqID_4558; Location=56..2433; Strand=+
  SCN-specific regions: Sequence locations=1-1796,1818-1897,1923-2378
  Gene Ontology: Mol. function=monooxygenase activity; Cellular component=integral to membrane; Biological process=gametogenesis
tcgaccccttccaaaagatgtgccattgtcggcgcgggtgcgtgtggcctcgcatgcgcccggtaaacaattcaaagaccctactgtaatcacagataccgtatttggtgtcaacgatttatcatggggcgtaggacggatttaaaaaatgatttatatcccgactatctcggtttacgttacggtttacgggttgactgtcctaataatggtaagccatttcatggttcccctgttagatgggcacttgcttacggcttccgtcccgtagtgatcgaacgacgacaaaatttgggcggcctctggcgttacactgacgatccgttacccgacgaatgtataaaaactaaaaaatgctatgtgtctctgccattttggcatttcgtttcctcccatttccccgcaaagtggccaccgtaatgcgctgtacagtaaccaactcgtccaaagagttgaccgcgttcagcgactttccaccggactctcagctgcccaattacatgcggcacgacaaaatgctcgcctatttggcggcatatgctcggcaccacaacttggagcagtacatccagtaatatttgggataaattacaattaaaacttctcgcccaaattttggcagatttggcaaaaaagtgaccaaaatttgtcggtcgccaaattatgccgaaacgggacaatggacagttcagtgggaaaatgaagggaacggagagcaaattgaagacactttccaatgcgtattggtcgcaattggacaccacgcgaagccgaattggccaaattgggaagggatggcccaatttgggggaaaagtaagcgaaaaggggggggatttaaaaagaaattacatcaaaaaaaaagattttccattcgcatgactttcgccgtgtttcgcctgacatggaacaaaaaagtgaatgtcgtcgtcggggccagcgattcggctgcggacatggcggtggagctgagcagagtgtccaaggaggtgaggggcaacagcagcagataatttaaaattaaattttcttgttgccgagatcggttcctcagattagggttactccccgacccctcggggggcaaaatgtagagctccgcggaccgtcgggggggggcacgtcaggggtcgggtcagggaatgggcccaaaatactgggtccgagaatgtctggtccgaggaccgttgggggggacacgccgggggtcgagttggagaataggcccagaaatgtcgggcgtcggggggactcaaggagatggacatgttgggagtcgggccggggataggcccattcggggtcggggagaaaccctaccttagatatatccatttttattggaaatggacccgaaaaaaaactccggttgagctaatttattttgtgggcactaattggcgattctgattagccaacaaataactgctgatcagagggcaccaaattgcggcatttgatttccaaaattgccaaaaaggtgcttttgtccacccgccgtggcttttgggtgctgcgcaaatgtgccgagaaaggccttcccgtggactccgtgctgaccacgcggttcagcgcgctgctctcgcgctacgcgccccgccgcttcgacgagtggcgccgcgtcagatttttgcaaaaggtgctgcacaatttagaggccaggacaaaaatttaagttctcggcattttgtccatttggccataatccgatatgactgactgaacttatttgaaaagcgtgccatgctttttgacattccgtttaatcgctttcatatttctgtctgtattggttacttatttatttaaatttatgtttggtgccttctcgtatagtcaaacggagaaagtgatcaaattgatcagcggtaggagggcaattgatgaccagcaaaagttccctaattaattcattaattaattgatgccaggggttggatcatgcaatgtacggcataatgccggacatttctccactggtcagccaattcttcacggtcaacgacgagttgccaggccgaatgttggccggcatggtcaccgttaagccggacattggccattttacggaaaacggtcactgatcattgactattacactgatcacttatagttgataaatgcttctttgcacaggcattgtatgggcggacggcacgcgcactgatcaagtggacaatgttttgttgggcaccggctatcgctttgacttcacactgatcgagcggggacagctgctgatcagcagcattgatcagtcgtcggacaacggcacgacatcgatggcacagctgtacaagcacatgttcccactgggcagctccgattggaacacattggcaatcgtcggaattgtgcaggcagtgcaaaatgccaaaa

SEQ ID NO: 54888 - DNA, 606 bp, Heterodera glycines
  Genomic contig location: Contig_ID=SeqID_24176; Location=411..1016; Strand=-
  SCN-specific regions: Sequence locations=1-197,230-375,469-606
aaaatttattggaaccaatttgacgatgcgaggaagaagcaattgaatgaattttatgctgttttggctcaaaatcgaagtgttgatcaattcttcaactatttttttgatcaatttggcttggcttgtgatcagttttttcatttttgccagctcggtgacacaataatgaactgttgtgaggtgctaataatcgcaattaaattttaattatatatttaaaaaaaaagatttttgttccaatttatttgattcgtcgtggtcgttgctttcggagcattgaattgtaccaacaaaattttgatgagctcggaaaattgcgcgttcagctgcgtcatccgtaccaaatggaccccaaaatgacaacccaagaagttttttttacaattaaaatttttagtgaacattatttaaaaatttttattaaaaattaaaattttcattaaaaattatttaaattttatttttcccaggaaattatggcttttattgcggagtataagccacaacttgcgccattcccccgctactatttgtacccaggcatttggacaaaaatgcgtttaaatgccaagcacatcagcctgtttcctgctaaagaagttg

SEQ ID NO: 54889 - DNA, 174 bp, Heterodera glycines
  Genomic contig location: Contig_ID=SeqID_24177; Location=1142..1315; Strand=+
  SCN-specific regions: Sequence locations=1-174
atgcaaattgtcaattccgatggaaatccattgccaattccgcaaaatccgttgccaaacaaagtcatcggattagaaggcattacaatcgatgtaatgccaatgtttcgcgactccattgattgtgatgtttttgaataccatcgcttttcgccgcttacgccaagtcaaatg

SEQ ID NO: 54890 - DNA, 400 bp, Heterodera glycines
  Genomic contig location: Contig_ID=SeqID_24179; Location=227..626; Strand=+
  SCN-specific regions: Sequence locations=1-13,36-213,235-400
atgccgcgcccgcgtgcctccctcggcaccgccgccgcaatgccccttcatcagcagcagaaaatgccacagcaggaacgagcggtgcccgcgggcggcgattgggaaggcaccggcgcacagcaacaaacaacaaccgccttttgctttgtgccgttgaaacggaacagcggcggcggcaccagtcaaagtgagggagaaatggcggcggcagaaagaaaaatgccaatataaacattattaagcatattctgataattgggctaacaatttaagttaaaatgtcattattttggcgttttgcaattcttatttgcattaaaaaaaatttatttgatattttgtgacaagaaaattaaaaaagaaaagaaaaaaatcattttaaaaatcaatttataca

SEQ ID NO: 54891 - DNA, 1217 bp, Heterodera glycines
  Genomic contig location: Contig_ID=SeqID_24180; Location=71..1287; Strand=+
  SCN-specific regions: Sequence locations=1-477,500-534,556-592,615 -729,778-1085,1108-1114,1154-1183,1205-1217
gccaatgtcgcccaacatccgccgatggtccaaccaccgcagcaccgtccccccgcttcccatccgatgctttcgcataaactcgaatttccctcgcccacccacgcgtcgcctgcgtccgttgtgcatgtcgttacgcaccatcagccccaattcttcggtccgtcgcacaataacagtctgaacgccaatccgatgaacaacgggacgactccgccagccattttcgacttccaaacgcaacagtttcgggaattcgatttcatgaacagtccggaagacccgatgccgtccagcgagtcgggcggatatggcggcgatggcacagcatatggtcgcgtgccaatgggtggctatcatcaccaccatcagttgcacgcgcatttgcacggaggggagcacatagcgtacgcggaaggggacggatgcgcagtgaacgaagtgacggcagtgcagcaccaccaacggcattatggtgaggggagggtgaagtgctgctgcttaactttcgtttcattaagcctatcagcagcagtgcccttgcaaagagtgttttgccgcgtgccgtcctccgcccccaccggtgactcatccgccgtaccctccgccgccgctgccgtcctccgctgctgcggttgaccaggcaaatgcgcaacactacgcaatgtgcacttatgacaacagcagaaaaggaatggccagtggctgctgtcagcgagccgaagcagtacaacaaaaccagcaacaacagcagcaacaacaaagacagcagcagcatttgtatgaggctccaatggcagtgcaacaaacgcagcagcaacactttagggaggagcagcacggacaacaccagcacgtgcttgtccagcatcacccacagcagcatcagcaacctccgcactttcaccctcagctgcagcaacaaatgcaagcagtacaccacggggaaatggaaattgggcatgggaatggcggtgccatgcatcaggtggacagaaacggcaccaccatgaccttttatgtatccttttaaggttgttcatcatggtcatcccaatgaaaatgaagcgcaaagagtggggccgccctccggcggacatttgtctgctggaatgctggaggacattgagctggacgaagtgagcagcacgtttagcgacttgaaaatgagcggaggaagagagggagacggagcaggaggaggaacaagcagatga

SEQ ID NO: 54892 - DNA, 394 bp, Heterodera glycines
  Genomic contig location: Contig_ID=SeqID_24181; Location=872..1265; Strand=-
  SCN-specific regions: Sequence locations=1-127,149-233,255-394
atgcggtgcgaaggaggcgagcaactgcgcaaacggtaagggaatgaatggcacggatcgagttagcttatctctccttccatttattaataggagtaggcttttcgcgtgtttttctttcagtgagacaaataaaactgctgaacaatcgaatttcgaaatcccccctccccaaaaatttaattttcgcatcacataatttgtttttttagagaagtgcgtttgtgagaattgcaagtgcggcgccgactgcaagtgtggccagtaaacgacaccgaagaatgggccggagggttgtgataagaagagcaaaaaacagttaccttatttaatttgatcgtgaccgaccataattttgacatgtttattttaaaatgctgattgatacaataaa

SEQ ID NO: 54893 - DNA, 676 bp, Heterodera glycines
  Genomic contig location: Contig_ID=SeqID_24182; Location=1..676; Strand=-
  SCN-specific regions: Sequence locations=1-385,409-542,565-676
  Gene Ontology: Mol. function=transcriptional repressor activity; Cellular component=nucleus; Biological process=muscle development
ctcctcctccgacttttcattctctgtcgaacaggtgggcgttctgtgcgaaattctgcaacgacacaatttgttcgaccgactggtgggacattggcacaattagacactttggcacttctaatcactgcccaaaggcacaatttttatggaccattcccccggtggacgaatatcgcttcagtgagggagtgctcaaagctcaggcggttatttcttttcaccggcacaatttcaaagaattgtatgccattctccagtcgcacaatttttccccagaaaaccatgccgaactccaggtcgttggaatggggcaaagaaacaattttaattgacattcaaattttaaaagtttaggagctttggatgcacgcgcattacagcgaggtaaaaaagtacaaaaagaaagggaattagacgaaaggccaatcgaaagggattcaaatccgaccaaagaagggcattattgcttcctataattaaggcagaaaagattcggggacgcgaattgggagcagtgggaaaataccgaatcagaaggaaatttcctttgccacggaccatttgggacggggaagaaacgagttattgcttcagagtgagttggaaagggacgagttggagcagtaacaaaaattggcgagaccaaattgccctcccttccaggagaggtccc

SEQ ID NO: 54894 - DNA, 1960 bp, Heterodera glycines
  Genomic contig location: Contig_ID=SeqID_24183; Location=73..2032; Strand=-
  SCN-specific regions: Sequence locations=1-41,388-401,554-786,1012 -1066,1090-1118,1458-1477,1701-1723,1918-1960
  Gene Ontology: Mol. function=transcription factor activity; Cellular component=nuclear heterochromatin; Biological process=histogenesis and organogenesis
gaaaaagaaaataaagaggatgacagagagaaagatcttctgaaggggagggaaaggagcgaagaggaaaagaaggagcctaaggaggaaaaagtaaagaacgagaaaagggaaggcgagaaagacgtagaggcaaaggatagagagaagaagaaggagcaggaagagaagagagacatatcagtcaaagagaaaaagagggggccaaaagcagagaagggagagaaagaaagggaaaatgagagagaagagaaaaaggaggcgaagaaagaaaaagaggaaacaaaagaagcgacggaaactgatggagaaagtgaacagaaaaaattaaaagaagagaaaagagaacccaaagaagcaaagagggagaatgagagacaaagggaatctgaaatgaaactaaaagagaaaggggaaaaagagacaggaaagggaaaagaagcagaaatggaggaagtgaaaaaggcagaaaaggaaacaaagaaaggagtagttaaaaagtgtaaagaagaggaaaagaaggaaaaggaagagaaggaggcgaatgaggagagagtggtgttaacagagacaggaacagcggaagacgaacagagcgagaagaaagcgaagaacgaggcgaaaaaggaagcgaaaaggcaggggacgacggaatcggagagggacatgcggatttcggaaacatcatcagaggaagaagaagcggtaccatcatccggaggaaggtccgaaaaggaggaaattcggacgaaaaaggatgaacagaatgaagcgaaaaagagcgcagaaaaggaggagaagaagcggaagacggaagaagaaagagtagggacggaacataaagaggagacggaagtgggggggaggaaaaagcagagggacgaaaagaaagaagagaaagggaaccgggaggagaaaaaagatgaagagaaagaggagggaaggaagagacaccatgacgaaaagaaagcagaggaagagaagatgaaaaagcaccgggaagagaagaaagaccatttcgagatggacgagttgaaaaagtggaagaacgaacatggtttcgtttctgatgaggaagagaagggaggaagagcggcactgaaagaaaagttaacacggaaagagttggaagagatgaaaatgaatgcgggaaatgaggaggaaaataaagtaagaagaaagttgaaggaggaagaaaaggaaaagaaggcagagggcaaagaggaagcagtaaactcaagcaatttggcaagtgaaaaggtaaaggaagaaaaggaggaggaggagacgaagaaggaaacgctcaagaaggaagagaaaaaggaagaggaaaagaaaaagagaaaggaagagcagaaggaagaaaggggagagaatgaggaagaaagaaagaaagacaaagggaaagataacaaggacaaaagggatgagaaaaagacagaagaagaaaagaaggacaaagaggaggccataaaaaaagaggaggggaagagggacgtgaaggaagagataaatagagagggtgatgaagaaaagagcaacaatgaaagaaaagggaaaaaagaaagggagggagagggagaggggaagagtaagctggaagaggacaaacagaaaaaaaacaatgaggaaacgaggaagagagaaaacgaggaagagaaaaaggcagatgaagaagcaagagaaagagagggaaaaaagacagacagtgaggagacagggaagaaaggaaaagaggaagagaaaagagacaaagaggagacgttaaagaaggaagaagagaagagagacagtgaggagacagggaagaaaggaaaagaggaagagaaaagagacaaagaggagacgttaaagaaggaagaagagaagagagacagtgaggagacacagaagaaaggaaaagaggaagagaaaagagacaaagaggagacgttaaagaaggaagaagagaagggagaca

SEQ ID NO: 54895 - DNA, 851 bp, Heterodera glycines
  Genomic contig location: Contig_ID=SeqID_4559; Location=39..889; Strand=+
  SCN-specific regions: Sequence locations=1-348,370-573,597-851
atgcgtgtgacggtgtgccttacagctcgaaacaagggacaaaactcaagccgtacgtgctggtcaacagaaagcgatcgataccgcaaattgtcaaccaatttgctggaaattggtgatcaatttcgctggctcgatatggatgaatgatgacacaacggaggactacatgcacaaaatcatcggggcaaagctgttcgttggcgaacgcctcttggtttgggatgcgtttggcagccataagagcgagagaacgacgaaggtggtgaatggattggaagtggagacggtttttgtccctggtggctgcaccaaattcatccaggtaccaaatcatccttcacaatgaaattcatttttcttccctaggctcccgatgtctcgtggaataagccgtttaaggagcgaattcgacacttctacagcatttggatgtccaatgaggccgaaaagaagttcacgtcagcgggaaatccgaaggcacctgctcttcatgtggtacttgattggatccaccgatcatggcaggaaatctccaaagaagtgatcatcaaatcaattaagggtcagtttaaaaattaacacaggaaaaatgcctaaacttttaagtctgtggactgactacgccattggacggaactgaagacgaaaaaattgcttgcttcaagccggaaggagcaattggaccgatagggatcaaatttttgcgcgagtttagaggaaatcaaacaatgagagatggacgaaatgatcaggaggaagccgcctatctgatgatgatgtagagatggatggagtgggagatgacgatgaattgctcatttgttaaattttactattgttttttgaaa

SEQ ID NO: 54896 - DNA, 75 bp, Heterodera glycines
  Genomic contig location: Contig_ID=SeqID_4559; Location=1605..1679; Strand=+
  SCN-specific regions: Sequence locations=1-75
atgcgcgaactgttgttcaagaccgccaaccaggaacagcacactttcactcttgaggtcgaggagaacgaaacg

SEQ ID NO: 54897 - DNA, 339 bp, Heterodera glycines
  Genomic contig location: Contig_ID=SeqID_4560; Location=8..346; Strand=+
  SCN-specific regions: Sequence locations=1-7,29-105,141-141,163 -221,243-249,271-339
aatgatttggctggtgctgatgatggtgagatgttggtgcagcctatgcacatgaacgatcatccggcggcggcgcaagcgggctatgtgaacgaccacgctgcacaccatcaccaccatcatcatcatcaacaccaccagcagcagaatgggatgctcatcgatcacaacgtgtggcagcagattcttgctcccgtacaacaacagattcagctgacggcgcaggattacccggccatccgtcgagtgggaacaacaaaaacatttaaattcaaatttatgatttcccctcatttcagctcatggcgctgggctttccgcgaaatttgtgcatcgaag

SEQ ID NO: 54898 - DNA, 751 bp, Heterodera glycines
  Genomic contig location: Contig_ID=SeqID_4561; Location=1018..1768; Strand=+
  SCN-specific regions: Sequence locations=23-571,594-665,687-689,711 -723,745-751
atggggaaaacatgcatttttaggctgaaagaacgtgagaatgaaattctacgcctacggaagagtccgaatcgacgccacagcccacagcacaggaaaagtgagacgaacgggcaattttaagacctaatgagcgaccaatttcaactgctttttttagggaatatctacccgagtttgaacggcaacactcccatcacttcgttgtcatttctcgggtgcggtgcgatgagtacacccaacgatgaagtatcataaaaaaacattcacaaaagattaattataagcaaaaatggattaggagagcgccatgaaactttatgttggccatgttgagtatgaacgccaaaaacggcatatttttgatgagaaatttcaaaacccatgttttagtatacagaggaatttcgcatattagtattcgccagttattgtacaaattgatgattatgcgtttagcccggcggcatgaacttcaacatggccacagcaacgccggcgaattttggcattcgaaacgaaaacaatgacgcggagcagaacatcgaagcgctgttccggacgcaaaatgtgcaggaggagacgccacttgcggggcccgcgttctgtcctacgacgccttaccttttcgcaatggcggggagcaacagcgaaaagtgagagacaaacgaaaaaagcaattttcagacaaattaaccaaatttagacgcacgggagtaacgccgaaatacttctgaactgatctaatgta

SEQ ID NO: 54899 - DNA, 1166 bp, Heterodera glycines
  Genomic contig location: Contig_ID=SeqID_4562; Location=1460..2625; Strand=+
  SCN-specific regions: Sequence locations=1-163,185-186,208-704,727 -1166
atgaagaagcccgccgttgtcgaggtaaattcactcagggtatttgatgggcggggagttctgttgatttctttgccctttaactttgtgaatggcattcccatgacccattggcatgcattttctgaacaaagaggcaatcccttcccatacggcaaggcggtcattcattttcattccaaacactccaaaatgggaaaaaatctgagaaaaattcctgtcgaatcgctttttgaaactactaaaagtcttcgatttgacatccgctgggccactgttcgggtgtccgcctcatttgaccactatgttcttaagtgccaatcagattggctcttaaaggaaattgagcgtctagtgattttacatcgaaaagtattaacggctggagggaacatatccaattctaattaatgacaattacaggctttccaatttattaagattgagttcgtggcggatgaaaaagaacgtctgttccaagtcgtttctcagttgaacagcgaacgccgttcgattatccaccgcgccattgcgtcctattttggggttgacgaaaagtttggggcgaacttggtcaaagacggtgccactgaccacgaacaattctgtgggaagctaaacgctatggttgaccagttgatcgactacaccgacgcagcaaaagtcgcagtcgcaggagactgtaagatggcgagcacagaaaattttgaactttttatagcatagcaatcccccaagaaatcccaaaagtgacacttttatttctggttttcgagctcatcaattaaaatctacatccattttgtttgaggattggtttcatcaattttaacagtattaattactacatttatcactcagttttgcatcaacaaggccagtgtgcgtaccgatctcttgcggatatgaatcagatctcaaatctgaaggcgcacatttctgagcttagtgctcagaacttgacccaacaggcgcaaattggtgcacagcaggttcagattgatggctttcatgcccaagttggtaatcagcagaatcgccttcaggctcaagttattgctcaacagaatctgatcggtgaccagcacaatcagatcggtggccttcatgttcaagttgctgctcagcaacaactggatcggtggccttcaggcccaaattggtga

SEQ ID NO: 54900 - DNA, 205 bp, Heterodera glycines
  Genomic contig location: Contig_ID=SeqID_24187; Location=1076..1280; Strand=-
  SCN-specific regions: Sequence locations=1-54,111-111,135-135,157 -157,180-205
attaatggaaaagcttaaaaatttcactcttgacgatttattcaaagtattggctctaccagacaaagaattcgaagaatggctcagagaacttaagcttctacacaccactcgtttttgtgactgtggcaacgaaatgagctacaaatggattaaagaccggaatcaaccgctttggaactggccagcatacgaatacaattga

SEQ ID NO: 54901 - DNA, 383 bp, Heterodera glycines
  Genomic contig location: Contig_ID=SeqID_24189; Location=722..1104; Strand=+
  SCN-specific regions: Sequence locations=1-231,253-255,302-324,354-383
atggattatgcggcagacaagctgacggagacgagagagtatggaaaatattcgacagacaagcagacggtgacgagaacatacgggaaattataaagcagagaagcagacggcggtgagagcgaatgggaaattgtgcggcagacaagcagacagtggggagaaagtacgggaagaatggagaaaaggacacgtacgcaaaagaggaagaagcatgagctggctttaccaaaactcaaatcaatgatcaaacgaagcgtggcagagaaaaataaatgacttttaaaaaatgtattattatgtttccagaaaattatggccagaagaattgaaaagaagaagaaaaatgcttttttgacaacactctcaccaaatttgggatg

SEQ ID NO: 54902 - DNA, 1290 bp, Heterodera glycines
  Genomic contig location: Contig_ID=SeqID_24190; Location=174..1463; Strand=+
  SCN-specific regions: Sequence locations=1-98,229-248,270-581,603 -699,722-762,784-831,853-919,941-962,984-1159,1184-1290
atgataccggtgatcactcccggcttcacggaaagtaatagtacatatctattaaattggcacacagcaaaaatcatcaaaaatgcacttgacgacggtatttatttttttaattatttaaataatttctaaattttgtaaaagttttatttaattatctttaaataaaatactttaatttaattgtttatcatgtttatttacatatttaaaatattaaaataatttccaattctatgcttttcctatttttagcatttaaattgtttcattcttcaaaaagtggaaatgaaaaattgtctatgctctttgaacaacaaataaaattccacgaaaaggtatattggtaattataaaattggggacaataattaattaggtaaataccgtatcctataaattacagtattcacaatattttgcgatcacttgtgtcgcatccgattcaaatatgtttaacgaattttgcggatttgttgttacacgcatacgcattcaacttactcgcctcaccgactgcaggcgtgattatgttgatttttgtcacgtgcttttgttaaatggctgtccaccgtatactgcacaaaaatacacaaaaatgtacggtagtgggaggttatggcgttgtgttattaaagaacaaataagctaaagttgatttttcccaaaattaaatcattccgataatgcagtttaatcttttttaaatttggaatttttggatgcacctcggaaatcgcgaatatacggtagtaggttattattaaaatatgaatttatttagctatagtttttgccaaattaaatcattccgaaaatgcagtttggtcatttagaaattttgaattttttaaacacattggaaaagccgagactaattaccgagtctcaggatagattcattttgtataatccgcccaataaaagaaattcggaatattaaatgtctgttttaaaactttggagaaaattctttaataaaactaagaactatatttagcaggtgtccccaaattaattttatattttgcatttttcccatttagttcatcaaaaattttctacaaaacttggcttgtcagtgtcaaaatgaagaataacacccaaattcaaagccaaaaaagcaatgtcggaggacagttacagtttgaatttgacggaacaaaaaattcaaaaacatttcgccagaaacaatataaacaagggacggatgagaccgataatcaacgtgattttgtcaatttagaatctgaatacattggcaaacagatagtagatgacttaatttaa

SEQ ID NO: 54903 - DNA, 635 bp, Heterodera glycines
  Genomic contig location: Contig_ID=SeqID_24191; Location=47..681; Strand=-
  SCN-specific regions: Sequence locations=1-96,118-121,172-268,290 -293,316-330,353-361,393-429,498-611,633-635
atgatattaattgtgtgtggtgagtgatgagggtttagtgggcccaatcgattaccaattttatcagattttattgcaatcctttcagttcatcgtacaaacatatttctttacatttttctaatatttatttttatttaattttttaactaaatatattaaataataaatgcacggagaatatacaaaagattcgcacgatattgaggtgaatgaaagaaactataaaatttaaaaattctttgtttccttctttaaccattctccattcattttctctttttatttgatggaataaaataattttttttttttgaaatttcagtaaaatttcaaatgttttttcatccaatcacttttcttaataaataaataaataaattttaaaaaaacaactttttttactggtcgtcggtcccactgccacccaatatttttctaaatgaaaatgaaattaaaattttttatccaaataaaatattaaaattgataatttagtcacttttgtcattgaatccacgcatacaacagaacgcgacactaaaaccgagtgcggacacaaagctcgtaaagcagcaatggaagcggaatgtgaacaaatcatgcggggtaaaagcaacaaaaaactaaattaa

SEQ ID NO: 54904 - DNA, 156 bp, Heterodera glycines
  Genomic contig location: Contig_ID=SeqID_24191; Location=1042..1197; Strand=-
  SCN-specific regions: Sequence locations=1-156
atgattgcacagaattgccgaaaaaattcgagaccaatttccgaatgttgaccgactaattgccaaaacgaaagccgtctttgtcaaagcgccttaccgagtcaaaaaatttggaaatgtatctcatatgcaatttcaaccaataaatttgaagaa

SEQ ID NO: 54905 - DNA, 309 bp, Heterodera glycines
  Genomic contig location: Contig_ID=SeqID_24192; Location=1..309; Strand=+
  SCN-specific regions: Sequence locations=1-86,108-152,174-220,242 -247,269-309
agaactcattttagcgaaggtgtaaaggtggccttcgtcattacaattttactttttgttttttggttgcaattgggttagccatttctggaaaatgtccaaatcagaatgtacatcaaattggttaactattaaaaaataataggatttggaataagtaaaattgtaaaaaatgagcgaatgttaattaaacctaacttatgccaagtggcgagggatccctcaggcttagttttaagaatcttaatttttaaaaaagcacatttttctatttttgggttggggcccaaacgaccccggggcccaaaa

SEQ ID NO: 54906 - DNA, 990 bp, Heterodera glycines
  Genomic contig location: Contig_ID=SeqID_24193; Location=688..1677; Strand=-
  SCN-specific regions: Sequence locations=1-353,375-381,408-990
atggctatcaacctgcaggacaagcgtggtcttctcaaccaaattctgggagaagccgacataacagtaacgactagtggcctaacgattagcggtcctcgcctctcctctccccgttttgtcccatttgatgagagcggcagatgcaagtcttgtaaagggactgaagtggaggtggacattatggtcaccaaagagggtatcacaatttggtgtacgcgaatcgcccgagtacaattcgtcccgtttgatatcatatacgacttgcccggccactgtttcttccgtgtaaagaacaaggcacgcgtgttcaacatcccctacggggacttgccggccgtcacatacccaaaccaagaagcactgatggaacagcaacaactgctgcagcagcagcagcagaacgacttgcgacaaaaggccaacacggcgctggacttggtggagagtggactgttggctgattcgttgcgtgaagatgaagtgcagaaggctgagctaaagcggaaggcaaaagttgcactcgatctgattgatgccggcttgactggcgatgcactgcatgaggagggacaacgttggaagaaggccaaaactgcactcagcgttcttggaaacatgctgctggccgattcacttccggaaaagaagactgcggagctcccgctcccgccagccgaaaaaattgaatcacttccacttccgccactcgaaaaaatgaaaacgcccccacttccgccaacactcccaccatcatcaaaaatggaaagtgatgagcaacaattctacgatagcatttctgcggccaccacgatgatggacacttcaatgcagcaggcgccgctcaaaagaaagcaaccgactccaaaaggcaaaaccaacggaatgaagaagtcagccgaagaggtacagaatctaggagacattgacaagacacttgacgaattttttgagagcgtcaacgcagcgacgaacaatttgtctatataa

SEQ ID NO: 54907 - DNA, 2426 bp, Heterodera glycines
  Genomic contig location: Contig_ID=SeqID_4563; Location=227..2652; Strand=-
  SCN-specific regions: Sequence locations=1-184,206-253,285-440,541 -541,563-605,627-665,687-927,949-1171,1193-1642,1664-1887,1929 -2082,2111-2426
caaacaatcattaccaaaccagtggtgaaattgtgttcacgatttccaaattcaaagcattttcggaaggacgaggaccacattatttttacagtgacaaagtgttcatcaacggaatgccatggaaaattgcgattaagcacgccaaaaagggatctcttggattttctttatgtatctatggttataaaaatgtaaacgaaattttgatttacatattcagacacctaaaaattgggaatatgaagaaatcattaaaaaaataataaattaaagtttttttagattttgctattagctgcaaagcagaattcgaattatccattgtttcatcctcaaaaaacgatgaagaaattaaaaagtcattttttcatcatttcactgatgggggaattagggattgctggcctcaagacaattatgcatttggaaatttaaggaaaataaaaatgatttgtattttattaaaaattaattgaaaaagttccaatttttattattgaataaatccagattttataattttaatattaaattttagaaactaatgaacaaaggaaaagttattataatgtggaggaggacacaatgacattcaaagcgaaagtgaaagtgggaaaaccttttccaattcggtaattaattacttgtttcatttgagtgttaaaataacacaaataaacaaaaagtttattaatttgcaattttctttttgttgtgcttgaatcctaacaatttttagattttggcggctcaatcaaatttttttaaaactttattttttggagagaatgcatatgaaactcccaagattgaaattaattctattgaaaatgccgagaaatgttttgaacaattaatttccgtgataaattcaccgaatttcgctgttcatggtaaaattgaaagaaatatttaaatgccaataattatttagaagattgtgttcaaaatgttcttcaattagccaaagattttgatttgtctgccgttgaaattaaccgatgccgcggtcaaattctttttaaagtgaccgaatttaggtcattggaaataaataaggaagtgaaaagtgaagaagtgtccatcggcggaatgccatggcaaatttcgattcaccgtaatgctattgactatttattctatcaagtgtccagtcgtggaatttatggtgaaatgaattcattaattttgttgataaattgaaattttaatttcctgaaactccaaatcttgattatttcactttatttttcagattggaattttgaagctgctatcgaatttggcactgtttctgccacaaaaagcgatgaatggcttatgcggagaggaaatttggaatcatttagtaaaaacagtttatgggatagattttgtagatattatgaggtatattatgcttatttttttattttctcaatagtgaaacttaatgaatttttagacccagcaaatggcgtcgtatacgacgaaaaagaggatgcaataacactcaaagcggaaatcattgtgaaagccgaactgaaaaagccaatcatgtaattaattaacgattaattaatgccatttaaaataatccatttttagtgagtttcaagcagaagacaaattaatggttaatggccaagtggtgaatgtgaataaatatgtaagaaatgttcaagattttgttttttgaatttaacgaacaaaccctaaaactagtaattgacaatgataaaaatgcagtgggaaattttgaaaaattaatttccttagtgaattcaccgagtgccgagttggacggtaattttgcaaggagcagaatgggcatggaattcccatcgaaaattgaatgaaatgatattttacgctattaatttgcaaataaaactcttaaatctgattaaaattaaatgaatctaataattttaaattataattaagatgattcggtggaaaatgttcttctgttggccgatcgttttcagttggattctgtcgtgaatcgttgtgcacattttttggtcgaaaaaagcaaaaagccattcattcacaaaattctgctggcacattattactgaataattggcatgaaggtaaaaaatataaatagatttaataatttccaataattcaggagaaattgatgaacgatatggttcatggtattcctgttgaagaatattttccagtattaattatctcattgaaaaattcaaaatcgatgaaaaagcatcgaaggaaaataatcttaagaaaatttatgagtataaaagtgaatatggttctgtcaaactcaaagatttctatcaaaaaatattattattttcgagcatttaaagtttgacgctgaattgatggatgaactgaaaagtacatcggaaaagaagaaagtgattcggaagaaagtaacacggaagggagtgattgagaagaagaaa

SEQ ID NO: 54908 - DNA, 312 bp, Heterodera glycines
  Genomic contig location: Contig_ID=SeqID_24194; Location=306..617; Strand=-
  SCN-specific regions: Sequence locations=1-312
atgggcaccataatttttttttttgaaaattacaaagggattaagtgcacaatccgaaactttttgaacaacagttccaacattggcacaacaaaagtcaaattgtatcggacagtgcggcaaaaacggagtggcacggaacggacaaatgagcgggtggacagagtggcagcggagcgagtgcagtgccagcagggcgggcacaattttttgtgtttttcgacagtggcactcgcgctagcgcattggttgagaagcggacggaagggcagcggagcgagtgccttttttgggcatttgcctcctctatag

SEQ ID NO: 54909 - DNA, 817 bp, Heterodera glycines
  Genomic contig location: Contig_ID=SeqID_24196; Location=30..846; Strand=-
  SCN-specific regions: Sequence locations=1-78,100-483,505-507,529 -531,564-564,586-648,671-817
atggcggcggtgccatccccggcggcggcagtgagtacggcaatttgccaccgcagcagcggtgccgaaaaatccaacagaagctggaggagttggaggccgacctgaacatcaaggaccagtcccaggcgggcatgcagaggatgcacgtggcgtacagccaaaacccgcagttgggcgacccgacaaaggtgggccaatggcacagaagcataggcatggcatttttcggtttattttttcaaatattttcatttttcatgaaatttttgggccagggaaggcaaatggttaaccttttttgcttttaagtcaattttttatgaatttttcttcggtgacattttccgatgtaaattcctttagattttttttgaaaaatgcaaaaaatccttaaaacgcaatgattttaagcaaaattttcccactttttttgtttctcaggcagcactttagttttgggttaaaaaaacaagaaacccgttttttaaaaattcaaagttccgctttggaaccacaaatttctttaaatttttattgtttttgaatgaaaattgaacaaatagacaatgtttaaataaaaaaccaaaagaatgaattgcgtttaaaaatttcaggtggcggagaagttgttgcagaaccaacaggagatgcacgtactccagcagcaaattcaacgattcaaggcatggcaaaagcaaaattcacaaaaaaataatcgaggatttggttttacggcgggactttcggattttttaaaagaaagtttgaaaaaaattttggtttttaaaactttgaaaaaccgctaaaaaataaa

SEQ ID NO: 54910 - DNA, 688 bp, Heterodera glycines
  Genomic contig location: Contig_ID=SeqID_24198; Location=84..771; Strand=+
  SCN-specific regions: Sequence locations=1-370,395-430,452-494,526 -539,562-651,673-688
  Gene Ontology: Mol. function=DNA binding; Cellular component=nuclear nucleosome; Biological process=chromatin assembly/disassembly
atgtctgacaaccgtggtgcctccgttgcttcgaccggtacgaccaacagtcaggagtctcaagtggcgtctccagtgaaagccggaaaagctactacgaagacgacggctagcggaaagggcggcaaagcgaaggcggacggaaaagtgaaggcgggcggaaaaggggcgaagaaggcgggcggaaagggtggaaaagtgaagattgctgcgagcggatcgaagaacacgcgctctgctcgtgctggcgttgcatttcccgtcggacgtatccatcgtttgctgcgccacggtacagtttttggagagagaggattttcaatggaattttctgaatttcctaatcacaggtcgccatgctcagcgcattggggccggagcgcctgtctatatggcatcggtgttggaatacctggcggccgaagtgctcgagctggccggcaacgcggcgagggagaacaaaaagttgcgaatcaccccgcgccatttgcaattggctgtgcgcaacgacgaggagttgaacaaggtcagatgcagtcggtggtttttgcattttttgaaaatccattgaaattttcagcttctcgcggaggtcaccatttctcgtggcggtgtgttgcccaacattcacacggaacttttgtcgaagatgcagcagaagaagcagcagaacgacgacagtcagtga

SEQ ID NO: 54911 - DNA, 576 bp, Heterodera glycines
  Genomic contig location: Contig_ID=SeqID_24199; Location=146..721; Strand=-
  SCN-specific regions: Sequence locations=1-576
atgcagtacaatgcttttaagccccgccgtgaggcgggacagttccaaaattttgtaccacattttactgtggaaagtccaagtaccttattggacaactacgtgtcaatgagcacagtcgcctttggccagttgtggaacggaaaaatgggaatatcagatggggtgcgctcttttctaaaaattcctcttttcgtctaaccatccctcccttttgtgcactatttcgtttcaaaattgaatcattttttttggctttttgaaataaattgtgaaaaatatacgaaaattattttagcttttaattatgcagtacaatgcttttaagccccgccgtgaggcgggacagttccaaaattttgtaccacattttactgtggaaagtccaagtaccttattggacaactacgtgtcaatgagcacagtcgcctttggccagttgtggaacggaaaaatgggaatatcagatggggtgcgctcttttctaaaaattcctcttttcgtctaaccatccctcccttttgtgcactatttcgtttcaaaattgaatcattttttttggctttttgaaataaa

SEQ ID NO: 54912 - DNA, 508 bp, Heterodera glycines
  Genomic contig location: Contig_ID=SeqID_24199; Location=700..1207; Strand=+
  SCN-specific regions: Sequence locations=1-60,82-508
gcttaaaagcattgtactgcataattaaaagctaaaataattttcgtatatttttcacaatttatttcaaaaagccaaaaagtccggaaccaattttaaaaactaaaatagtgcacaaaaggggagccgccgcacggcggggcttaaaagcattgtacagcataattaaaaccgaaaataattttcgtatatttttcacaatttatttcaaaagacaaaaaaaatgattcaattttgaaacgaaatagtgcacaaaagggagggatggttagacgaaaagaggaatttttagaaaagagcgcaccccatctgatattcccatttttccgttccacaactggccaaaggcgactgtgctcattgacacgtagttgtccaataaggtacttggactttccacagtaaaatgtggtacaaaattttggaactgtcccgcctcacggcggggcttaaaagcattgtactgcataattaaaagctaaaataattttcgtatatttttcacaat

SEQ ID NO: 54913 - DNA, 183 bp, Heterodera glycines
  Genomic contig location: Contig_ID=SeqID_24200; Location=264..446; Strand=-
  SCN-specific regions: Sequence locations=1-183
atgcaggaacatttgccgccggctgacgcaagctttgagctgcgcgcttcctacaatgaagccaagtcggttgctgatggacatgtgacggagaaacaacttttggatgtgccagcgcaaatgacgaaggaagtgcttgcgatgttggaggagaagcagtcgctgcgattcttgtcaaaagag

SEQ ID NO: 54914 - DNA, 424 bp, Heterodera glycines
  Genomic contig location: Contig_ID=SeqID_24200; Location=710..1133; Strand=-
  SCN-specific regions: Sequence locations=1-12,35-424
atgagcacacagtttttaattggtgatgttatttgggtgaagcgcggatctggcgtccaatggccagccctggtgagtgttccgttccgttcgttcatccatccttttagccgctttacaaaatttgccattttaattttttaaacttttttaccccactttaagattaaaaatgttagcgcactggaagtgacatatgttgaatttccaattgtcagcggcgacctgcagcaaaaagcagagattaaaactgtgacaaaatttggggtaagcagtgaaataaaacactgatttaaatgctgttgaaatggatttataaaaaaggcgtttattgcggtcgttgatggtcgtggccacttactccccccccggctctattgcagttcacatgaccataaaattgacaactttgatacataataaa

SEQ ID NO: 54915 - DNA, 363 bp, Heterodera glycines
  Genomic contig location: Contig_ID=SeqID_4566; Location=655..1017; Strand=+
  SCN-specific regions: Sequence locations=1-363
atgaaatatgcattctattattctattatattttccgccttttccaatttgcatgtaaaagcattcccgccaaaagataaagaaggtaaatctgtaaatatattgaactttctctaagttcctgttgtattcctaaaatacgaaattccgctggctatgccccttagccaattccatgaaatgcttatatatattcctcctcttaataaatttcaaatttaaggcaccagtaatggaaaaattgtcaattctttggcagatcaaatgaaggaagtgttggacaaaggagaatattcggatgttcattttttggttgggaaggatgacaaaaaggaggcgagtcaaaaaaagcaaaaaccatag

SEQ ID NO: 54916 - DNA, 706 bp, Heterodera glycines
  Genomic contig location: Contig_ID=SeqID_4567; Location=309..1014; Strand=+
  SCN-specific regions: Sequence locations=1-247,269-396,444-547,578-706
atgggcctgttttcgtttgcacttgccgactgtttggccacatttcatacatttgccatactgttcgactgtgagacacctgtgccatttgacgagcagcacaagcgatacgtgttcgaacacagggacaaaccgcggctaatctacgtttcggaagatggtagcgctatacaggttgacggtgtggtgaagcaagggaaatttgtgatgagcatcgagacgatgtatctcgataagcgaaacggagttgatcacttttgcacattcctgcgcacttttggcatttgtttcttgatgtgccattgaatgtgtttatttgttgcctattcagagcagtaaattgtttgcataattctgtttaattattttttgtttacaaccaaaatattgatccgcatttttatgttataattttaattcatttttgaaatttttatttaaatggcaaacgaagacttccgcttgtccgaatgcatccgttttattgagcgaactgcccaagagtatgattgtgttctgccggttccacggcttgggtttgtcacggaaaattttcttaataattttttttaaaatagctcaaggcgcgatgagcacctggatgcctgtgttcttatggaatccgtgggctcaggccatcggctctacattttcgagtttgaggattgcatccaggtatttttaaaatatgaggtcaattaattaa

SEQ ID NO: 54917 - DNA, 240 bp, Heterodera glycines
  Genomic contig location: Contig_ID=SeqID_4567; Location=2935..3174; Strand=+
  SCN-specific regions: Sequence locations=1-240
cagattgcggatgaaagttgcaccgggcatttgtataaggccaacagccacgttggctgatacgtcaactaccactccgtcttctgcgattttcttgagcttgaattccgtgcacacaaacactttgctgaggtctatgtagctggtgatcggatgaatctgaacaaacactgataagagttatacattgcccaatatttgccttaaaatggaaaggccttgagctgatcgggttcagcg

SEQ ID NO: 54918 - DNA, 815 bp, Heterodera glycines
  Genomic contig location: Contig_ID=SeqID_4567; Location=4930..5744; Strand=-
  SCN-specific regions: Sequence locations=1-47,88-105,136-693,717-815
atggctcctcgtaagcagaatgagcagtttttggacgaaatccagagtaaattttaaaataaaacacaaaatataagcattttatagaagcgaaccacgtggaagaagcacaaaacaaccaaagaaaacataaaatgggtaaaatttttcacaaattttacaaaaattttggattttttctcatttttttcatgtttcagatagtgatgatgacgtcaagttggttgactctcagtcatctcacgcagaggaacgccctgtgctcaagaagaggggccgaaagtctcgctgggaaaaactgctggaggacgtgaacaacgcaaagaagtccaaccccgcagaggttgaagtcgcagatgtcgacgaacgcaaagcagccaaggtcttcgactacccaacaattttctggaagctcgcacgtccaaaggtaatgtttgctctggtggcagcactacaatgttcttcttccgttgcagtatggggtgttcacctttatgtgcaacgaatgccgtaacgaaaacttcaagcgaggcgacaagcgcttcatcctcaacactggcagtggccaagagaagctggagttcacccaaacattctgccaagactgtgccaagttgaactttgactgcacctacctgatcatgaaacaccaaaagaaagatgacggaccatctggacagaagaacggaggacggaacacctattttagatggaaaagtgatctctgatcattcattcattgatttttcgttgaaatgagcaactctttctttgtaattttgccaagcaatacgccgggctttgtcggcaataaa

SEQ ID NO: 54919 - DNA, 1079 bp, Heterodera glycines
  Genomic contig location: Contig_ID=SeqID_4567; Location=5970..7048; Strand=+
  SCN-specific regions: Sequence locations=1-247,270-989,1013-1079
atgcacccactgacaacagccttatccaagctgctgaactgtaaagctgagaatttggccgagtacctgaataacccagaagctgttaacaaggcgagtgcatacctgcgaggaaagaagctcaagacaacctactcgaacaagggcggcactacaaaggaggtcgagtttggcaacttctcgctaaagtctgcttcggagacgtacgccgtcgagggattccttggcaagtgtcctttctgcaaacattccctcactttggaaagttcagaggtcaaagtacaccagtacttctacataaagcaccggatccttctgctgtacccccagctgaagtgcatcgttgagtaccacagcaaaggtcattgcaagtactatccgttgggtaagccttcgctgcgatgatgcccataatctcgcacggtttcagagttgttggccatagaggacagtgcagagataacaggcgaaaagccaacagacaccaactacttggactacctgggcttccgaagtgtttggcagccaacccccgtctattgaagcgagatgaagcgttcgagaccgtcgcaggagttccccgagattgagttcaacgtaaacacgatgggtgttacggtgtacagccctagacatctgaagacccctcggtttgtgccatgggatcagccgggtcggtgtacacgctgcaagagtgggaacgtggagctggactacatcatccagccagagggagtgaccatcttctcttcacggctcaaggatgacggagagaactttctgccatttgatgagatcggtaagggtttggactattgcgaaaaagtaatcagcagcttaagtggactttggcgacaatgccaagtttcgcgtccggtcacggaacaaaatgttcaccctgccactgaaacacccggaagtttaccaagctgcacaagtcgcagcggaagcgaatgaactgctggcagaagttccaccaatggctgacaacaatgatgatgatgataatgttgacccaaagtgataactcagtgtgttgataagccattttgttatcattcgtgatggattacccgaga

SEQ ID NO: 54920 - DNA, 414 bp, Heterodera glycines
  Genomic contig location: Contig_ID=SeqID_4567; Location=7320..7733; Strand=+
  SCN-specific regions: Sequence locations=1-354,376-414
atgctgaaaaagttgccaaaacccttccttattgtctacgatgacctcatgggcgacattgatgcgaagaagttggccgatctgtacaccaagaagtcccaccacaacaacttttcggtgatattcctcacccaaaacctgttcgacaaggcgatgagagtgccaaggtccaatgcgcagtacatctttctgatgcgtgcgcccagcgatatgttgagcattcgtaatttggccagccaaatgtttcctcgcgagcaagggtttctgatggacgcgtataagcaggcgtgtgccgatccgtacgggtatctgttggtgaccctacacgcaaacacagacaacctcttacgactgaggacaaacattttcccagacgacaaagaaaagattgtctttgtacccaaaaatggttaa

SEQ ID NO: 54921 - DNA, 857 bp, Heterodera glycines
  Genomic contig location: Contig_ID=SeqID_24204; Location=62..918; Strand=+
  SCN-specific regions: Sequence locations=1-449,471-804,826-857
atgaagtaccccgggagcgagcccggtactccgatcagcactacacgccgaacggtactgagcagcgtcgccagcctgttcgacccgctcggcttggtctgcccggcgaccctcaaggcgaagctgttcttccaaaagctgtgggacgacaaccacgaatgggacactcctttgtcccgggaggaagctcgagaatgggagcacattttggcaagttgggagggggaaagtaacgtgattcctcgaggcgtaactgcgggcaggggtcacccgcttcaactgcatgtgttcacggatgcatcggaaatcgcatatgcagcagcagcttacatacgaacgggaggagaaagcgggtgcagctcccgcctcatcatggccaaatcacgcctcaagccgaagaaagcggctaccacgttcacaataccaagaatggagctgatgggcattctgttgggggtccggctggcagcattcatcgagaagcaactccaccatccaatcgcggggcaacacatttggagcgactcaatgatcgctctccactgggtcagaacggcttcagcgcaaccacaattcgtggccaatcgactcttcgagatcagaaaagcgacagcaacgacgtttcactacattcgaactaacgaaaacccagcggatttggcaactcgaggggaagtgcccaccctcttacaacacaatgatcagtggtggaatggtcctcaatggttgcgcgggccgagaacggaatggccaagcgaattggagtttcagcctgatcaagagggcctaccctctccggcggggcaggaagaaggacaatcagcattcattgtccgaaagaagcatccacaggcctc

SEQ ID NO: 54922 - DNA, 751 bp, Heterodera glycines
  Genomic contig location: Contig_ID=SeqID_24205; Location=20..770; Strand=+
  SCN-specific regions: Sequence locations=1-383,426-572,594-617,639 -709,731-751
atgcccacaaaaatccttttatctaacaacaaagttttgataaattacgcacttcacaaagcttttgccatattgaccaattggttgtgccttctccgttcgccatgtgttactgaaaagactgtcctcgtttttggtgtctttggcttggttactgttgttgttgttggcattgtgttgttcatttttcaaatttgttgtattctgtcgccaaaatttgaatacatttcgaatggaaatggacgacggttcggcacgccatttgccctgggcgaccaattcgtggagcaactgttgccaattgtggtggcgcaacggcacaaccacttcgtcaatgtcgcaaataagaacaaaatgatgggtggcggaatacctgccgtgtgatttattttataaataatttattttatttaaatatatatataccataattggatgtccggacaatccgtcattaaatattgacataatcaaaaaactaatacgaaaatatttgttcgaatgatattccaaaaagttttgtatgaaaaaaaggttggaacttattataggcgtttcaacttagctatttaatggtttaattattattttttacttcagtgaaaatgttttgaattattcttaaaaattgtacaaattacaagaattcattgttacagtaatgcccacctgttaaagcagtcgttgtacggtataagttcatgacgtcttttttgctgtctgttcctctgtataaattgatgtcttctaa

SEQ ID NO: 54923 - DNA, 1901 bp, Heterodera glycines
  Genomic contig location: Contig_ID=SeqID_24209; Location=205..2105; Strand=-
  SCN-specific regions: Sequence locations=1-64,101-291,313-423,445 -489,511-1224,1255-1332,1355-1453,1475-1519,1549-1580,1629-1700,1722 -1869
atgaatgttaatcattgggagggattggacgccggcatgattactttcaaagatgggaatgaggtataaaatgtaattattaaaaagtaaattatttaaacgaccattttatcctttggcccaatgttaagggctaatatttgtcggactcggaaagtttagtctggcagatttagtctgcgacaagtttagagcatcataacttttttctttgttgaccaaatccaacaaacttggtatcattcgaaagctcttaaccataagctctattgcctttccaaaaaacacaaagatataccgacatgtaaaatagttataagtaaaaacatgaaaaaattctgtcttttgtgaagtattcatgttgcagattttttataagttcttcaatcgcttataaatagctattgaacagcttctaaacacactattatttttctcctaaataatgttgctttcttaaaagggttatatatatatataacttggaatgtaatttttatttaagaaaatcgtaaaaaatatgtaataaaaatgtacttacttcttaaaatggttacaaaaaaacttaaatgaaaaattaaaaaagatttgagcccaaaaacggaataggcagaaatgccataaaacttcaattacgcttagaacatttggaaatttaattaatttattgtctttttcgcggccaatagatcattttttggtaaagaaatttaacttttgcaagtctggtttagtttttcaagaaacactgttcaattttatcaaaaatatgttgaaactttgcggaaaatattggcataaatctaactcaatgcttcaaaattccaaaactttatccacctataaatctttttttttacaaatccgtcttttcctagaaatttcaagtcacaaaattacaaccctagcaataaaaaatgaaaattcatttgatcgtttattattttaggtgttaggcgcagcgacagtcgaagtgttgcgcaggcagccgcctttggatccgctttataccttttttaatcgagatttctattactgtagcgacgacgatgatggcaaatgggtgattagagaaatttgcttgaacaacgatgatgacaaatgcgtcaattatgaagccaattaccgtagcgaggatggccaatcgttcattagaaaagatcgcttaggtaaatgttaggagagaaaaaagggcattttcattgcgataaacgatttctctactatattttttaattaataaagaaaaaaaaacaatagagcaaaatctcctgtaagattttataaaccattaagctctctcattgaagcactacaacatttctgggctcgagaaattaatgttaattattattagggcaatgatttttatatttttacatatttttttgctgctaattatgccgaaagaagcagctacttttgtttggcgtatattttgacatttttgggtaaaaactataagaaaaataaaagagttccaaatcaattttaaaatcattgggtttcaatgctgtgctatatttttttgttttttaaattttttttgtgtcttactttttttttgcaaaagttaaatcatttttttatatatttaattacgaatttataaatatattttttattaaggaaaattggaaatttgcacattcattgatttctctgagtgacagcgccaatcggtttaataccttccccagacttatgtttccattaatataattaacgcccaaaaaaaagaaataggtgctaaaaattgaaaaaatttggagacgaatttatgtgaattattaatttcttaagggtatatttttctgaaatttttggggccatttcttagtggtgtatctttcgttttattgcactttcaaaattatttataagaaatattaattaataaa

SEQ ID NO: 54924 - DNA, 998 bp, Heterodera glycines
  Genomic contig location: Contig_ID=SeqID_24210; Location=925..1922; Strand=-
  SCN-specific regions: Sequence locations=1-190,212-535,557-873,895-998
cactggaggccggttacaccgcccgcaaagtcttccacatcctccaatacgaccagtggagtaacaatgtcttcaagtcctacgtgagtgaaatgatggccctaaaaatccacgccactggcttcccgtcatggtgcgagagcgaagagcagaagagtgaatacattgaggagtgctgggggaaatttgcaattaaacttgacaaagaaaagatgaagtcggagcctgggaagcgctacatcgccaagctctgcctcaactcactctggggccgcttctccatgcggaaccttctctcaaaagcaataattgacaacgacgaaagccttattcatcagtataccgaagacaaaaagattgagctaatcgacttggaaatgatggatgaggacaacgacgtattcatgctcacttacaaaccaaaggaggagtttgtcgacgaaaataagtactccaatgtagtcatctccctcttcacaacatcaatggcgcgtctctacctctacgaagctctgaaaaaagtggccgacactcccggatgtgaaattctctactttgacacggacagcatcatctacgttcatcccgaggacaacgacccactcccaacaggaaagggacacctcggtgagctgacggacgaaaagccagaccacgacattttggaattcatcagtgctggctgcaaaaactacgggctgaaacttcaacggaaagacaatggtgaaatttgcttcgacttgaaaataagagggttcactctcgacgaacagactgtacaaaaaatacactacgacacagtaaaagagcaaattttacgttatggttccgatgaccccgctgaccccataattgttacatatccccattttattcgtcctaatcttatccaaggcaaagtgtttactcattccctcacaaagcattatcaacccatattcacaaaaggtattattaatgattcattccaagtcctcgaatttggttatcgaaaataa

SEQ ID NO: 54925 - DNA, 497 bp, Heterodera glycines
  misc_feature (481)..(481): n is a, c, g, or t
  Genomic contig location: Contig_ID=SeqID_24212; Location=873..1369; Strand=+
  SCN-specific regions: Sequence locations=1-258,324-341,383-497
atgtatttcacattaaagatcattaaatcggagaaaggtgagggagaaaaaggcgacgaggagctgatcccgatcggatcgccggtctgcaagaagccgagagatgcgggccacagatgccatggccgagctggcggaccaatcgcggccaaaaaccttaaggtacttactgtaagaaagctaatcaaagggaataaatactgtacaaattttattctagattattatatgtgatagattattagtaactttaacttaagagagagggcgagagaatgagagaaaaaggtgagagaggaaagagagagagaaaaagagacagaacaaagtaaaagagaaagtaaaaataactttatttaacaatttaaaaattatatattttcagtggtattttgacacggagacttttgaatgtttggcattttcgtacaacggctgtggcggcaacggaaatcatttcgactcgcccgcagattgttgngacaaatgcaaacttg

SEQ ID NO: 54926 - DNA, 1367 bp, Heterodera glycines
  Genomic contig location: Contig_ID=SeqID_24213; Location=779..2145; Strand=-
  SCN-specific regions: Sequence locations=1-308,341-410,432-692,714 -808,835-1367
  Gene Ontology: Mol. function=protein tyrosine/serine/threonine phosphatase activity; Cellular component=membrane; Biological process=protein amino acid dephosphorylation
ttacttttgtttagtcgtctcaaaatttcaacacgtggaaaatttcgtcggctaacaaacgatttgagtaagtccaattaacaaatgcctcgatattttttgcattttcacttgagaatctgttcgtcataccctcaatatttgattgttcccgcttctgtgtctgacgatgaactgaagcaaatgcgacttggcagaatttattaccgctttcccactttggtgtggcgttgtccaaagaatggcgcagttctgctcagaagcagccaaccgtccattggttttttcgggatgtccaacgagtacatttattttcccttttttatatacttttaatttaaagcaaagacatgcatctctacgagaggattcgagcggccatttcaaatggtcccttttccattttacggtctcttaattttctattttttcagatgtcaatatgaaatttctgattgtcgatgctcgttcgtacaccgcggcgtgggctaaccgtgcaaaaggcggaggctttgaaggagctggtcacttttttaaattaaagccaccgtttttatattgaaaatgtctttttccgtctaaagttcccactgttttcagattcctatgccaatgccgaagtcgtcttcatgggcctggccaacattcacaacattcgctacagtttctaccaattgcgctctttgatgaacgcttgcgggggcgacccgaacaattacttccaaagtttgcagtcgaccctttggctgcagtacatttgccaattgttttctgcgacggagcggtgtttgcattcgctgctgcaggaaggtgacattttcttttctaatttctatgagcgatgtttgaaattatgttgcattcgtttaggcgtttctgtgcttgtccattgttccgacggttgggaccgaacgacgcaaattgtttcgttgtgtatgattatcgctgaccctttttatcggactttcgaagggtaatgcctttttaaacacttttaaagacgggaacagcaatttaattgaactggcttcttaaatattgtatttatcttagtattttcttccaaatttagctttgaaatgcttgttcaacgccaatgggttgagtttggacataaattctcggacagaggcggcgttttgaatggcgacgacaatgagaaatcgccagttttcttgcaatttctggattgtgtctatcagttgtggaccaaaaacccggaccaattccaattcaaccgacgatatctggttgttgttttgtgttgcttttttatcccttttatggctctcatttggcagatgaaacttgtacaacacactttctccggtctcttcggcacgtttatattcaattctttgaaagaa

SEQ ID NO: 54927 - DNA, 1078 bp, Heterodera glycines
  Genomic contig location: Contig_ID=SeqID_4569; Location=402..1479; Strand=+
  SCN-specific regions: Sequence locations=1-263,296-471,493-643,665 -667,689-724,770-780,803-828,851-903,925-1078
ttacctacatcaggtcgttgtgagcccagcatggaatgagccgcaatatttcatggcaggatgtctaatggacaattgcacaacaatttaccaaaagaagggtgtcaacgtggtgatcactcgcttcagttggaatgatcacgattacctcggattccgtttgccacatctgcatgaagccattaaacggaaccgtgatcaaatttttgcagaaatgaggtgaatttttgtttcttctttttcagttaaaattatgggaacaaaaaattctgaacttttaaaaatattatttgaacattttcgaaagcattttcaacaaaagcatgtggaaaaagaggttaggtaggcgtttggttcatgaaaatgatcaccgattttgtgtcaaattttgaagaaacgtgaattttaaattggtcggtgacaaaagcctgggggaaattttaaaatttgagtccaacttatttctaagtcttcaaagttaagtaaaatgcactcaaaaattatttttagaccaaaataaaatttcactcgagctcattacttttatttaaaattgtttacagtaaaaaattcaaattgaatgggggcactgccgatttacgttcaattatggcacttaatttgcgaagcacatttaccgaaacagtttatagcaaagatatgtggcaaaattttgttttggttcacaacaggaagtttttcaacttggtaagtaaaattggagaaaaataaataattttttttaaatataacttaattttcttatttaccgcattttctaaaacattaaattaataatttttgatacaaattgtcaataaaaaaaagcttaaaatccaacatttaaaaataataattttcccattcctaaggcgtgtacgattccgcttggcattgctggcgttgagctgcaaggactgcatgcatacgacaatcaaacggaattgttcaattcgcaatttttcaccgttgcgaaccgttacaagttgattttgatgctttaaaatgattaaatgtttttggcatgcaaaatgtaacattgcttctgtcctacaaaaatccaatgttgaagtgataa

SEQ ID NO: 54928 - DNA, 1420 bp, Heterodera glycines
  Genomic contig location: Contig_ID=SeqID_4570; Location=1514..2933; Strand=+
  SCN-specific regions: Sequence locations=1-201,223-246,272-405,437 -745,771-989,1011-1042,1070-1091,1113-1132,1154-1420
atggacagcggacagcgccggcgggtgaacggcccggcgctgaacggctcgctggagttggaggcaattgcggcggtgcatgaactcgcctcacaggttttaattagtttagagagcatagttccatgttggatttgatgtcatggcaattcatacaaaagaatttcgtgcaatttttttaatttttcagttaaaacagtcaaaaaatcagaataagaaaaagttgaataaacttgaaaacgttagaaaaaatttttttttttttttttttgtatttctgttgaaaaaattcatttgggttttttgagaaaaaaaactgggtttcacttgataatttaaaaaaaaacttctttattttgatgtacggcggtcaaatattttaccatgttcacccatccactaattttgaatgttaaatgaaaaatggtgtatttatttcttgatgttagcctcgcagttgggtgattcatttaattgatgatgcccgagttggtaaaacgattgttcatttcttccaatttttgcatgggttcaattcccattggcgccgcgaggcattttctcccattcctcagtgggcaagagattgtgaatgacgcgatttaattgatcgttggctcgcaaactctaatcagacacagagggcaaagtgatcagtggttcatgttgatctcccattgtacccgcttcaccatcgggcattgggttttgcaatggactaacaatttagtttaatttcattttataaaaaatgctttttatttattttagtgtgtgtgtgtgtgtgggattttaggcgctaatttgacatattatgctgaaaatttattgaatgcaaatacgtttttatgcgaaaaattatttttgaaaaaaaaacatttctcattccgtcttccagaaataagaatttatttggtacttatccttttttaccccctcttgaaaaaaaatttacttctaaatgggaaaattttattcgctttggtcagatttttgcaaatttgactccaagttaatgcgcattagtcaatctttcgtcatgattttttttttatatatataattttttccgcacactttttaaaggtcaaacaaatttctgtctctgaaattctgccccgcacttccgacctgatcttcctgaacatcaaaacgtacgaaggtatggggtaggcaggcgtaaaaaaagttacaaatttttttttgagaaagttattttgcttatgttagaccatccttacactttggaattgaccatgaaaggatggcgcgtttgttccacgcacaccgattgtatgaatggtaagttttgcaatttattattggcaaaaaaaaatttaaattttcaaagttttcaggcgattatcacaacgtggcactgcacacgcgctattttcagaacgcaaaggaattgcttaag

SEQ ID NO: 54929 - DNA, 640 bp, Heterodera glycines
  Genomic contig location: Contig_ID=SeqID_4571; Location=2131..2770; Strand=+
  SCN-specific regions: Sequence locations=1-270,292-350,373-508,547 -605,627-640
atgtttgttgcacgttcccagtgttgtgcgcctgttacaaacagtctaaagattagtcgctcttttgcggtcccttggaggcaatttttcgacaaattaaaagcggacagaatcaatgcgcaagtggtgagaaattagggggtggcggatggataaaatttcaacaatttatttgggaagtcgataatgcactttttaattttgcgggccaataatttatagggtctcaaaaattgtccgattgtgtcacattttcaaaatctttcgacatggttgtggtggtggtgggaccctaaaaatctccaaaaaaatggggggtccgtttcgttacattaaaaaaatcccaaaaaatgagtaattccattttgaatttttgcagaagcataagccgttggacgatgaccacaagcggtacgcggatgacgaatggcattggatgccgacgggcgaaagcgacattcaaaaccaagcaaccgtcacatttctctcgcgcacattgaagaaagagaaattggtgcgttaagaaaaatttaaaaaatttttgttaggtagcttatgagggaggaaataataggtgatcgtcgttccaccctggtggattaaaacaggactccaccgacccggtttttgggatatttga

SEQ ID NO: 54930 - DNA, 661 bp, Heterodera glycines
  Genomic contig location: Contig_ID=SeqID_24214; Location=178..838; Strand=+
  SCN-specific regions: Sequence locations=1-661
aaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggaatgccccgaaaacaaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaac

SEQ ID NO: 54931 - DNA, 473 bp, Heterodera glycines
  Genomic contig location: Contig_ID=SeqID_24215; Location=462..934; Strand=+
  SCN-specific regions: Sequence locations=1-473
atggctaaatcggaagacccggcacatttggagcgggcgagtcgaatgatggaagtgggccaaagccattggaaggcacttttaaaaggcgaagaattggtaagtgtgaagctaatcatttgccaaacattgcctaaagcaatgccaatttcaatttttcagtccgttcgaaagtgccgccaaaggccaaccgcaaaaagcttctcccaattgtcctccgacagtctcaacacttctcagttttatcaactcattgcgaaacatttctgtgaagggtttccccagcaaatctgcttggaggtgaattactcggacgaggactacctgatggagggtgccaacgactacgtggacacgtactttgacgacggcgacggatacgacgacgaaacaaacgcattggaggaggagggcacatactgacgggggggggggggggaagagacgaaaaatgatcaatcaaagagggaaga

SEQ ID NO: 54932 - DNA, 1226 bp, Heterodera glycines
  Genomic contig location: Contig_ID=SeqID_24216; Location=333..1558; Strand=-
  SCN-specific regions: Sequence locations=1-445,467-939,965-1134,1156 -1226
gccgcgtcgtcgaaattgacgaaacattagttgtcaaaaggaagtacggggttggccgggtcttggagaaacaagaagtctggctgttcggcggtgttgagcgcgactcaaattgggagcgcgttttcatggttcctgtagaatcccgtggtgcggctcgccttcttcctctaattcagcaatatatacttcctggcacaacgattgtcagcgatgaatggcgtccgtaccgcggaatcccgaaccttccgcaaaactatgtgcattggaccgtgaaccattcacaaaactttgtgaatcccgcaaatcgtcttgcccatacccaaaatgttgaatccatgtggaaaaaattgaagaggaatttcaaacagcaatttgggaacaagactgaaacttacgacacctacttcccagaatttggcgtcagcgtttcggtgatcgtgaaaatgttttttataatttttggctgcatgtctctgagttttatccatgcgaacattgaattttttttgttttttttcttttttcgtgcgtttggagcgattttgttggataaatgtgaatttcgaaaaatttgagttttcgatttttgttcgaattcggatcaggggttcggaattgggtgaaatggatgccatattcgtgctcagcgaccccgaaaaccttataacaaatatttttatgacttttgaaattttctaaaaaaatttcaaaaaaggtgtgataccatcggtactatttaccgcaaaaaggcgttgaaagagcttggatggactggagacggcagtttaccagttcaaggcatttctcgacgaacaaccaatggtgcgaacgcttctttcaaaaaagacaaaggcccatttgctgcttcaccactttgttccgtttgcgcgccaacacggatttttgggccttttggatgagcagggtgggaccatatcatttttgggggttcaattttaaaagttgtgatttttcaggagatgaggcactgcattccgtgtggcggcgacttgagcaactttggaagacgatgccggactctgaacaaatgcgacaacagctggagcatcatttcgtctcgaattggctgctggacaccggcagactcgacgaattgaatacaaacacaaataacccccggggggtggggagtccgttttcagttttaacaagttgctgctctgctgatgctgctgctgcacgaatccattcccaattgccgg

SEQ ID NO: 54933 - DNA, 1326 bp, Heterodera glycines
  Genomic contig location: Contig_ID=SeqID_24217; Location=1..1326; Strand=-
  SCN-specific regions: Sequence locations=1-1126,1148-1326
atgagcgcggaccaaattaagcaactcctcgaggccatgcgtgtgcaatcggatgccattcaactgctaatgggccaagcaccacaaaacgccacgagtcttaaccacgcaaatttggcgagttccatcgacggccgaatttcaaaattcaattatgacgccgaaaccgggaacactttcgaacagtggttcaaaaggtttggagttctgattgaagaggatggtaaggacctccccgagtcgaccaaagtcagactcctccttggcaaactcggcgacgaggagtacggcaaataccgcgacagcatcagtccgacccagcccgacaaagtcaattgggtggactcgatcaccaagctcaaaggattatatgccgaaacgcgatcattattcgtccggcgctacgaatgtttcaaaattcgtcagcagccaagccaggacatctcatcgctggtcgcacacatcaacgcgtcctgtgaaaatgccaatttgagtccgaccaaagaacagctaaagtgcataatcctggtcattgcactcaacgacgagcaccacgacctgaggcaaaagtgtctcaaaatgctggaggacgcagaaaagacaggcacggacatcactctccaaaaagtggaagaggagttgaaggcgattcaaatcgttaaagaaagtgccctttctctgcttactcaaccggtctcaaccagcgccatccaattgcgacctcagcaatggcgagagaccagcaaaggcaaacataaggcaaaaccgggacccaaatggccacatcatgaaccggcacccaaatcgccacatcatgcgccttcgcctaagcaaaaatcggacgacaaagcaaaccgaggccatccatcgcatccatgcgcatcatgcggaagcaacgatcactggcgatcggactgcaaatttgccaacgcattttgcaacaaatgcaaccggcaaggccacattgcgattgtctgccgtcagcgctcgtccaacacggcacacaaatttcagaaccgatcatttcacacggtcgtggccaagtcacaatgcatggtgattggcacaacccaaggccgatggtggaagatcccggtcacgatcaatggcacaaatttgaagatgaatggagacagtggagcccaagcaacagtcatcagcttcaaaacgtggatcaaattgggtcaacccaaactctctccaacacatcgaaacccgcaactgcaatggcaccgcattttcaaccgaaggaaaatttcattgcaccgtcagttgcttcgatcggccatccaaaacactgatcgtttacgtcagccagtgacttaa

SEQ ID NO: 54934 - DNA, 409 bp, Heterodera glycines
  Genomic contig location: Contig_ID=SeqID_24218; Location=956..1364; Strand=-
  SCN-specific regions: Sequence locations=1-211,233-262,309-409
atgaaatataatcaaggtattcatttttttcgattaaaagcgtatgaggcgcttccggaaaaatttaaaaaacttttttttttgtagattatgcaaaataaacaataaaaaattgaaatttctgagaattttttgcaaaaaattttggaaattccgttagtaagggagctccgaagaacctgctaaatgcaatataattttgttgagaaaataatgctcttttaaaatattttcgaattttccctttaatgtgccttttctcttttataattcattaaattaattaataattatttttcttattttttgtacatatttaccattgaaacttcagaaattgcactaattgtgataacatgtgcagtcacattcacaattgttggtgcaccttaataaatattaaaataaa

SEQ ID NO: 54935 - DNA, 461 bp, Heterodera glycines
  Genomic contig location: Contig_ID=SeqID_24221; Location=138..598; Strand=+
  SCN-specific regions: Sequence locations=1-128,156-370,392-461
atgcatcgggacggtgtgaaagcaagacatgccggaaatgggggagaaatatctatttttggtgacaaaaaattaaaaattgattgtataattggggcacaaaaaagaatcattgaatttcaggtgggaaaattttaaattttaaaaaatatttagcatttaggggtgcgcttttcacgggtgtaatacatgttataaaggttatatgatacaagcaaatggatttacggcggaacaaaattatgataggactcaacgaaaaatggaaaaattaagaattgcggggaaaaagatgagatatactgtagaggaagtttgggtaggtgtataaatacattttggtcaaaaaaatctaattttaggaatgtgatgtaagaaaaatgttttataaaaagagtgcattttatgacacgcaaatggtcaaattttttaacaccttactcgtaaataggacctattaa

SEQ ID NO: 54936 - DNA, 487 bp, Heterodera glycines
  Genomic contig location: Contig_ID=SeqID_24222; Location=336..822; Strand=+
  SCN-specific regions: Sequence locations=1-250,272-410,433-487
atgtcaaaagaatatgcggactcagaaatcttagaagttgtctgtgcgggtaattaataaaaacgaaataaaaataaatgttagttttaggacctaaacaatacgctttaaaattgaaaaacaaaaatggagaactttggtataagacaaaaattagagggatgacacagaataagaacaataaaattgattacgaagaatttaaggacatggttttaaattatcaggaggaaaagaaaatactgtttaaacatccaaataaattcgggtatttttactaatttttttagaaaataaacaatttctttagaccaacgagagaaggttatgtgataagtcgtaacgttacaaaggattataggccgattcaaaagaaggggttagtttgacagtttttattaacgaaataatatataaatttaggattattttgaacgatgaaaatttaagtgttttgccttttggttgttggtgattttttttttga

SEQ ID NO: 54937 - DNA, 1013 bp, Heterodera glycines
  Genomic contig location: Contig_ID=SeqID_4572; Location=184..1196; Strand=-
  SCN-specific regions: Sequence locations=1-199,221-629,674-794,832 -1013
atgtcgagcaatttgctgggccgatttaagctgatgttgagcacgggcgatggggcggacgttcactttttggttgggaaagaaaaggaggtgagttgaacccacaaaagttgattaatccaaggttccgttctaaaattttcagcgcacggaggaaaagcagggatttgtattcgtttttttccaaaaaaaaaaccaaattttttgccattttctggtcaaattttagtaaaatgagggtcagacggtgcttcgccgccagggaaatgtttataatttaattgaatctttatcctcattttttttaatttttgaacaagttccatttctattccgagtttttttagcttttgaaagcacacaaatgcgtgatgatgttcgcttctgatgtgtttgggtcgatgttccgttttgatgataaaaacgcaaagacaaaaagtaaaaaaaatcgaaatattttttaaaaatgtttttttttcatcattttttagcctctgccgactgtcctcacgtaattgaagtgaccgatgttgaagcagaagcgttcaaagtgatgttgagcttcatttacgcggaagatttaagcgaattgaacggacaaaatgccatggcagtgctttacgcaggtgaaaaatttaaaaaataaataaataattatatttaaacatttttagccaataaatataacgtttctctgctggtcaaagccttattggcgtttccaattaatgaattgtcaaatgttttccttgcctttgacgaagctcgtcttctcaacgaaaatgtacaaatcgaaatttatacaaaatatttttaattgttttattttaaggatttctctcgtcgctgcttggattacattgaccaaaatgccaaaactttatttgaatctgaggaatttttgcaaattgatcaaaatttgttgtgcgaaattatcgaacgtgaccaattgaaaatcgccgacgaactcatcatttggaatgctgtactaattaattaattattcgattaaa

SEQ ID NO: 54938 - DNA, 374 bp, Heterodera glycines
  Genomic contig location: Contig_ID=SeqID_4573; Location=384..757; Strand=+
  SCN-specific regions: Sequence locations=1-89,117-374
atggcaataaagattgctgaatatggaaattataataataaaagaggtaataatctcttttcttccaaaaagaaaggaattggtaatggaaaaactaaaatttaacattttaacttcgatttacagaggtcgatttggattttaatgacgtaaaatgtgaattaaaagggcttaatgatctgattacacttttgctcctaaacacaacaaatcacggctcttcacaccacaatgacggcaagcaggactgggcgagcagttggcgtgcccgtgcctcgggcactcccggcgccgccgtcgccgagtttgcagcggccatcggtgccgtgccgtacaataggccggcgccaggtgtgagcgcccgttggtgctga

SEQ ID NO: 54939 - DNA, 1211 bp, Heterodera glycines
  Genomic contig location: Contig_ID=SeqID_4573; Location=599..1809; Strand=-
  SCN-specific regions: Sequence locations=1-551,573-655,676-711,765 -971,999-999,1021-1032,1057-1211
atgctcacacatcatcggaacgaccatcagaactccggtcaacaacattcggtagacgaaagtgaggaggagcgagaaacggacgcacttccccaacaacaatggcacattgaacgcgatgccaaaattgcgtttgtcgcattggcacagttgcatcggcgaacaacggcgagctgtgccggcaccacaactgccggcggtgcatcggctgtcagtatcataacccggtcggaacagtcagcgttcagcaacttcgtcaagcaacaacaaacaccgcaacagcacaaccatcaacatcgacacgtgcagcaacaatcgtcgctggtgcaacaacaacatcaagcagcatctgttcggcagcaacagcggcaggtgtggatttaaacgtgcccgaaattggaacagaatcagttgcaggctaacgccctccaaatagtggcaaatcccattttcgtaaattaacggcatcccagctctaatcattacaaaaaaatcacagcccggcatggttttgttggccactcatcaacaagtgccctcctcctccaccgctgttatttcttcttcagtgccttccgcctcctcttcatcggttgctgctgctactgttgtagttcatcaacaacaaatgccgcattcgaatgtgccggcaatcggtggtggtggtggtggtggcattttgatgaacaacaacaccagctattgttggtccaacaacaaattcagcaacgacaacaacaaccttactaataacaccaacagcaggtggggctgcttattgattttttaaacaaatttggcatagtacaaaaataatggcattaacgtggtcagaattgttgccgaagctttaaatcgagaattatgacattctgatcggagttttttttttataagttttgccatgaaaccgcaataacacgatgtaggtgtatcaacgatatacaatttatatatagtagaacttttgcgcaactccaacaccaccaccagcaacatttgtcctcctcctcttccgtcggtggcgccaccacgcctttgtttctgcaccatcagcaccaacgggcgctcacacctggcgccggcctattgtacggcacggcaccgatggccgctgcaaactcggcgacggcggcgccgggagtgcccgaggcacgggcacgccaactgctcgcccagtcctgcttgccgtcattgtggtgtgaagagcc

SEQ ID NO: 54940 - DNA, 538 bp, Heterodera glycines
  Genomic contig location: Contig_ID=SeqID_4574; Location=2198..2735; Strand=+
  SCN-specific regions: Sequence locations=1-39,62-131,153-326,370-538
atggcgtcatttggtgcgctattgaaatggacctattggaaatttttttaaatttaattttctgacccaaaaaatgaaatgttccaatcggtaccatttccccccccccacgccgatttttttttaaactcccaaataaattttaaaaactggcaccacacactcacctccgtcgtcgcctcgtccatggcaatgcgtcgccgcttgaacatcggacagtcgagcacaaatgtttcatactcaccgccctcgccgcatacgtgcagcccgtacttggcatgcatggccaccaaatgggcacgcatctgatcaatgcgaggaaaaacaaaaaatatatattagaaaattaaagaaatttttagaattaatgcatcacgagagtctcgactcgtgctctgccaagattatttagttttattaagcattaattaattttgatgttggatttgaatttgggacctccaaaacatcaagtttgctcattacacagtcaaagttccaattttcgaagccctcagaaataacaaattcacactaa

SEQ ID NO: 54941 - DNA, 830 bp, Heterodera glycines
  Genomic contig location: Contig_ID=SeqID_4574; Location=3439..4268; Strand=-
  SCN-specific regions: Sequence locations=1-65,87-502,538-597,668 -754,786-830
  Gene Ontology: Biological process=nucleobase, nucleoside, nucleotide and nucleic acid metabolism
attgccgagttggacagttacatgtaccaaagtgtgggcagtgagggaatcaaggttagtgagactaaatatgtatgctttaaaataaagaaattgaatgcaatttaaattttttttaatgcatttgcaatccaaaaattagaacaaaggtgccataatttttttaaattttcggcttcaaatttttaattttccttaaatttcatttttttgcatttccgaggtctcctttgtttggaaaaaactcctaggcctgttttcctgcaattttcagttttacgcggatgcccttggcctgccgctgttccaacgcaaaatttcggggcgtccaaaatgtgtagagagcaacacttatgtgcaggacgaggaggacgaagtggaggatttgtaccaccttttgaagacggtcaaagaatgggacccggaaattcggggtgattttttaatttaattgtgcattttttacatctttttgcaaacaaaaaatttttgctcaattttcttaaataaaatttcataattaaatttacaaaaaatggcattttttgacgaacgatagcaaaatgaaaatttaaaaaaacctacaatttcattcggaaaaaaactaaaaaaatttaaaatatttattggaaatgaattattttttggattttaaatttaattttttgtttttaggcgtttccgcgggcgcgataaacagcacttatcaaaaattgcgtgttgaacatgtgtgcgaacggcttggactcgtcccgctgtgcttcctgtgggaattggaccaactccaactgttggacgccatggtcagtgaatggtgctgcacaaaatga

SEQ ID NO: 54942 - DNA, 864 bp, Heterodera glycines
  Genomic contig location: Contig_ID=SeqID_24225; Location=88..951; Strand=-
  SCN-specific regions: Sequence locations=1-339,362-864
  Gene Ontology: Mol. function=ATP dependent RNA helicase activity; Cellular component=nucleolus; Biological process=mRNA catabolism
atgctggacgtgaacaaaaaagtgccagaattcgacgcgctccgggacaacatggccaagcaggttaaagacagacacgattcacggaaatttaacaaattgaaaaaaatattagttatttcttcctcaaaaaaggcgttaaaattttccgcaaaaaaaaaaaatctttaaaatatggccaaaatttaccaattttcccctacggcaaaaaaactcattaagaaaatttccaaaaaaaaaaaaaaacagttttcccctaaaattaagtggaatagtggatctaaaagtcaaaaacgcgttcatcttctctgatgaataaacaaaatgccattttaaacgtttttaatttttcccgtttcagtaccccttcgagttggacccgttccagcagcaggcgattgtccgcatggagcagggcgcctccgtttttgtcgcggcacataccagcgcgggcaaaacggtggtggcggaatacgcggtggcattgtgcaaactgcaccggacgaggtgagttggggtggggtggcacaattctgtttttttttgacaattatttcgacttttttttaattgccgggaaaattaaaaagtgatttaaaattttagaaaattcttcaataattcgtttttaccccgaaatatgtatatgaattatgtcctgacttttcgctgtctgtactcctacataaaatataatttctaaaaaacgaattggtcggttaaaaattgccaaaattcttcgcccctctccaataatttcaaaatttttagagtcatttacacttcgccaatcaaagcgttgtccaaccagaagtttcgcgatttccgtctccattttggcgacgttgggctggtcaccgggcg

SEQ ID NO: 54943 - DNA, 60 bp, Heterodera glycines
  Genomic contig location: Contig_ID=SeqID_24226; Location=65..124; Strand=+
  SCN-specific regions: Sequence locations=1-60
agagcccgggaacagctgcatcggatgcaagtgcccacgttgctgtacacttaacagttg

SEQ ID NO: 54944 - DNA, 2020 bp, Heterodera glycines
  misc_feature (1978)..(1978): n is a, c, g, or t
  Genomic contig location: Contig_ID=SeqID_24227; Location=1..2020; Strand=-
  SCN-specific regions: Sequence locations=1-182,204-380,403-850,872 -1062,1138-1470,1493-1515,1537-1684,1707-1708,1730-2020
ggttttttgataggtccaaggagggttaaattttcaaaaaaggggcttttttgtgggttttttggagaaatttttaagttttttttgttaaatattttcataaaaactagaaaaataccaatttttttcggaaaaatcacaaaaatacgaaattttttttaatgaaaatatgctaaaaatatggtcaaaattctttaatttttcccccggcggcgcctatcggcaccgccggacccgtaaaaatcttaatttacaagcaaaaatttgctcaaaatcgcaaaatttggtcatttttcggacaaaatctgttaacaaatcgcattgaaaattacaaaatttttcccggcgcggcgcctatcggcaccgccggtccccctgtcccccaaaagttttttgggaaaagcgccgcaaaaaagcaacttcgtttttcatgttcagaatcccaaaaaatgcttatttctaacaaaaaaaatgctcaaattgatcatggacaatcaaaaatataacatttgaacattttaaacgtgttttgaataaattttgtaaaaatgaggcttttgaaaattttaatctggcagccctggttttaaatgttatttttgcattttccgtgtttggatttgctgctgttctctgtccgtgtccattggtgccgtcacacttttgcctttttctgtgctcggctcggaagttttggagcgataccccgacaatttctacttgaaatggcttaacgcatcgctgatcaattctctgtggaattacgtgttcatgctcagcaatgtgtcgctttttgcactgctaccattctcttactttttcattgaggtacagaaaaattttgaatttttccagtttggtttttaagaatgtgccttttttcccttctaaaatacgaaattgaaccacaaaaaaaaaattaacccttgttacatagaatgatagtatcaaagtttgcatagattttccaggtggttgggctacaaccttttttttcttaaaatagtcatcacgcctattattttttggttcttttaataatttaatgactggtttttcgtaagcaccgtggcgcagtggaagcgtgctgggcccataacccagaggtcgatggatcgaaaccatccggtgctaccagctttttttaaatttttttccatccttttgtttgtgttttacttttctctttttagtctcagggctttagcactgctgcctttcaccatcttcaagtcgttcagccctttcccagcaattccgcccccgcgtcagtgcgtcgccctctcatcgcgcgcttttacgaaactgtcgttgtctgtgcattggtcatcattgtactggtcggaattgctgacatgttttactctcatctttttttacaggtaattgagtgtctgtcatttcattttaatgttttgccatttgtcagtccgttttctctcttttagccttcgtacatttcgctctctctcctgtccctttccctctctttgtccacccctttgctgtactccttcgcgtctctttttggcgtttcgctgttgctcctttctgttccgctcggatttgcaaaattattcgacttgttcagtgaaatgcttatcacccaaaagacaacaattgggctgagtgcagctcaaactcggccacttatggtattattaaaatggcttaattttcggatgccatttttcttttccttttcaaagacaaatatgactgtgcttttcccattcgattcttacgaagtgaccactcctgaacgattgcaggtgccaacacttccacaaataattcaaaaacgagtcttccaggctttaagttgtattcgcaaggagactaagttgcgtccgttccaacaccaattgcatttgtccaccccatttttaaggttttcaacagcgataaccaattactctgctaacgtcatcttttctgatcacaggcaccgttcggtcactgaactcaattcgccttncatttaacgtgtcggtgcaatcgctgccactaatgaccatgc

SEQ ID NO: 54945 - DNA, 181 bp, Heterodera glycines
  misc_feature (135)..(135): n is a, c, g, or t
  misc_feature (149)..(149): n is a, c, g, or t
  Genomic contig location: Contig_ID=SeqID_24228; Location=1..181; Strand=-
  SCN-specific regions: Sequence locations=1-181
tatttttcctacacaaacaatattgtgacagaatatagcaagaaaaaatgattgggtgtgtgtgtctatcccaagatgacgattttccatggtaaaaaatgtaacaccaattaattcataatcagtcagtcatanaattgactgtttanagcgtgacgatgaaaatgcatttttacaagac

SEQ ID NO: 54946 - DNA, 363 bp, Heterodera glycines
  Genomic contig location: Contig_ID=SeqID_24230; Location=186..548; Strand=-
  SCN-specific regions: Sequence locations=1-363
cagaaacaactccgttcagcgcaagcgtgcgcatgggcagcgaaggagaccgagcaagtggtaatgacacagcgctggccaggcatccgagcttcccggacttgggaagaaccatctcgccgctggacacagctccgagggcagtgcacaggcactcacacgagcactccggatttcccggttaggacacttcctcaggccaaaggccttcgggcgcttatgtctcgtgttttttcgaatgcaagcacactggtccccaggcaaggagttccgatccacgaactcatagggcttgtcaaccatggcaatacgccactcactcgtataccaacaccaccaccaactttaggttcagcatcccca

SEQ ID NO: 54947 - DNA, 66 bp, Heterodera glycines
  Genomic contig location: Contig_ID=SeqID_24232; Location=731..796; Strand=-
  SCN-specific regions: Sequence locations=1-66
cataaacatttatttgatttattttaccatattcaaaatttgatcaaaatataggtggtcaaaagt

SEQ ID NO: 54948 - DNA, 97 bp, Heterodera glycines
  Genomic contig location: Contig_ID=SeqID_24234; Location=1044..1140; Strand=-
  SCN-specific regions: Sequence locations=1-97
atgaaatcgtggttccttgtcctggtgttgctgctcgccttttgcctggttgttcgcctcgtgatttgtttggtcaaatgcattaactgctgctgct

SEQ ID NO: 54949 - DNA, 308 bp, Heterodera glycines
  Genomic contig location: Contig_ID=SeqID_24234; Location=1390..1697; Strand=-
  SCN-specific regions: Sequence locations=1-308
atgccgtcctctccgatgcctttttcgctgttcgtcgtccttttcctattcgtcccatttttgcccggatgttcgtctttttatttggcgcctccttcttctccttgtgtctcctccgatatcgccaaaatctgtgagatttccacacaaattcatttaccaaattctgcattttgtttgctttttcaggcggtgaaccatccgttgcgcattatttcgagtgctgtggagacaatggcgcaggtcggcacacgaaattggcacatgacaaatgttttgtggcacttttcggcttctttgtgccttga

SEQ ID NO: 54950 - DNA, 338 bp, Heterodera glycines
  Genomic contig location: Contig_ID=SeqID_4576; Location=469..806; Strand=+
  SCN-specific regions: Sequence locations=1-167,189-194,216-338
atgcattcggttgtccatattcatcaattgtgcccaaatcggtcggttgccaaaacaatgaattgctaattctttctttgaattcgtagtcaccattttggtaccactgcgttctttcaccgcttttcaagtccaagtggagtccgcgcatctcttgcacacggccctttttcaaagaaattcaaaatttaataaaatttttagaaatttgggcctggaaggcacttggagtcctatcaataaaaaacattatgaaggcacaaaattaatggttcgacaatttctgctatttgtgtttcgagttttgatttcggctttatgattcgctgtccattgga

SEQ ID NO: 54951 - DNA, 1142 bp, Heterodera glycines
  Genomic contig location: Contig_ID=SeqID_4576; Location=1635..2776; Strand=-
  SCN-specific regions: Sequence locations=1-47,69-71,93-384,406 -458,480-502,524-1142
atgacccggacaaaaaccctaaagaagatcctccgaaaaaacgccgtaattaatgaatatttatttttgtgccaaatttttgttcccattttcggcactctcgcactttttgacggatgcatcaccggggcaagcaaaaactgtacggcaaatgtgaaaattgattacgatgagatttttcaattgtccaaatgtttttggggagaaaggcgccgaacagcttttaagggcacgtaagtcgggaaatcttgaattttaattaattttacataattatgatatttgttgagttgccagcccagaatggatgggcataattgattttgattgaggacaatccataattatgattgatggcacgcaaatatcgtagaaatttaattaatatccataagttttgtgttttgattaacgattttcatgattttaggtcgttaattacggattgtgttcaatcaaaatcattttttgaaggcacgtaaaccggaaaaattcaaaactttaaataattaggatgaattagtaaggtgcaaaaatccaaaaatagatgaatattaaatgacttttataaataggaattgttggataaatttgaaagtttttaagaaatcaaaagattccttaggtgccagagatgaattttactggattttagtttcgaacaaccagaaaattgggagggcataccataaatatgtataaaaaaatatttgttgctgtttgttgttaaaatagtgtttttattttttacagtatccaaatcaaagcatccgttgatggttacggtatgagtggcgcttcaccgttcacttttcccgtggtgttcaaaaaccgacactgctgggacccaattaattactacacttcacaagatttcgagaacataacaatcacattgagtggcgagtgagtcaataaaattgaaaaataatgaaattttaaagaaccgaagtttggacttggaaaatgcacacactttttgaaatctgatcaagacggatcagcagagtctcttctgatcttattatgtggatatatggattaaggaaacgaacccactaaaaaatttttggatttatcttgctggtccaagtgcattctcaaaaaaagtctagacaaaatccggtcagggcggtaataaa

SEQ ID NO: 54952 - DNA, 450 bp, Heterodera glycines
  Genomic contig location: Contig_ID=SeqID_4576; Location=2779..3228; Strand=-
  SCN-specific regions: Sequence locations=1-91,113-125,199-240,268 -417,439-450
atgccaagctgcggtaacaaatattatgaccatgtgaaacattgtgccatggtctgtaattggtagggatgagatttttaggtagaaaaattgcaaaattggcactaattacccccaaataagcgaaaatatgtaaaattttaaaaaaatttcaaaagggaattttaattaaaatttcatcaaaaaataattttttatgaccgacaaagaaggcgattacaaatgacaaataatgagaaaatttttaattaaaattggtaatgaaatttgcgctgtttctaaaactcaaattttaatggatgaataattgaggatctttcagtcttagggggggggggggggctaattttttgaaattctttggttggatttttcattgaaaatttcatccccacgcatttctaattaaaatatttcttatttttggaatttttaggtccatttctataa

SEQ ID NO: 54953 - DNA, 92 bp, Heterodera glycines
  Genomic contig location: Contig_ID=SeqID_4576; Location=4944..5035; Strand=+
  SCN-specific regions: Sequence locations=1-92
atgcttgatcagagaatgattagagtgatagcgaatgatcagagacgtagagtgattgatcacagagaaagagtgatagcaaatgtgattaa

SEQ ID NO: 54954 - DNA, 610 bp, Heterodera glycines
  misc_feature (401)..(401): n is a, c, g, or t
  Genomic contig location: Contig_ID=SeqID_24236; Location=1004..1613; Strand=-
  SCN-specific regions: Sequence locations=1-587
atgcgcgccttcgtctcccactgcggtttcaacagtgtcaacgaggctgtccaatttggagttccaattttggccattccgttgcttgccgaccaactgtacaatgccattatggcacgtgtgaaaggcattgctgtccaattggatgttggtcaactcaacggggacggggccgaacagctgctggtcgatggacttgacaaggctaattagcatgaactgattatgcatttaatgactttattgctttgcaggtgctaaatgacccctcatacatacaaaatgtcaaattattgaaacaaaagttcgcttcaaccccttttggggcaaaggaaaagctgatccgatgggtggaattcgcggccgaattccccgacctgaacgagttgaacttgccctgngaagaagagctcggcacattggcctattatagcgtcgacatcattctgtccattgcggcactgttgggaatatttgcttggattattttcaaattggcaaaatttctgacaacaaaatatttgatttctggcaaaaagggagggcaaaagacaaatgaattaaactaattgattatttcataaattcattattacttgtaattaataaa

SEQ ID NO: 54955 - DNA, 1461 bp, Heterodera glycines
  Genomic contig location: Contig_ID=SeqID_24238; Location=125..1585; Strand=+
  SCN-specific regions: Sequence locations=1-379,404-432,455-623,646 -757,794-923,945-946,969-1334,1359-1461
  Gene Ontology: Mol. function=RNA helicase activity; Cellular component=nucleus; Biological process=cell growth
atggcggacaacgaagtgaaactgagtggccatagtttgacaggaccagtgaccagtttccaggagtcgacattcccaggtttgcatttggtgatttggggcacctttttggggtgatttgtccctcttttattggcactgaccaatagcaaaaccgaaaaataatatttgattttcaaaaattattgattttttgagccatgcccaacacatccacggcacaatgcggacgaggcatttttgtgtatggatgaattgggatatggataaattgtgtgggataagttggtttaatccccgatttctaaatttattcttgtctcaagttgaataagtgccaaaatttattgtgtttggtgattcgtaaaatgcggagaataaattttttacaaaaaattttcctaaaattgcattgacacagtctcgtgtcatctaaaattttatacagaaaatactcattttttttctttcagcaccaattgttgcccaactgtccagcgtgttctccgcgcccactgccatccaggcaatttcgtggcccgtcgcgctggccggaaaggacttgatctccatcgcaaaaacgggcagtggcaaaacgctgggcttcactttgccaggtttggatttccttcccccgatttttagtgctgataaatgtgccccgccggtggtaagcgttattcaacaaatttcaagtttcaccctgttgtttggtttacaaaacaaccatcatttaaataaaataaattttcatccaaattcatggtatatgtttctgattttgtcaaaattggtggtcatgttcggtgatcagtcaaactcaaaaccaacccagacaacatgttcataaacaaacttttaggacaacaaatttttgttttcttcgaaaatgggagagaagagagctatgggtttcattacccattatataaaaaatatattttcaatgaaactaagaaaaatgaagaattttgaattgatcataaaccggtcaaaatttcgccgagcaggttggcatttaatacaaccggttccatggcccgacctttccaaaaccagtcaacccggattcttcaaaaagtggcggtccggttttgccgggcccgataaaaacatgtaccgggcatggccagggtttcgcatccacttacaattagcaggaactctctgtcccgggttttttgtgaaaaatactgggcacataagttttaattgacccaatttttctttctttgattaccatttcattttcagccattgtccacgtgctgaacaaccaacgaccgcagcagcagcgtcgtcctggcgaaggtccggctgttgttgtgctgttgccaacccgtgagctggcccaacaggtggagacggttgcccgtgaatatggccaactgatgcggctcaatgtggtcgcgtgttatggcggtgcatcaaagtggccccaaatgggtgcgctgaagcgcg

SEQ ID NO: 54956 - DNA, 557 bp, Heterodera glycines
  Genomic contig location: Contig_ID=SeqID_24239; Location=779..1335; Strand=+
  SCN-specific regions: Sequence locations=1-284,306-557
atggccatggttggtggcactgtttgcccgcgaggccggcatttgtggcgatggtggcaacaaattctgttgtacggcatcaatcattgggccgcagcatgtgctgaccgcggcacactgcttcatgtctttcaaaggcgaacagcgagaaaatatgcacgaagaggtaaatgaaatgatgcgactaatttttttatgttcctaattaggcaccctaattaatgattatgattttcaaatacatagaaaataggaggctgatttaaacaagtacctgggcagtggaaaacaaattttcaactttgaagtagggatgcctcccccattccagcggtgctatgtcgttataaaaaagccatgaaaagcccaaagtgttttccactagcctgtcaaatttcaaaaaatttcactatgttttaaaaaagttttagccaaaaattttgaaaaactggttccgggtgtattttttggccataactttgttcaaacctgattaaattttttgaaacttaggcgagcttatagcgaattgttagagatatcgaatgataccaaga

SEQ ID NO: 54957 - DNA, 685 bp, Heterodera glycines
  misc_feature (286)..(286): n is a, c, g, or t
  Genomic contig location: Contig_ID=SeqID_24240; Location=49..733; Strand=-
  SCN-specific regions: Sequence locations=1-650,675-685
atgcccgatttgctggtcagcattgaacagttttggctgtccgattattggaaggcgttgaaaccgacggagcttctcctcttttatttgttccccgtaacggtaaaagaaacaagcaaaaggaaagaagcataaattaataatcttcagaaaaaagagaattgcgaaggccaatttatcgtgccgaacataaaccaattgttgtggataaacgcgggaaaagtaaacgaagaaaaaatgggaggggcggaatcaaacgcaacgggggggggggattcaaaatgcncaatttcgatggatggcaaattgatcaaactttgccaaattctatcccatttttgcattcgctttcactctcacatttcagagcaaagaacaagtggcgaagcagaagagcggaatttggctgtgcagggcatcgctgctaattgacatgagcgaaagtgcggaagaatatccaacggaagaggaaacatcgcccgaggtgctattcgaacacgacgtatttgtgggggcggagaaagtgcagctgtactacgaaatcactgtgcagcgggagaaccaactgaaaatgagcacaggtccaagggaaatgccaaaaagggagaagggaggagacaatccgcaaaatgtcattttagccaatcccatccccaaaatggcttttaggcaaagtgaaatttga

SEQ ID NO: 54958 - DNA, 312 bp, Heterodera glycines
  Genomic contig location: Contig_ID=SeqID_24243; Location=1060..1371; Strand=-
  SCN-specific regions: Sequence locations=1-234
atggtgattaaaagtgctacaacagtgatcagaagaagtacaacagtgattagaagaggtacaccagtgattagaagaggtacatcagtgactaaaagaggtaaacagtgattaagagaggtacaacagtgattagaagaggtacaacagtgactaaaagaggtaaacagtgatttaaagaggtacaactgtgattagaagaggtacaaaagtctaacttgttatgagatgtacaaaaataatttcataattttaaatataattttatagaattaggtttattttaaaattttaaaaaaacaaaataataaa

SEQ ID NO: 54959 - DNA, 280 bp, Heterodera glycines
  Genomic contig location: Contig_ID=SeqID_24244; Location=119..398; Strand=-
  SCN-specific regions: Sequence locations=1-236,258-280
atgttgttcactggcattgaccgactaattgtcttaatttttggtgaaatgtaaaaaaacgataaaaaatattcgcctttacattaaatttgttacagccaaaacaagcgcaaaatccgactgtatttgactacgataatatttatttgctctattttctgtatagatttatgttacactttttatcagaatattgaattgtatggtgatcagatgatcactggaaattacattgattttttcatggtttttcaaaacaatcttttgtcataaaattaaa

SEQ ID NO: 54960 - DNA, 466 bp, Heterodera glycines
  Genomic contig location: Contig_ID=SeqID_24244; Location=433..898; Strand=-
  SCN-specific regions: Sequence locations=1-39,75-214,260-438
atggccaaattggacaactacgataatgatacggtaattaattggtaaagtgttattttaatatttttacaatcattttgcagttttatttggccttcaaagatgcccatcccagctggtctctgattggatgtgcagcaatttttggaatcactgcttcatttggaatcctgtttcatttgtccgtgatttttgtcaccatcaaaacaaagtgataattaattatcattattttggtaattttaaaatttaattttttgatcactgaatggcaccgttaattaccttttggcactttgctccttttttgagttgcttcacctaactggccattttctgtttgtgtacaacgctttgtctggacaaaatttcgttgagtatcgtttggcagcaatgattttattcattcctgtgattggattaggtaattcataaagctaaaattgtataaatattatatattaaa

SEQ ID NO: 54961 - DNA, 131 bp, Heterodera glycines
  Genomic contig location: Contig_ID=SeqID_24245; Location=1602..1732; Strand=-
  SCN-specific regions: Sequence locations=1-15,38-131
aaaaagatccagtgatttaatgtattattttataaagtgcaaatttttttttttcattcattcgtttgtttctttttttagtcataatcattatatgatttaatgattcttatatttattaaatatcaaac

SEQ ID NO: 54962 - DNA, 1491 bp, Heterodera glycines
  Genomic contig location: Contig_ID=SeqID_4577; Location=779..2269; Strand=-
  SCN-specific regions: Sequence locations=1-228,251-414,436-486,519 -630,653-686,747-769,810-1185,1214-1252,1274-1359,1381-1491
atgcgtcagacacttgcattctttctgcaccttttcgtcttcgtcgcttatttggccaacggtggcttcggtaggcagtcaaattttgacggtgctgggacgttagtcaaaaaaccatcaaatgaaaaatttttgtcagaaatttatttataacttagcctagtatgtacgaatttttaaaatcttgatatttttagatagctctaagtgttttcaattatcatgcaaaattttagaaaaattaattaagtttgaaaaaagttatgacttgagaagctcagaaaaccaagttttttttcaacatttttggccataacttttttgagacttaatgaatttttttgaaattttgtaggctaatagaaatacttagggctatcgaatgatatcaagattttaaaatttggttgcctctgagcaaagttatatcaaaaaatcttttcatttgatggttttttgactaacgtcatagcaccattttgacagaatatgggtgaaaaaataataattgttttaaaatgccggcagatgaatcgctgaagaaaaagcatagattaatgttcaataaaagacaaaatgtgcctttttaataaattttaatgtcatttagagtcctgctggtgggaattttgtgtttgatttgttaaaagatttttgtcaaaaatctcacaaatttataatgggaattgccttttatttttccagtgtttaaaaaaaacttttttatttaaattatttatttttttccaaatttctcaaaaattcagtctttacccagtgcttttcttttaagaaattaatttataaatcaaattcaacaggtctcaagtgcaaacagggacaagaaagccagccaatcagcagaaacttcatcatggccaactcctcatgtcctgacaaagaggcgaaatattgtgtagcggcaacctgcacaattggtctgagaggacaaaatgatactgtattttgcaattgccatctaaaaaggatggctaccgtatcccttcaattgggtcatcggtgctttatttttcgccccttccgtcaaaaaaaacattttttttttaaacgttcataacatggagttaaaacaataaaattttaattggagatggtggtattttccatcacagcaggtgcgttggagaatagagaatttttatcacgattttatggacagaactcattaatttaattaaaatttagttttttagagtttacaatatacgaaaaatttaaaaatatacaagaattttaattcagtgctgagtattttaaaaaaacataagcaattaagctgagattcccagtttcggagcaattatgtggttttgtcaccaaatcaaaaatgtcgaacaatgtgaggaaagaagcaaaaagtatggcttgtcgtgcaaatgccattttggtgaggaagggcaagatcacggcaacgaacagtttacgcttccgccgccgatcccaattgatcagaacgagaaaggtatctga

SEQ ID NO: 54963 - DNA, 758 bp, Heterodera glycines
  Genomic contig location: Contig_ID=SeqID_4577; Location=2327..3084; Strand=-
  SCN-specific regions: Sequence locations=1-65,124-189,220-295,317-734
atgctaaggaatcaaatgctaagattaatatttgaagaagaaaactattcgcaatgttttatcggtaataatttaattgtttgttttataaaagatttttcaataaataaaataaaataatttccagtggctattaatttgcatttttctgctttttctcttatgggctatcacaaatggagaaaagtgtaattattcattcattcattcattaatcatttataatttttgctgatggttttgatggtttcccatcatttggtgacaaatcagttgttacatacatatcagtcaaaaccattttttgattaaatataatggacttactaaattactaaaatcctaatgagaatcattgagattgaatttaaatgcaaaaaattgaaatggttttataacacatataagaaatgttgaaaactattctgataggaatttttatagtatggtgacaattttttttagaaaacttggattttttatttgattttttatcaaaaaatatgaattttttgctagcttttttcaaatttatgcttttttatccttttcattactttttttatgtgtttcaatcttttttgtgcctttcgcatttatttcgtaaaatatttacggaaaatccaccaaaaacaaaatgcattcattcccaatgaatcatctccatcattctgtcacaatttctattcaccacttattcgatctgctgcaaaaccaaatggattcattttacgattaattaaaaaaattaaaataaa

SEQ ID NO: 54964 - DNA, 899 bp, Heterodera glycines
  Genomic contig location: Contig_ID=SeqID_4577; Location=4109..5007; Strand=+
  SCN-specific regions: Sequence locations=1-264,298-369,423-556,578 -656,678-713,757-783,806-899
atgtcagaagaaatgaggcagcgattcaaaaatgtcctctgcaaatgccaaattggcgaaccgtacaaagacatgaccaatgatatgccaaaaatgacgcttccaccgcctaagccaacatcgccaccgacgccaacaacgacggagccaccgagtgagccgttagaattgggttcccggatgctcgggccaacgtccggacaaatcatcacagtagacaatccgtcataaaatttttgggcaataatgatcaaaagtcttgtgaaaattattgtaaaatttaataaataatatttacatagattcttaacatttctagttacttcatacttctattaattgaccatcttgagagaaatttcatttaagttttaaaaaatgattatttcatatatatatatatatttaaaaaaaaaataaatctagttgacggattgttcactgacagattgtctactgacggattgtccggggagcctgctgggccggggatgtcggtgctatgtcgttatataaaaaccatcaaatgacaatttctagagaatgatagcaagatcactttattttgttcgttttaagaatgttttgatcagaatttttgatgatcaaaatcattgtatttttaattaaaaaacttctgttagaaattattcttgttttttattttcttgctattcgtcgatagacctatgtgtcctctaaaaacttaaggctaataatttataattaaattcttatttcaaaaaatttaattaagtttcaaaaagttatggccaagaatgtttgaagacctgattccctgtgtacttttggcattaactttgtggaaacttgacgaaattttttgaaatttttactttctaattgttgaaattttcttttgatggttttaaaaaaaa

SEQ ID NO: 54965 - DNA, 770 bp, Heterodera glycines
  Genomic contig location: Contig_ID=SeqID_4578; Location=86..855; Strand=+
  SCN-specific regions: Sequence locations=1-489,512-548,570-597,619-741
atgcgagggggcgcgtcatatgaaattcatacaaatgagaggggtaaagttgtgcatggacttcatcaataaagtcaagaaaagtgagcatttcattctgctgtcgactctcgctgtcgacaaggtacatggaaagctaagcgggaagaagttcgagcagttagtcacatcagcaaatcactctaaaattgattatttggggcacatgagattgtagatcgtggagctatcatatgcatattatatttattagagtgcagcgggaccgggaattttgggcttaaccgggaccgggaccttttctggttgaaaaaccgggactttttggctgggaaaaccgggaaaaaaccgggactagtcccggtcccggtcaaaaccgggaccttggtactcagttgtactcagttgtccgtgtccaggtcccggtcccgctgcactctagtatttataatatgctaccggttttatttcctaatataaaatcttgaataaaaaataaattggaaaagtggtgccaggccaagtcgtctggccaagcatcttaaaccaatttgtgccattaaattcttttatttgaccgaatccaaataaaagagctttcacaaaatgaagaataaattccttacattaaatacatatcatttacagttgcattcggcaccattggacgacttactgcagtgccaatcagtttctgttttacgatgctgattggttagggaaaggaatacgaataatacgattttaaaaataataacttaaatattata

SEQ ID NO: 54966 - DNA, 214 bp, Heterodera glycines
  Genomic contig location: Contig_ID=SeqID_4580; Location=974..1187; Strand=+
  SCN-specific regions: Sequence locations=1-214
atgactgagctttttgaagaagcgtgtccaaggtaatttttttctctgtcttattaactaataaacaattattagttacccgttgaaacctcgtgaatttatgacagaattattgaaagaagaataccgaaaaaactcaatattgtaaaagaagaaattggaacgagaaaatttttgtccttcactacagacttttggcaaaatctgcgcaaaa

SEQ ID NO: 54967 - DNA, 708 bp, Heterodera glycines
  Genomic contig location: Contig_ID=SeqID_24246; Location=338..1045; Strand=-
  SCN-specific regions: Sequence locations=1-11,37-40,63-78,100-197,219- 615,638-708
atgcaaaacaagagaaaaataaatgggaatattcaagtagttaaatatttaaaaaacaatttgaatatgaagcatttgtttaaaaaacaatttgagcaggtatggacgtgtatgactccaaattgtgaagggagagctgagtctcaaggtcgatcgagaacgcttcatgaaaccgcaccacacaatcacgctccgaaccaagtttatttcattcactattccatatgattattagataaaaatagttttaattcagagaaaattggaaaaaacgggacggacaagatgtgcagttaacaggcgatggaacaacaacaaacagttcagcgaggcaatggatttggaaaaaaaccaacattcgaatggcacgtgccgcgacagcgtacatgaatcaggccatatcatatgctattggtttttacaatatgcgggtgaatttacatcggtatgttaaaagcaacagatgaattttcaatgcatcgttgggcttaatattgaattattttaggtttataaccctattgtaaaatttcttttttaacaaaaggagattttgaatagcaaatggctaggaatgagttcaaggataaagcaaaaaaaaaaaaatttcagaacttaaaaatagtgataattattttcttacaagaaattttttttgcgaaaagcacattgtattagctaactgaaatgcaccttttgttcaataaa

SEQ ID NO: 54968 - DNA, 57 bp, Heterodera glycines
  Genomic contig location: Contig_ID=SeqID_24247; Location=1063..1119; Strand=-
  SCN-specific regions: Sequence locations=1-57
gctatagggaagctattcccgaaggattcggtctccccataaatctgggcgccttcg

SEQ ID NO: 54969 - DNA, 661 bp, Heterodera glycines
  Genomic contig location: Contig_ID=SeqID_24247; Location=218..878; Strand=-
  SCN-specific regions: Sequence locations=1-661
aaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaac

SEQ ID NO: 54970 - DNA, 1019 bp, Heterodera glycines
  Genomic contig location: Contig_ID=SeqID_24250; Location=958..1976; Strand=+
  SCN-specific regions: Sequence locations=1-673,695-715,737-1019
atgaatatgagaaaagacgtaaaacgaacaataacattgatcggtgaattgtcatcataatacacatttgaatattgcaaagttaacctttcggaccaaaagctctttaaaaagcgataaaaagggctctcaaattttaactttttttattttacctaatctttgattattaatttatttcatatcttttcgttgtttatgtaactcatttaacatgcattgtttgcttaaaagaaacttcagattcggtgtttatctcttaaaattaccgcagaaaaatttaaaaaacaaaaattcaagggccggatctaaacagaacaaaactgttgcatacatttacatgcacttttcggtttgatgttgcatcccatttaaaaagaacggtgaacaaagggcgatcgatacgcataaaaatcgatgtaatttttatgcatttggggaaagtttggcgacgaaatttattgtgtttaagccttcagaataagattgtttttttggtcaaatttattttctttttgcattgttccatttacataaatccatttgaggaaatcttggctcaaattgcggcattcatgcccattatataattcttgcgcctagttttgcaattcttccatttgttgattaaaaaaaaaatttaggccccaaaacggaaaagtacctattactattccccccaccccaaaccccgtaacattttttaagtttctcgtaatattttttataattttatctctgtattttattacaatctaaaaacattgcctataattcggactccaataattcaacccccgtttatttcaactctaaaaagtgtttttcccgttgcagcgtttttcggagtggacggagcaggaccagacggacttctgcaaacaccttctgcagcgcatgtgtcaccaccaacacggccaaattgaccaatttttgggcccaatgcttcggcgggacttcattgcgttgttaccaagtttgtttttgttttgtctgggtttttcccatttttagtgcca

SEQ ID NO: 54971 - DNA, 950 bp, Heterodera glycines
  misc_feature (41)..(41): n is a, c, g, or t
  misc_feature (766)..(766): n is a, c, g, or t
  Genomic contig location: Contig_ID=SeqID_24253; Location=359..1308; Strand=+
  SCN-specific regions: Sequence locations=1-1,24-52,80-136,200-344,374- 427,463-950
atgcaaaatgagaaacattcacgaaaagaatggaaagaatntaatgcaaaaattaaacaaatgtttggaatttattatagaacaattgaaaaatgggacaagaaaattggcttaaatcaaattctttcaaagggtgaaatttttaaacaaattgttatttattaattaaatttaaaaatttttattatttaatatattacagggcagaagcattatacatttgcggaaaaaacggaaaaaataaaacaatattatcaattgaaaaaccaaaacccaaagctcaacgatcgccaaattgcggaaattttaaatattacaaaaagatctttagaaagatataaatctgaattcaagagaaaaagtgaaggtgtcacggattgactgagaatatttttaagctttcagggccattcattgttaggttttgataaatttaaatttcttaaaaatttatatattattcggcatttcattcattttccaatttgttgcttatgtaagagttaaaagtattatgcataatgtttgaaggttgttttttttgttctattttttgttgtaattgccagggaacggatttatatgtgccaaaaaacctccaaaatatgtgctaaaaagctcaaaaaaggccaacaacatatgtgccaaaaattgaaaaaaaactgtcaaaaaataagtgaatttatcaaaaagatcacatttttttatccatttcgctagtacaattctaatcaaaaacatttcaattctttgtgacgtaaatatntttctcgctctccaagatttacttatttttctgtttttcatcgataaaattcaaattttgccttaaaaatgaaaaaagtcattaaaaaatatcaaaaagtgaaaaagaaaaaaaaagaaaatttttgatcatttttggatatcttgccaagaatttgagtgcaaaaaagctactttcgtaaaaa

SEQ ID NO: 54972 - DNA, 562 bp, Heterodera glycines
  Genomic contig location: Contig_ID=SeqID_24253; Location=1648..2209; Strand=+
  SCN-specific regions: Sequence locations=1-3,32-234,267-516,539-562
atgaaaatattattaatatttttattattatgcgcattaatattcaaaaaagcaattaaccaaattgaggctggcaaaataatccaagaaaaaagttttgctgaaatatttggccaaagatgggacgacggagcagaagaaaacatctgtcaaaatgatcaaataattcatggagaaattgctgatcagaataaccaatttggacaaaatgttcgacaatttgatcagatttttgataaaaatgtggaagtgaaagaagaggagagtgaagaaatgtccacggattatgatgaattgggcgaccaattgccaatgccaacaaataatggacaaatttatgatcaaattcgaattttaaatgacaaacagaagagagaaattgtggaaaaatttcataaaattaaggagaaagttaagcaaatgggaaaaaaatattcaacaaaagaatggaaaaaaattgaaagaaaaattacaaaaaaattgggcgtcagtcaaaagaaaatttacaaatggaagagagaatttggattaatcaaaaacagatattcggatgaggaaagac

SEQ ID NO: 54973 - DNA, 555 bp, Heterodera glycines
  Genomic contig location: Contig_ID=SeqID_24256; Location=171..725; Strand=+
  SCN-specific regions: Sequence locations=1-290,329-342,364-555
atggccctggagccgataaagcttacacatttatcagtgttaaatgcacatttaattcttttgagggaatttacacgtatgaatgtctataaagtattgtaaggatattatttagaatatgcggctagagaaatagttgaaaatagaaaacagtacaacacagggcaataaattttctatagtgtttaatgttttcgaatatttctaagttaattaattaaataaacgcgaaagtgaaccaaaaagtcgcgaagcattctaaaataaacttgcgtataattatgtccttgaataaatcaaccaaatatattttttaaacctctttttgctacaattttcaaatattgggtaaaaaataaattttcatagatcattgtagacttagtgcatggccctggagccgataaagcttacacatttatcactgttaaatgcacatttaattcttttgagggaatttacgcgtatgaatgtctataaagtattgtaaggatattatttagaatatgctgctagagaaatagttgaaaatagaaaacagtacaacaatggaca

SEQ ID NO: 54974 - DNA, 253 bp, Heterodera glycines
  Genomic contig location: Contig_ID=SeqID_24257; Location=91..343; Strand=+
  SCN-specific regions: Sequence locations=1-48,70-81,110-124,146 -193,215-253
ttttgggagatcatttgaaagcaattttggagagaattggtgaaatggagaagcagcaacaacagcagacaaaaggcgaggagaaattaaaatgaaaaaatatttaatcgaattaaatgtttccattttaaatttaaaaattaatccgatttttaagctactgcggggcaattgtcaaagattttggaaaaaattgctgaaatggaaaaacagaacgaaaacacggacaaaggcgagggaattttagcgaaga

SEQ ID NO: 54975 - DNA, 622 bp, Heterodera glycines
  Genomic contig location: Contig_ID=SeqID_24257; Location=890..1511; Strand=+
  SCN-specific regions: Sequence locations=1-21,62-90,127-175,203 -301,389-554,576-591
atgaaagaaatcgggtaagcgaattttatataaaaagtgaaatattttaatatttttttttctttattcagttggggcatcttcggattcgctgttaaacagcagacaaaattggatggatcaattcgatgtgaaaagggcatttatgcatatgaaagcgatggcgatattcggattaacggaaaaggaaagggaacaaatgccgaatattcctacggtgttggtgatactgtaggaatgggcgttcatttggccagtcgacagctctttttcatcaaaaatggacttcgtttgggttagcaaataataaataatataattttacgattttaaattacaatttggttaattgtctattttatctaatttattttatgtttaaaataatcaaaaaccccttaactttttcacagataactctgattttttcgttgatccatcttttgctgatggttcatttcatccattcgtttctttgcgcgcatttggtgacaaaattgaggcgaattttgggcccaatttcaaattcgatttggcaactctctgaaggaagaattaattatttactaatgttttcgatcaatttgctcgtttttatcatttttatgtttttcttcttcaa

SEQ ID NO: 54976 - DNA, 1571 bp, Heterodera glycines
  Genomic contig location: Contig_ID=SeqID_4582; Location=2587..4157; Strand=-
  SCN-specific regions: Sequence locations=1-336,368-641,663-739,774 -868,890-918,940-1063,1102-1397,1433-1456,1492-1571
atggcaattggcaacggataccacaacatttcgctggagcaagacacgcgaattcgctacaattacgcacacggaatggtggacgagttggactggcagcggatcaaaacagatcaatgctcgggaaacattggtgattaaaagaaatgggaaaatgggactaattaatcagagactaacaaagtttagacagttgcaatttggcggacgtggtcagtcggaatgggacgataattaattaataaaacgatattaacaccacaatttgaaggatttgccttccgggttcaattatggactgaatgtttatgacatttaccaaaaatgcggtaaatgaaaatattttttttaataactatttaaaaaacgcaattcagacggtggcccggacgaggaaggccgacaattggaccaattaattgccaagcaaagggccgcaaaatggccacaagccccgccgccgaaatttgagtttctgtcggaggaaagcgacgttcaattgtcggaattaaagtgcgaaaatggtcagtcccacgcaaactcattagtaaatactttaatttgttaatgctttttagtctacgacatgagaagctatctgaacaaggcggaaggtaaaaggcgaataatttgaaatttcgaattattttcccatttttagtccgcgaagctttgcacgtctcaccgaatgctcatcagtgggccgaatgcgggtaagaaaaaaaaaaacaaaaaacacttaaaaaaagaaaataataatttattaattaattcatccatttaaggggcatccacaattacaagacacaatacggtaggtgggtttatgggatacggtaacaaatgcaatgcattccatgggaagtgacaaatttaaataaacacaaagccaaaattgggattagaaatgcaatacagaggagacaactgatcagcagatcatgatcatatgcaaatcacttgggagaggaaaaaaagaaatgctaatgatgaaattgagaaattgacccaaaagaaattgccctaattgataagtgagttaaatttattgcccaattaccttttttgggtaggccaatcaaattttaaaaagacaaaaaacaattttttttagagggcgttgaattccacgtgaaaaaagtgctgaaggcgggtgtgccagttctgctgttctacggcgacacagacatgcgttgcaatttgattttgggctctaaattttgtgccagtctcggcatggaagtaaaaatacgagaaagcccccctaaattattattacacgaaatttagctggaaaaatcggccaggccatggcttttccgaggccaagtgggcggctttaagacaatgtacaaaggcggactgacttttttgacaggtcgaattcaaaagaaaacataattttaaaaaaatttaaattttaaaatttttagttcgtggagccggtcatatggtgaaaattatatttaaaaaatgtaaattaaaaaaaatgtcgttttaaggtgccccaaaagaaaggcttcgaacttttgcatgtcatcgaagcatttatggaggggaaaatcatttga

SEQ ID NO: 54977 - DNA, 638 bp, Heterodera glycines
  Genomic contig location: Contig_ID=SeqID_24260; Location=463..1100; Strand=-
  SCN-specific regions: Sequence locations=1-67,89-172,259-349,378-638
atggcaaaaaatgtccacaaaaatagcacaatgatttggcgtggcctcaaattgcgcacagtgccaatgcaaaaggaccaaaacattggaagcattattatttttgagtcatcaattgcttcacagaaacagttgaatgtttttaattattttaagcaaaagtgcgaaattgaatttattttaaaattttaatattacacgtttataaaataaaatttgtattaaaataatttttaaaataattttaagatataatttgagtgcaggacaacgcaatttttctgtgctttttgcatcgaatcaaattgctgagccattcactcgcttttctttggaagaaaatggtgagaatattattattttatatattttaaattggcattctcggctttcccaaaatgccattctcagacttcgatggccgtgccattcaaaatgatttcctccgttcaaatggtccgtcttttttgtcggattatgccgacctttggcttcttggacttgacatgctgccgatggcacaccaaacagaacaaagagaacagcttaagatggagctgttcatcagccgcagctccaaatgcttcatggaagcatgggtagaaaaacaactcgatcagaagggacccgttttttag

SEQ ID NO: 54978 - DNA, 225 bp, Heterodera glycines
  Genomic contig location: Contig_ID=SeqID_24262; Location=676..900; Strand=+
  SCN-specific regions: Sequence locations=1-225
atcttcgaaaatattcgctctttttcggcctgttatcccaaaattttttcagttttgcgagtaagtttttgtttaaaatatctaatttcgcgtttattatttgtctttttggtgtctgaatttgatttatgaacaacaaaattcgtctttgattcactccgtttatgggccatcagtgctcgaaatgggctcttcggagaggctaatgcttgtctgtgagtttgg

SEQ ID NO: 54979 - DNA, 351 bp, Heterodera glycines; identical to SEQ ID NO: 53910
  Genomic contig location: Contig_ID=SeqID_24264; Location=374..724; Strand=+
  SCN-specific regions: Sequence locations=1-20,51-351

SEQ ID NO: 54980 - DNA, 478 bp, Heterodera glycines
  Genomic contig location: Contig_ID=SeqID_24265; Location=1307..1784; Strand=-
  SCN-specific regions: Sequence locations=1-92,121-263,344-354,405-478
  Gene Ontology: Cellular component=synaptic vesicle; Biological process=synaptic vesicle priming
atgccaatggacgagggcgcattgccatcggtgacggtgatgcgtgccaaagggtcgctcactgtgctggaggtgggctcatcaattagatcattaattaattaatttttaattttatttcagatggaccacccaatcgtgtccatgttgccgctgcacgcgtcgccctacgccagcgcagcacaacatccgcacgccatggctgtgctgttgcgcaacgacctgctggttgtggacatgcaagcccaagggtacaaaatggcaattaataataaaaattaattacatttaaataaagaaataaattaattacattataattaattgattatgtattttatttgagcgaacccgaatttaaaaaaaagttatttaaattaatttcaaagttatttaaataatttctttctttcagatatccctgttttgaagtgcctcatccgatggatttgcacgaatcgccagtcacaatgatcaa

SEQ ID NO: 54981 - DNA, 126 bp, Heterodera glycines
  Genomic contig location: Contig_ID=SeqID_24267; Location=429..554; Strand=+
  SCN-specific regions: Sequence locations=1-126
atggtcaactgctgcattggcagagtcagagaggggtcacaaagagttcgcacagcatcgaatatttccttcattttgggcgtcattcttccccactgcacttctttcttcggtttaattacccaa

SEQ ID NO: 54982 - DNA, 883 bp, Heterodera glycines
  Genomic contig location: Contig_ID=SeqID_24268; Location=574..1456; Strand=+
  SCN-specific regions: Sequence locations=1-21,47-433,455-475,498 -533,557-637,717-784,806-826,848-883
atgtgccgtgccgttggtttgctcgataaataaataaataaattcgtgctctttcagatgggcttaatcattttttcacgaaaatcttttttcaacccacgaggaatttatcaaaaactttctcgatttcaagccattttcaggttttcagatcaccattgaaggagtgatctattttgtgttaccaaaaccaaaatagaaaatttttttattaagaaatctcattttttggcattctgcattgctttgcacaatataaataattaatttgcgaaaaattttatcacattgtttagatgggctctgcgcaaattcgggcgattgtcccaacaaatttctttgtgcaacatttgcggattcgaaattgagtgccaattcgtccaaaactggttactgtatcccgggaataattattggcaaaattgtgaaaaacaatggcaattttcaacccgattgttcaccggcaccgcaaggagcacaaaaatgtagcgggcttaacggaatttattatgtggacaattaatgatgacggatttattttgaacatttttgatggcatttaatgagattttgaaatagttttaattcaatcctaagcttttttttttgcctttttgaaagtcgaaaattcgtttcgttttttaatttacatatttataaaagtttttgaattttattattaatattattattttctggcgtaaaccctgctgccaacaacaaattgagttttgactcccactgaaaaacgcagtaaaaatccaacgctattgtttatattaattatatatatatatatatatatcaaatgtttaaaccttaccaaacatttgaacattccaaaaattagaaaattttccaacaaccactctaaattgtccaa

SEQ ID NO: 54983 - DNA, 1136 bp, Heterodera glycines
  Genomic contig location: Contig_ID=SeqID_512; Location=639..1774; Strand=+
  SCN-specific regions: Sequence locations=1-66,88-336,358-715,737 -780,802-833,904-986,1008-1136
atgtcggcatcaccagcaccaccaaatgttccggacctgagcgagttcccgccgttggaaaagttaacattggaggatgtaaggaaaaagaacaaaattgcctcggcaagcccaagtggaaactcaaatatttctaaggaaacctgtagtagtgcaataagtgtggatttagttgcttcggcaagtcaaataacttggggaggggaaaaagggaacagtgggcaagaaaaaggggaaaagaatcaaaaattaaataaaaatgttgcttcggcaagcccaagagattatgaaaaatttgcgaatcaaggatttgacaaaaacccggatgaaatggctgaagaaatgatggaagaattttcaagttttaatgtgagagaaaatgaagaaaaaattgttgaatacctggtttgccaagtagaagaaaatatagtgattggaggaaaattgaggacaatggcaaacaatggctggccacattttgtagcaatctcaaatgaggtggctgaaaaggcaagagagtttaaaaagaaattgcaaatgggagacatagttggagtgaaaaaatttgagtggaaaaatgattaccgatacttagcaaaaagagaaactgacaaaagtcatttcaacaaaatgtggtatgtgcaaaaaataaacagtcaagcaacagtcattgacctcggtcatataagatatgcaattctgagggaacataccacccccccccccccccgcccggtccaattgggtggcctaagaatggggaggaaaacaattccatttaggtgttgtttggaaaattttacgactttgatgaacactttatttcaaatggctttaataatcaaaataagtttttttaaacagttaaataatgttttatattttttttatttttaataatttgtttcaatttattcaaaatgctaccatttaactcagttatttgccgtatcacttcaattaccccacccatcattagtgttcattaatttttgcagctgtctctcccaaatcgatcctccgtttttttcccgggggccgctgggatttaagcccaatgaatttgtgtgatggaatggacccaattagtacacaattttcattcctccacctttttcccaaaatgggctactaaa

SEQ ID NO: 54984 - DNA, 2015 bp, Heterodera glycines
  Genomic contig location: Contig_ID=SeqID_513; Location=286..2300; Strand=+
  SCN-specific regions: Sequence locations=1-255,299-631,653-657,681 -863,885-1061,1095-1157,1181-1290,1344-1480,1502-1782,1804-1832,1856 -2015
  Gene Ontology: Mol. function=voltage-gated potassium channel activity; Cellular component=integral to membrane; Biological process=potassium ion transport
atgcatgaaaaagccgaacaaaccgcaaaatcgcatcagtcaaattctgccgcttcttcccaatgtttgtccaaattcggcattggatatttggccaaaaaggagggatttccaatccttgcgattatttgcacagccaaagtgttgatatggcgaattactacagcaaacacattttaaaggccaaagaattggtagttgaccatgtgggcgatgttcggctggtcatcaacgtgtccggggttggattcaaccattaattaatttattgatgaattaaattatatacataaatttagcgtcgttttgagacatggaaatacaccttggaaaggtttcccgaaactctgttgggctcaagtgagaaggaatttttctacgacgaaagcgccggcgaatatttcttcgaccgggaccctgaactgtttcggcacattttggccttctacaggaccggcaaacttcactacccaaaggtgggaaattaaattatttggatgatattgtaaagtaattaattaattgtgtagaccgagtgtttggttgcctacgacgacgagttggccttttttggcataatgcccgatctgatcagcgattgtatgttttgccatttgcaattaattggctgaaaatcaaattgttttgcattaaaaggctgttacgaggagtacaaggacaaaaagcgggagaaccaagaacgactgatggaggagcgcattgacgcgcccgacaaacgcaagaaggacttgacactgcaggtggggggggggggggtgggtaattagcgcagagaaagggaaactcgactaattaggataattaattaggcagcagagtcaaatctcagtcatttgggttaattttaggagaaaatatttttcatggaacccgggaggttcaaacccccgttttttcttcttaaacaattttgttttgatcctattttttcaccaggattttctttttaaaatattgggctaattataatgtaattacttttcataattattaatgctaaaattttcagcaaaaactgtggactgcctttgaggtgcgtgaaatattttttattatttaatttttatttatttccaaattttccttctcattgtcagaatccccacacttcctccgtggctttggtgttttattatgtgaccggctttttcatcgccgtttcggtgctttgcaatatcatcgagacaattccatgcaaatatttggccaacaatgtgtccatcacttgcggcgatctctacgaaaaacaggtggacaaattcaacgctattattatttatttatattttcatttttaatgtatttttaattatattttaattgatcttgcagttttttgtgcttgacactgcttgcgtgatcattttcaccgttgagtatatgctgcgtctttttgctgcgcctgatcgttgcaaattcgtccgttccattatgtctctgatcgatgtgatcgccattttgccctattacattggcctggggcttcaggtggccaaaaacccgatcatttcatttatttttgtttttaattttgaatgttttctttttgtaaaggaaaataaggacgtcagcggagcatttgtcactctgagggtgtttcgggtatttcgggtcttcaaattttcaaggtccggcacatttcccctttttcatggcatttccctccccccaggcattcccaagggttgcgcattctcgggtacacgctcaagtcgtgcgcgtctgagctcggctttttggttttctcgttggccatggccatcatcatcttttctacaattatttactataccgaaaaacgggtaaattcgaaattaaaattggcaattaaaaaattgcataaatttgtttgtgcataaattgcccattttcaggtcactgaaactaaattcacgtccattcctgccgccttttggtataccattgtcacattgaccacactgggctacggtgactttgtgccgcatactgtacatgccgaatttgtgcattaa

SEQ ID NO: 54985 - DNA, 1103 bp, Heterodera glycines
  Genomic contig location: Contig_ID=SeqID_514; Location=980..2082; Strand=+
  SCN-specific regions: Sequence locations=1-10,53-127,161-432,455 -659,682-814,888-1040,1064-1103
atgaacatgtaccagcaacaccaccaccaccatgttaatcagctaaaatatacggacatcaacaaacaatccaaccaattgtattcatgtacgaccgccacaacgtcggtgacaacgccgcactgcaacggcgacgacgacgacgacgacaacggtgacgtggaggaaggcattggcattccgatgcgacagtcaaaaggcaatttccgaaatggtaaattgttgaccgatccaacaatcttgatatctttcgaaagctcttcacaggctctattagcctaataaaaattacagagaatgtctaactgaaaaaaagaacagagacaacaacacttttttgtgagctacttcagcatttagaaataacttatttgttggcaatacatatcttctaatcatttaaagctttcgaatgatatcatgtttgttatgtttggtcaacagagaaaaaagttatagctttgtgaaatttgttgagacggtgttgactcctatcgaaatgggagaggcaattaggacattttaaacattaattacaacagtccagcaaccacttagcaataattaaaaccattagcttccttttgcgtaatgatttagccaattcttcgccatctccgcccgtccgaattgtcgtgtcggaagaaaacgacgaatacgagccaacacagcagcagaagggcaatggtcaagatgaagcaggggaaggacaccaacattatcaccaacaacaatggcatggccatgatgaaaatgatggcgatgaactgttgggagacgaagcggcggacaatgagaggcggaagagttcaacggaagaggatgagggagaagaaatggaggacaaaacggaagaggaacggacgaggaggaggaaagggaggagggacagcagcaacgacaatggcaccacagaaatgcccggcacggaaagcgtcggcaaaagcagcagaagtcgaagcagcacatcggcacgggacaaccgctgcagtccgaccgccgcagcggggcggagaagacggaaacggcgcggatgggcgcaaaaaaggggcaaagcgcaagcggaggaggaagaggaggaggagtgtatgtccactctttga

SEQ ID NO: 54986 - DNA, 1055 bp, Heterodera glycines
  Genomic contig location: Contig_ID=SeqID_514; Location=7219..8273; Strand=+
  SCN-specific regions: Sequence locations=1-305,328-443,479-776,805 -819,842-1055
atggaccaatttttggcaacaaaatgcaaattcgagaaagaaaaaataatgtcgaaaatgaatgagaaaattagagaggaaaaatatggccaaataattggccaattgaaacaattgcgactctctgaacttcaatttggacggcagaaggaaaatgtaggcgaattgagccaacaaacagaagagtttatcaaaatcattttggcacattgggtcggaagcctcgaggcaattaaggttttgaaattttatggaaattaaaaaaaaaccaaatttaaattaaaaaagaaagttgaaaaaattgttgtgaatttcatctacaaataatttcttaagtggaaattttattttttttttgtaatttttggcagagagataaacaaagacaaataataaaaaaagaaaagaaaaaattgtacattgtaattttagaaatgtttaggtttttttgtaattaaaataataataaaatttattagcgtgaaattcgaccgtcggagttaaacaaagaactggccaaattgaacgaaccaaaagacaatttaatagtcatggagaaactgttcgatttggcatggtttttgtgcgcaaaattgaaacatgacgaaaagcggtacgaattggcaagatcgaagacaatttggcgaatgatcgattggaactattacgaagaattggagtggaaactgtgcaagactcgggaacttattcggaaaatattagtcaaggaatttcaagtgccaaagtcaattcattcagccattaacagactaattgactaaaataataataataattagagtgctcattttgcagcatatgctgtttttctttgttgctaacttggggcgtgataataagcatgaaaaacgcattcctaacttggtttgaggcttctaagtccacttttttcatgctgatttttgcagatttctcgattttttgatttttgtgctgatttggcgtttttatgcttttttatgctgtttcgtcattttgagcaattttttaaaatattttcagcaattttcaaaaaatttattaacaaaaatgca

SEQ ID NO: 54987 - DNA, 1665 bp, Heterodera glycines
  Genomic contig location: Contig_ID=SeqID_514; Location=3269..4933; Strand=-
  SCN-specific regions: Sequence locations=1-258,280-306,329-572,612 -829,853-955,988-1163,1196-1327,1371-1665
atgctttttcgttctgcccgctctgttggccaacactgtgctgccggcggaggtgcaattggagccgaaggcgggcgccaagcagtgcgccagggacatgcagccattgcacgacggggtcagctgcgcggaggacgcgcagtgccaagctttggccaccggctttttctgctacagagggcactgttgcgcaatggcaaagcgtaaattgcgaatattatggcaaatataatttatttcgacgcgaatagccggaaaattttgaaattgccaattaatttgcgcaaatttatcaacttttcttccactcattgggtttttgagatcaacaagccgcggacatattaagccatttggtgtccaatatgccggccgattgccatttgaaatattaacaataaatcatcctaattgtttttaatttaaacagcgtccctctcgagttacggtgccgcgtgcacattggcagaacattgcaaattcacaaacagcgaatgtgccaacaacatatgctactgcaggttcgggtacagctttgacggctacgaatgcatcccgcgggggacggagtgtaaaaatttaatttaattaaaaaataatttaattaataaccaaattcccgccggattattctcagatgatgccccgcaatcgtcaaatttgtgcctgtccggccaaatgctgatcaacggtcgttgctacagttacgtcagttacggtgccacctgcgattactgtacaccaccgttttgcccttctcatcatcattcccttttaatatttggccttttaaagcggaacaatgcaattacctgggcggcttctgctaccagcggcgctgtgtgtgcccaccgggccaaatttacaatggccaaaagtgcgcggacgacccaaacattccgtcaaacggtaagaaaagcgaagggcaaaatccacttatttgttaggggaaagcaattaaattatttaataactatttatttatttgttgtcaataaagaaaagatccacaaaagagagatgcgttactttttggacatccaaataaattaattgtccaaaagtaattaaggaaaataaaaataaaagagagaccgcacaattaaaataaatataagtcaatgcagctcaatttatcaaaattatcgcagcgcttatgtaactaattaattaaagatttatttatatattttttcagtcatttggccttataattattctaaagattttttgagttttgttttaaaattattatttttgcatgttctttatttaattaattccacagtttagttgcccttcccgcaaaggaaatagattttttggcaaataaaatcatttttaacaaattaaaaaaaaatttaatttttggaaaaatatggtattccaatcgtagtccattcattttatttcattaattttcccattttcagctgcttgttcctcgaaccaagtgcgtgtcaatggccaatgctttccgctgttgggcgttggcgaacggtgcgtcagcgatttgcagtgccgcggacggccgggcgaagcggcactgatctgccggaacggcgtgtgcagccaaatcggccgaagttgggagccgacggaggagcagcgggcattccgtcggcacttttaattgaaaataataaatgcatattcaatttataa

SEQ ID NO: 54988 - DNA, 101 bp, Heterodera glycines
  Genomic contig location: Contig_ID=SeqID_515; Location=486..586; Strand=+
  SCN-specific regions: Sequence locations=1-101
atgcgacgaaacaacgctttgctgtttctgctgtacggagtgggcctttccgcactgcttgtcgagctggtcgatgcgtatttgtacggcggaaacattgg

SEQ ID NO: 54989 - DNA, 595 bp, Heterodera glycines
  Genomic contig location: Contig_ID=SeqID_4583; Location=203..797; Strand=-
  SCN-specific regions: Sequence locations=1-478,500-513,536-595
atgcacactctcatggtgccgtttcaggagaagttcagtcggctctgttcgctggagcacgcccaccacgagcacatggaacgcatccgcgcattgaacgcggacggagaatggaaactgaacatggaaatgcgggagccgggacagaagttggctcggcgcattcaggagttcgacacggtgttgctgaccgcgatgaagaagatggacccgaatccggtggccatttacttggtcggtgatgacggactcgagtccaacctctgccaatgcttttccaataaaaacacgcgtcgtgccacactttaagcttaaactgtgcaacgaaattggcacagcgatggccgcccttcgggtgcaggatgaaacaattgcggtggcactgccgcgtctgatgcttttatctgctgccaaaaaagtgctaggcgaaggcatgcgtttgctcggcattgagcccatcgaaaggatgtgaagtgaacggacagactgaggacagacaacgaggcgacgtggtgccgaaactttttgttattgtttattttttttcacccatttcactgttgttatttctgaagatttgtaacaaaataataaa

SEQ ID NO: 54990 - DNA, 764 bp, Heterodera glycines
  Genomic contig location: Contig_ID=SeqID_4584; Location=193..956; Strand=-
  SCN-specific regions: Sequence locations=1-280,302-612,634-662,749-764
atgtataaaaaacaggcaccattcaccggaaaattcgacaaacatttcgtagccgggggtaaatacacttgcgtgtgctgtggtgccgctctgttcgtgtcggagcagaagttcaactcggggtgcgggtaagaggtcaaaaattgaattgaatttccaaaatttgtgctttcgcagatggcccgccttctccaagtccattggggacgatcaaaacattgtccgactgcccgacaattcgtacggccgtcaacgaatcgaagttcgatggtaaatgtctaaaaattactaaatttccttttcgtttaaatttcccataatttagtgccaaatgcgacgcacatttgggccatgtattcggtgagttttattactacgaaattgtaaactatccgttaaacatttgcaaattcatcaaaacctaacaataagatgacggaccgccggccgacggtgggcagagatactgtatcaacagtgtggccattgactttgtgtccgggcaacagaaatgaggaaattgagaattgccctttccgctgtgatccgtcattgaccggtccatcatttgttacgagttcaaggggttttctgtgtgccgggctagaatccctgagatttatttacaaattaatgaaaatgccggacagaccaattaatattttttttatttgcttgtttggctatttatccaatccctttttcatttatttgtttgtgattttttggcttttgtatttatttttttcggttttcataataaa

SEQ ID NO: 54991 - DNA, 262 bp, Heterodera glycines
  Genomic contig location: Contig_ID=SeqID_4584; Location=1644..1905; Strand=-
  SCN-specific regions: Sequence locations=1-40,70-262
ggaacatcggcgacccgcaaacttcgtggtaagtccaaacgccatgatttggtttatttttgtttcttgaggctggccaaccgaattcgcaaccaaggactgcccgtactgattgattatgatgatgaccaactctgcctgtcccatttcttctttcgttttttgagtgcataattttgattgacataaatttcttgtcactatttttctatatttattcccagaaaattaattttctctgtataaaaatggacaccaaaaa

SEQ ID NO: 54992 - DNA, 1006 bp, Heterodera glycines
  Genomic contig location: Contig_ID=SeqID_4586; Location=1648..2653; Strand=-
  SCN-specific regions: Sequence locations=1-10,110-262,307-379,401 -555,577-694,718-782,823-874,896-949,971-1006
atgatgtaagtttaatttaaaaataattcatttaattatattttataattattttaacaatatatttaaaataaatgtttaataattgttgaaataaatttaatatttagtgatatcaaattgacaattgtaattgctgatgcggttagaaatgtcaatggaaaatcagtttggacattggttggtagcgatggttacgattttatcaacatcacaatgtggggcagcaattacgaaaaaatggcacgagaattcggacaagaatttaaagttaaatttataatttaattaaaaattatatttattgttaagcaaaaaacatatgtatttaatacttggggagtacaaaaagttattccgaatttcaattatggtaatgttgattatgaattaattgcaaaggaaggatcgacaattaccctgatcaccgcggaacaatatcaaattttatcgataaaaacaaccaattatttcacatttttgcgtgagaaatttgcactcgataatgatggtttttttccaacgccaatcaaaaaaatgcgcgcaggcgaacagtttgtgtaagttaataaatagggattttagctaaaacaaaaaaataaaatttaagtgaaattgaatgcgaattattcgaattaaagcccgtgagaactgtaatggcaaaaggaaacgaagcacgtgtcattgatgcaatgattaatgaaggaaataacaaaactcaattaactgcttggaatattcttgcggattttcttgaatatattttacaagacaaaaaggtgtattaaaatatatattttttaaaatattttttaaaattaagggatatgttttaaaactccaaggcttactcacgaagaaaggctttccggttcagaatatttcttttgtttttaccaacacttctcgaattggatttgctgaaaaacagcgaccagagaaaattccattgaaattggcagaattaactgaaggactttgtgaatgtaattttaaaaagttttga

SEQ ID NO: 54993 - DNA, 788 bp, Heterodera glycines
  Genomic contig location: Contig_ID=SeqID_24270; Location=277..1064; Strand=-
  SCN-specific regions: Sequence locations=1-248,270-513,535-577,603-767
  Gene Ontology: Mol. function=ethanolamine-phosphate cytidylyltransferase activity; Biological process=phospholipid biosynthesis
atggttaaatcaactgctaatgctaatggtaccacggaatttggtggacctaaagagcaagtggtgaagcacaactatcgagtgtggtgtgatggatggtgagttgtttgcccaatttgtctttttcatatgacatttagttacgacatggtccatttcggccatgctaatcaacttcgtcaagccaaacaaatgggcgcctatttggtggttggggttcgtttttgaactcatttctatttccatgtattatatcatcatttttactttttggtcaggttcacaatgacgaagaaattggaaagcacaaaggccctccggttttcaacgagaaagaacggtaccgaatggtccgcggcatcaaatgggtcgacgaagtaaatttggacatttggtggcacttggctaaaatgcccactcacttaggaactttcagacaaaaacaatatctttttcacccttatcttttaacttagaaactattatttctgacttttttcagattgtggaagcagctccatatgtgaccaccttgaaaactttggatgagaataattgtgacttttgtgtgcatggcggtatttatttattttttgtaaaaattccttaaccccttccaattttgtccattagatgacataactttgaccgccgatggaaaggacacttatgccgaagtgaaggaagcagggcgttacagagaatgcagccgaaccccgggggtttcaacaacggtaattaagagagtattcatttgggtgtatgacttaaaaaataatttaaataaa

SEQ ID NO: 54994 - DNA, 928 bp, Heterodera glycines
  Genomic contig location: Contig_ID=SeqID_24271; Location=194..1121; Strand=+
  SCN-specific regions: Sequence locations=1-304,326-386,437-599,621 -652,674-883,919-928
atgcgcacccgtccgatctggcaagttaagcaacgattgatgactacccaaaaggttcggtgccgtgatgaaacaaaccagcactgcttaccccgcggcacccggtacggtcccccgaaagaaaggagttaattaaattctctccttcggtatatttttttccattatgtcgaccgctaacgatcgattgctctagtcaatttttctaaatttttgctgaaatatttgtcgtgctctgaagggagtggaatggtgaggatatattgtattgcttacaaattatttaaactaaataaaacatcactttttatatttttattaaatacgtatttaatgactttttgattttgttctgtatggtccgagcattcatcgattcaataaacaaattaaataataatttcttatttcttttaattaacgatttaaaatattagcgcgtaattatcttggtcttatttggttattatgttgtatatttattatcaaatgattatgttcgggccaggccgttttcgcgttgctggggacgttttcgcgtgagggcctgtttaggactgaagttctactaataatacctgcagagcattagaccgtgaacaaattattagaatatatatttgtcagtcttaatttagtttctaaaattcactttttcatttaaaatatatattgaattaagcacccgaagtaaaatgggagtgaaacaaattttcaaaatataaaaaagtaaaaaattctcttatatgcaaccacacgaaaacggcccacgcgaaaacgaccctgaccggattatgttatgtcctcttgctgtacacagacgctaataatttacatacttaaatgaataatttgctttatgtcaaattcaaaaaaattcatgaatttattttttattatacagaatatttataaaatgaattgcaaa

SEQ ID NO: 54995 - DNA, 1572 bp, Heterodera glycines
  Genomic contig location: Contig_ID=SeqID_24272; Location=23..1594; Strand=-
  SCN-specific regions: Sequence locations=1-158,180-432,459-512,572 -769,817-918,952-1009,1041-1218,1240-1282,1311-1405,1434-1572
  Gene Ontology: Mol. function=pre-mRNA splicing factor activity; Cellular component=nucleus; Biological process=mRNA splicing
atgcccatatttcgcgcaataaggtcggcctcacgctcgcgctccgttgacaccaacagtcgcacgggctcgcccgcatcgccgcgccgggcacggtccggctcggccaactcgcggcgcagctccagcgctggtcgttcgcgctcggcggggtcgcggcgccgctcgcgcagcagcagcagccaatcggtcgccacaaattcgtcattgggtggcggcgccggtgctggtgacgatcgctcgtcgctcgagcgtgagaagtcattggactacagcgatattgtcactacggtagcacagcgcgtgggtgggcgggggtacggtatgaaaataccgtatttacgcaatgagaactctcccctgtattagatagaacccccctatgaaataaagccccgatttcaagggtgaggtaaacacaaaattctgagctaatatttttatttaataattatttagagtgaggtattatgatggaaaatggaaatatgtaaaacaaaaaccgatttttgaattaaaataaatttttaaacaaaaaaaataaatttaaaaaaattattcaaaatttttacagaaaaaaaatcgcaaaaatttcagcgcaaggagcaaaagcagcgcgagctgtcgcattccccgacgccaccgccgttgaaaaaatcaaaaaaagctgtgctcaaaaggctgaaaaagggcaaaaaggacaaggacaggcaccgtgatcatcaacaacatcgatgttcgtccaagaagaaggtgaagcagtacgggaagcaacagcagcagctgaagccgaagcagcaccaaccgcagcagcagaacatgacgtcgccccattcgtcgtcggggtcgtcgcccgaggcgcgacaccgccaccgtactgaagagtccgatgtggagatggccagcgacgaggaagaacaacaacagcagacagagcacgagcagcagcaggagatgaacacgaaaagtagcagcaaaaccaagcagaagcaccagcaaattgctgttggggggaagaaggtgtgtgggtgggtggttgggtctggtatcgggaaaatgtaaatgtgtaaaaaatgaaaatttcaaaaatctattgttagccatgttacgacaattatttattgttataccgaaaattattaaagtaaattcgattttttttctggcttttggcaattttttccctcgttttttttttggcttataggtcgaaaatgctaatttattatttttttatttgcgcgaccaaatgccggaaaatttattttcactattaaacctcaaaattaaattatttaaacattttaaatcattcgatttgattggtccagtcagtttcatactgctattaaaaattttttcgtggtaaaatcttttattttcaatctgcgaatcaggcaagaacaattattattaattaattaattaatttagtcctcatttgtcaaccgctttctccccgctggcgccggcgctggcactgttacgggtggcactccttcaatagacggatcgtcagtgaaaacaacagtaacatcagcggagttgcgaaggcgacacaattgtgcttga

SEQ ID NO: 54996 - DNA, 60 bp, Heterodera glycines
  Genomic contig location: Contig_ID=SeqID_24272; Location=1885..1944; Strand=-
  SCN-specific regions: Sequence locations=1-9,32-60
ggattgctggggtcgtgggttcgagccccaccgggcgagttaccttttatgttctacaaa

SEQ ID NO: 54997 - DNA, 519 bp, Heterodera glycines
  Genomic contig location: Contig_ID=SeqID_24273; Location=869..1387; Strand=-
  SCN-specific regions: Sequence locations=1-9,31-41,63-476,498-519
atgtccaatcaggaatggacagcttcacacgtggtccaattcaaagttcaaaaattggcttttgtgtcgccttgcgaaaattatgcgcttttcgaaatgatcaaaaaagggcaattggagagacgaattggcgcaaatgaatcgctgaaatcgattgtattggggcgatggatgacggacggagtggaagagcagcagaaggacaacttcctcttgctgaagaaggatccgcatcccttccaaccacaagtgattcccggccagctgatcactcggccataaactcaattagctaatgagtctaatcataaaaaactgatcagtcgcccttctctcacttgccaatcgttctgtcccttttgagagtggccgtgcctttgctgaggatttgaagttggctgagcccggctcgcgcactttcaagacggcctcacttcgcattgaggacggagtgcacgtgtgccattattcacgcggaatgaaaaggcagtgccaatggaaagtcgacgaagtgctttg

SEQ ID NO: 54998 - DNA, 61 bp, Heterodera glycines
  Genomic contig location: Contig_ID=SeqID_24275; Location=1884..1944; Strand=-
  SCN-specific regions: Sequence locations=1-31,53-61
ctgacataataagcgtctgtctccttcttcattttgttccccttttgactgcacttcagca

SEQ ID NO: 54999 - DNA, 513 bp, Heterodera glycines
  Genomic contig location: Contig_ID=SeqID_4588; Location=408..920; Strand=-
  SCN-specific regions: Sequence locations=1-513
atgccaatgccgaattcaaatgatggaccgtatgaaagcgaacggaaaggtataaaaaatattggaattgcaattatttgtacgaagttatcccaaccaaaggctgacaatgaagcggatttacatcggcaaatgttcatcactgatgtcattcttcgtaattctgagcttctctgcacatcaattgcaaaattcgattcatttttgcttcgtctacgtaaatttggaccaaaattagccgctctgagtgatctcatctcatccacttcatctaacgacacttctacatcaccggatgaccctcatcaattgctacaattcagagccaaggaactgctcgacctttttcccattgttctggagatgtacgaacaggaactgtcatttaagcgggactcagtggttgatttggcagttttcgatgataaggatcttttcacggcgattatttcggcatggaaacatggcatttatattgagcctgcaattgtttcgttgctttatcctttttga

SEQ ID NO: 55000 - DNA, 1177 bp, Heterodera glycines
  misc_feature (12)..(12): n is a, c, g, or t
  misc_feature (60)..(60): n is a, c, g, or t
  Genomic contig location: Contig_ID=SeqID_4589; Location=60..1236; Strand=+
  SCN-specific regions: Sequence locations=1-808,831-1177
atgaaagatcgncgcacaacagaaaagaggaacggagccaatggcaaagaagggtaggtnttcagagagcgcggtgcgccacgtaatccgcgggtgggattgggactttgagggacttccaaaattgcgggaataatcccgcgggaatcagtcccgcaaaaattaagagttctaatctcgcaatggaattcgaaaagttacaatttctgggtttagtgattaataaacaaaaaaaaacattaattggttcggctcgcgccgtaaaacggtttttttgttaatcaatctttggctttttgtgaattctttgattgtttaagcattggtcgacgaacaattcgcgcagttgcaaaatggtcagaaggcaattttggagcggatcggtgaattagagaaaaggggacagccggacaattacggtaggtttacgataagtgcattttgaattttgaagaaacaaagtttacgcaatttcaatttctttcattttttcagcttcaacttccaaggcaaatgaccaccaattcgcacaatttcaaaatgatcagattttcttcaattgctgggatgacaactttcgtcaaaaacaactgcaaatcgacaacttaaaagtcgtccatatgggaactagtaatttttccgaaaaattactgtcaaatttaaattgctagaaaattttctataatgaatatacaaattgaacagttatgaccatttaataatgtttaaatctcaatctttcttcaaaggtggtgaccgcactgtctttgccaaacattccatattggcggccgttccttcttcatctgtccttttttattttgagatttccatcataaaaatgaaccggcaggcgtatttattcattatatttttatatattcgaatacaattcggatattttttactgtattgattatttatttccatcattttgctctttttcagtaccgcctgctttggatttgccataaaaaatacgagaaatcttgctgggtcatttttttctgaagcgactgcttacgcgtatggaagcaagggcaaattttatgtcgacggtaccaagaccttcgcaaatcccacaaatgccttcgcaactggtcacacggtcggatgtggtgtcctggcaaacagggaattgtttttcacgaggaatggactttgtttgggttggtaa

SEQ ID NO: 55001 - DNA, 59 bp, Heterodera glycines
  Genomic contig location: Contig_ID=SeqID_4589; Location=2994..3052; Strand=+
  SCN-specific regions: Sequence locations=1-59
taaatatgtactaacattttcaaattttccatattactttctaaaaaattctctatagt

SEQ ID NO: 55002 - DNA, 848 bp, Heterodera glycines
  Genomic contig location: Contig_ID=SeqID_4589; Location=1348..2195; Strand=-
  SCN-specific regions: Sequence locations=1-8,40-299,321-332,354-848
atgacctggacccaggaaaaatccaggcctggatccaggttagtgaacgacaaaacgacttttttaacgaaaaaacgtcgttataaattcaaacgacgaaaaagtcgtttaagcgattacgacgataatcataaaccagcggtgaaaaacggctaaaaattcgttcacaagatgtggatgatgcgggaattgacaaaactccatagccaaagaagacaaaaagtgaagtttttttgaattttctttccaaaaatcaagcagatttatcttttacctatttttgaaacattttcaaaaaattccttccttaaagtagatttagaaagatttacttcaaacaaaaaataaacaggcagtgaaacaaaaaggcatttttcagttaaagtggtcaaaaaaagatttaaaaatgtttttagcaacctacccatatacacgttgcatgagacatgtacacattcataagttacatatttgtacaatatgtaacccattatgtgtacatgtgccatgcaacgtgtacacaggcaaaaccaccaaaagaaatttcgatttttgaccaccctaactgaaaatttcacaactttttttcgtgcaattagaaaataacaattttagtttatgttctgtttcagccactcataaacagattccattgaatatctttcgctgctcctcacgctccaaacgttatttcatcagagttgccaaatcgaacacgaattcgggtccaaagttcgcctcaatttcgtcaccagattcaagcaaagtaacgaatggaaagaggaacgcacaatcagcagatagagaaatcgaaaatgcagttgaatcttaacaaatgaagaattaaa

SEQ ID NO: 55003 - DNA, 2186 bp, Heterodera glycines
  Genomic contig location: Contig_ID=SeqID_24283; Location=1..2186; Strand=-
  SCN-specific regions: Sequence locations=1-97,137-305,436-447,591 -902,953-1921,1943-2186
  Gene Ontology: Mol. function=transmembrane receptor activity; Cellular component=plasma membrane; Biological process=receptor guanylyl cyclase signaling pathway
tcatttaacacttagggcctctattttctgcatactttcgctcatcaaataccatgggtttttgtgtcttcaaaattgtttggtcgactcaaattggtaaaaattttttaatttcaaaatttaatgtataaattaaggaatgtgaaattgacaaattttgtgacggaacaaatcattggggacaaactgagacacaacgagcttaaatacatgacggaatcaagattaaaatcgcacaaaaaggcaaagaaagtggtcaaggatgatgagaaaaaaacggcgggtgggcggagagacgacaaagaagagagagaaaaagacaaagaccgagaaaaagtgagagagtgggaggggaaaggagaaaaagtgagagagtgggaggggaaaggagaaaaagtgagagagtgggaggggaaaggagaaaaaatgagagagtggtgggaacaggagaaaaagtgagagagtgggaggtgaaagagaaaaagtgagagtgggtgggaaaaggaaaaaagcgagggaaaaagtgagagagtgggaggaaaggagaaaagagtgggaggaagaaggagaataaaatcgagaaaaaaagaatatggaaaaataccggtatttacggtattagaaccccccccccccctgaattacaaccccccttttgagggggtgaaaaatagaacccccgggggttctaataccgtaaatacggtataaaagggcgagaaaattaattctttatcaattcgaaaggacagagaacgcgagaagcggcgccggacccgtgacaaggaaaggagcggcgcggacagtacggaggacagccgaagcgcgacggacgaggagttggagcagtccaagaaaatttatgagaagtcgcacctgaagagtttgtcttttctaaattcatttattcttaattaaagtaatataatttaaataagtttgttttaaaaatcctccgcccccttcagaatacattcagcaggcaccggagatcatccgcgagttcatctccacaaaacatttgccaccgggcagcccggcatcggacatgtacaggtggagaatgatgggggagcacaaatcgacccaaagaatttttgaatctgttagcattttttttcttagacttttcatggtttcattaaatggacggaaaattcccggccccatgctattaagaaagtaatttaacaacttctccattgaagccttggcatggtgctgtaccaaatcctgttcaagttggagccattctatgagcggaatatgcagccaaaaagtgccaaaattgacaaaaaaaatacttaattttttgaaatttgtcttagaaataatggaacgaatcgcattggccaacgaagacgaccaaatcatacgcccgaccttcccaaaacagcaagtttctgccatcgaagaagcatacaatttccaacttctatcggtttggccaatttatatactgtagttgtgccgattacggtaatgaccaattgtttgcacaggcgctggaggcatgttggctggaaatcccggaaatgcgcccgaacatcaagcggatgaagacaatggtcaactcaaatctgaagtcgacgggcagcggcagtctggtggatcagatgatgaaaatgatggaggacgtaagagcaaaaagcgaaacgccataaaccgaaattagaggcccaaattcgcgaagaagcgatgggaaggaaattcagttgccaccaaactcattcgttacaattaatttgaattaattggatgagatgggttggcccacaattttggggcctaaaatgcattaatttgtcagtacacaacaaatctcgaacaattggtcaaagagcggacgcaactgttggaggaagcgcagcagcaggcggaccgactgttgaagaatatgttgccacagtcagtggccaattttattttggaaatattaaatagcgcattagcataattaattattaattacccaatgtaaatatacccaactcaaaggtcaattgccgaggacctgaaggcgggtcgtccggtgcttcctcaatactactcaaattcgaccgttttgttttccgacatccgcggcttcactcgcatcgcgtccacctcgacaccgattcaggtcagacacaattcgaacgatcgaaaagattcggcaaaatgtccatcaaatttgatccgctttg

SEQ ID NO: 55004 - DNA, 1287 bp, Heterodera glycines
  Genomic contig location: Contig_ID=SeqID_24285; Location=64..1350; Strand=-
  SCN-specific regions: Sequence locations=1-534,556-1029,1053-1287
atgccacgcgcttcggctgaccgccgaccggacgcgccacgaggcggacgtgcaggcgcgcctgatgcatgccaaggaggcgcaagtggaccaactgcagcagcgagtgcaccagtgtgcgcacgagcgtgacgaggctgaggcacgcgcgacgcagtacgcgcgcgcgtacgacgaactgctccagcagacggagcaattgcaggcggaacaccggcaggcggcggaggcgtgggaacgcgacacgcagcggcaactggtcagttgatgaataatctagcggaaaacctagaattttacaaatttgactgaaattgtttaattttcggtgttaaaaggtttcaaaaacagaaaacggtttgcccctgcttttcaggacgaacagagggccaaaattgtggatgaattgggtgcacagaatgcggcggaattggaccaagtgcagacggaggcaaacaacgcgcaaatgcggttgacagaaatgctgaaaaaggcggcggaaactcatcggaaattggtgggcagaattcgcggatgaattttcaatttttaaattgggggttagtagttcagctgaaaatgtgtattaatttctagagatatggccttttaaaaattgtgaacctggttttgggtgcttcatttcccccgagtcgtttccccttgaaatctaaaaaaatttgcaaaaaaaatattggaataaaatttccaatttccacgccctcattcattcgatgcacttaaaaaaattcgtgaacttccatttcatttttaaggaggatgagcgcaatcaactgtttgagaagcacaaattgttggaggacaatttggaggcgtacaagcgacgctttgtggcccaactgcagcgagcgatggacacgcgctgttcacagatgggcaaaggattgcgcaacgcatttgcggacattgtcggacagatgggtgagttggtggaattatggagtaaaaagaaaactatctcataaaggggcgggggtgccctatttccggcaatttttttagtgcctgaatttcctgcaaaaaaattttttggcttgcggagtcacccccccccaacatgtgccacacagactctctgaaaattatttttaatcttacgccgccaattttttttagatactgacaccgcggcgtcgacgacggcacggcctttgccattgtccgaccaatttgccaacgatgatgattgttccgtgctgatcgggttcgactcatcatctcccagacggggtaacggatcggctgacctcttcaattcatcggcgc

SEQ ID NO: 55005 - DNA, 502 bp, Heterodera glycines
  Genomic contig location: Contig_ID=SeqID_24286; Location=958..1459; Strand=+
  SCN-specific regions: Sequence locations=1-159,199-502
atgttgtcgagtgcaaccgaccaaattctgagacgtcatttgttgcccgttaagccggagagtgagatgagcccggaggagcgcgcggagaagaaaaaggcggagattgaagcggaatttgcgcgatacaagctggtaaatttagggggaaaatggaagaaaaaaataaattgaaaaaattcatttttttaaatttaaggcccggaaattgcgcgtcaaacaacagcaagtgagttcaatgattgttatgtgtacaaagagtgtagaattttgtcggtgtaatttttcccgaaaaatgccggtgggcctcgaaaaacaacctacccgacccggattttcgccgaccgcgcctgggttttttgagggcctaaattttttttcatgaaaattctcagttcacaatcagcatttgttcaaaaatgtcgatttccattatcaaaaaataattgctttttcctccaggaaagtggtggcgccggcgatgaagcggctgctgcccaag

SEQ ID NO: 55006 - DNA, 610 bp, Heterodera glycines
  Genomic contig location: Contig_ID=SeqID_24288; Location=173..782; Strand=+
  SCN-specific regions: Sequence locations=1-393,417-610
atgtcgtcattcagttggatttgcaacgacatttggatggatattctgccatttttttgtcgtcctcaacttggcctagaattggcactgatttcgccccatttcgatgttttggtggacacgcatttcgactgccaatccgaattgaaaatttggagatccttcaaaatttacaagcgacaacaatttgtttatgaaggaattcacacttcgacaaggaaaagaaaaatgattgatgttgaaggagcgcctcaccttttggtaacaattttggtatttccccccccccccccctccattttgtgaaaaaaaattttttgtttaaatcagtgtaaatgccttttcctgggttttcgaggtcgctggtcataaattttgacaaatagcgaatcctgaatttcgaacaaacgtagaaaattcaaatttccgaaaagcccaggaacgacgttttacatggcataaattttattagttttttcgaaaaattgggcgacaaccataataattaccaatgtttccgtgcaggtcggtcgccacaataagcagtttccgtgccacgagatgcccaacaaaatccgcttctgtttcctccaaattaagtaatttaata

SEQ ID NO: 55007 - DNA, 119 bp, Heterodera glycines
  Genomic contig location: Contig_ID=SeqID_24289; Location=583..701; Strand=-
  SCN-specific regions: Sequence locations=1-119
atgggaaaaaatgccacccaaatcagatcgggtgtgccgtttgtcgtttcggcttttgcgagcgatgcgttagccaaaagtgcgcagtgccatcagtgtccccgaccaaaccggtgccg

SEQ ID NO: 55008 - DNA, 211 bp, Heterodera glycines
  Genomic contig location: Contig_ID=SeqID_4591; Location=2068..2278; Strand=+
  SCN-specific regions: Sequence locations=1-111,133-211
atgcctagatcaactgaacaacatccaaaacactgttctgtccatcgacgatttggtgatcggtgtgccgttgggtccgcctcgtttaaaaagtagtttttttcaccgaggatttcttaaaaaattgtaaaattctcatttttttagaccaaatggagcattttttcaatttccatggcgatttgcgtcattttactatgaacggctttga

SEQ ID NO: 55009 - DNA, 855 bp, Heterodera glycines
  Genomic contig location: Contig_ID=SeqID_4592; Location=2138..2992; Strand=-
  SCN-specific regions: Sequence locations=1-91,120-289,347-358,380 -540,573-672,750-766,813-828,852-855
atgtccattctttgttattcgttaattgtttctcgggaattggtaagttgttaatgaatttaaattgcaacaagtgacattaattactgtgaattaaaaaaaattttttttttaattttgtaaggattaatttaggaattaatatgattaacaaaatagaatttaattaacccacctcatatttgtcagcaattcgatgctgcttggtggtcatgatcatcttttgtgtggtggtggtgctgtcgtgaataatttcagtgctctgaacgccgttttggcgttgtgtatctttaaaaaaaaataaatttcaaattgataaataaataaaatttaactaatttttttaggcgggggaatatgtattttttagtcctgaaattgcccatccatcattcccaccctccggggccgcacaccccgttaaaaatgcgcgcgacattttctcacaatgagcgtccgggggcgcccgacggcattggcacaccccacccacatataatggataatcccctcaatggcacaattttgcgtgccaaatgttgaaaagaaattggagaagacgagaaaaacaaaggttgagcagctaaaagcccatttaggaattgatcgacttttgatgggcggaaaaaaagtgcaacaactaatttatgcaattttagtttttgcaattacaatttttaatgaaattatttttaaaaaagaaagagattataaaaaaaatcataattatttattaaactaaaaatttagaaaaacaccaaaagacattataatttaattttaaaaaatgcaattaatttatgaaattttaaggtttttgcaatatgccgtttttaatgaaatttaaaaaataaa

SEQ ID NO: 55010 - DNA, 520 bp, Heterodera glycines
  Genomic contig location: Contig_ID=SeqID_4592; Location=3491..4010; Strand=+
  SCN-specific regions: Sequence locations=1-77,99-278,302-332,381-520
atgctcctcctccgcgggagggcgctgtgtgccgtcgccgtcgccacactggcaaaagtaattaggacaattcgtttcccgctcctccccgcacttgacaatgagggacgggacaccaccgcgtcacacgccgtgccgttgggggttggaaattgtggcacctgataattgtacatttgtcataaagttttaaatcacgctggagaggctttttttggggtgctagatcattccgtaaaatccgccattttagctatttttgcaacaaaatatggcataattttgtttaaaagtaacaaaatttttatacttggtattgttcgatagcccagtttttatctattataaaatttcaaataaaattatcaaatttaatataagttatggcagaaatagtacatgcttatacaattttttcgaaagttgaccaaatttttttgaaattttgcaggtaaatgaagggaaaaaaaaatctcgactatcgaagggtacaaagaatgttaaattttattacttttaa

SEQ ID NO: 55011 - DNA, 498 bp, Heterodera glycines
  Genomic contig location: Contig_ID=SeqID_24290; Location=749..1246; Strand=-
  SCN-specific regions: Sequence locations=1-266,351-412,434-498
  Gene Ontology: Biological process=N-linked glycosylation
atgaacaagaaaggcagattaaacgagcccaaagaaaagaacgggaaaatttacgaaagccattcatttttaaagatggaattgttatcgaaagaggaggaagaatctctgaagaggttgaagagaaagctcgaacatcaacttctgagggtccagcaaagtctgaccgaaagcgaaaaatggaaatccggaacgtcggatatccagtgggaccacaggagtgggaagaaaatgaaggaagaaacgacgaaaaagggcgaagaaatgaaggaaaaagaggaggagaagaaaggaagagagggaaaagaaaaagagacggaaaagaagaaggaagagatgaagcagaaggacgagacggaaaccaaacgaagcctcagcgtcggaacaacgaaagacgatgaaatctcgattgtggattctgaagaaagagaaagggatgccttcgaaaacccgccgaagccgacaaacgagcgactgcattttgggagtcgactttga

SEQ ID NO: 55012 - DNA, 772 bp, Heterodera glycines
  Genomic contig location: Contig_ID=SeqID_24291; Location=116..887; Strand=+
  SCN-specific regions: Sequence locations=1-772
  Gene Ontology: Mol. function=ribonucleoside-diphosphate reductase activity; Cellular component=ribonucleoside-diphosphate reductase complex; Biological process=DNA replication
gctttctcagaggttatttccgatctttaccattatgttcatccgaaaaataagcgccaaatgcctatggtcagcaaaaaaacgtacgacattgtgatggcaaatgcacaggtgaattatatggcattttaaattgtttattccattttatttaaggcccttaattcagcaattatttacgaccgggacttcagctacacatattttgggtttaagacacttgaacgttcttatttgttgaaaattgacgggaaagttgttgagcgtccccaacacatgctaatgcgagttgccattggaattcattacgaagacatcacggcggcaattaatgtgttgtatagttaattataattggaaatgtatgtgtgtgcttcattaatcgcctcatttttacagacgtacaatttgatgtccgagcgatggtttacccatgccacacccactctgttcaatgccggcacctgccgtccccaactctcttcctgcttcctcctgacaatggtcgacgattccatagaaggcatttgcacgactttggatcgctgtgctctcatttccaaatccgcgggtgggattgggttgaacgtgcactgcattcgagcccaaggatcatacattgctggggttctttcccgtctttttttcttttggtttaaatggatttgcagactaatggcacttccaatggtctcgtgccgatgttgcgagtgtttaacgccatggcaaaatatgtggaccaaggggggaacaaagttaaccttgcaacagt

SEQ ID NO: 55013 - DNA, 882 bp, Heterodera glycines
  Genomic contig location: Contig_ID=SeqID_24293; Location=48..929; Strand=-
  SCN-specific regions: Sequence locations=1-7,29-250,292-353,375 -813,835-882
atgacaaaagaaaaaactgaaatttatcttgaatatgatcgaaatcgtaaaaaaccacgtgcaataatgagtgaggaagaaaaagtaattgaaagaataataactgcaaatgctgttcaatcacatagagaacgaatgaaatgtagtgaaggtccaatttatttaaaagcaggtgaatatatggtttccaatgttgaagtctttagacttagtgattttaaattaaaatgcaaccactgccccgccattcatttttatgaagaacaaaataataccaaaggagttaatgaatttttaggctgttgtaactacggaaaatcaagtaatttggaagatatgttacttgattatccaatggaattaaggcttttgtttcaaccagaatttgaccaaattgattctacgaacatgaggaatttccataaagattttataaaaaacataagaattttgaactcttctttttcctgtgcttcgttgggttgcatgcggtttaaattcccagataaaaatatcccaatctttaaaatacaagggaatatataccattcgtataacacttttgctcaaccaaataattatgatgaattgccaacgaatggtcagttgtattttgtagatactgaacaggcaattgatattcgaacaaatgctattagtaacaaaattagttctgacaaaaataacaatattattgcaataatttcttatatcgaattatatctacgtgaaaattatatttattcacaatcttataaaatgatgaaagatgtttctgaagaggctgctgaacaatctgaagacattcctgatattatgatgttgtttggcatccgagaaggagtggatttaagaagatacaatataccaaaaagaaatgaa

SEQ ID NO: 55014 - DNA, 1185 bp, Heterodera glycines
  Genomic contig location: Contig_ID=SeqID_24294; Location=45..1229; Strand=+
  SCN-specific regions: Sequence locations=1-755,778-1016,1039-1185
acagcccgatggcttaccactgtccaaagtcttgagaaggaattagcaactgtggagcttgccatgttgctaactttgcccagttcattgaaaaataaagttaaatgtttgaaagatttgcatcggaaaaataatttgtacagtgatactgttaaaaatgaattcttgtcacaattcaaatcgccatggacaaacccatggcggcaaccagattttatgcattcaattagagcaaaaacaggtgggtgattgataaggttaatatttttagttttttaacattttttcctgagaccctcgtgacctgtaacgctcgaaaaacatgttttctttttggaaattttaaaaaaatatgctcaaagaaccgacaataaattttcaaaataggtacactcctaataataaaaaattttctcaaaattttatcgccaaaatttatttaatttctttttgctaacaatttttatttaaaaattatgtatttctctgtcaatatgatttggcttaattttgatacttttttgtataaattttttattttacgccccctaaatttgaaggtttttagcaactattttcccattttagcacctattttgaggtttttttaaatcaaaaaactattttggcagtttttagcacctaaaattgcatccctattcatcaatatttatgtaacttaactgtaagtgtctttttttagggagaaatgttctctcaaatgttgtgatcaatttgaagaatattttcaccgaagaaatgatcaatctgaaaattgaaaacaatgatcaattgggtccggacgaaaatagaatagtgcacagaaaagtgttcttctccttatatttggcaatgaacaaaagggagtttgacgaaattcgcaatcaaaaattggacgaagcaagaaacaaagccaccagttatctgattgaatgcttaagcgcactccattcataggaggatgaagcatgagatgaacaaatcggtaaatggcaactcgtacaatggacaactcgttaaaatttttatttaaaaaaacctaactaaaaatttgagttgaaaagttttttaaatttatttttgaaaagtttttggataatttctcaattttcgtaaaaaagtacaaaaaaattttaaaaacttgataatttgtttattgatgaatattgatatttaaatgaaaaa

SEQ ID NO: 55015 - DNA, 822 bp, Heterodera glycines
  Genomic contig location: Contig_ID=SeqID_24295; Location=305..1126; Strand=-
  SCN-specific regions: Sequence locations=1-145,168-222,245-670,699-822
atggcacagcggtcagctgaagaagtgccattgttggagcatcaggagaatttcattgccgcctttctgctcggcacacagcaaaatgattgggacgagccggcattgtgcgtggagatttttgtcccttttttgggattcgtcgtccttatttacaaggacatgatacccttagacaggctttccttattcaaggacagcccctctttgatcaacagttccaataaaaaattattttttaaatcggatttatgtagagaatttccgatcagaaatgtcagtcggtgtcaacgaatttcccgaaagtctgatttggtgatgccaaaaaattaggatatcaaagaagggccagaattcagaatgggcttacatccttggcacaaacatgcattaaaaacggaattttacaccaaattaacacaattaattgcctaataaaaggggccgcctaatttgcgtgtaaaattcgtgggaaaaatttcaattattcgccccccttcctccaccaaaaaatgtctattttatttagcaaattgtcgttggcactgtgcgccggcgatttgtgggccggcggtttggagacgctggtggccacgctgaattgggcggtgctgtacatgctcaactacccggatgttcagcagaggtgggcggttgcaaaaaaatatgcaaaattaattatattattttgattaaatggattaccatttgattaaagcaatgattttaattttggaaaagaaatttcaatctgctaaatgataagctattgatctaatcaatgtttgagtcgatcaatccatttccaggcaaattcgataa

SEQ ID NO: 55016 - DNA, 410 bp, Heterodera glycines
  Genomic contig location: Contig_ID=SeqID_24295; Location=1872..2281; Strand=+
  SCN-specific regions: Sequence locations=1-191,225-315,346-410
atgtcaaacttaaatcctggtaattggtggtattattttgagcgtcaaggcaaagcaactgctaaatgtaaagccgatggatgttcctactcaaaggcattaaatgcttctctcagtacaactgtgctgacttttcacctcaaaaatcaccaccctgaactttacaaacaacgtgaagattttgttcaagcagagaagcaaaaaacagaaaagaagggacaaagtggaataattttcttgataaaaagtgcggcgcggaacgggatcccgcgcgggattttgcgggaccccagtgaaaatcctgaaaaagcatgaaaaaatgcatttaaaatgttttttattaaagatttttcgtgagcagaacatgaaataaccaaaaatttaattttggtcatttaaatgatcattaa

SEQ ID NO: 55017 - DNA, 848 bp, Heterodera glycines
  misc_feature (661)..(661): n is a, c, g, or t
  misc_feature (695)..(695): n is a, c, g, or t
  Genomic contig location: Contig_ID=SeqID_24296; Location=643..1490; Strand=-
  SCN-specific regions: Sequence locations=1-428,450-848
  Gene Ontology: Mol. function=carboxylesterase activity; Cellular component=endoplasmic reticulum; Biological process=embryogenesis and morphogenesis
atgtccgattgcaattgttccgccgtcgtttgcctcacaaatagtcactgttcgtcgcccagtgctccgccggtcgtccgcacttcgtacggcgatgtcattggcattctgcggcgtttggacagcggcgtccaagtcgaagtttttctcggcattccctttgcaaagcctccaattggccaactgcgatttgaggtgatcagtcaaaattgatcacactaaccaatcatcatcacttaaaatcagcagcatttcctaagggttttctctacggaatgatcgtttcagaagcccgtgccgccctctccgtggctttcctctccgttgcgggcattcgcttttggtccggctgccattccgctaaacccagagaattcagagtcaattcccttctctgaggattgtctgcagttgaacattttccgtcccgcgctctctgcttctgctcctttgcccgtcatgttttatattcacggcggtggctttgccgaaggctccgctcgccaatacggctacgacggatgggccgagaatttcgcgccgcagggaattttggtggtcaccgtccaatatcggctgggcccattcggttctgctgagtcttccgcctttttctcccgctttagtttgaatttgcttatttaggttttttatcctttgnccgtggaagtgttttgcccggcaatttgggcctntgggacatttgtcaggctttgcgctttgtacacaacgaaatccgcgcctttggcggcgacccgggccgcgtcaccgccgtcggtctcagcgccggaggggccgccgcggcatttatggcactgtcaccgcacagcagaggtggaaagcattag

SEQ ID NO: 55018 - DNA, 1027 bp, Heterodera glycines
  Genomic contig location: Contig_ID=SeqID_24298; Location=73..1099; Strand=+
  SCN-specific regions: Sequence locations=1-306,328-370,402-532,570 -763,787-796,821-844,875-1027
atggcttttccatatttagtcaatgtcccattaatagaagaggtatgttttgtacatatttattctcatctccatttaagctcactttccttttcaattcccccccctcccgcccccaaaattgcttaattgtccccatggatcacctattggtaaagcatcgttctctcccagccgaactcttcgacgaaatgtcccgtttcgttcccggccttttttgccgtaaaactttgagcaaaacaaactcaatattttaccttttgtttcgattcacaaaacgcgcaaaacggtggaaaatcgaagtacaataatttaaattataattttgaaagtaattgctctaattttttgccagtgggaaataaattgcagaattgttttaggtttatagaaattaaaagaaattttggccaccttaatattttttacttttttctgagccccatgagcttacaaattatcgctacgttgttgctaatgagagacgattcattatctctcttctgccaccgcatggccacgggtttaagccatttaaataaataaataatattcaattatttattattctatcctcggaattaaataattacataaaatttttgaaaattgattcagaaagcggccattcgcgagcacttcactgagggcgttttgaatgaacttgaaatgcgcttcaatgttggcctgactttccatccgttgccgcttcatattgtaagcataatgaattgattttgtgggtcaattcttatgataagcccactaaatttagcacaaattatccttaaacaagtttttatttaatttttatttttttgccttttgataatgtttttgtgggttaatttcttttaattaaatattttaaaatcaaacagcaatgggacgtttgtatggtcacctttttcgccactttggatgcctgggacgggttcatgagtgaagtcagcgacctgctaaatgaagtaagctaacgtatcaaacaaaattaaatgcaattttcaaatgcccataaaaacctata

SEQ ID NO: 55019 - DNA, 1621 bp, Heterodera glycines; identical to SEQ ID NO: 24299
  Genomic contig location: Contig_ID=SeqID_24299; Location=1..1621; Strand=+
  SCN-specific regions: Sequence locations=1-517,539-874,954-1100,1144 -1154,1231-1260,1284-1320,1414-1458,1508-1621
  Gene Ontology: Mol. function=transcription factor activity; Cellular component=nucleus; Biological process=cell proliferation

SEQ ID NO: 55020 - DNA, 159 bp, Heterodera glycines
  Genomic contig location: Contig_ID=SeqID_24299; Location=1399..1557; Strand=-
  SCN-specific regions: Sequence locations=1-50,100-159
atggctggtgctggcattgtggctttaccaacagcaataatcaaatcaggtaaaaataaaattcagaaaaatataataataataataattaattttttagggattggtccgggccttttaatgaatgttgctttaacatgtaagaatatttcattttaa

SEQ ID NO: 55021 - DNA, 2215 bp, Heterodera glycines
  Genomic contig location: Contig_ID=SeqID_4593; Location=1..2215; Strand=+
  SCN-specific regions: Sequence locations=1-7,29-75,97-703,726-838,860- 1200,1235-1772,1794-2215
  Gene Ontology: Mol. function=MAP kinase kinase kinase activity; Cellular component=intracellular; Biological process=response to nutrients
aattgagaatttatttaaaaaattattagattttagctcgggagggggcctcccttggatttttatgagttcgtaattttcaaaataagcctcaattttgcttctttcttacccatagaatcttggggataaaccttcttttttttggttaaatcgcgattatttagatttatagttagaaatacgctttaataagcactgaaaatgagttagaacttccttaattttttgtgccgttttttctcattttttgccaaatgctggagttgatatacatttccaaaaaatgaacataagcaataaaatacaaaataaataaaaaactagtagttcaaaaaatatggccacatttttttgacaagaattttgatttaaaacatgtatcttaatacgatttgtcctaattttgttgctttttgaataaagttttgttaattagtccctaaatttataaattaatgtacatagtaatattctcttcttattctggtaggtgccttggccgtggcgcatttggccaagtgtttgtgtgtttgaatgttgacacgggcgagcagttggtggtcaaaaaagtgccattgggccacacaaattcccggcatcgccagcgtgtgctggccacattagagaatgaattgaacgcgctgggctcgttgcgtcacgcgcacattgtcaattatttgggcgttgtgcaacgcaaggattgtgtgcacattttcatggaattgatggcgggcggctcgttgaaggaccaggtggacaaaacattctattgccaaggggggaagcatccctcgtttttcgacaactttttatggcattttctacttagcgcttattcattaaaatgacatataatttgctattttttcattgggattttatactgcaaaattgatggcaataatacacacacatgcagttaattgttcattcaagcgattaatcctttatcaataatcctcaatcagatcagcgagtatggcgcgcttggagagccggttaccattcggtttaccgctcaaattcttgacggtctcgcgtatttgcacgcgcgtgacattgtgcaccgggacatcaagccggcaaacatcctacggcacacgcatgcgcacgtcaaaattgccgattttggcgctgcaaaatttttgcaggccatttgcagtgaccagggcatcgatattcaggcacaaaatgcgcaattaaataatttattaatttctttattttataacacaaaaaataacttttttttcctctttgactgaattccattaaaaacatggtgtcattcgatagctaataacagactctattagccctcggatttaatggagcctcccgttggcaactctctgctgaaaatttaatggacctaattaactcaatgtgtctactacaattttgtcgtacgttttcagggcaccccacactatacggcgcccgaaattttgcgtgccgacaattgtcgacaatttgaaccacggtcagacatctggagtgttggaataactgtaagcaaatgcaaaaaatgagcccatgagctatttctaaaaatattaaattttcggtggtggaaatgatgacaacaatgacaccatgggcaggcattgatccagcagcggtaaaaaaatacattaggaagggaaatgggaggggatattgtgtcgggacaattggtcaatggacaatccatcaatactggacaatctgatagaaaattatatttttaagaggctgaaataagggcaaaaaacagtaaaacagagataccaaaattaaaagaaaattcttttactaacaaattgattttcgagcagtttcttcatttgtctttcgaacgaaaaattttattttttgggatttttttattgaatttttagggtgcatttttcaaaatttttgatagttcgatagagggttcatatttttaaattttttgcattttgttcaaattaaaaaaagcggaaatgaggcacgtgctttcgcttgaaggaaaatcgtgtcattgaccgagagtctcgacaagcaataaacctttattataatcttatttgtgatttatgatcaggttcaccttcgcattgtctttgctcgacctgatctcagctcattgcccgatggtttatcaacggcactgcgtgcgtcaattgaggcaatgcttaatagtgagcctgatcaacgaccacaggctgtgaagctactgaaaatgcca

SEQ ID NO: 55022 - DNA, 848 bp, Heterodera glycines
  Genomic contig location: Contig_ID=SeqID_4594; Location=186..1033; Strand=-
  SCN-specific regions: Sequence locations=1-39,125-257,284-477,499-848
atgacgaagatagctgtaggttaactactatggtaaatgataaaaaataattaatttcattaaaaacttactttttttgttttaagttgaattacatttactaaattctttttttaattttttagcatcttttcttatttatttacgaaattaaatttgattgaattaattgaaaaaatattgaaattttgtccactgctcataattaataatgaatatttaaggtccttattaagtttacctggtacttttcacatacattttttaaacattcatttattcatagacaagttttagacaaaatagaaattcgaaaattttcggcttttagactcgttgtttgagatcgcatttataataaagaactaaacagttttggatttcatgatttcattagttttgcagtgagtgacaattcaatcaaatttatttttcacaattaaattcttacttctttgcatttccaaattaaatcataaaaattaaggaattgttggatccgagcaaaggattttacaacaaagacgaggacaaagtgaaattggtcatttatgtcattgtggacgaggcaaaaacggagaattccgatccaaatccaacggcacactttcgatggaaattgaaaaattatcgaaatttgcacaagaaatcaactgtgtacataaagagaatgccatggaaaatatgggcagaaattaaaatgaaagcactgcgaaatggttgagcttttttcttttgtgcgacgcttctgaaaaaggtttgctttagaattttaaaatgtttcaatacatgcgcttggagagattaacatgataattgataacaaacactaatatttttttattaaa

SEQ ID NO: 55023 - DNA, 1057 bp, Heterodera glycines
  Genomic contig location: Contig_ID=SeqID_4595; Location=740..1796; Strand=+
  SCN-specific regions: Sequence locations=1-522,544-756,778-1025,1049 -1057
atgggcaaaaggacgggtggcgcaccccgtggaccaaaaattgtgccaaatgcatgcacgtcacccgagcggaaaaaacgccaaaccaaacactacaataaactaaatcgacccaaagtaagaaaaaaaaggaaaaaattttcattttttttgaaattttgagatcactgtatccagcagcgccccgaatgtgccgccgatcattcgctctcttgaaggggagcgcagctaccgcgtgaaggctgttttggcgacctacacccatagcaacaatagaatcggatattacgtagactggcttcgtaagtggttgggatgaaaattaaaattttttttcatttcttctcatatttttgtctctatttgtttggttattgatgagttgtcactgaatagctcctccataatcaaacagtccggggtttgaatgtttgttgccgagttgtctttgaatagctccgcgcaagcgttttaagttccgttcctccttttcatctctctctcttctcgctgtctctctcaattttaaatttatcacagtcctaaacactgtttattattaattaggtgcgaggggccaagagagttgggtgcagagcgagtcgtgtgattgtatggaactcgctattgacttcacaaggaaggcgaatgtccacgatgtgttgcgtggactacttggcgagccaattcccgagagtattgccaaggaagtgatggcgagtccaaaattcgtagaaggtcatttttttttgaattttcaaaattattctttaagtttgtaatttgttgggccgggaccccgcaacagtgctgaaaattgacgacctgaacatttcatttgctccatcactcaatgtccaggacattccgtacaaaaaagtattttggaagcgccggcacccgaggaaagcgacagtgaagacgaatgaaaggaaaaggctaacacataacaaattcactcatttttaacatttctcacaaatttcctcttacaaaacatttctcaccaatgtgctcttacaaacatttttcaccaattttacaattttaaacagaa

SEQ ID NO: 55024 - DNA, 510 bp, Heterodera glycines
  Genomic contig location: Contig_ID=SeqID_4595; Location=2643..3152; Strand=-
  SCN-specific regions: Sequence locations=1-82,105-349,375-510
atgccaaaagtaatgtcgttgctcctgacaccgaattatgtgcgatacattgacaccatttttcttaagaacccgtaggtgatctattcacccacaaagtttcattcggaaatcccacggacacctgggtactgctgcttctactgagcaacatcaaataatcggtcccaaggcgcccaagccacatgaagagacccccaaaaattttgagccaaaggacgagtcggcaacgaagaaacgcaaagtggaggaccgagagttgtggaaattggccaagggcaaatttttgctgacgacatatttgtgtcatggtaataattactaataatttctgcaaattttaattttgattaaaaattttgagatgattggaatcgtctgtacaacaatcagcagaaggtaaagcgtctggagggggaccgttttgccttcggctttgagatgtgtgaggaatgcgtgtgggccaactgccgcgcaaccgaccttttggcgccattgaagaaaaagtga

SEQ ID NO: 55025 - DNA, 1740 bp, Heterodera glycines
  Genomic contig location: Contig_ID=SeqID_24302; Location=175..1914; Strand=-
  SCN-specific regions: Sequence locations=1-1740
atggttcgaaaaaaacaaatattttctgttgatgttcagactccctcttcaacaccaccaaccttttccgatgttcgtccggtattaaatattgggttcaatgaacccatcagaaaaaatcatttgccgggttcaaagctcccaaaaaaaacggttgaaagaatgccaaccaatttattatgtttggatgaagttgatgatgattttttccgacaatcaacttcacaatcagcaatgcgaaaaaataaagaaagaaatgaaagaactgttgaaaaaacagaattagaaagacatttaaatcgccaaagaatggcaacaaaacgaaaccaaatgaccgttgaagagatagaattagaaagaagtttgaacaaagaaagaatgacaacaaaacgaaaccaaatgactgttgaagagatagaatttgaaagaattttgaataaagaaaaaatgacagcaaaacgaaaccaaatgactgttgaagaaatgaaattggaaagagaaatgagtaaggttcgaatggcgtcaaaacggagtgagatgtttttagaagaaattgaaaacgagaaaatatcaaattcagtttcgcatgttttttcaagaaaacgcgaaaggaattttgatggtttatattatcttgctgccgcagaccctaaaaaagctaatctttatctcctcggtgattttaattttaaatgtacgaaatgtgacagtttgcagtttcctgaggaaaaatctgtagttaaggattgcattttttttagttgttgtaaaggtggtaggcttttaaatcttttagaatgtgtttcgaaatatccggaagaaatgaaagcattattttttgaggaaaatcctttttatagtaattttattacaaatatacgtcgttataatagtatgttcgcctgtgcttcaattagttgctttcggtttaaatttcaaagtcctggccctccatgctataaaatacaaggacaaatataccacaaatttaatcaaaacgctatgccaaaagataatgaaattcctacaaacggacagttatattttatagattctgaagaagctatagatattcgttctgaaaataataaagaatgccgctcagatataattgagtttcttgaaaatttattaagaaaattgaacccttttgcacaatcctttttaatgatgaaagaggtttatgaaagagaagaaaataactgtaaagaaaatgggttaaaaatgccaaatataaatttagttttcagtctaaaagaaaattgtgataaaaggcggtacaatattccaaggtgtaatgaagttggagcaattgtagtttgtgatgccaatgatgaaattccgcctgcaagaatagtggtttacccgaaaggtgaaaaacaattaaaaaatatttatccgttagacaaatgtgtagaccaaatgtgttatcctttattatatccaatgagtagcgaaggatttaatgtaaatatcaaagatttaaatggaaaaaaaatttctttgtgtgactataccaaatttttattattttttcgagaaaatggtatttttttccctcatttttacgcaaaaaaactctttcaacaatggctggtggatcaagcagctaaaattgaatgggatcgcttagaatatataaggacgcatcagatggaattgtgtagcagtaattatttaaatgttgaagattttcttaagaatagagcttctaaaacaggcgcagaaattaaaaaaaag

SEQ ID NO: 55026 - DNA, 209 bp, Heterodera glycines
  Genomic contig location: Contig_ID=SeqID_24303; Location=664..872; Strand=-
  SCN-specific regions: Sequence locations=1-179,202-209
atgacgacttgtcatttagagatggtaccacgtttgtttggacgacaaattttgagtttttatactaaattaaattttagctaagaaactgtggggtagcgattgtgaccagacatatgaaaaagtctaaatcgggaccggcaatttttagaaacctggctttcaagtcactttttttgatccttaggaattttttcagagttaataaa

SEQ ID NO: 55027 - DNA, 153 bp, Heterodera glycines
  Genomic contig location: Contig_ID=SeqID_24306; Location=301..453; Strand=+
  SCN-specific regions: Sequence locations=1-110
agcgggaccgggaattttgggcaaaaccgggaccgggacttgccgggacctgagaagccgggaccgggacctcgatttttcttcgggaccgggaaccgggaccaaccgggaatttttaaaaattcaaaaaaattcaaaaaatttaaaaaatta

SEQ ID NO: 55028 - DNA, 951 bp, Heterodera glycines
  Genomic contig location: Contig_ID=SeqID_24306; Location=1..951; Strand=-
  SCN-specific regions: Sequence locations=1-418,542-709,731-899,921-951
  Gene Ontology: Mol. function=homogentisate 12-dioxygenase activity; Biological process=phenylalanine catabolism
tctccggcactgcgttcaccgctccgcgctgctccaaccggttcagttggctgtaccgcgtccggccgtccgtcctccacaggcctttccgccgtttggagggcaacggacggtgagtcatgccgttccctccacttttgttcgacgctttaaagcttcacgaatgatttctctcaatttgcccccaatccaaatcaaatgcggtggaaaccgcatccaatgccaaattcggtggctaatggcgccccatcattggactttgtccaggttttctgttcttcgatttccacaaatcctccacccttcagggcctttacaccgtttgtggggccggacatccgaatgattaattgtttgaaagaaatgaagaaaatttgatttgaaaattttcattaatttattagctttaacttttgggttttattaaataaaaaactaaataaaaatttaattatttaatattttcacttgaaataaattaaaatttgattttttttttaattttttaaattttttgaatttttttgaatttttaaaaattcccggttggtcccggttcccggtcccgaagaaaaatcgaggtcccggtcccggcttctcaggtcccggcaagtcccggtcccggttttgcccaaaattcccggtcccgctctactctaattattacttctaatttggcattcttttgggcttacgcttgtatttgaattacataaataaataaatttttggtttttagacttttgttacatacaaacaatgggacaagtactgacgatgcgaaagaatttaaaactcccataactttaacagttcaaaaaaacaaaacaagcgccaatcagtccctccctccgctacgatcagtctctccctttcccttcgctaatctcagtacgccgtctcctccctctgtcctcggctttcgtttcgagggttatggcgtgcatatct

SEQ ID NO: 55029 - DNA, 212 bp, Heterodera glycines
  Genomic contig location: Contig_ID=SeqID_24309; Location=37..248; Strand=-
  SCN-specific regions: Sequence locations=1-212
atgcaaagccgtaagcaaggcaacctcaagcttggaggtgtgctgatcaattcggtgaaccaaccgaaacggctgattgaatgccctattaaaatgaatggcaattctgtggaattcgcgctggactcaggtgctgaggttgtagtgatcaatgaagagactcatgaagggatcggaaaaccgaagctgagtccatgcaatgttgaagcgaa

SEQ ID NO: 55030 - DNA, 715 bp, Heterodera glycines
  Genomic contig location: Contig_ID=SeqID_4596; Location=261..975; Strand=-
  SCN-specific regions: Sequence locations=1-234,257-585,607-715
  Gene Ontology: Mol. function=ATP binding; Cellular component =heterotrimeric G-protein complex; Biological process=regulation of action potential
atgggcggaatgttggcgagttgtcaaagcgaagaagtgcgcgatcagatctccaaaagcaaagccattgagaagcaactgagcagtgacagaaggatggcatcgaatatcatcaaattgttgttgttgggtaaggaaaaggggcgacaaagtgatgggaatgatcagaagaagaacgatcagcagagtgacaagaataggaccattagtttgactatcatagtgatcagaaaagggctattgtcaaaataagtgataaaaaaaggatgattttataaaaatgatcgaacatttcgaccgattgattatctgagtgtatttaaatagaaaggttatcagagtaatcgcttagtgatggcagaacactaaagtgatcagtcaatgattgacggataatcttagcattgttcaggggccggagaatgtggcaagtcgacagtgctcaaacagatgcaaattttgcacagcaatggattcactgaggaggaaattaatgagcgaaggtgagaagacaaatggatgacaaattaattaatcagttataatgatgctaattaaggtccgtcgtctattccaacaccggtgcatttctctgtttttctttttgctttacttctgtttcagtgacttcaatggcagccattctcaaggccatggactcggtgctgcacattccgttggaagacgccagcaaagaggtgatccgattgattga

SEQ ID NO: 55031 - DNA, 754 bp, Heterodera glycines
  Genomic contig location: Contig_ID=SeqID_24310; Location=283..1036; Strand=+
  SCN-specific regions: Sequence locations=1-754
atgaatattattcagagattttctctgcagtttgtttggctttttgtgagttttttttaaacgaagaaaagcaattttgaatattttttatttttgcaataggttgctgtgatttttacggaatttatgctttaaattttgaatgtgtgtttagtttcttttatggcactactgctggcaaggggaatgctcgctttcaaaagcaatttgctattgcgcaggagaaaatccatgcacgtcaaacagcgataattccacgtatataaattgtaatgccaatgattcaaatagagggtgggcttttccatgctttacgtctgaatgtcacagtttggccagcatctgtaggctaattcattcactagcgaaatcagtagaatacccattgattcagcccccggctttattattgcaaaattttatacagaaacaatcagttagtttatcattaatagagcccggaattttgaaatggccgtgaccgggacttggaaaatggaccgggacgggatcccgggaccgggactcccggtcccggtttgtccaaaaaaacgggaccgggagttccggcaaaattccggcgggatcctggttccgtccgggctctactcattatggtgccgggtcgttactcaaaaaaaacttggtttttcggacatttttggctataacttttttaaatattacgaatttttttgaaattttacaggcgaatatagaacatttaaggctatttattgatacaaaagattaa

SEQ ID NO: 55032 - DNA, 156 bp, Heterodera glycines
  Genomic contig location: Contig_ID=SeqID_24310; Location=1288..1443; Strand=-
  SCN-specific regions: Sequence locations=1-50,72-156
ctcaatgacgaagaaaaaacaattgtcacctcaactcagccaccgttcaacaaaataacggtcaatttgcaatgcgcgtggaattcttatgggcaaagagtttggagtaaaaccggcgtcgacggctaccccaaccgagtgatccaagtggaaaag

SEQ ID NO: 55033 - DNA, 321 bp, Heterodera glycines
  Genomic contig location: Contig_ID=SeqID_24311; Location=89..409; Strand=+
  SCN-specific regions: Sequence locations=1-106,128-278,304-321
atggaccaatattacaacgcggaattgatggcatttgggcacattgggctggcagttgacagggaaaatgaccagcaaacagtgcaaaatgaactgatcagcgcattgtcagaggcattgggacggcggcagcggaaaaagtgacaaaaattgaaaataaaaaatgccttttaaaggacaattagcaatgattcggccacgcacttcgatttggccaaattcaaagccgtaagcgcggcatttcgccaaaagaatgtggcaaaaacaatcgctgacgcaatgaaagaaattgaaaaagaaattgggaagcagaaaaaataa

SEQ ID NO: 55034 - DNA, 171 bp, Heterodera glycines
  Genomic contig location: Contig_ID=SeqID_24311; Location=530..700; Strand=-
  SCN-specific regions: Sequence locations=1-73,95-171
atggtaaagaaattccaaatattcttcggccgctcctatcggcgccaccgaaccggcaaaaaacatcttttattattttcatttgaaataaaattttccaaaatgcagattttttgtcggtcaaatgctgattttttaaaattgagttgggagccctggctttatctttga

SEQ ID NO: 55035 - DNA, 537 bp, Heterodera glycines
  Genomic contig location: Contig_ID=SeqID_24311; Location=857..1393; Strand=+
  SCN-specific regions: Sequence locations=1-16,38-178,210-382,404 -423,460-537
atgcacaattttcgtgaattaattttcaccaagaaattttacaatagtgaaaaacttgtgctcagaccgccccaaattgacgcattttgggtgcattttacgcgtcattataaggggagggacaaaccggtgcaattgtccactgattacctgaccattttgcatctttcaaaggatgtaattaaaataattttgaattattaaaaaaagatggaattttctttatgacagatcgaagcaaattcaacaaaaggatacaatgacaaattgctaacacaatttgatggacaattgggcaacggaagtgcttttctgaacgactcgaagataataaaggtacagaaatgataaccaaaaacccaaactgaatggaaaattatgaatacaatataaaaatttttaactcgaattatttaaaattacccaattaaaatgtataaaataccaaaaaattatttaatcatgtattcaaagtgactggaaaaaacaattttgagatagttagttccttgtatatcaatatactttattatacaa

SEQ ID NO: 55036 - DNA, 216 bp, Heterodera glycines
  Genomic contig location: Contig_ID=SeqID_24312; Location=1103..1318; Strand=+
  SCN-specific regions: Sequence locations=1-216
atgtctgaagcgaatcttcagcagcaaacgcacggcccaattgctggcactgactacgattcggcagatgaatatgtggtgattgaacaggaggaagaaaccgacttggaaaagaactcaactttgccggagacggtggctacgaacactaattcgactcccagtgacgtgcaaagtgtggcagcatcagtcggcacttttggacgcggtcgctga

SEQ ID NO: 55037 - DNA, 376 bp, Heterodera glycines
  Genomic contig location: Contig_ID=SeqID_24312; Location=1062..1437; Strand=-
  SCN-specific regions: Sequence locations=1-376
cgaaggatccaaaaatggaagattgaagccattttgcgaatagttcgagccgctcattgcattctgtgggaaaacagacgaaaccactgagttttgctccgtcgaggccattgccaatgtcagcgaccgcgtccaaaagtgccgactgatgctgccacactttgcacgtcactgggagtcgaattagtgttcgtagccaccgtctccggcaaagttgagttcttttccaagtcggtttcttcctcctgttcaatcaccacatattcatctgccgaatcgtagtcagtgccagcaattgggccgtgcgtttgctgctgaagattcgcttcagacattttgttcgttgaggtttaatgctaggaggggtgggaatgtg

SEQ ID NO: 55038 - DNA, 153 bp, Heterodera glycines
  Genomic contig location: Contig_ID=SeqID_24315; Location=195..347; Strand=-
  SCN-specific regions: Sequence locations=1-153
atggacgatggggacggagtggagcagcatcaatcaaccgatgggcaaggcttaatgaacacgtcaagcgatgagaagcaacctcagatcacaatcactgttatgtcggatggaggtgtcaaagtgacggacgtttgtggaaccgaatacatg

SEQ ID NO: 55039 - DNA, 371 bp, Heterodera glycines
  Genomic contig location: Contig_ID=SeqID_24315; Location=496..866; Strand=-
  SCN-specific regions: Sequence locations=1-371
atggacttgctgcgagaattgctgaaagatcacgagattgagcctgagccggaaacaatcggagcgaacgcgcagaacgctatcaaattggtgcccatctctgaagaaatgttacgccggcgagcgcacgacgaagaggcaagcaacggagaaccgcaagcggtgcgatgtgccactcagtgaacgtgaccgtgaccaatgaaaggatgattttgatggtcaattacggcgtctgacttttacatattaattgctgaagagaatattataaaccgctgtttgtttgttctttctgtattccaatcgcattgtttgatcttttacttggattcttcatgtatttgattagacctggaacagctgcagtttga

SEQ ID NO: 55040 - DNA, 164 bp, Heterodera glycines
  Genomic contig location: Contig_ID=SeqID_24316; Location=78..241; Strand=+
  SCN-specific regions: Sequence locations=1-164
cacttctttccattgtcaagcgcaatgttgaccgtcttcatcaattatgcaatgaatggataaataccggacacttctcatctattcccgaccattaccggttattgtacgcattttgctgtgccgttcgtgccaaactcagttatttacttaaggattatttc

SEQ ID NO: 55041 - DNA, 175 bp, Heterodera glycines
  Genomic contig location: Contig_ID=SeqID_24318; Location=208..382; Strand=-
  SCN-specific regions: Sequence locations=1-175
atgtggcgtctcaatcggatgatcatcgaacgtaaacagcattatccggacttggacactgttttccgcaaatatagccatgagtgagttgatcatgttattcttccctcattgaaaaaaaatttttagaattttcttcgaagtggcgaagactaagcagctgagggaacattga

SEQ ID NO: 55042 - DNA, 1097 bp, Heterodera glycines
  Genomic contig location: Contig_ID=SeqID_4599; Location=63..1159; Strand=-
  SCN-specific regions: Sequence locations=1-156,178-1097
atgcaacgactcgaatttgaggacgggagcgaaagcaacatggacccagcgaatgagggccatcgcaacggcgcacagcacgacgaaaatgtgcaggacggggatggtcccgtcgcttcaacgaacgaagagcaacaaaaaattgccagagtaaacgaagcaacgagaggaagcaacatggcgacaggcgtggcgacaaatcagcaagggatgctacccttcccatcacgcaatttgcggagtgtatccatcccggtacggacagcgcgggacagaatcgagagagcatccgggactctcgccgctcgaattgcggaggctcgagaagtgatcgaccaagaccttaccgaaggggaggcaggctaccaagcggcgcgactgttggccatggagagaggactcaaggaggcaactcaaatcttccaaggacatttcgagattggaatggcagcagcgggagcagaacccgcaggtcaccaggacttcttctacgacctactgacagcgccactgccggcagcaacgaaagagttgcagttgcgaaaccatccaacaccagctgaactgcttcaaattgcggacgagcacatcggagacttaagaacgatgcgacgagcactcgaggatgaagaagaagcaatcgcgcggtctcgattgagcgggtcattcgggaccaacaacagccatccggtgggggacgacccacctccactcgaaaatcggaacatagaagaatgtgagagatccttccaagtggcggccaaacgatggcaaaacggcggacaaggtgtacagcaacacaaccgaagaccaatgggacgagtcgcgacacccgtcatgtcgaatttggacgggatttttcagcggcgtgccaaagtgccgtccgtcgccagcatgagagtgacgaacacagcgcgagaatggatcaatcgaaatcgagacgagatgggggcgttccccccagcaacagcccatcggccggcactgatgcaaccaaaaatcgaaaagcagcaggctcacgtgaacgacgactatcgggagcgtcagacatacccgattcgacggcatgctcgagacgagggagaacatgatcggaa

SEQ ID NO: 55043 - DNA, 1970 bp, Heterodera glycines
  Genomic contig location: Contig_ID=SeqID_4600; Location=310..2279; Strand=+
  SCN-specific regions: Sequence locations=1-309,337-564,586-597,619 -678,700-864,892-970,993-1007,1307-1313,1338-1382,1406-1525,1547 -1575,1649-1970
atgccaaagggaaaggaactgggatcgggaggattgggggagaacgacgagggctgccaggaaaggaagggggtcaagaggtgaatgggcgcctccgtttggccccgcacgagaatttgccgaatgtgatggagtgtggagggtgcttttccctcctttccgagtcctccaagccgtttcagcacgaatttattaaagcaaaacgaataatgaataaaagcgacgaattgatcgaattgggcgatgggacgggggaattggaggaattggtcacaggcagaccgaatatgaagcggaggggagtggaaggaagagaagagaagagaagagaagagagcgaccccttggccgggggcgcttaaatagacaattttcgaagggggcgggcaaaaggccatgcacgtggacaaattgtgagagagacaaaaaatggacagaaaattctagaagcgaattgcgaacaaaggaaatgggcgcacaaaaattgaatgtgaattggcagatgtaaaaagtgagaaattgtgaaaggaaatctgagcacaaagttggccgaagatgagccaaccgatgagaaagatttgaattgtgaagggatgcgatggggcaaaaatgggacaaaggaacgggcaaaatgtgaatggtacgaaatggagaaatgcatatgagaaattagatggaaaaggggcaaaaattaggaatgatcaattttgaatgaattgatgaatcgggactcgccccgatcttctccaagaacatccctcattctttttgcttcgattgagtcccgtcccgttcatttgtgcaataggcggggattgacccgccttctcgtcgccaatgaaaaaattggcgacacacattctgtaaaaaataaaaattaaattaaattaacagctaaaatctaaacattgtcagaagatgccgtaaaagctaattcctatttctttagccaaaattaaataattgaaagaatttttagatattttaattttgttttgtataattacattttattaaatatgaattatttaatgtacttaagttttatatttaaacaatcttttaaaaatctttaattactttaattacaattttttttttgcctttttacatttatttgtaaataatttatgtgttttaaattaatattattaattcattctctttacttttatattttattgagtaatataaaatatgtacgtatatttgaatttaaaaattttagaaattatcattaaaaatttatgtgaaattttttatgaaataattatgattttaatacataattgaaattttttttaaagttggacaaatcaattaaatttgtttcatttctcgtattgcatcataattagaacatttatcatctgtaatattccttattaattttatttaatttttagtttatcaccaaaccaaaatttttatataagtcttaagtacaaaaattaaatgaatattttgtaaattttcaaaaactttgataaggcgaaatttaatataaaacgaaaaagtgcaagccttaaaacataaaataatactaaaattagccgcacaaaagaatatttaatctaccgtatttcctcgattataagccccggggcttctattgttcaacccccctccaaagggggcttatattcgagggggggcttccattcgagggggggcttttattgttcaacccttcatttctacaaattaatgcaattttttcagaaccttcttttattcaactttttacgaaaaactacgttgctttttaactttcaagtgccaaatacaaatcattttataattaattatggatgcaacaaaaaccttacctgaatcatcgactaaaaaagtacctacctattaaaaaattcttttcaaaattacctatcttaaggtttgctgctactgcagcaatccttgttctggtgcccaccaatgctggaagtgcaaaaaaccttgccatgcgatag

SEQ ID NO: 55044 - DNA, 567 bp, Heterodera glycines
  Genomic contig location: Contig_ID=SeqID_4600; Location=2527..3093; Strand=-
  SCN-specific regions: Sequence locations=1-120,144-567
agtaacggtctttgagcccttctcagcaacacatgtcccgccacccgggtcaagccaaaccgccgtttcgtctgccgcgtagacgtgtgtagctgaaaattagtcgtttgaaaaaatatttctcatttacctacttatttttgtgtatgagttgttgaatatataatatgaagttgatgatgatgtttttgtatgtatcgggttctttttgcgctactgttgtcggtcgacgtaaggaaaatttatgacggtgcatgaatttttccagccatcccttactagcctaagagaaaaatgttcaaaaatttttcgaaattttaccgcaaaattttccatgtcttcgtaggcggcgctcattttgattgcttgtgcagcaatcatacttcgtgtcacccgcactttcttttctcgcaattcagacacccactggaacacagcttcttcgaagttcctgtttggaactttccttccgcccccttccaaacgttttcgttttgacgattcggccctaaattaaacgaattaaaacattgtgacattacaggcatcttacactttcctcaaatt

SEQ ID NO: 55045 - DNA, 1231 bp, Heterodera glycines
  Genomic contig location: Contig_ID=SeqID_24320; Location=550..1780; Strand=+
  SCN-specific regions: Sequence locations=1-260,282-470,493-801,850 -1107,1129-1231
atggatgatttttacattgtactaccttcgaacacaccggggcaggagaacactacgtcaaaattcacagttcgactccccgagactttggaattgggcacaaattgggcagtagctctctcatcaattatttacccctactcattcaccgcactcggtataaacggtcaagagtttattaaagtatgggaaaacgacatcagtgtccctactcaagtttatttaccggacatgaattttaaaaccgccgggggcctgggaaataaaattaatgaggcattcacacatcattacaaaatcaaaaaacaacgtggaaagagagaagccaaggctgaagataccaaagattcaaaaattgatgtcgcaaagagggccgcagaacgcgccgggagagacgtagaaagacattttaatcagatcaacaatatatcgaattccatccaaacccaactaaacacactacgagaaacaaatcctcaaattttagaagagcctgatataaaaatttggtttgacaaaatggttgagatgggaaccgaaattcaaacatcccgaaatgaacttaaatcttttcaagaagaagtagataaagccaaaaacataacattggagcatgtggaaaagaatgacttgaaaaaagcaaagaaatcagccgacgtcgcaaagggaatcgccagacaggcaaagaccaaatatacatcaactctcgaggaatataatgataaatcggaaaagggttttagcgggatggtggttaggcttaacgaggcgctcggtgagcattttaaacataaggaaattgaaaataaagaagtttcagaagctgaaaaagggccgcaaaaaagagagagattagccaatgaggatgttcaatttaactacgacagtattgatcaaaaatttattgtctatctttcctctgccgtcacccatatagatttgtcaaaacacctcgcatatgttctggggtttaagaatacaaggctatttcacgcggaagaggcgacttatatgccggatttgacgggaggtgtaaggcagctatacatttatgcaccaaatttaatcgaaaacacaattatcggcaaccagatggccccactcttaagaatagttaacgtcgtcgatgacccgggatcaattagtgaagttatatatagcaccgagtattttcatcgtctacaatcgaaacgaatttcagaaattacaattgaaattcacacaccgtttg

SEQ ID NO: 55046 - DNA, 1759 bp, Heterodera glycines
  Genomic contig location: Contig_ID=SeqID_24321; Location=3..1761; Strand=-
  SCN-specific regions: Sequence locations=1-263,285-313,335-468,514 -662,684-753,776-1348,1387-1759
atggaaaattataaattaattgacgaacggtcgacgatttgcgaaaaatttggattcacgaagaacattatggaatttcggatcaatccggatgtgagacgcccggatgaaacgatgagggacgcaatcgacacaatgattaaggcggcttttaagactacggaagaaaggatgaagcggaaagtgcggatgtttggagtggcaataacgggtgccgggcttgcttccccggtttgggtaccgtacagggcgtacccgcagaacaatgcggatgttattatgcaggagattaataagttggggcagagcggggaaggagatgaaaataagaaaacgcttttgttgtcggagcctattatgatgaaaattacttgcgtgaccatgcccagtggagaggggccgaggaatgtacataaatttgatttcggattcaaggaacaccaacggataaagtaagttttttttttgaaaaaaaaataaaatagaaaatagaaaaaaagaaaaaagaaaaaattataattatttattaaggatttcgaatgtggataaattttgtttgttttatgcgttggtggcgtcaaagctttatttggaagtgcaccggaatatttttaatcgatttatgaataacatcgtgagacaacgtgaggcagcatacggacttttaagaaattgtggaattgatattaacgaatatagctatggagtggagcacttatcgggggttcagaattattgggtggggtttaaatgaaaaaatgcaaaattaataaatttttcaggatgagatttaccccggaaagtaccgggttgttgcgtttgagaagtctgcggatccgcggaaatcgatccgtgttttgtggaagggccctatgggacgagagaaggtcgtaccgatatttttggagaatggtcactgggatggattaaagaaatatgtttgctttttcaaccgtgggaggaagttctgcgttgaatgtgaatgtttttacgatcaggatgtttatcatacgatggattgccgggcgagatgttattactgcaatagagctggaggaatgccgtgtcaaaaggagagtggagtgaagattgaatgcccgaagtgtcgacgttacttttataattgggaatgctacacctatcatcagggacatcagacttgtaaattatggaggcgttgcgttatctgtgacaagacttatcgatttaacccgaaaaaggaccatgaatgtggagagacttattgccaactttgtagtgtgagccatgaccccaagcggggatgttatattatgccgatcgaggagaaggaagacaaggacgtctaccgaattgtcgtttgggtagatttaataaagaaaaagacaaaataagacctaactttcaggattcggagacttcgcaggattctatttacaagggggaccagaaggagcatgttattaattatatttcggtgagagttacgtgtacggaatgctgtgatgacaaaaacaggacgaattgcaaaatttgtggggaggagaggatcaaggattggagcgaggcggagggacatgagccgacccaggattttgtggagtggattttacctgcttttaccaattatgaaaccgcacttattttgccctaaacgccggacgttttgaacggctaatttcaaaatcttattttttaatccctaattttttaggccttttggcttttattacctctgccgtacccgggaaaaccccgatcccgcttattaatggattga

SEQ ID NO: 55047 - DNA, 1146 bp, Heterodera glycines
  Genomic contig location: Contig_ID=SeqID_24322; Location=570..1715; Strand=+
  SCN-specific regions: Sequence locations=1-771,793-861,883-941,963 -1069,1091-1146
atgactcatgtctttttcaaccctgactccattgaatggtcaacatttctagcctcgcagcaagaaggaagaggcgaacagcagtattttgttggtacacgttaccaacgcggaggcggtcttctgcaaaatgtagcccgatttttgatgccagtggcatcaaatctactctccagtgcttcgaaggaaggaattgctgcaggaacacgcgttcttggcgatttgtcccaaggtaaagcattgaaagaatctcttgaaacgcatgctaagcaaggtttcgaaaacctggcaggaaaattacaacaatgtgggaaaggtggaaattatggtgccgatggtagaagaggacaacgagtgtcaaaggttaaaaaaattagtggcatcagctccagtgattctattattggcagaattgggactgttaaaggccgacggaacaaaatcatgcatcagttaagctccccttgacaccttgaacgcgaaagtctataaataggtaaagaattttgcaaaatcatacatttaggaactcattatcatcatatagcagtactaaatattccttattgattaatcatgagtattatcaaaaaaattgacaaagatagtgttgaaggtcttgaaggtagtctatcattgtttaaccttccaccgacaaatgtggctattaataaaacgagcgttcaggagcttttaccattgtccgctctcaaccagacaggaccctatctttttcgtctgttttccgatagtcaatattgtgatcttagcaaaacgtacatgtatttgctcacttcgatagagcgtaagaatgccgccggagaatgggtgccgaccgacgatgcgattgaagaggacaaacatgtaggtgttattcaaaattttggaagcagttttgttcgatcattgaaagtcaacatttctggtgtcgaagtgtttgatagctcaatatactatcactatcgtgcgtacataatgcaggagcttggctattcacatgagattcgcaaagcatttcacgaggctggctgctattatccggatgaaaacagtcaggataactactcaaacaaaggttttaccagccgagcacagagattctcaaacggaaaacagtgcgaaacaatggtaaaaactcaactttga

SEQ ID NO: 55048 - DNA, 56 bp, Heterodera glycines
  Genomic contig location: Contig_ID=SeqID_24323; Location=1777..1832; Strand=+
  SCN-specific regions: Sequence locations=1-56
atggaacatgactttatttttaaaatttttcccaatcgttatgctctattcacaaa

SEQ ID NO: 55049 - DNA, 1330 bp, Heterodera glycines
  Genomic contig location: Contig_ID=SeqID_24325; Location=1..1330; Strand=+
  SCN-specific regions: Sequence locations=1-607,856-870,894-1043,1092 -1103,1126-1330
agtgatcagaagaggtacaacagtgattagaagaggtacaacagtgattagaagaggtacaacagagattagagaggtttcaacagtgattagaagaggtacacaagagattagaagagtgattagaagaggttcaacagtgattagaagaggtacaacagagattagaagagtgattagaagaggttcaacagtgattagaagaggtacaacagagattagaagaggtacaacagagattagaagagtgattagaagaggttcaacagtgattagaagaggtacaacagtgattagaagaggtacaacagagattagaagaggttcaacagtgattagaagaggtacaacagagattagaagagtgattagaagaggttcaacagtgattagaagaggtacaacagagattagaagagtgattagaagaggttcaacagtgattagaagaggtacaacagagattagaagaggtacaacagagattagaagaggtacaagagtgattagaagaggtacaacagtgattagaaagtgggcattcaaatagagcatttatggtaattaaggaattgtttttaatcaaaatagataaaaaatcgatgtgttatatttttcattttttaaaatataatacactttttattaatgaaaaacaaattatgaaatgtataataattgaatagttatttaaattgaaatgaaaaaaattttacaattaaattttaaaataatagctgaaattctttaattaaatataataaataatttaatgaaaatcattattcatcaaaaaatttaattaaactaaaaaaatttattattaataaaaccaaacatttaaatttattaaaagtaatgaaaattaacccaaaaaatacaaagaaaaataatgtacaccgcccggcttcgaacttcgcccccccccaaaaaaatgatgcctcagaatccccaatcacacagggattctgaggtcttgacgatgtcaaaagtaaaatctgatcacgtattcgtgatcagcgtcataaaatacccctaatgacatgtttttgaaagatttttggtgaaaaaattttttcaatcaaaaatcatgtgctcacccctttggtcccgaatcccaaaatcacttttatttttgtatctttttttaaaaatgtgatagaaatgctaaataaaatttatataatagagcaaaaaattgcggatttttgtagtattttactcttccctaatgacttttcagaaccgagatataaatttttttctgaaaaatagaaaatttccagattttctggaataactttttttcttttagagatagaaatgccaa

SEQ ID NO: 55050 - DNA, 1221 bp, Heterodera glycines
  misc_feature (1216)..(1216): n is a, c, g, or t
  Genomic contig location: Contig_ID=SeqID_24326; Location=21..1241; Strand=-
  SCN-specific regions: Sequence locations=1-274,311-371,403-404,451 -557,580-623,666-1002,1024-1032,1059-1107,1129-1135,1167-1221
atgatgaatacaaacaattttctgatcgtattttgctgcctttttctgttggtacagtttccccaatttgtgtataccgtgggaataaatactgtgtgttttcgatacggtagccagttcagagttcaagtattctataatggcaattgtgagttttggcaatatacaaatccattgccaaatggacaacaacaatgtttgagcgttcagtcaacaatttggaatagaatggataccaatgcatttgttgagttcagaaatgatagtggacaagtaatttaataaataaatcaattacaattttttaattcactcttagaagcgatccaaaaattttctcctaaaatatttaaaaatccgacgaaaaatggaaaaattaaaaaaaaaaaattttttttttatgttttgccaaaattctgtttttcaaattttcttattttcaatagaaaatcaattgttttgaatttattttccctaataaaaatgcaatagataaaaagaataacaaattaaaatggataaataacagttaataatggatttcaaaaaatacacactaaaataaaattttttttaattcttagaacgagtccttatttccaaggatgtttttgaaaatgggcatttaaaataaaacattcaaaaatctatttttattaaattatgttattcacacaaaaaaaatccaaaattttaaaatattctcaggtgattggtaccgctacagtacatgaattacgtttttcaacttctaaccccccaactttgaattttgaatgggaaaagaaagtgtgtttttggcggccaatgaatgtttctgtttattcggatcagcagcaaatcaccactattcaaacaatgactgattattttgatcacacaaattgtatggagattgatcctaatcagttggtcattggattagtgaatcctaatcctcagatttcattcttcgagcaaaatcatcaaaatagagtgagtgagtggtaaacaataaatttgaaaaaattattttattgggaatttctttacatatatttttagaaaataaagtgtttgaatatattgcaaattttgaacatgttttatttctcgtagttttttgaaattttcttagaatttcttatgaaaaatcaaaaaaattgtttattaaaaataatttttaactgattttttttagcatttcttatgaaaatcaaaaagaattgtttattanaatga

SEQ ID NO: 55051 - DNA, 941 bp, Heterodera glycines
  Genomic contig location: Contig_ID=SeqID_24327; Location=135..1075; Strand=+
  SCN-specific regions: Sequence locations=1-147,172-426,448-693,728 -749,773-869,934-941
  Gene Ontology: Mol. function=ATP dependent RNA helicase activity; Biological process=regulation of translation
atgcggctcaccggcgcccaggagggcatcattgtgcgctgcatccaacggctggacgaggtgtgcaaggatgtgcgcaaggcggcacgcattgtgggcgatccggcactgttcgagaagatgggcgagacgagtgccgcaattcgaagaggtgggaggggagaagggggattctttttatttggaatggcatttttagcatgccaaagtcacacaaaaattaataatgcgaaaatacgcagtcgggaaaaaaaatttttggatgcgattttatgtttgggttgtctatctccaatccaggacaggtctaagtttcctatgatttcgatgtcgccgaccacgaaaacagcatctatttcggccaatttcgaaccccggacccgaattcgaacaaaaagtcgaaagtccaaatttgcgaatttcgcatttttggtttaaaaacggctttaatgatcctttattgcagaattgatggtttcagtttgtttccgtgtaattaactctttttttgaaccaaaaatacgaaatttcgaaaacttggggattccgattttttgttcgaattctgttccggagttctgaattggccgaaatatttgccggattcctgatcagcgaccattttttttttgaaaaaggggggaacaaagcacagtatttatacccaaatctaaaaaatcggaacattgtagaaatttttgttgaagtatttttcaaattttattttcgaatattgcattattcaaagctattttaatttatttaaattaaagcaattaaattttcagacattgtgttcgccgcttcgctgtacacaaccgaggaggaatgaacgagctgtttttaatgggccttttttctcaatatcatttttctattcatttttgtttatttttctatcccaaagatttgtttttgtttttttttttgcttataaatta

SEQ ID NO: 55052 - DNA, 812 bp, Heterodera glycines
  Genomic contig location: Contig_ID=SeqID_24327; Location=1274..2085; Strand=-
  SCN-specific regions: Sequence locations=1-355,378-554,576-602,627 -677,701-714,736-771,793-812
atgctttttcattgggagagatttgctgagaatttaaaggaaatgggtgggagtggataaaatttcttaatgttagggatgtggggggactgttacttcacccactgtcaagggacggcttttatggtgaaaattctactcaaaaaattatataggtatatttgccaatctaggtgatcactttctacggcacaattctactttctgctcactgtaagtgatccttccctttaaccaaagtgccaatgaatgaattataaagaaatgcgccaatgagtgtaaaacaaaaaattcacaaatgtaaagtaattttggagccttattattagggatgatatttttagggttttcctgttttttctgagtttccagtggctgcttttttggtggttgttaagctatttttcgagttattagagccttttcgaagtgtttatttctagagccgaaaagccttcggttaatgaaaaatattttcattgatatggatggtataatccgaggtgtcatcgaaaaactgcaaatcagaatttcgggcggaaaaaaaatcagatttttgggtaaaaaatcagaattttttgcaattgtattatttatccaatcaaaaatgtaaaatattattttttcagactcccgtttttaattttaacattcttggagacgaaataagcatatcgaatttattttgtttttcaaaaaactttttcgtcgaggagatttttagggaatttaattgtgatttgttaacagtaaaaaatcaacaaatttgcgcttttgagccagttttttaatgaaaaatttttcataataaa

SEQ ID NO: 55053 - DNA, 1278 bp, Heterodera glycines
  Genomic contig location: Contig_ID=SeqID_24328; Location=159..1436; Strand=+
  SCN-specific regions: Sequence locations=1-29,51-705,729-847,871-1278
atgttgtcctccgacactgaacagatcacccacggctcgttggggttccacgaaaagtcgctgattttggccgtgtgcccgccatggatgaacaacagttctttaaaaagatccattttagtccgttttgcctccactcacccggtggtccgtcctccgcgtcctctggcgactgttcgtcgccaattttgctcagatcccaaatgtgcagacggcgatcggtgcccgagctggccaaaatggtctcattgtggggcgaccattggaccttggaaaaatgtttttttttgtttaaatttattgaaaaatgcacaaattcacttgaaatatttcatctctgtgcgattcaaatgaatgcagcttcaatttcaaattacgaaggtcccacaacgcaacagtcttaaacagatttgcttaaaaatgctagcagatgcgtccaaactttgtctgccgatccggtggccaaaatgaattccgagtacgggttgaaggagagacaattcacctgggaagtaacaaaaattaatgaataattcagagacaaacaaaaaacatcacacattggcatagaataaagaaaatttggtaccgatcgaaggaccgaatcaaaatgcgtttttgtctatttctcaagatttacaattttaattttttctaagtattttgggagggaaacccatacaaattttcattaacttatctttcaaaaaatttttttttaaaatttagtgagatggggagggggcagtttcatccttataccactggttaagtgcctgatttttagcacacacatttatggactgatttttgctgtcccaatttctagcattttcggctacgagtaagatataatttccttttttccaataaaaaaatgttctttctacccttttttaacatcaatctccccccccccccccggtctccgcttgcctcggccgagtgtgcctccacaacatgggttggctttgtggagctgttcgtgcgcgtgtcccacaccatcagtttgtgatcgtcgccgaccgaaccaaagactgtgtcatgtaaaacgtgccttaatttgaaaattattctcaaaattcagttcgtaattccatgtttactaccatgccacgtccctcacaaccgcagtgtgtgctgtgaaaatggattttgcgtccaaaaagttggcattcgcagtcgccgcttgaatgtcccacaggcacacggtcatgtcgtcggaggcactcaacaaatgaccaggcaaattgttgttccaggataagcctgatttga

SEQ ID NO: 55054 - DNA, 1643 bp, Heterodera glycines; identical to SEQ ID NO: 24329
  Genomic contig location: Contig_ID=SeqID_24329; Location=1..1643; Strand=+
  SCN-specific regions: Sequence locations=1-998,1021-1643

SEQ ID NO: 55055 - DNA, 899 bp, Heterodera glycines
  Genomic contig location: Contig_ID=SeqID_4602; Location=188..1086; Strand=-
  SCN-specific regions: Sequence locations=1-274,297-397,451-498,529 -864,886-899
atgcctcgtggagcagcagacggggatgaacgcgccattgtacggacggtccaaagatgtgccggagaagcgcttgtggaatgtggtcagtcaaatttaaaatcataaatgtcatatcgaattgataaatgatttattacaattaattacagttatcaaatattttgtttttaggatttagatattaaaatttgaaatttgccatagaatttcgatattgaaaatgctatatgtttttcttttctatgtaaatgcgattgagagtttaattgattagcaaaatattctttggttttccccaatgaataaaaacaaatttaacttgaattttgctcgagttttaggctggtgctgcgaattattgggctaagaagggcatgccgaaatcaaaggtcccattttattatttttttgtatgtttaatttaattttattattaaagattattatcggaatcccaacatatggtaacaaaaatttaaatcgaattacaaaaactttatttttattatttatttttaataaattgaggccgtggttggactctgagcaacccgcaacaattccgtgacatcgacgcaccggcccaagtggcaaaagcgacaaaatttgtcaaattggcgggcatcggatcatactttgaggtggaaaataatgaaaagatatcttatgttatttactttgggttgagcggtaccggtaccggtaccgaccggtaattaccggtttttttggtaccggtaccggtaccggttttttcaaaaatcaaagtatcggtaccggtttgtctagtaccggtaccgccggtaaaaatttgcactggtaagaaagggggtctgggtgagaaaacagtagggaatggtgaagaaggagaaattttttgagaaaaaaaaattaaa

SEQ ID NO: 55056 - DNA, 2223 bp, Heterodera glycines
  Genomic contig location: Contig_ID=SeqID_4603; Location=5..2227; Strand=-
  SCN-specific regions: Sequence locations=1-99,159-218,240-306,329 -483,533-599,623-629,651-858,885-1166,1188-1217,1238-1829,1851 -1987,2060-2223
  Gene Ontology: Mol. function=chitinase activity; Cellular component =extracellular space; Biological process=response to bacteria
atgactgatggcttcttcgcggacccgtccagctgtcagcacttttaccgttgcgttggtccaatggcttatcggtccgttttctctattattacattgataatatttaaatatttaaaataattttaaaatatttttaatgatttcataatttatttcattccatccactttatattcttttcaaatatctgttccaaatgttcagtttcgactgtcccaatgggctccacttcagcaaaaagttgtcaatgtgcgatcggccgaacgaagcaaactgtgaataatttacaaatgttttcctcattttcatcttttttattctgtaaatttttgtgcttgaactgcataaatttgtaaaaagaatttccgatataaaaagcgaattgattctcagctaacattgccaatttaatgatcatttggaggactgcacgagtcgctttataatcctttaagcagtccttatactgtagggatgggctaaattaattgtaatttttattaaaaatttaagaaattcttttataaaactgagaaaagatttttggcatttatattaaaaataaaacgaattaattcgccctaatgtctttgcaactctccaaacatttgctcagcttatctacggttttattcatcatttgttttgtcggtgagattttttaaatgaagcctaatgattaatttaattagtgctaaaactattggtaatgggggagagaacaaaagcccaattaagagattattgcgaatgtagcattttttgcttcattttaaacgatcggctcctttttaagccggtgacaatgcttcatcctccgcggtttctggtgccagtggcacttaccttcggccctgctacttcaccaattgggcacagtacagagagggccgggccaagttcatgccggaggattacatcccgggactgtgcacgcacattctgtacgcatttgggtggatgaacgaggactacacggccaagtgggacaaatcgcggaattattaaaattattgttttttttttggcatttcatcatttaaatagggaataaatggaattttagggccattaatccggccgatttgccaagtgataagcaaccaaatgggatgtatgctcgagtgaacggactaaaggttataataaaatggaaattctttacaaaatagtcataattcttttatttattaaagtaataaacctttttcgaaaattaattaattaattaattttaaggcttttgatccggtgctgaaaacgcttctttcatttggcggttggtcatttggcacccgactttttcgagaaatgacttcaaagtaagaccaaaaattgcggttgttttcttttagcatgagttaaacagatgttttcagttttgggcaaagataatctctaagcatccgaataaatacagtataccattgcttcaatttcgaagtcctacaaaatgcaccaaggaacaggaagaaatttttttttttgttctcggtcttccaaccctctagcatttttataagaaaattttcacaatcaaacttaggttagtttcgttgcgcgcgcgacttttcccaaagatattctcggatttcgggtcaaacatttttgatcaattaaccgttctcgaagtgttggctgaccggggcacccgctgcgcttcaaatgtgttcaattgtgcaattttccttcgcaatttatttaaacttttaatggaaattttatctgaaatatttgattattttatggacaattaatttgattaaattctttattttttttcctttttgctttaggttacatccctagtttctcaaatgaaataaattttttgatatttaattttcagaaaagcaagcagaaaaagtttcatcgattcggcaattgcatttgtgcgaaagcacggctttgatggcattgacatcgtaagagaatacccaaagggcggagagcagaagcgaaacttcagcagattttttaaggcaaatttttatgaattaatcaaaaatattttttattaaaaatattttaatttaagaaagtatttaaaaaaaaacataagttgatttcactaggaactgaaagacgccgttcggaaagaagcgtcttcaagcggaaggccgcgtctgctgatcactgctgcggttgcggcggggacggaaaacattgacaacggatacgacattccgacagtcggaaagtcgagcaaaatataataaa

SEQ ID NO: 55057 - DNA, 968 bp, Heterodera glycines
  Genomic contig location: Contig_ID=SeqID_24330; Location=161..1128; Strand=-
  SCN-specific regions: Sequence locations=1-301,323-468,490-574,597 -761,788-800,822-918
atgaagcgaaccaacgcatcaaacatcactccgcctcgcgcaaaacgttcaatggcacccccactggacctggacccaaacactgtcgcactcgcggaacaagaacgacaacgcaccctggtcttcattggcctcccggaaagcaatgccattcgcccatcggaacgtgttcaggaagacagggaagccgccacaaaaatcctggaccatcttgaagttgaggcccaaccaaccgccgtctttcgactcggacattacgacccgcagcgaacaacaccacgcccgctcaaggtggtcatgccaacaaccacacaccaacacatggcactcggaggatggaagcgcgagcgtgctcgactccgttctctacaaaacctgaaccgcctgttcgtccgcccagcgctgaccaaagaacaactcaaggaagaatatgaagcgcgcgtccaaaaacgtcaacaaaaccctgctcccgtggcaccagcaatgcaacctcgccagacaaatgttccgactcccgtcaaagaaaatggaccaagccagaaggaggccagcgacgacatttccaaaccgccggaagtttttgagcaaacaatcctcgtatgttatgaagcattaaaatcattaccaccaaacgacaaaattgttcaccaaattcaatcactcgaaaaacaataccctcgtcttttcaataaatagttctgtcagacctccaaacatttcctcaaaaaaaaaaatacattttttccagtacttcacattccaaaaaaaaaaaaaattttttttttttctcctacaaccctaaaaaacaaacaaccacttttccctttgttggaggtctgacttttctaatttctgcttctccattcaaaatttcaattcttttatcactgctttccatttcacctcatttccgccaaaagtgtaagtggcacatgtccttcttttggttatttttatttttgaataaa

SEQ ID NO: 55058 - DNA, 1044 bp, Heterodera glycines
  Genomic contig location: Contig_ID=SeqID_24334; Location=46..1089; Strand=+
  SCN-specific regions: Sequence locations=1-36,59-1044
atgggtaaaagaaatttaccacgcaagcttaattgcaaaaaggcgttgaaagagcgtgagaacaagcgggaggagagaaaagcgcagacggccaaggcgatgaaagcccggtgggctaagaaaagtgagttttttcagcaatttttatttcaaaaatcatttttttaaatttcagccgctccaccgccgaatcccaatgccgaaacgccacagcaggacgaagcagggccgtcaacatctgctgcaccgacagaagaagcgatggagccgcctccaccaactccagggctagtgccaacgccggacatggacgaggaaattttggaatatggcgttttgctgtcgtcgacaccggccacaccaatcggcgatttggtgccgttcccgtcaacaccaactgcgccaatggacaccggagagatgacaccgccaccactggccatcgacgagcgatcaccgcgcatcgaacagctggaaaagcaactgaaggaccgggatgacaccattcaatttctgcgcgagcaggtccgaaaccgagaagcgctgatcagtgatctgcgtcgtcagctggagcaatgtgcggcaccaccaacggcgacaccaaccaccagcaaaagtgagtgaaatttcgatgccttctcttttcacaattaattttctcaaaaattgatcattcattttttgtcaattttagcaacgccaaacagaggaagaccaaggaaggccatcgacgaactccaacgcagctcgcgaaaacggttgacggagcagattttggacgccattgatcgggaccgatcgagatcggcaagtcggtgttcactggagcgcatccaccgagaagtccggcacaaatacggccattatacaccaaaaaaaacaccagcgaagaagggcaaagatgaaatggaggccaatgacggcttgcttttgatgacccaacttggaacacagaaagcttatcagcggatgaaagcaacccttcgtctgatccacaaaaaattcgacattttaccgccattaaaaaaggtacatttgggttga

SEQ ID NO: 55059 - DNA, 2139 bp, Heterodera glycines
  Genomic contig location: Contig_ID=SeqID_4606; Location=1381..3519; Strand=+
  SCN-specific regions: Sequence locations=1-728,750-752,774-871,909 -934,963-1117,1140-1455,1478-1591,1634-1711,1874-2057,2079-2139
atgcaagcacacgacagtgacgacagcggcattgaggaacctgacaacgtgcaaggagtcgtgcaagaagggcaagaagggcaaggagtcgtgcaagaagggcaaggagaggaattggtagaagtaagttttgcgaatttcctcattcttttggtgccccgacatttgcggcccccagccgaaaaccacttgcgtctccgacttttgcggccaatttcttaagggtcattttccgattcatttcacaaattgtgcttgctcaagaccccatcagagcctaagtttttttatttctaccaatcctggattcctatatcgatcagtcgatactgtagagctccgaggtgtcccaataatgtttcgttcctattttcacattgtcgtaatgcaaaatcaactttttgatccctcttcattttccacattttttttctttcttgtttcagttaggggaaaataatttgataaaaggtgaaaggaatatgtttgattattttttatcgagtaattgacttgaacttagtaaaatgtgctgaatttacacctgagtaagtctaattttggtttgggctgaaatttcggaatgacccttaagaaatggccgcaaaagtcggaggcgcaaatgtcgagacatgattcgtttttgggagcagcttcccccccccccatatcagtccccgttttgtttctcctcgaaaattgatttctcaaacccaaaaattatattgaaaagttgaagttttacaaaatttcaacaaaaaactgaaaatcttttgctacaaagtatgatgaattacaggtttttccaaaaatttgcctaaaactcatgtctttttgaaacttataaaattttcacgaatataaggatgggtaataaaatttctaatttattaatttctaaattttttgagactatcttttttacgtcacggtcaatgtttgcggcttgctttctttttcaaaatgaacgaaaaattaaattagccgtattatttatcctttttgggtcacttcagtcccgggtccgttcattccaaagtattctccgccaaaaattattctaatcgacaaattgcttcaattaaatctattgactgatttcccatttttatagcattaacttattttttatttcttgtattaagataataacaaatttgtttcctctaatgaaaaaagggcacaaacgttttttcaaaaaggttattttcggtttcattttttgatgaaatttatttcaggtcggacaaattgattttgatattggggagctagcggctcaagtcgacaatgtccaagatgatcatgccctgctccagaatcaagtcgtaaacttgaacaaccaagttgtcaacttgaacaaccaagtcgtcaacttgaacaaccatgttggagcactcttgaatctggctacacaacagcagggtcagattagccagttgcaggttttagttgcaagatataaattaaaaaagtagctgggggatttttcatgtttagtaaaaagattaaaaagcgtttcaattttcaggaggcgcttcagcagttggtcggaccggtatttgtttcaaaatattgtcaataaaaaggcatataatgattttaatgttttttgaaaaaaaaatttaaaaaagtcctgaattctaggcgattggacaagccgcagcgggcagccaacaacaagaggagaagagcggcaaggaaaagcccaaggaaggcgaggacgaagaggaggcggggggcataactgtggccgaggacaaagaggaggcggagggcgagaaaaatgtgcccgagggcgaggacgaagaggaggcggagggcgaaaaaactgtggccgagggcgaaggcgaggacgaagaggaggcggggggcgaaaaaactgtggctgagggcgaagatgagggaaccagcgatggagagccgaaaacgaagcacccccgtttgcaattttaagacgatctgtttcttgccatttcaaatgttttttgaacgcaagaaaataattgttgaattgcgaaactaacttaaaatttgttgattcagttacattgaaattcaaaatttaattttcaaaacttgtttacattggcagtctaaaaatgtattctggcgatgggagacgtttttccatggcga

SEQ ID NO: 55060 - DNA, 49 bp, Heterodera glycines; identical to SEQ ID NO: 51181
  Genomic contig location: Contig_ID=SeqID_24340; Location=396..444; Strand=-
  SCN-specific regions: Sequence locations=1-49

SEQ ID NO: 55061 - DNA, 140 bp, Heterodera glycines; identical to SEQ ID NO: 54846
  Genomic contig location: Contig_ID=SeqID_24342; Location=546..685; Strand=+
  SCN-specific regions: Sequence locations=1-45,67-140

SEQ ID NO: 55062 - DNA, 1150 bp, Heterodera glycines
  Genomic contig location: Contig_ID=SeqID_24343; Location=38..1187; Strand=+
  SCN-specific regions: Sequence locations=1-118,166-265,308-465,528 -533,557-590,643-652,681-704,739-924,948-1112,1135-1150
  Gene Ontology: Mol. function=neuropeptide receptor activity; Cellular component=integral to membrane; Biological process=olfaction
atgatgttgtttggcctcatctattcaacaatcatcgtcacttccattcttggcaatttgcttgtgattatcagcgtgttccgttaccgatcactgcaatcagtgcgaaatatgtaagaattttaaaatttaattattttttaaaattattttttttcaattttaggtttatcgtgtctttgtctgtgtcggacattgttgtttccatagtgtccggcacaattactgtaagttgactaaaaattcatttatgtataaaatatgcaaaatatataagtaattaataaaataattaaaaaaataatatgatagcatctttaagccaattaatgccttctcaaaaatttggttgtttggcgaattgttatgcaaattagtgcccgtcattcaggtatttttttttttcttaaaagtataaattgctcatctcaaattagaatatgattttatttatgagatgcaaagaaattaaaaattattcataattatttatagaaaatcatttgaaaaaaaaacaaataaaaataggggtttttggaaaaaatattaatattcataaatttctttttttgagaaaaaattcatcccacaaataaaatttatttatatgtccaattttttttcttaatttaaaaattaattccaaataaactcttaagaatttaaatattttaaaagttaagccaaataaattcaacggcatgaattttaatgaatttaaattattttaaatttaatccaaattttagggtgtaagcctttgcttctccacgctgactctaagcgcaatctcaattgaccgttttcggcttattgtgacgccacttcgacaatcaattcagaagcgttgtgcatgccgtattgtggcacttaacactgccatttcactgatcatatcgtatgataattaaaaaaaaagtacggtatttttaattaatttattttttcttagacttccgatgctgttcacacaaaaattggacacctatcatcgtttttgtggccaattttgcagcgaatattggggcagcgaactcggcgcaatggcccgaagtgcatacggtaatatattcggcggatttttgtacttaccgtaactcagcagacaaaacattaaaatttttactattaattttcaaatgacgctaaa

SEQ ID NO: 55063 - DNA, 347 bp, Heterodera glycines
  Genomic contig location: Contig_ID=SeqID_24344; Location=363..709; Strand=-
  SCN-specific regions: Sequence locations=1-157,208-347
atgaagacaaacgacgaaatggtccaaatattcaaatggatgaacggcgtcagtgacattcagtacacgcgcattggttcaacacacattcgttttgaggagggggacgaatggtcattgagcactttgaaactgttcaaaaatggtgagtcaccgcattaaaatatttaattgttttgttttttataatttaattgtatttattttctttagagacgaaaaacaaagccaacaaaaagctgaaaaagaacaaaggtcaatttgagatgagtttgtcaagagaatttgtcgaatggcttttgaatgatttggaagtttcgattatgctcgacaaattaaatttgtaa

SEQ ID NO: 55064 - DNA, 351 bp, Heterodera glycines
  Genomic contig location: Contig_ID=SeqID_24345; Location=104..454; Strand=-
  SCN-specific regions: Sequence locations=1-351
atgggactgaaaatcgatctgaaccgagctttcggaattccgacaattcgtgccgttgaaaacaaaaaggaattggaagcatgtttggcccaatatccggaggttttccaggacggagtcggacgatgcaaaaagattgcgtcattgaaattcaaggagggatgccaaccgaagcgatgcaagccaagactggtgccattttcacttcggaatgaagttgaaaaagttttggaccaatggcaggcggagaaaatcatagagccagtggcaaccagtgaatgggccacttcgctggtcatggtaccaaaggcaaatggcaagctgcggttgtgctttgactataaagtcacg

SEQ ID NO: 55065 - DNA, 577 bp, Heterodera glycines
  Genomic contig location: Contig_ID=SeqID_24346; Location=440..1016; Strand=+
  SCN-specific regions: Sequence locations=1-114,137-318,340-375,398 -518,540-577
atgacttttggcggaaaaaatggggagagagataacgcaaaagtgagagggtgttaaattcagccccagccatacaaaaatattctagctgcagaacaaagacaccagcaataatttcgggttttttctttaaaaatgtcaaattttcttgacttatttaggtattcttgcaccgttttctgttcgtgattttctttccgagttgtcagaccatcctttctctgttgctggatatcatgagtcattttaaagtgaaaatcaaggaccgaatggagaaacaattttttggaattattactggtcaattgttgcgccgtctcccagaacaaaaagaacacatgttgaaaaatgctttcacggtagattgagcagaaatctttttaaatatacaaattttcagtcattctacaaaacaactttggattatgtcgccaaatggtttcgcaccgaacgttatccggatcatattcaatggcttttgcttacagatcggcaattagtccatgagaatctcattgaattggcatcgactttttgtcctgatttgtccgatactttattcgatgaaattagtcaa

SEQ ID NO: 55066 - DNA, 200 bp, Heterodera glycines
  Genomic contig location: Contig_ID=SeqID_24347; Location=769..968; Strand=+
  SCN-specific regions: Sequence locations=1-104,159-200
atgtctcgggtttgcctcgtgcacaaaaacgaatcctttggattggaaatgagcaaatttcggccgggcattctttgccggtttccaaaagtctgaaaaaactgtttaaaaattatatttaattaaaaataatttatatattttttaatttatttttacagtcacctaacaatgcctgttgggccatgaggaatgactaa

SEQ ID NO: 55067 - DNA, 1403 bp, Heterodera glycines
  Genomic contig location: Contig_ID=SeqID_24349; Location=162..1564; Strand=+
  SCN-specific regions: Sequence locations=1-287,336-732,768-813,835 -867,891-968,994-1018,1040-1298,1337-1363,1396-1403
tagcaattagcaacggcactaatggaatcactgcaacgccgcggggatcacgcgacgaaagtgcgacaacaaaacgcagacgaatagccgccagggatgactccgcggcacggaaagaggaacaactgcagcaacaatcacaacagcatacggtagcaacaagcgcagcgattgttacggctggtggcgacgctggcggcacggcgactacggtagcggcgttgcagcagcagacgaccattgtgtacggtagtgccatggaggccaagacgtcgctgaacgccacgcaacaacagcagcagcatacacagcaaaagccacaacaacaacaacaaatggtggtggacggtaagtcaagtttgcttactgtatcccagccgagactcttgagcattatttactattaaaagaactactgtttttgtatttttcggaataccgcagggttaaaaattgtatattacagtatgcctcgaacaaaaactattcaaaagcatttactgtacttgtagggctaccgtacaagcgaaagtactttaaattatctgtacagtgcgacagtatacctagacagacgtctcacaattagcattatttttcggggttacagtatacgaccataaaccaagttttgctcgtgttcagatctgcccactttgcgccgtgagctggaacgaccgccggcgattgtaaatgccgccgcagccgcaatggccgtcgccggcacggcgtcagtgccgtcctcctcctcctcgtcgtcgtcgtcgccatgcgttggccaagcagcgactgtgccatccacggcgaccacggcacaacagcagcacaatcatcaccaacaatcgctgccactgtcatcgctgcactcgcagcagcaacaacagcagcgagtgtcgtcctcgtcgacgtcgtcgctgtcgtcgctccgtgaactgctcgcccggccgcccattctgcacgtggtggtacaacagcaacaccaccaccaacaaacgcatgttgcctcaactggtgcagcagatgttgctgcttttgttgaagaacaaccgctgaatttgtgcgtgcgtgaccaatgaatgatgtggcaccgtaatgccaagaaaaaaaatgggtcacgccaaatttaaaaatgcctaacaaagtgccacaaattggcgatgactacaatgtgtcgattatggtagcaattggccccttcaaattgtggaatttgttttgtttatttaaattgtattgttttttggcatttcgtttgtttttttgtgtcttttcgaccttttcttttaatatttaggtgcattttttgtatatattatattaatattattatatttaacatatacataaatagcatatgttgtgatttattttttatttctatctttgtttactaaaaaagacaa

SEQ ID NO: 55068 - DNA, 1267 bp, Heterodera glycines
  Genomic contig location: Contig_ID=SeqID_4608; Location=251..1517; Strand=-
  SCN-specific regions: Sequence locations=1-289,311-796,818-889,912 -1021,1043-1122,1158-1267
atgtatttgatcaaattcattttgcccatttctctttgtacgacattgaaagttttttatttaactgcattttttggcatccaatcgtacctctgtgaggaagtgctctttcgctatgccgtcgcattgtttgtggatggtgtgccgcgggttgtttttggacttcaaaattggcacaaggaattagtggggcaaatcgccgctggtggacgggggagaggttcagcggaggaggatggcaccgccggcactttgccggagggcaatgccgcgccgttaagtgttgcaaatgatgatgatgaagattgatctgttgttggtggccatttttggcatttcatactaagaaaataggcatattacacaatgtggttgaggttaaggcatcgagtgaatgaaagaatcaaaacgggtgcaccccaaaatgtcgccggaaggctttttggaccataactttgttcgttgctaatcaaattaagcattttatttatgaaaaaaaatttcaaatttttagattaatagagtttctcaagtgttttcgaacaatatcagaatgttaaatttttgagagaaagaaaaagaccactattattctagccaatttgaagtggagaaatggacaatttttaaagtgaaattcaaaaaatggaaacaaatattgatggatggtcgcatttactgcccttccactcctcaaaaaaaaatttttcaaagtctcagttgagatacattaattttgttgaattttttgtgcattgggagtgaatgagtgaccagcgccctcgggggggggggattatttgtgcattttaggaaaaagccccggaggggcgaataatcccccattattatggaaggggtggacgacggcggatggaggaggacaaaaccaatgaatgaatgaatgaattgggggggggggggaattgtttgtggagagaatggaattgccaaatcggagcatgacaagagaaatgggagggggacgtgcttttatgactcgagaaaatttgcgggggtcgagagaatggaagagacaaaatcttggaattggatgtgcgcaggaaatgccataggttagccgacatttgcggaccataattattactgaattgagctctctaaaaaattaaaataattcctttaaaaattaaattggatttgtttttcttgagaaactctttccattcttaattctaagtcacggatttctcgactcctgaaaaaaaatgttgactctcggtttgagcgcgcctatcagaataaa

SEQ ID NO: 55069 - DNA, 754 bp, Heterodera glycines
  Genomic contig location: Contig_ID=SeqID_4608; Location=1707..2460; Strand=+
  SCN-specific regions: Sequence locations=1-471,493-754
atgctcacaaaggcattcattagttgcagaaagcggcatgtgccagtcgttcacctccgtgccacgcacatacattcggacagcggacgagttggagccgttgtcgttcagcgcacggcttgccagcttccccactctggtgccagccgcttgctcgcgtgccgagtcgcccatctgccagctgcagcgtcgtttcgcacaacaagacgatgcggccagccgacggatggccgaccatcggacgctgccgtcgcaaatgccaattctgccgccaaaagcgctgccagccggcctgcccaagtcgctgagaccgtccaaattaccacccagtgagcacagaagggcacacttttggggaatggaattgtaacattgtcaaagggagtggaaaattgagctaatgtcggacaaagtgtcaaaaaattaagcaatttgggcaaaaaaataaaatgccgaataattgatatgccaagaaacaaattaaattattttggcaattatagaaaaaatgtcagaatttttcttggaaatattaagtattatttgttatcatttgataccctaacatttttgttttaggctgcatatttcattcttaattcaaaaaatgttatacctagaaaaatgatttggaatttttgagactaaactttttcgaaaatttaatttaaaattttgcaaaataattgaattgagataaaaaatttggtgaaatataatattcaaataattctttctgaaaatttgctaacaa

SEQ ID NO: 55070 - DNA, 1533 bp, Heterodera glycines
  Genomic contig location: Contig_ID=SeqID_4608; Location=2566..4098; Strand=+
  SCN-specific regions: Sequence locations=1-311,333-488,522-536,558 -797,819-1392,1417-1444,1466-1492,1514-1533
atggccaaagagccgggcaccggactgctcggcaaatgcgtgctgtgccttctgctcaacgccgtgttcgtgctcgccttgttcctcgcatttttaattggtcattttgcggccgacgctcatttcccccacagcaataaggtaagactcaacaacatcaaccaacaagcagagattggcatttgtttctcgaaattaacatttttgactatttttaaaaaattgtaagaaaaatttaggaaaatttctgtgcgtttccccctccacgtgaaacaacgcaaaattatgtttttaagtgaaaacctgttggcatcttattgaaaaattttcatggttttactaaaaattcaaattatggtgacctcccagtcgctcgaagaacgcggctctacaaaaggggtccattttttggctttccatcgggttttatataacccgaattatgatttatggaaattactatttcaaaaatcgaaaacttggccactttctgatgttatttttaacctgtaaaattttcaccgcccgcaaaaaatatctgcttattaattaacactaacaaaatgcgcaacagcttgtttaacattttttgcaagactaacaccagcaacactgctcatttattgcccggtgaggtgcctgtggctgacggcaccgatatccgcggcaaaacaacggcatttgacctacgcggaatggcaccaaagcactcggatggcactaacattggcactgatggcacgcaattatggagccagcgagaagaagagttccaaaaagttgggaatcagtgttttgctggtggaaagtgacttttgagagtcgaaattccctaaatttcgagggcctagacgaaaaaaactgagaattttgcgggaatttgagccgaaacactcgaacagccctgcctttaatggtgccgattattaatcctcacagccctttcttcaacccattccgtcaaatttcttatccaagcgaggatcacattaattgagttgatcactgagcctttcaccggtgatcacttttcgtttttcttaccatatgccaattgcgctaccgtattccaaaccatttacattacacgctcatcagagattgggcagcaattaaataattaagtatctctttttctgatctcagagcctggaacgacgacggcaacgtgtgccgtcgttgagcgaagtttacccgccgctgttggacggtggcgatccgatggcggacgaagcggacgacccgatgccgttgagtgccgcgacagccgcgcatcagttcggcaacgggccggtgatgcaccgatcggctggcattgccagtcaaaatgttccattgattccgttgcccaaaacggtgatgccaaggcattacaatgttgaggtgatcaggaaacaaaatatttgaaaaaatattccataaaatccattcatggattacataaattttaggagataaaaactgccgaaatatatctataaatgggaaaataggatctaaaatttgaaaagttaactgccgaaattagtttaa

SEQ ID NO: 55071 - DNA, 505 bp, Heterodera glycines
  Genomic contig location: Contig_ID=SeqID_4608; Location=5735..6239; Strand=+
  SCN-specific regions: Sequence locations=1-32,55-118,140-334,356 -364,408-452,474-505
atgtgccgacccaaaaagcgtcaattattgcaattatttttgttattattttgttatttgattgatggacatcaattaggcccagtgcaagtaattgagaacaatttagaacaaactgaagaagtgaaagcgaaaaacattgaaatggcacaacaaattgttgaaatccgcgaaaaaaatgttaatgggaacattgaaaatgagctgttggaagtgtgcaatttgttgaaatgtcccagcgaaaatgttgacaaatttttgaaaaatcaacttaaaaaattacacccggacaaagtcggggctgaaaatgccaaattgggagcagaagcaacaataggtaaataaaatgtggcatttattttgcatattaattattttacaactttttttaaattttatttattttagtgattaataagttgcgacaatttgttatagagaacacgcgaaaaggtctttatcattacagacatagaattgttgagattttggcattttaaaaata

SEQ ID NO: 55072 - DNA, 244 bp, Heterodera glycines
  Genomic contig location: Contig_ID=SeqID_24350; Location=148..391; Strand=+
  SCN-specific regions: Sequence locations=1-244
aggtacatcagtgattcgtaaaggtacatcagtgattcgtaaaggtacaacagtgattagaagaggtacaacagtgattagaagaggtacaaaagtgattaaaagaggtacaacagtgattaaaagaggtacaaaagtgattagaagaggtacaacagtgattagaagaggtacaaaagtgattaaaagaggtacaacagtgattaaaagaggtacaaaagtgattagaaaggtacaacagtga

SEQ ID NO: 55073 - DNA, 534 bp, Heterodera glycines
  Genomic contig location: Contig_ID=SeqID_24352; Location=489..1022; Strand=-
  SCN-specific regions: Sequence locations=1-216,443-474,504-534
  Gene Ontology: Mol. function=general RNA polymerase II transcription factor activity; Cellular component=SWI/SNF complex; Biological process=chromatin modeling
atgagtgaagcaaatgtgcttgacaaaattgagaagaaacttaactatgaggcccgcatgtgtaaagagttaaaagaaattggactgcaaccgcatcatcagcatagactcgaagaagcgcgacagaagtttgctaaaggagagtgtctgacacaatgtgaacttactctactgtttatggaacaacaagagcgcttgcggcagaagcgcttccggcagcagcagcaactgcagcagcaaccaccgcagcagcagcaaccgcagcagcagcagcaaccgcagcagcagcagcaaccgcagcagcagcagcaaccgcagcagcagcaaccaccgcagcagcagcaaccaccgcagcagcagcaaccaccgcagcagcagcaaccgccgcagcagcaaccaccgcagcagcagaaaccgccgcagcagcaaccgccgcagcagctttctgaaatcctccatgagtcgtgccgctcgttggagcagcagcatcagcagcaacaaaatgtgcaacgcctggagcaattgcgccagctg

SEQ ID NO: 55074 - DNA, 487 bp, Heterodera glycines
  Genomic contig location: Contig_ID=SeqID_24353; Location=294..780; Strand=+
  SCN-specific regions: Sequence locations=1-487
tttttatttattaagaatactttgttaattgactctgatcgaattgagcaatggaaggaagaaatgaatttggtgttttttgcagtcgaaatgacttttgccccgctaattggcggcaatgttttggatcgatcggaattgttgaagcaaacagcgcagcagcagaacatcgtgtgcctgatcaaggagaaggcggaaagactggacttgaagcaaattgtgtggctgaccaatgcaacaattgcgtcacggcaagtttaaagcttcaaagctaatctcacacatgcattttccaaatcgatcatcagattcggccaatcatttcaaatcagtgattttgtgaactctatggttttttagagaccgagccatgtcgattttcggggcccggcaaaccggttcgggaattttggaaaaatccagtttgaccaattttagaaagggatccgggatcagatttttttttgaaaatgtccgacccgaaaaa

SEQ ID NO: 55075 - DNA, 259 bp, Heterodera glycines
  Genomic contig location: Contig_ID=SeqID_24355; Location=1..259; Strand=-
  SCN-specific regions: Sequence locations=1-192,217-259
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaatttttttaaaaaattttttctccatcttcctttttgatactaaagcatcatagtgctaaaat

SEQ ID NO: 55076 - DNA, 210 bp, Heterodera glycines
  Genomic contig location: Contig_ID=SeqID_24356; Location=406..615; Strand=+
  SCN-specific regions: Sequence locations=1-210
atggaaggcggaggtggcgaagaaacgcgccacagaggcggaggagggaccaacgcggacaacgaggaggagaaggaggtggacacgggaaagcactgctgtcgggcggaagttggcccggacgacggatggaaaggctgcggagtccgacgaggcgacgcggaacggaaggactgggcacaaagaccgggcggaaaggaggacgaatga

SEQ ID NO: 55077 - DNA, 586 bp, Heterodera glycines
  Genomic contig location: Contig_ID=SeqID_24358; Location=53..638; Strand=-
  SCN-specific regions: Sequence locations=1-105,127-168,190-586
atgtctgcacgcgttggaattcatcatacattatgcttgaacgtttgtatgaacagagccgcccgcttatgcttattaacgaagaatacaatgatctttctttacctgattttgagcttgtaaaaaacatttgccaggtcctttataataattagtcttattgatttatctaatttttaggttttaaaaccctttcttatatttacaaatcaattatcacaacgtgacgaatcgctttcatcagttatttcggtctacaaatgccttcaaaattatctccgtgttaatggcgaagaaaatgagtccattctgagtttaaaaaatgtcataaaagatggattagaatcccgtatgcgagaacaccaatctaaaatgtaaattttggattcttatttgtcatatttgctaattataatagtttaagctttttgcgcatggccactctcgttgaccctcgtttcaaaaacaatcctaacattttctcgacaaatgaacgagctcaaaatgaagtgttattgcttgacacagtaaaaatggtaacgaatccatcacgtcgagggtctgattctggacaaccgaaaataaa

SEQ ID NO: 55078 - DNA, 341 bp, Heterodera glycines
  Genomic contig location: Contig_ID=SeqID_24358; Location=1020..1360; Strand=+
  SCN-specific regions: Sequence locations=1-61,172-203,246-341
atgttaaactatttatttaggggtttgtcgttaagaaaaaaataaagaatttttaaaaatttaaaacaaataatatatgcaattaaaattaaatagaaaaatatatacagaaataatataattatattataaaataatattggctaaacgaaattaaacaatatgaaaaaagcaattttattttggcggcgtcacgctttgcgtataaattattattattattattaaaaaattaatcttttaaagggtaccagcatcttcatgtgactgtcaagatagcatgaagatttaaggggttaatcagttattaagtgtttaatctattatactttggtttttca

SEQ ID NO: 55079 - DNA, 508 bp, Heterodera glycines
  Genomic contig location: Contig_ID=SeqID_24359; Location=219..726; Strand=+
  SCN-specific regions: Sequence locations=1-207,322-508
gttttcctcgtctacacgggtctcgtcctcttcgtttatttggccaccgacagtttccaaaacaatgctccgtttgtgttcaccattcccgtggtcgtcctcggttggttcactctttggacgcgaatgccacggaggacacgcattctcaccgctgtttctttcttcacgttggcattggcactgtacagctggtcaatgttcccaaaaaagtgagaaaaatgggaagagacagagagggagaacgtaaagagaggggggagagaaagagagagagttgggaagaaaatgagagacattcaaatggggagagagagagagttggtgatgatcaatgcttatcagtcagtcttttgtcgatcattaagtctgataatgccttgtgtccctctgttttgtgtcctcagattggagctgtccgccctgctcatttgtttcagccaattcgcctatttgctctccttctacaaatcccttcgcaaatggtggatcgctcttgcaatttcga

SEQ ID NO: 55080 - DNA, 438 bp, Heterodera glycines
  Genomic contig location: Contig_ID=SeqID_4611; Location=126..563; Strand=-
  SCN-specific regions: Sequence locations=1-438
atgagcttaggaattgaggccgagacagaatccccaaaaacccgggaatcgtgcacttccctaacctgtcattttgaacattggccaattagtgcaaattggcaagccgaaaacgaccatcgcaaccagcgggagaatgcgtttccacaactgaaaaagaataatgccattctcagcagttggcaagccctgtactttgtcatgtttcaatgggactgcaattgcggtcaatcggttgagaaggatgaaagcggtggccaaattgtttgcctggaaagtgtaaccggtgaggaaaaaaggcaatccgccgatcatccaattggggaacagagaataaatgggaaaaaggacgcagccgaacagagagggcaagcggtagcagtagaaagagtcgagcaagtacagcaaatcctaagaggaaacagtcaaaggaattga

SEQ ID NO: 55081 - DNA, 693 bp, Heterodera glycines
  Genomic contig location: Contig_ID=SeqID_4611; Location=881..1573; Strand=+
  SCN-specific regions: Sequence locations=1-274,297-534,556-657
atgaacaagctcaagtttaaccagcagcagaacactcccaccaactttgaacggaaactgttcatttacgcgttggccaccttttgtggacatgcgctaatcgcctgtctgttggtaatatcaattaattaattagcgttaattgtaatagaaattcaaacgtcaatttgcagatctgcatttacattgcgtcaaatgcgcttaacgttcaaatggttttggcattatacacccattacccgtgggtactcgacacgggcagtgtgattctgtccagctggctcctcctgtgggcgggcgactcattccgtgaccaattattgcgcgactaccgtataccacgaattcgtttcgaaattcgcgctaacaatcgcgtggtatcggtgaagagaccaattgagcaaaccaatggaataaagggccacgaaaagctgcgaaaaatgccaaccgttgcatgaacaaacttttggatgcttcaccagatcatgttccgtttgaagatcttgcagtgttgttagcctaattgtgtcaaaatttcttactcatttgtattctcaattttaaacactaatttttcaaccccacacacagcagaggtattttcttaattttttaattctcttttttggtctattttttaaatcaaaaaaatcatttcatcctgttttccattttttaattttaaattgtaaa

SEQ ID NO: 55082 - DNA, 1243 bp, Heterodera glycines
  Genomic contig location: Contig_ID=SeqID_4612; Location=39..1281; Strand=+
  SCN-specific regions: Sequence locations=1-56,156-541,585-704,730 -774,796-813,835-948,971-1101,1139-1182,1206-1243
gaatacagtaatcaaatagttttaacagaaaaccaattacaacccatctcacaatcagcagaagaaggagaggaggaggaggaagaggtggtggtggaagaagaagggcaccaaaatagtgaagaacatcagcaggaggaggatgagcagcagaaccgagtgattgtcaaccgaaggccatccgtccaaattggcactatgccaaatcaacaaatggcggacggacaacgcgaggagaagccgaccgcggaaaaaaaacaaacgcagaaaaaggcaatgaagccgaagaatacaaaatacccattcagggcaaaattattttcaaaaatcttaaataagtaaaaggaacctttggcacattgtagtatattttatttttcgattttttactataatattttttgtacgtttgccaaaagatgaaattcagcagaaaaaactgacagtgcggccaagttattcgacactgcggacaaacatcattcgtctgacccctgaaagcatgaagtgcaaattatattgcaagtaaatcccggcttagaaaaacattaaaaaatgatttacaaattaatggaaaaaattcgaaccatttgaaatatattttaaattcagagggccaaaatgcatttattgtggaccggagaattggacagaaaatcaacaagcaattaaaggcttatattcacattggttgcatcattttgttttttatttattttttattttttaggataaacaatgaaattttggcgatggcacggccgacaattcgaacctttgaggagtttgacctgatcaaacaatttaaaaagcaagcttaattaaaaaatattttgagctaagacaaatgcacaaaaaacagtaaaaaataaatatattccgattaatgacataaattcttaatatttttttccggcttttatataaattttcattactgttctttttaagtcagaattttcatataaattccacgttaagacaacacattcgaactgtcttgaaccttcaatgtgtgaaggagcacgacttttgtggtccgccattaattgaccacaccggcttcacctacaatcctgaactgttaatgcgtgaaaaatgtatttttttatttattaaaattgaaataagttaatttgtttttcagtgtattattttaattttgcggtccccgatttcggcacagtgtcagcaaaatcaattttggacatttgcaaagtcatttggttctcattgaaacatg

SEQ ID NO: 55083 - DNA, 1421 bp, Heterodera glycines
  Genomic contig location: Contig_ID=SeqID_24361; Location=4..1424; Strand=-
  SCN-specific regions: Sequence locations=1-299,323-1137,1159 -1338,1360-1421
atgcctagtaaaacgaaaaagcggaaaagcaacaaagctgaagaagacaacgaaagaaaaagaatcaaaattggctcccgaaagagggacttactagcagtggcagcagctgccccattaccggttgatgatgactttgaactctcacaacaatcggggacctcggctcaggtccatccaccgggacctccgttgcctagtaaaacgaaaaagcggaaaagcaacaaagttgaagaagacaacgaaagaaaaagaacaagaattggcactcgaaaaagattgtcttcaccaaatgttaccaaaaatcagccaaaaagacaaaagaacccggtcggcgaagtactttccgaagagcagcgtcatcagtttgcggaggatcagcaccttttcaccattccaaattcgcaacttaccaatgagcaaaagagaagacggcttcagttcgtgtttaatcgtaaccccgtcaagtacggtgttcacggtgacaccgttttaaataatgcaggaaacccaataacggacagtagtgtcgcccaagctctcgactatattatagaacgcagagcgggacgaattccacaatttagacagcctccaggaacaaaattgatccgcgatcgcattaacagtgaccttattttgcgaacatggacggctccaccagtaccaccaaggggacccaaacggagattgtcacaagcagagcaaacgacagaattaaaccaaaaatcccaaaagctcagaggaatgaggcaggcgagaggcagggtacaagaaggaatgacacttccgtttccaatgaggggcgtcaagcggaagtcgacggcactgtcagcaatagaaacggaaatccccaccaaaagccaacgtctcagaccacaaaaatggaaaaatcaatagaaaatgtgttggaaagactctacaatgacccaaaatccccggctgcgttcgccggtgtcgaccgattgtggctggaagccaaaaaagaacttggaaataaaattcccaaacgcgatgtaaagcactacctggagggacatcgcacctacactctgatgcgtccaagacgcatcaattttccgcgcgctaaaacaactgccgccggttttatgaccgattgtcaggtggatttggctgactttcaagcactttctcggcacaacagcggcaatcgttatttaatggtggtaatcgatgtactttcgaagcgaatttttgtgacacctcttcgtaccaagaaatccgatgacatggtcgaaggatttaagcgagtcttttcaactatgccaatgaaaccacacagaattttctccgacaagggtacagaattcagaaatcagcagatgaaaaagctttttgatgaagaggaagtcgagaaatatgaaaggacccattctgagaagaaagcagcatggccgaac

SEQ ID NO: 55084 - DNA, 821 bp, Heterodera glycines
  Genomic contig location: Contig_ID=SeqID_24361; Location=1307..2127; Strand=+
  SCN-specific regions: Sequence locations=1-249,271-273,295-383,420-821
atggggcagctgctgccactgctagtaagtccctctttcgggagccaattttgattctttttctttcgttgtcttcttcagctttgttgcttttccgctttttcgttttactaggcatcggaggatcaggtgcgagaggctggaaatattctccatcaaagattttttgtcactaatattaatggccattttttggagctttgatcatgaatgttaccaaatttaaaatcgaatcgttttatataccctttttcattctcttctgttccatagtttatttaaaaaatgtttcctcatcctttccgtttatcgaccaaaatattgctacgggtcaaaagattgggtaaacaaatgcaatcgccgatgttcgagactctcgttccttatttttcattcatttttatcccttttccccaaatggcacgccatccatctctccttccgatttacaaacgaaatattcgtcgccaaaaccacgtacacattaagcatgtacgcgtaaatttttcatgttgacataattaaattataattattcaggtgtttgttactggaggacaaccgccaagttattgtatttggtgtttagcacttgggattattcttttattcgcttggttgatttggtaagaaaacacagaattttattcattaatttaaaaagttcgtaaatttcaagatgtcccgcgagaatcggatgacctcgaggatgcaatggatggggaacggatgtaagacaaacatttcaattgattaattctgaccttaattatttttcagtaaattttaaacctttctctaattcctaccgtatcatttta

SEQ ID NO: 55085 - DNA, 492 bp, Heterodera glycines
  Genomic contig location: Contig_ID=SeqID_24362; Location=32..523; Strand=-
  SCN-specific regions: Sequence locations=1-492
atgcctgccgaacaatcaacggagctcaaagacattctgcaggcgatccattcgcttttacaaaaaagcacacaaccaaatgttccatcccagaattcagaaatggacttgttttgcaaactcagcgcacagatcgccgaattcgtctacacaccggacgacaatcacacattcgagcagtggtttgaaagattcggcactttcatcgcagatgaaggaaagaatttgcccgaagcaagccgagtgcgactgatcatcaacaaattgggcgctgaggagtatcgccgctacacggagagcattcagcccactgcaccggaaaagataggttttggtgaaacaatccacaagctaaaagcaatttttcccgaatcaaaatccctttttgtcaggcgtttcgagtgttttcagcttaagtgcgcggacaatgacgcactttcgttcgcagcaactgtcaacccaatggcagaccgcgcaaaaattggattttga

SEQ ID NO: 55086 - DNA, 608 bp, Heterodera glycines
  misc_feature (107)..(107): n is a, c, g, or t
  Genomic contig location: Contig_ID=SeqID_24363; Location=21..628; Strand=+
  SCN-specific regions: Sequence locations=1-90,128-162,210-451,473 -473,511-608
atggactgcggaggggagactgcccagtggcaactccatttggcacggtggtgccaaatggagttttagagttgtggcaccggtggactgaaaaaaaattcaaattntaaaaattcattttttttttgtttcgcacagatttgaagtccccaaattataggcttatttataaaaaatttagcttttaaaattaaaaaatatatataaatgtatagaataatacatggttttaaaatggaaactattaatatttggtggagaatgaaatgcttgggccgttggtcattcttctcgaattatgctgggcttaagggtgcccattggcctaaaagaggcgaggaaagagggaaatcgatgagtgaaaaggccgacgacagctgcccagcagctgccgaatggccttagcaaatgcgaaatgacaatttattcaaaaattacagtaaattacaaaatttagcattttagaaaaccattcggaaaaagattatttttaaagtaacacattaattaaggttcaaattgggacaaatttttgatgtcaattatctgaaatgacaacattttgatcatataattttttccaatattttttggaaatatgtaaacaa

SEQ ID NO: 55087 - DNA, 95 bp, Heterodera glycines
  Genomic contig location: Contig_ID=SeqID_24364; Location=497..591; Strand=-
  SCN-specific regions: Sequence locations=1-95
atgttggcggcggcggcaccgttcaaactgctcactccgctgccactgctcactccactgctgctctccacactgcccgtcggactgtacgaact

SEQ ID NO: 55088 - DNA, 831 bp, Heterodera glycines
  misc_feature (785)..(785): n is a, c, g, or t
  Genomic contig location: Contig_ID=SeqID_24364; Location=26..856; Strand=+
  SCN-specific regions: Sequence locations=1-831
tcgattcccaccgctttgttcaactacggccattccaaccatcactaccaacaccaacataagcagcttaatcaacagcgtcatcaccgaatcgccacaccatcagcttcgtcctgttcggacaatgccaatgccaccgccgtcgtcggggtgccatcacaaaaccatccgccccatcaaaggagcaattcagcgcttacaccgtcgccggttaacaggtaggggcatacggtatggaaagacaagcactacagtatcagggcatagtaccgtgggaaatgcctattttggaattaaatgtaattattgaacaagttttacccctggggggctttggaccatctctgacaatgacccgtgccaaatcccacacgagatgtgaatagacttttggcatttatcgggtaggggattggcattccctctatcccaacaagtttggcgttaaaatggcattttgtccctacgtacagttcgtacagtccgacgggcagtgtggagagcagcagtggagtgagcagtggcagcggagtgagcagtttgaacggtgccgccgccgccaacatgatgacgtcactgccgatgcatcatcaccaccagagccagcagcatgtgacagtgaagacggaacccggcatggcacctgcttcaactgctgacatttctgccaacattgtggccaccccgtcaacatcggaaagcagtgatggtagtggcagtggcacaacaccgaggacaacaacggcaccgccagcaccgctcattggtggagaagtcgcgcgggngggagccgaaagcgcaaaagcccaatggacggcaacactacggtaa

SEQ ID NO: 55089 - DNA, 857 bp, Heterodera glycines
  Genomic contig location: Contig_ID=SeqID_24364; Location=1464..2320; Strand=+
  SCN-specific regions: Sequence locations=1-42,91-423,511-544,574 -710,733-785,814-857
atgagccaaatggttgcttcttcaccgcttctgcttgcgctccaacagcaacaccaccaccaccaacaacagcagcaacaacagcagcaaagtccgttcctttccgccgcgctcaatgccatgagcagttttgccgcttcaccggccgcgatggttgccgcttcgtcaccgttggcacacgcggctgtgtggcaccacttggccagcaacatgttcaacaacgcgttcagcccaagctgtcagtggggtataggaaaagtgggcgggcgacgcgacaaaccgatcatttagtgatcactaaaaaaaagttaaatcgttacaaaaattttgatcgatagattgatcattttggaccagtaaattgactgcaaattcattttccttttctaaatttttggagccttaacctaagaattgccaagcaaaaatttaaaaacacattaaaattttataaaaaatatttaaaaacgaattgtaaaaaattatttacaaatatttatatattaaattgaatttcaaatgccattacagtgaattcgttgtccaataacaacaacaacaacaacaacagcacaaacaatatcagccaactgttgtcatcggcgggcggtggtggtgacaattcgccgtcatcggtggcgaacagtgtcagcaacacaaccaccaacggaaacaatgacacaaccgcagcaacgcaacaactgcaagcaaacaagacaaataacaacaacagcctgtacagtcagctgcaaaatgcgttgacaacgccgaccattgtccacaaccatcaccagcaacaacaacaacagcaagcagttcggacaccacaactgtccaactcggccatgctgtccgcg

SEQ ID NO: 55090 - DNA, 332 bp, Heterodera glycines
  Genomic contig location: Contig_ID=SeqID_24366; Location=15..346; Strand=+
  SCN-specific regions: Sequence locations=1-332
ccgggactcaaacgtcccgctcaggccaaaaaatttttctatttccgggaaaaaatcgaaatttttccgaaaaaaataccagtcgatagagctcgaaaaactacgtttcggaagtggtctccgtttttctcgggaaaattcgttaaaaaatcataaaattaaaaaacccgaaaaccgttttttaggcctaactcgaaaaattttgaaaattttcgaaattttaaaatctggaaaaatcgagcttatttaactctacaataagtctgctggccacactcgcgctcaggtcaaaccctaatgagttattcgcctggtactgaagtgggaaaaaa

SEQ ID NO: 55091 - DNA, 1617 bp, Heterodera glycines
  Genomic contig location: Contig_ID=SeqID_24367; Location=138..1754; Strand=-
  SCN-specific regions: Sequence locations=1-93,118-365,387-458,480 -489,596-1319,1341-1617
  Gene Ontology: Mol. function=peroxidase activity; Cellular component =extracellular space; Biological process=protein targeting
atgaaggacaaagcgaaggaattggcacagaattgggtgtccgccaacttcaaattattcaacagtaaaaattgtggaacgaaagtatgggagaaaatcacagcaaatgaaggcttaccaggcagaggcggtgaatacaatgcgcaagtgaatgaaaattgaataatttgtatataaggattgtttttattttcctttttgccagattaatgttggcacgactctcggtgtattgcttgacatattagtgacttatggtggaaaattaaatttgggaattgatggatcaaactgtgaacaaaaagacttcgaaattgaaccacgcaaattcccgaacgaagcggtaatcagaaaatcttattcttatataaattttctacaaaatttaaaaattaacagttttgttttagtctgagtatcggtcgaagcagttagctgcagcgcagaaaaaagtggacacaattaataaaagccaaaaatattggaaggttaaaataaaattataatattcttattcttttgcaaaatactcgtaataataaaaataaaaattaataattagtttaataagaaattgtttttttcaataaatttaccaggctgttatctacgaacctttcgctttgctgacagatgcggaattgaaaaaacttgatggcgtgtttccgcccatatatggtccacagaatcaacagctgaagacattggaaacgctaaatattgaaactcaatacagcaacgacaatgatttaccgcgtcaatttgacgcgcgggaaaaatggcctgattgcgcggatataatcagcacaattacagaccaaggtaatttgatttctcaaaaaaattaattcacttggaagttcaaattattcctatgttaaataggactttgcggttgctgctgggcagtggcttcagcttcaacattaaccgatcgcatttgtattgctcgccttaaaaagggacaaaaaacctcccattatggagggtcatacatctcagcacaattcacttgcgaattcactccaggaagtgacgggtaatacgatacaatgtagaaaatattgaaattaagagtatttaattttgcaggtgtaaaggtggttggcccagcatggcttggaaattttttcataaagaaacagtatctgggtcaaattatgaaatgtacgatggatgtaggccttggacaattgatccaatttttgctggaactttttttgaacgtttaccaattttaactatggaatatctttttgtcggtcccgaggcttcgtggaaaacaaaaagaccaaactgcaaaaaagaatgcagaatcggttggcatcagactgtcgaaaacggtaattcatgtttactttcaaatggttaattttataaagagcacatttaatgttttcttcattcaagttatgaagataattactacgactttcagaaatggctgatacaccgactgtcattggacatgagtgttggattgggtggcattttggaaatgagcaaaaaatgatgcgtgaaatcatggtcaatggctctatcactgcatcatatgccgtttacgacgattttcaaattacaatggcagctgatataaatcaaatttatgttgtatga

SEQ ID NO: 55092 - DNA, 1285 bp, Heterodera glycines
  misc_feature (1257)..(1257): n is a, c, g, or t
  misc_feature (1283)..(1283): n is a, c, g, or t
  Genomic contig location: Contig_ID=SeqID_24369; Location=424..1708; Strand=+
  SCN-specific regions: Sequence locations=1-1285
atgattgaaaagaagctcactcccggattcctgcgcacaatcctcaccaaaaagggagaagacccggcacgctggaacacgacaaagttccgagacgtactcaacgaagctgttcgaaaagaaacccaaattcaagaagtcatgggcgagtacggacactcgcagcagcatccgcaacaacggccacaagctcaaaggcccaatttctcggcatcgaaattccgagaccgcgcaccaatcccacagcaacgggaacgcacattcatcacctcagcagtggatgacaatcacaaaaggctgatcaatcgacagcctcaacacaggccacagcaacaaaggcctcgcgcaccacaaccgcaacaaagaaacttgcgcactttcaacaatcaaaggcaatttccaactcaacgtaccaatgcgaccaacaatcaacgacaatttccaactcaacgtaccaatgcgatcaacaatcaagggcaatttccaactcaacatgccaatgcgacattcaatcaacgcaagcctccaagtccatgcatcttctgtgacaacgatcactggaatgaagaatgccggaaatacagcacaattcaacagcgaagagaagtgctgcgcacaaaggcattatgcttcaaatgcctcaaaagcaatcatcaagcaagcaattgcccacaaccgaaaagatgcttcaaatgcaaacaacctcatccaacggcattatgttatgcagacgaaaaaccaccgaaccaaatcacagcagcaatgttggggcaaacacaacaaaatgtgtcaatcacaactcaagacggaagtaacgaaccaacggcatcgacatcgcaaatgtgcaatgccgtaaacggaagcgacacacgcgcactactcatgaccgcaacttcaacggtcttcaatccagcacaaccgcatctcagcatgactgcggcaattttcatcgatccaggcagccacacatcattcatttcagcaaaggcagcacagctactggatcttccggtggtccacactgaagaatgccacttgaccagtttcggagaacgcgaaccaaaaagatacatcagcgacctggtcaagctcggatttctctgcacgagcggggaaaaactcatcttcaacctcaacgccatgaaattcttggtcaacgacatgccaatgattcaactgtcagagctggacaagtcagagttgaggcaacaaaagctcaatcctccgcatgaacaacgacaacctgacatcatgctncgaattgatgtctggcacgaactgcnag

SEQ ID NO: 55093 - DNA, 1122 bp, Heterodera glycines
  Genomic contig location: Contig_ID=SeqID_517; Location=238..1359; Strand=-
  SCN-specific regions: Sequence locations=1-57,110-349,392-733,755-1122
atggtacgaatgacaaaaaaaacaacaaaaaaaagttaaagattttgaattttatcaaaaaaccaaagggggaacccttttgttttcaaaattttttgaaataaaaaatcgtgaatatacttttattcgccaaattatgctcaatgcttaatgtgttcatcattctgtatcaaaacaaacaaaaaaaaaaattagaccaaaaaaaagtgaaaaaattttcaaaagagtactctttttaagtagcgccacaaaattgcattgaaattttctaaaatttttcccacggcgcctattggccccgccggaccccaccccattcaccaaaagttttttggaaaaagcgcgccgcaaaaaaaataatatagattttttcattttgaattaaatttttcaaaatgctgacttttgatcccaaatgaagattttttgtcagccaaatgctgattttgaaaatttacagttggcagccctgcattttaggctaataaaatattgcttcaagtcatttttcacgttttattgtgttttctttgcgctactattagtttcagaaaaaatcttatttttggggtccgaatcttagtttttcacccattttgtcttattttgaaaaaaaaacttgggagccctgactaaaacactcgttgaattcgtttttcagacagacacccggactgggacaatcggactttgctcgaatggttctccgaaaagagatggaccgacgaagataattttccacccttttctgagaagcacttgcaaattattgaccaagccgttgccgaaatgaaactgctcattcgatatgcgcaactttttggcagtgatccgtcgcgcattgtcttccagccgtcgctggcacgcggcttggattactacacgggcatcatttttgaagttgtgatgaaaggtcacattatataactttaacggaaaggacaactgggcgttgaatgcacttcactttccccaagtcgtttctctactgaaaatgatctaatccgtgtttttggctataactcatttcaagttgcccaaaatgaacgaatttagtatcacttgaaatctgagctttttcagccatcaaaatttcaattgtaaattatgttaaaaaataaa

SEQ ID NO: 55094 - DNA, 103 bp, Heterodera glycines
  Genomic contig location: Contig_ID=SeqID_517; Location=2235..2337; Strand=-
  SCN-specific regions: Sequence locations=1-31,53-103
gagaaaaggaaaaacgtgtgaaaatggataaatgtgattgaattgataatggccaatgggaaataattaaatgagggaaatgcgtcgaataatccttacaata

SEQ ID NO: 55095 - DNA, 1240 bp, Heterodera glycines
  Genomic contig location: Contig_ID=SeqID_518; Location=1643..2882; Strand=-
  SCN-specific regions: Sequence locations=1-33,76-280,307-1240
atgaaaaaactacacattcacaaaaagaaaatgtaaaatagaaaaattaaatctaaaaatttgaatttaattttacagtttcatctcctcagactgttggcttttagtgttcgatttgcttgagccttctcaactgggccttggaattgcacttgtcagccaccgttttgacttttacgtcgacgaacacttcaagacgcggcgttgggcgctcaaagccatggaaattaaagccaaatttgaagcggatggcacaaatggatgggaaattgtcaattgcgatggaaaagaattgccaactccacaaaaagcgctgccaaagaaagtcgtgggattcgaagccatttcaataaagtgaaatgaatgattaattttttgttttctgtttgtaaaacaattcctttattttcacagttacatcgaccaaaatgccatcacttttctgcagcgttttcgccaacttttcgcctcttctccaattaatttgtttatctacacggacgatgaccgcactttggagttcattttgcgcaaattttggccaatgattgcgaaaaacatttgtgccatacaattgccccgatatgctctcagccgtttgcgacgctttgtcccgtcacttctcaacgattgtccatcgcttcgtgttgtcaattccaattatgctgatggtttcttcgccaaatttccttgcgatgacagtgccatggcatcggatggacaagcgttggccaaatggctgttcactcctcgtcctgacaatgtgccaaaggtgttcaaatgctggttgcatccgtggtggtatgggaatttgtcgtcgcgcattggagccttcaaagcggtgattcgatttgattttaattggcattttacgttcattgggttcgctgacaaaaaatagtttggacggcattcaactcgtttttgacgaatgcaaattgcgtcattttatgatttcttaatcaattgtcccatattttaggcatttgccaatgcttcatctcccgtcagtttcattgttgtcatttggcgaccgccggcttctgttgaccccaatttggcctttgatctgaccaacgaagtgactcaggaacaactgacgttgaaatggatgaacgatgtcggccgttttcttctgatccgttgtccaattgtgcgcgacatggacaaatgggcgaaatgggaaaaggaagcgattgactggcaattcaatggccaatggaacagaatcgacatttga

SEQ ID NO: 55096 - DNA, 1071 bp, Heterodera glycines
  Genomic contig location: Contig_ID=SeqID_519; Location=663..1733; Strand=+
  SCN-specific regions: Sequence locations=1-842,864-1024,1069-1071
atgatcgcgagaaacatttgtgccatacaattgcccggatgtttcgtgccgtcaattctcaacggttgtacatcgcttcgtgttgtcaatgcctattctgatggtttcttcgccgaatttccggccgatgacagtgccatggcatcggatggacaagcgttggccaaatggctgttcattccccgtccggacaatgtgccaaaggtgttcaaatgctggttgcagccgtggtggtatgggaatttgtcgtcgcgcattggagccttcaaagcggtgatgtcgatttgattttaattggcattttacgttcattgggttcgctgacaaaaaaatagtttggacggcattcaactcgtttttgacgaatgcaaattgcgtcattttatgatttcttaatcaattgtcccatattttaggcatttgccaatgcttcatctcccgtcagtttcattgttgtcatttggcgaccgccggcttctgttgaccccaatttggcctttgatctgaccaacgaagtgactcaggaacaactgacgttgaaatggatgaacgatgtcggccgttttcttctgatccgttgtccaattgtgcgcgacatggacaaatgggcgaaatgggaaaaggaagcgattgactggcaattcaatggccaatggaacagaatcgacatttgagagatttgctgagaagtgatcgatcaatttgaattgtgaagttggagaatgaatttgatcctatttgatgtgtataacattgttgttttgttgcggtgatcaacttttatttgtgttatgtgtatgcatttaggataaatttagggattttctgaaactgtaattggctttaagaaatgctttagaaggttttttttttttgaaaaattttgccgcaaaacaattgttaaaaatctgattgtttctaacccaaaaatgcactgaaattcactaaatattatttgtttatttcttctccaaaattgttaaagatgataatcggaggcgaaaattaattaatataggtaaccaatttttaaaaatggaaatttcaaaataattattttttaaaattcaa

SEQ ID NO: 55097 - DNA, 5333 bp, Heterodera glycines
  misc_feature (3046)..(3046): n is a, c, g, or t
  Genomic contig location: Contig_ID=SeqID_519; Location=4184..9516; Strand=+
  SCN-specific regions: Sequence locations=1-398,420-1796,1818 -1866,1888-1998,2023-2109,2131-2435,2458-2496,2534-2645,2669 -2674,2704-2946,2968-3505,3527-3569,3592-3739,3761-3784,3806 -3972,3994-4112,4153-4183,4212-4372,4401-5239,5261-5333
atgtcagacaacagaaaagaagccgaagaaaaaatggcgaaagcaatgtaaaattagaatgccaattttcaatttcaattttaaattttgttttcctttttttcagctttatctccgccgactgttggctttcagtgttcgatttgcttccgccacttcaactgggccttggaattgcacttgtcagccaccgttttgacttttacatcgacgaacacttcaagacgcggcgctgggcactgaaaccaatggaaattaaagccaaatttgaagcggacggcacaaatggatgggaaattgtcaatttcaatcgaaagccgttgccaattccacaaaaagcgttgccaaagaaagtcgtcggattcaagcgcatttcaataaagtgaaatgaatgattgattttttcttttgttgtaaaacgattccttcaattttatagacacatcgaccaaaatgccatcacttttctccgccgttttcgccaacttttcgcctcctgcccaattaatttggtcatctatacggacgatgaccgcactttggagttcattttgcgcaaattttggccaatgattgcgaaaaacatttgtgccatacaattgccccgatatgctttccaccgtttgcgacgctttgtcccgtcacttctcaacgattgtccatcgcttcgtgttgtcaattccaattatgctgatggtttcttcgccgaatttccggccgatgacagtgccatggcatcggatggacaagcgttggccaaatggctgttcattccccgtccggacaatgtgccaaaggtgttcaaacgctggttgccgccgtggtggtatgggaatttatcgtcgcgcattggagccttcaaagcggtgatgtcgatttgattttaattggcattttacgttcattgggttcgctgacaaaaaatagtttggacggcattcaactcgtttttgacgaatgcaaattgcgtcattttatgatttcttaatcaattgtcccatattttaggcatttgccaatgcttcatctcccgtcagtttcattgttgtcgtttggatttcggcgcctttggcttttcccgcacaatttgatctgaccaacgaagtgactcaggaacaactgacgttgaaatggatgaacgatgtcggccattattttttgatccgttgtccaattgcgcgagacacgaacaaatgggcgaaatgggaaaaggaagcgattgactggcaattaaatgatcaatggaacataatcgacatttgaaagatttgctgtgaagtgatcgattaatttgaattgcgatttggagaaatgaatttgatactatttgacgtatatatagtattgtactttttgttgctatgatcaacttttatttgtgttatgtgtatgcatttaggataaatttagggattttctgaaactgtaattggctttaagaaatgctttagaagtctggcatgaagatttgtggcaaaatttggtcatttttcgacaaaaatcagtttacaaatcgcattaaaaattacaaaaaattttccaggcggcgcttatcggcgccgtcggacccatcaccgtcactccaatctccaaagtttttttttttttttgaaaaatttgccgcaaaagaattgttaaaaatctgattgtttctaacccaaaaatgcactgaaattcactaaatattatttgtttatcctctccaaaattgttaaagatgatcagggaacggatttatatgtatcaaaaaaatcgccaaaatatgtgacaaaaactgccgaaaccccaaaatatgtttttattcccaaaaagtccaaaatatgtttttatatgtgctaaaaactcgctctgattgaaaggaaaacaagtaaaaatgttatttttgagcttttcatgcgatagcatatgcgcaaaaaaaatatgtaaaaacatataaatccgttccctgaagatgataatcggaggcgaaaaagataataggtatttaataattttttgacaaaataaattgtaaaaataactgatttgaagcaattttgcaaaatgtcctgatttttgaccccaaaatctaaatttttgggcatgatgttctgattttgaaaactttcgatagttataaaaagaaaagaataaatcataaaattctataacttttttgaaacataacaaatttttcgaaattttttacaggataatagagaatgccaagggctatcgaatgataccaagattgtccaatttggttggcaaaaaccttcaaaaataatttccgaaaatcgtcattttaatttttggacaaaaatagataaaaattcatgtagcccaacggactcgaacctcaccccctcctcctcactatgacccttcattttcttacaaaaaccatttcgccacacatgtaaactcttaattgataactcaaaattgaaacgatgtgtaataaaacataaaattcattctgtgtgttgtccttttccctttttttgtttaatttggccaatgaaaaattcacaaaatgataataaaataaataaggaattgaattgaaaatgtgcttttctgaattaattatagcaattagtaactgatgaaggaacgaaagaatgattgatgaattcggaagctataaaagttggtgccaaattttaagattttccattcattttcttaatccaaaaatttataaaataaatttcaattaaacagctttataaatgtttaaaattttcgttttattcaacgcttttttgctgatcaatttggcaataactgatgaacatgtaattaattgtgtaaagactggatgggaagtggagtacaatccgtataaggtaaaaagtaattaaaggctattctcgagagtctgtttcgtgtcgagaaaaaaaaactggctcaacatcgctttatttggtatttttttggacaaaatctgttttaacaaatcggattaaaatattttgaaaaatcttccccggcggagcctgtctttaaaaaaaaagtcactacatgcccggaagccttcgcaaaaatttcgattgaccccccncccccccccaccccgttctttgggactttggtctcgaattattatctaattttgggctcgagtctcgggaaatgttcggtctcgagcatcgctagtaattaattattgaaacattttggcgcaaaattccttaattattaattatttcggtttaattaaggcattcgtcgctcgtgcggtggccaaagcgaacaaagagtccaacaatacgtatcagtttgtcgatttggatgtaatcaatgtcatggtagaacccagagaagaagtgtatctctatgaagtgaccattttggctggacagacaaactgtgcaaaaaatgtaagtgccaaatggactgaaattggcacaaaaatgggcaaagtcggcacaaattttaccccccaaagtcgaaagtcgaacattccaagatcagcaggccctggggttgattgacatctgctgagatcagatttgtaccatggatttccttttttaaaaaagtcggaccgggaattgttgggattgctaaaaatgtgaaattcgaaaaaaataaaattttaaatttccgtaaaattaaagttttttaattgggcaaacaaaagcaggtgtatataattataggactttaaaataatgctgattttttaatgcagccaaagatggactactcaaattgtgttgaagtcgatcgggcaacgcgaaaggcattaattaatcctaataattattttttaattagcctaagccctaattactcttcagaaatacaaatattccgaatgtttatgtgccagaataaaatagaacaagaaaaaatgatacgaaaggatgtaattgggaaaaaattgatcatcaaattatcaaaatgagcatgttattgaataaaatgttctaattgacattcaacttccttaattatatgactcatttgtcacaattattgtaaattgagaaattttgtatttttaaatatttcaaaatccataaaatcgccgggatttttaggaggaaagggaaaaatggggaatccagtcccgattttttcgttttcccgtttccgaaaattttgttttaccacacttcacgttaaatataaaaagaaaagaaaaaataaataaaattaattctgtgtgttgtccttttccctttttttatttaattttcccaatgaaaaattcacaaaatgataaaaaaataaataaggaattgaattgaaaatatgcttttctgaattaattaaagcaattagtaactgatgaaggaacgaaagaatgattgatgaattcggaagctataaaagttggtgccaaattttaagattttccgattcattttcttgatccaagaatttataaaataaaattcaaataaatagccttaaaaatgtttaaaattttcgttttattcaacgcttttttgctgatcaatttggcaataaccgatgtgcaagcattgttggataatacagaacttctggacccgaatgacaagaggtttaaggtaaacaaaaaaaagtaattaaaggcgatgctcgagagtctcagtttcgaatcgagaaaaaaaaattggcccaaaagcgctttatttggatctgttacaaattgtcttaaataagtactatcggcactagggatggcattccgaggccccaaacattttcgaaaatcggaattccgagacccaaaaatgtcagaatcggaatttcatgccatcccagatcggcaccgctttccgaataatttggcaaattcgtttcattaattatttctgtttaattaaggcactcatcgctcgtgccattgacaaaatgaacagagagtccatcaaaccgtttctgtatatgcctgtcaacaagatactcaccgtaaacacaatgcatggaaataactatgtaatgaaaatggtggtcggagaatcaaaatgcgtaaaaaaagtaagtgcaacaatggactgaaattggcacaaaaatgggcaaagtcggcacaaataataaaatactcaaaaaattttcccggcagcacctatcggcaccgccggaccactattttaccatatttttgaaaaatggagaccaaaacggcaataaatagtaatttttggcgaaaaacggcaaaaaattttgtaaaatacacccccctaatttgggatttcaaaaaaacgaaaaatacacccctaaaaatcgagtttttaataaaataatgctaatttttaaaggagccgctgcagccgccgccaaagattgactacacaaactgtgaagcgaaagctgacccggcggcgccgaaacaggcattaattaattcataa

SEQ ID NO: 55098 - DNA, 1322 bp, Heterodera glycines
  Genomic contig location: Contig_ID=SeqID_519; Location=2573..3894; Strand=-
  SCN-specific regions: Sequence locations=1-87,109-222,258-264,288 -1177,1230-1265,1288-1322
atggcgcaacagccgacaaacattggcacaccgtacagactaaaaaatgagaaggaaaagggtaaatgtcgacaagaaataaaatggacaaaacgtacagaagcatttttgaaggcattgtcagggacaaaaatccaatggcgaatggaaaataatgaaaagtggctggtatgagaatttggcgtcgtgcattgaacacttgaaagcggtgatttcaatttgattttttgaaaatattagttaaaataaattaatttctgacagttttaaaaataattggaaaaattgaagaatatgtgtacctcacagaattcgacgaatgatatatcattcgacgcctctcggtctgtaaggcacggatcttaaagaattttttggaggaaaccactttgggccgagttatgggcccgggactgaagtggccaaatggctgtgggactaaaccgtccaaaggtcctcaaaaaacagggctcccagatcaaaagtttcaaaagcctcatttggtaggcaaaaaagcctcattttgggtaaaaaagcctcatttttacaaaatttattcaaaacacgtttaaaatgttcaaatgttatatttttgatcgcccatgatcaatttgagcattttttttttgttagaaataagcattttttgggattctgaacatgaaaaacgaagttgatttttttgcggcgctttttttgagcaaatttttgcttttaaattaaggatttttacggtccggcggtgccgataggcgccgccgttggaaaaattaagaattttgaccatattttttgcgtattttcattaaaaaaattctttaaattgccaaacattatgccaatttatcaaaatttaaaagattctgaggattttccccaaaagcctcaaaaatcctcaaaatttctcaaaaaaccacaaaaagcctcaaagcctcattttgaaaatttagcctcattgacctatcaaaaaaccacaaaatgaggctaaagcctcagacctgggagccctgtcaaaaaatgaccgtaagggacggcacttcagtcccgggcccataactcggcccaaagtggtttccgacaaaaaattctttaagatccttgccttacagaccgagaggcgtcgaatgatatatcattcttcgaattcggtgaggtacacatattcttcaattttaccaaataatttataaatttttaaaatatattttaaaaagtgaaaaaattaaaatgagtttttatgtgaataggcatttttttgttgtttgcaaattagagcaaatcaagaaaacaatagacgaagaacaacagttatttcaaataaa

SEQ ID NO: 55099 - DNA, 182 bp, Heterodera glycines
  Genomic contig location: Contig_ID=SeqID_519; Location=3915..4096; Strand=-
  SCN-specific regions: Sequence locations=1-23,45-182
atgcaatcaaagaaaaagaggagaaaattatgtaaaaattcacaagaaaagtttattttattaaacgtaaaaaaatcatttttaaagggttttgtcatggaaaaaacgcgaagaaagagtcgaaaacaaatgacgaatggaaaataatgaaaagtggtggaggagcaaccacttttatatga

SEQ ID NO: 55100 - DNA, 363 bp, Heterodera glycines
  Genomic contig location: Contig_ID=SeqID_519; Location=10035..10397; Strand=+
  SCN-specific regions: Sequence locations=1-260,286-363
atgtatggcctatttattgcgatacaaaaggttggggatgtatgaagtattgacaaatcggcacaaaaatattgtttttattgtatagttcaaggatgtcatttcgagaccccaaaaacgtcggaaatcggaattttaaaatttggtatatttccaatttgcttaggaaaagggtgctattgcacttttttgcggtgcgcttttgcaaaaactttttggcaacatggcggtagggtccggcgatgccgataggcgccaccgggtaaaattttgttaatttttaatcgctttctcctttttgggtagaaattgtattttattcagaaactctttcaatggagaaataaaatggggaaactttaa

SEQ ID NO: 55101 - DNA, 343 bp, Heterodera glycines
  Genomic contig location: Contig_ID=SeqID_4613; Location=1563..1905; Strand=+
  SCN-specific regions: Sequence locations=1-2,84-245,267-285
tttcctttcccgactgtctccatccgcttcttctctctttccccccccccaaatgcccctctttccctcccttaatccctcccctctgtcaattcattcgatttcccattccaaagaactccaaatcagatggttcggttggactcttttgaccatttggctgttaacagtaatctgcatgactcgagagttttggcgtatcacaaacagcggaagaagaggctgaggaaagcaatcggaagaggaacaaaatgatggaagaggaaggaaatcaggaaatgatgaagaggaagaacaggagaggaaggaagaggaagaacaggagaggagggagaggaaggga

SEQ ID NO: 55102 - DNA, 706 bp, Heterodera glycines
  Genomic contig location: Contig_ID=SeqID_4613; Location=298..1003; Strand=+
  SCN-specific regions: Sequence locations=1-227,249-362,385-706
atgaatgcttcgatcgctctggtccctgcactcgcttcagcaattgttccggctccgcgtgtattctctgtcagtctttgcccattttcaccctttccttcccaactgttgtatgattttgctctgatcagatgagaacctgcctaaacgaacttcgatcgccttttgtctgctgatcagtccggtggcgcggaaggacggcgctgagttggcgcagggatgttggagggacgacggcacttcgggagtcgaatgtgtgtgcactggccaattctgcaacataccgagagacccgagggcatccggtacggccgaacaacattatgatctcatcccttatggggtgcgtgtgcaaccactcttttttgccaacttaaaattctgtgccgccattccctgtcacttttccatcgttttcagatccgaattcttcaccagtgattggcctgaaaatgttacagagaaacccttttgtggattatggtaagtgaagcaccgttcgaatgtcaaaaagaacgatgttttagaatatttggacgatgaaaaagcggcgattttgggagacggaggaaagaaaacggaaggacgaggggaggaaagcagtgtggaggagacgcaactgccggagcagtatttggacgaagaagaagaaggcactgcaattgtttgttgtcctttcagtgtcaaacctaaacaacagatttga

SEQ ID NO: 55103 - DNA, 999 bp, Heterodera glycines
  Genomic contig location: Contig_ID=SeqID_4614; Location=1773..2771; Strand=+
  SCN-specific regions: Sequence locations=1-73,95-102,208-300,463 -522,559-999
atgaaaaagtgtttttatgaaagtgcactaaggacaattgactatttggaggccgaatttgatcaaatgaagaaagaagacgacaaaatgaaaggtgagagagaggaggaggggaaagggaaaaagaaagagaatgagagagagaaagagaaagaggagacaaagaaagaagaggaagaagaggaagaggaggaggaggacggaggaagcactttcgcaatcgcaaagccaccaatcattttcgtgaatgatcttacaaagaaacacccgaacatcaacgacgaattcactccgacggacggagaacggaagagatggaagaaaaacggagggggagaaaaaggagtgcaaagaggaaaaaggagggagggcaaaaaagaatagagaaatcggaggagggcaaaaaggagttcagaggaggaagaaaagaaggaatggaggaagacagaagagtggggggagtgcgcattataaagaaaatgacgagcagcaaatgaacgtagttttacccaaattaccacttattccaattaaattttaaaattgaaatttgtatgtgtaaatccctttttttcttcgacgcctttctcccgtcctccgcgctcttttctctccctaagcgcccgcttcggtcagatacgcgtgaggatggaccggtttctcggctcgtagcagcagccagttttggttgtcgtcgtcgatgaattgcaatttgtccatccatccctccagcaatttgtcgtacaatgtcttcccgaatctcttaatcgtttcggcatttgtctctcccttcccaattcgttcttccccccccccaccttcacaaattcgtctccattagcaatcgctcggcttcgctccatctccaaaatctcccttagacgtggtgtcatgttctaaggtcgcagagcaaagaatacgaaaagagtgtcccttttccaaacctccgtgaaaatgttggtgaaaccggcgccgtgggcagtctgaggagaaacgtaa

SEQ ID NO: 55104 - DNA, 2108 bp, Heterodera glycines
  Genomic contig location: Contig_ID=SeqID_4614; Location=2418..4525; Strand=-
  SCN-specific regions: Sequence locations=1-934,956-1032,1054 -1382,1404-1611,1690-1741,1763-2108
atcgccgacctcaccaaattcgtcgatgtgttcgccgccaaatggcaaaatcacacttttggcttccgtctctatgggatgtgccaagtgcagaattcgattttttcgcattcaaatttcctcgacgtccattggacgttgacaaaatccgaagaaaatcgtttgtacgatgacaaattggccactttccgggaatttctcgacaaaactcagtacactgaggacaatgtggcaagctacgaatggattttcggcaaggatttcataagcccaggtgggagacggacgaacagaagcataatggaaccaatctttgatcggttgaggtggcattgaggaaaaccgacgcgtgctgcgccgtttccgtcgccttcggccgggccaaaaaatgttggacattggggtgggcatcggaggaggggcacgacaggcggcacgggtgggccaacagtcgcattccttcgccgaatgacccaccgattgacaggagttcggcttgcaagtgctcggctgtgatctgtcgtccaatatgatccaacatgcattcgaacggaatcagcgcgacaaggcaacccaaacagatgagaaaaggcgataagcacacttttaggaccatcgagtggagtatcaaatcgcagacgcaatggtctaccgctatgagccgaactcttacgacattgtattcagtcgcgattgtatccagcacattcaggtgacggagcgatgccgactttccccgcgatctatgccattcccttccccacgatcgatgctttccccgaaatcatgccgtcccccctcccaatcggtcaattccttttctccgcgatcaatgccatcaccctcccaatcgatgcaattccttttctccgcgatcaatgccatcccccctcccaatcggtcaattccttttctccacgatcaattccattcccgcccccctcccaatcgatgcaattccttttctccgcgatcaatgccatcccccctcccaatcggtcaattccttttctccacgatcaattccattcccgcccccctcccaatcgatgcaattccttttctccgcgataaatgccatcacccctcccaatcgatgcaattccttttctccgcgataaatgccatcacccctcccaatcgatgcaattccttttctccgcgataaatgccatcacccctcccaatcgatgcaattccttttctccgcgatcaatgccatcacccctcccaatcgatgcaattccttttctccgcgataaatgccatcacccctcccaatcgatgcaattccttttctccgcgatcaatgccgcgattgttcggcagtgccttaggcgccgctcttcgctcattcgcttcacttcctattttattgcaacaataaatttttgattattttaggacacaaaggccctcttccgtcacatttacgtctgttttgccggaattggcttgacattcgttcgcttttagacttggctaaagccgggagggcaattgcttctcacaatgtatggaaagggccatggagttttgcaaccgaagttccatgaatatgtgcgaaaaaggcagtacatgttgaagactttggatgagtacagagaggtgaagcaaagcaaagaaaagcaaaagaaaagggaaaaaagagaaaagaataataaaagaaaaggaaaaacaaagaaaagagttgtcgccggccatctgctgattatgaaagaccccttcatattatgccatcctttgctttttatttacgtttctcctcagactgcccacggcgccggtttcaccaacattttcacggaggtttggaaaagggacactcttttcgtattctttgctctgcgaccttagaacatgacaccacgtctaagggagattttggagatggagcgaagccgagcgattgctaatggagacgaatttgtgaaggtggggggggggaagaacgaattgggaagggagagacaaatgccgaaacgattaagagattcgggaagacattgtacgacaaattgctggagggatggatggacaaattgcaattcatcgacgacgacaaccaaaactggctgctgctacgagccgagaaaccggtccatcct

SEQ ID NO: 55105 - DNA, 1011 bp, Heterodera glycines
  Genomic contig location: Contig_ID=SeqID_24373; Location=220..1230; Strand=+
  SCN-specific regions: Sequence locations=1-139,163-302,325-399,421 -432,454-1011
atgtcgaaacacggaaattacaacaccgaaaatgtcgaaaaccggaattccgactccaaaaaagtatgtttttgtacgcgtgggattgctgagatcggatttacgaaattaattgaagaatcgcgtaatacaatgtccatgtttttgtttttcttaaataattttaacttttcggtgggcggttgattgggcgtcaagaatcacaatcaagacgccccacgccttagtccgaaatcaattaaaaccgcgcccggaatcaattaagacatcaaatttcatagattcgacatcaacagcagaactgggtgtgtgtgtttgttgttcgacgcggttgcccctcccgccgcccgacgaccaaagaaaaggcaattaatcttaaattaattgcttgcactataattgttatttttggaacattttgggcaataaaaattaatggataaaatgaggaatgaataccccaagcattctcctctctctctcgccaattgattcggccactcctccgtccctatccgccgttgttttggttttcccatcccaatcggcaacaaaacaaacaaacaaaaattgacaaataaaaactaattatcttatcttccatataattagtaaagattcattgaaatttagttgttttttccaccgtttaattccttcaaattgggtggttaaaaagggtcaacagaaaaacaacccatccatcagcagaagcagaagtgagggaaaagcgccctcaaaaacatcgcattttttgccattttttcaaataattcttttatagcaaacacgtaaagtcaacaacagagcggtgcatcaatccctcatgaaaaaggaaaaaatggagcaacaacaaaaattgatgaaatcagtcaaatgattgtatacagataaaaaaatgggggggggaggaaaagacaaaacaatttgttgataaaaaatttaaaaaaatgatgagatggatttgcaggaatgggccgggttcgcaaatgataaatggacgaaatttaa

SEQ ID NO: 55106 - DNA, 138 bp, Heterodera glycines; identical to SEQ ID NO: 50950
  Genomic contig location: Contig_ID=SeqID_24376; Location=1445..1582; Strand=+
  SCN-specific regions: Sequence locations=1-138

SEQ ID NO: 55107 - DNA, 641 bp, Heterodera glycines
  Genomic contig location: Contig_ID=SeqID_24377; Location=355..995; Strand=+
  SCN-specific regions: Sequence locations=1-125,147-446,468-567,589-641
ctgtgtggagcttttgaacatgtgccaaaacattattttttcccgtctgttcatgatgccgttttatgtgctcaacaaatgggcggtttcattgcgccaagcattcacatgaggtaaatatatccatatttaatatttttaatattcgagagtctcggtttgaatcggttttttctctttcaccactttcaaatctgttttttgttatatttttctgtcaattgcaatcaaatgaatagataattttttagtgtttcgttgaatggttgccgtgatctgatcactctgtccaacgctgcgtccaaccacgacattactttgaacacagaaacaagcggacaatcatcagcaaacataccggtaattacattaaactgtttgtccagaagttttttctatataaaaaatggctgccaaaatggtgaccatctttctccgccagtgaaaatatatcgaaaaaatgttttaatgtgcaattggaatagatataattcgaaacattttttgtgcctttaagtgtaagcggtactctatttgatgtcatatttatttttagaaatggaaaacaattaaaatatttaaaattttgcaaatatttacgaaaatgttcacaaattcagatgctaattagtccaaattaa

SEQ ID NO: 55108 - DNA, 139 bp, Heterodera glycines
  Genomic contig location: Contig_ID=SeqID_24378; Location=1638..1776; Strand=+
  SCN-specific regions: Sequence locations=1-139
atggtccaatacaaattgtattattttgatttgcgtggtttgggtgaacccattcgccttttgcttcactatgttggccaacagtttgaagacatccgctttaaagactttgaagaatgggagaaaatgtacaaaccgt

SEQ ID NO: 55109 - DNA, 299 bp, Heterodera glycines
  Genomic contig location: Contig_ID=SeqID_24379; Location=305..603; Strand=+
  SCN-specific regions: Sequence locations=1-136,159-299
atgcctatagaaaaggatcaaaattctgttttgaatgaccgtacgtactttaaaactgttaatgatcttactattaccaaggggcatttgtttacttacaaaggtgtgaccaagccgaggacatgggtgcttcggttgtccttccaaaatttgtatgttcaatttgcgccactcccaacggtttatttgaagctcgtatagatcatttgagtacctaaattaggcattttttgcggctgtcctcaaataaaattacagaactcgatcgggatccaggccaggatttccctggtttttaa

SEQ ID NO: 55110 - DNA, 1352 bp, Heterodera glycines
  Genomic contig location: Contig_ID=SeqID_24379; Location=1..1352; Strand=-
  SCN-specific regions: Sequence locations=1-133,155-210,232-257,279 -890,913-1352
  Gene Ontology: Mol. function=transcription factor activity; Cellular component=nucleus; Biological process=transcription from Pol II promoter
aacaacaataataacagttatgcaaagcatcatcgatttatgccaaaatggtgtaaagtggacgatttgggcaggccaacgcctccgccacgccatgggcaccgcgctgttaccataaaagggcttatgctggtgtttggaggtggaaatgaaggaattgtcaacgaattgcatgtttacgacacaagcaccaacacagtgaggctaattgaaattaattatttgtttaaagattccgcctgaatttgagtcctggatgattttttcctttcatcttttggacaattaattgtaggccattttgagtaacctatatttttccactacttatatttttaataagacgtccaattgatgatcatcctcagtttctttggccataacttttttttctttacttgtcaagtcccacattctcaaattaggtaatcaaatgctggacttgaattaataaaaaaatagagtcaactaattgcaatttaccgtttagtggtgtgtgccagatttgcgtggccacagaccacctggttttgcggcttatggtaattttttgaacactatttgcacaacattttgttatattgaacccaattactgaaaggaatggtcacaaatcagtcgaaggttttcatctttggtggaatgatcgaatatggccggtacgaattctttgggttttaaataatataagagcttgacctttagaaaaagcctggacctgcatttcctgtagaaaaatctaggcctagttaaaaaccagggaaatcctggcctggatcccgatcgagttctgtaattttatttgaggacagccgcaaaaaatgcctaatttaggtactcaaatgatctatacgagcttcaaataaaccgttgggagtggcgcaaattgaacatacaaattttggaaggacaaccgaagcacccatgtcctcggcttggtcacacctttgtaagtaaacaaatgccccttggtaatagtaagatcattaacagttttaaagtacgtacggtcattcaaaacagaattttgatccttttctataggcatagttgttgatcattaatttcgccaaaaaaatatttacctatttatttattttttgttgttgtttttgctggccattcttgattttctaaattccaaaatgcatatgcaccttattagtgcaaactccgtaaactaaacatattttggggccctctaaaaaatttcttctaagaggggtacccttttggagggagttggaatttgttgacatagaaggcagattcgtgattaaacagcaaccccagtgaacaaacaaattttcacgacttgtgacaaaaaaaaaatttcggaggcccccaacaac

SEQ ID NO: 55111 - DNA, 1361 bp, Heterodera glycines
  Genomic contig location: Contig_ID=SeqID_24380; Location=112..1472; Strand=-
  SCN-specific regions: Sequence locations=1-117,139-1197,1219-1361
atggccgatctgtccttcgttttggagcagaggccaaacgcggaatttatgtccccgacgggtaaaaatgcaaaaaaaaaatgtttttgaaagaccatttttggtattacttcccaaattttattttcacaaaaaatttccttgtgcaggctcgtaaccggaaaaaaaattcaggggaggcacccaaagagatttttttttttgctcttccaccctatgcgtctcaatttgaatgttttctttaattttcattatttttgccttgcttttcaggagaagtgccctttctgcgtcttcagaacactctggtcgctgaattcttccctattgttgatttggtcggcaaaaaagtaatttttttcttcgctcgaaaatagttggtcgcaaattgataaaattcccgcatttttggcttaaatcaaagaaatttcaacagtggtatagccacaggtcgtaaaggctgcctaggctatggcccctttccttccctccgattcaaatcggacacagaattgaaaaaaattttgaatttacttttttgtgttctggggttgtaaaggtcctaaacatttctaccggcttacaattagtaaccgtcggcatacccgtgcagacaactttcacacaaaaccatttcaaaagctggaatagcacctgaaactgggccaaatgcaaaaaaaatgaaccaaaaattgtctgatttgtttaagaaattttcagggaattcgtccgtcaaatacgctaagcgctgctgaacaggcggacattcaggcattttgctcactgattgaggaaacgcttcgaaacgccgaagttggcaccgttttgagaccaatcattaattttcaaaattgcttttaccttatagaaatatttgtcatggcttgacgacgaatcctacgaattggtgaccaaaaaaaggtaaaaaaaatatatttccatgtcaaataaacatggaaatgagtccactggtgcaccccaaaatttcaccgcttaaattacgccggtcaaaagttctccaggtttcggcactcaaaaattcccccccctgaaaactttttttagcgatttttctaaaaaaagatttcttgttgttttcttatgattcctaaatttttttttttgaatttctaggtttcaaaaaattaaaaaaaattttctgatggaaacgaaggggggtggagtgaagtgcatcacaaaatttgccaacaattcctttccttaaggtacggcagcgtttacttgtggcctttgaattggctgctgccgacgctcaaacggcgcgaaatgcacaattatttggcggacatcggctggacggaccttccaatggccaaagtggcggagcgatgcgacaaatg

SEQ ID NO: 55112 - DNA, 964 bp, Heterodera glycines
  Genomic contig location: Contig_ID=SeqID_4618; Location=11..974; Strand=-
  SCN-specific regions: Sequence locations=23-75,98-251,273-287,309 -338,371-633,655-964
  Gene Ontology: Cellular component=membrane
atgacctccttcttcctcctgttcatgttgctaatgctcggtgtcaagtcgagtcgtgacggccgtgccccgattcaaaatggcttttggtttttcaaatatttgcttctcggattgctcattttcggctttttctatctgagggacggcggatgggcgactccgatggtaaatttaaaaattgcatttcaaaaaacctttttatgaatacaattttttattttttcagatgtggattggaatgcttggcgctttcatattcattctcatccaactggtaatttatttcagtgaatttttgcttttctaattcgacccgcgaaattcctaaacggcgaatctgaaagatttttcaaaaacattttttaaattatgagaattgcgtacgacatggcttattaatattagtttttacatcatattcatatatttttgttatattttttaggttattatcgtcgattttgcgcatggattggccgaaaattgggtgagcacttacgaggagaatgagtcgcgctggtgctttgccggaatgatctttttctcgctgctcacttacgccctgtccatcgccagcaccgttttcatgttcctttattacacttcggtttgtctttcattcctattttgtttttggcaatttccttttttgcttaagggtgcctcttgtgcccttccgaaattcgttatttccttcaatttcgtcctctgtttcgtcatttccgtcgtttctcttctgcccaaagtgcaggaacgaatgcccaattcggggctcatccaggccagtatgatgtcactgtacgtttgttacctgacttggagtgcgctcaccaataacccgggttggttatctgttcgaatcgagatcatccacaaactgttccaattgttcagacaaggagtgcaacccgtcgcttattcctcggcacaattccaccggcgacgcgggagggaattccaa

SEQ ID NO: 55113 - DNA, 595 bp, Heterodera glycines
  Genomic contig location: Contig_ID=SeqID_24381; Location=490..1084; Strand=-
  SCN-specific regions: Sequence locations=1-49,79-156,178-211,255 -341,389-501,524-527,557-595
atcagcagtgtcctcttcagtgaaaaggtagtttgccaaaaaaattgtgtaaaaaattttaaaaaaaatttaatttttcaatcattttgtttttagtactttgccgaaccccaccaattttggccagagcgctttttggacgatgagggaaaattgaaaaaatgtgacaaattaattccatttggagttgggaagaggtgaattaacttccttttttattaaaaataattttaatttattttaaaaataattttgcttcttagacaatgccctggtgaagcattgacccgaatgaccttatttttgttcaccgccaacttctttctcgcatataaagtgccaaaatatttataattaaaattacatttaaaattaataaataattttaggtgcttccgtctgatctcaaaaatcctccaagttctgataaagtccctgccttaactgttggtgcacacgaattcacgtgccatgtgatgccttatttgcacattcagtgatttaacagaattaatttgtgaaatttgttattattaaaaaatcttttttataatttgttttttggtggcctttgagtttatcatatttaaataaa

SEQ ID NO: 55114 - DNA, 538 bp, Heterodera glycines
  misc_feature (502)..(502): n is a, c, g, or t
  Genomic contig location: Contig_ID=SeqID_24382; Location=1659..2196; Strand=+
  SCN-specific regions: Sequence locations=1-25,63-194,216-328,350 -485,512-538
atgactgacgaagaaatcagcgatcattatttaaaatttttgaatttaaaaaataatttaaacgataaaacaatgaacagatcaaatcaatttaaacagaagttgacaacagcaagtttttacagacaaattgttgaattctttaagcaacacagaacgccaaatggaaaaaatgaaattttgaatgccaaatttaaacaattcgatggattaatttcggaattcagccaattttcacttttcaacaattgcaaactttgggttttctggcgagagcttgtccaactgttaaagccagattcaagcacaaataatgacctcgaaaacaaagttaaaaactgtgaaaaaattgtgaattgttttggccaagggtggtatactgtaaaatctgatgaatactgtaacctttatttacaacattttcaacagtcccattttgaaatgctttcgcatttgttgcccaatgaatccgaaaggttacctgcatataaaattaaattanatattttatctagctaattaatttactctaatggaa

SEQ ID NO: 55115 - DNA, 2642 bp, Heterodera glycines
  misc_feature (26)..(26): n is a, c, g, or t
  Genomic contig location: Contig_ID=SeqID_24384; Location=7..2648; Strand=+
  SCN-specific regions: Sequence locations=1-64,86-152,177-193,218 -311,382-450,559-572,599-629,651-787,809-961,1012-1122,1144-1208,1235- 1337,1359-1457,1524-1601,1655-1843,1865-2043,2066-2184,2206-2234,2305- 2402,2491-2530,2561-2642
atgggggttgaataatagagcccctngggggctattatcgaagaagtacggtaattagaattttaaattttctcctttaagttgtcctggttgcttaatggtccgctcagtttgctgcttgtgctgtctggcattgtgctgaacgcactttgtaattaaattaattaataaaaaatgacttttttaattgcacaatttttgcttgttttaataaaaaggtgtgattgtgttcgtgcgatttcgtcgaaatgttagcggtggcacaactcctataattcactattacttggtaaagagcaacccaaaactcataattttcatttctattttaaaaatatgttgaattttttcagatttctttggcgggatggcactcggcacttttgttcaacgcctttttgctttactgtctaccgacaatggtgcgaaactatagataaaggccatttcatttaaaaaaatgaaatttaacttttttattacatcttatatgttttaattattcaacaattaattattttaaattgtttatatattttatttttaaaatttaaaattcacatctcttaactttgtcaaataaatattattttccttttcataaatttctttgtttttctacaaatttgcattgcttaaatggttaaaagaatttagctttggggctccgtcgtctcatcgggtccctatgtgcatttgtacccgccaacctacgcattggcaaatgcgacacacaccggcactgtttggattgtacggttttttgacgaagaaattaacttttgtcataaaggctttattttcatactttctaaaaataggtccccgacggcagcaacgtcgcaaaattttgaacaatttattaactgaaatttcgcaattgcagattttggcactcactttggaccgctatttggcgttgtgtatgccattcaagcatcgaatttttagcaaaagaaggttaataatacaatttttgattatttgattttatttaaaaataaataaattgtttttagccgtgtgaagcgtctcgttgtcggcctttcaattggcgcgctgttcttctgtttgccacgctttttcgaggtgcaaaccgcggtggagtgctacgcgttggacggtggagcagcagcgcttttgtccagcgcgcacgctaccgtagccgaaacagaggtgctcatagtagcaaatgctaccgtaaccaatgaacagcagcaacaacaacaaatggacactatgtacggtagtgcaattacaaagtgcgacacgtttgtgcagcggacagggctaccggaggttgtgggaaggaaaatggaacttgtttttactatctattatttaaattttattgtattcgtttattgtattaaatcgctttttaacttttagaaccaactctaccgtaccatctaccatatccttctgggcagtgcctttgtgacaattttgccaggtaaattttttttattaacataaacaaaaaaatgataaacaattttaaatgaatatgatttatttttcagcaattttatttcataatattgattcaatcttataaacttttttttggcattttttgcttaattttaggctttttgtattattataattaattttatttttttaaatatttaaaatattttataattttggttctaggggttctcacttttgtgcttaccttgcgtatttcaattgctttgggcgaggcgcgccaccggcgaaaacggctaagccactgctgcgcccatttgcacagcgtcgatggcaccggcgccgggtcgaccaccgcacggacaacaacgacgacgatcagctgcaacacagaaagtaatgggactaaaatgaataatgagaattttaaattgaactgtaacgtactgtaacagttgtattcaaaatggtgctatgacattactcaaaaaaccaccaaaacaaaacaaaaaaattgaagcttgcaaaatttaaaaaaaacttttcgaagcattttctgtttttttctgatacttttcaatatttcgcaataaatcggtgaaatattttgtttaaaatagtaaaatcaaggagaatcgttggccgataattctgtgggcgaaaagcagcactaccgtataatgttaatgtccggggcgatgaccaacggcggcaaaaagccaagcctaaaacggtgaataaacattaaaaaagttattgttaagtaaaataaatttcttacctatttttgagccgtgtatttatattttaaatcatttttcaataataaaaattaaatttttatttaaatttaaaaaatcattttttcaggaaggaacaccgtgccaatgttatgctggtggtgataattgtcaaatttttgatctctgatattcttcccactgtattggacgtctttgaaacagtaaatttaaatataaaatatgtttatgtgaaaattttaaaacactttaatattttcgaagaaatatttaaaacattttaatataatttcattccaaaaattagctataaattaatcaaaaattatctctaattttgaaagaattaaaaataaataagacttaagttgagtaaaaaccaaaaataaactttttttttgttatttaaaaaatcagttttccctctttttgtaaacaacaaaa

SEQ ID NO: 55116 - DNA, 356 bp, Heterodera glycines
  Genomic contig location: Contig_ID=SeqID_24385; Location=310..665; Strand=+
  SCN-specific regions: Sequence locations=1-207,229-257,279-356
atggacgccgtggatcggtgcgctatcagccgtaccaaggacatttgcacggacctgcgcgagtgcgtgactccgatcgccgaaatgatggccgcccccatcgtcgttgatctgctcagaggaccaccccttttggttttcaaggaactcaaggctaaaggcagggacgccttttttgattgtttgggggtgttggactttttgacctttattttattttttatatttgtttggcattatgtttaattatttgtgaccattttttcccaccttttcttgtattcgaatttaattgcattagttttatgttttgtcttctccaaagaaaattgattgtttcttttttttaatttgga

SEQ ID NO: 55117 - DNA, 102 bp, Heterodera glycines
  Genomic contig location: Contig_ID=SeqID_24387; Location=1277..1378; Strand=+
  SCN-specific regions: Sequence locations=1-102
atgtacgccccatttttagtcattgtcggcggagttgtggttggactgcttctgctaattctgatcatttcatatttggtgtatcggcttaaaaagagagat

SEQ ID NO: 55118 - DNA, 989 bp, Heterodera glycines
  Genomic contig location: Contig_ID=SeqID_24388; Location=256..1244; Strand=-
  SCN-specific regions: Sequence locations=1-9,52-134,161-989
agtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatcccaaaaatttttttttgggttttcgggggcagtccccctgaaacgatgcgcccaaaatttatggggagaccgaatccttccggaatagctccactataccctgtacttaaattctgcgttggatttttgctccccataatggtttgagttccccaaactttcacttgaaaaaatcatttttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttt

SEQ ID NO: 55119 - DNA, 155 bp, Heterodera glycines
  Genomic contig location: Contig_ID=SeqID_24388; Location=1580..1734; Strand=+
  SCN-specific regions: Sequence locations=1-155
aatcgaacgctaacggacgacctaatggaaaaaaatccccgaaggagagaatttaattaaatccattccttcgggggaccgtgccgggtgccgcggggtaagcagtgctggttcgttacatcacggcaccgaaccttttggctagtcagcaatcg

SEQ ID NO: 55120 - DNA, 225 bp, Heterodera glycines
  Genomic contig location: Contig_ID=SeqID_4619; Location=1312..1536; Strand=+
  SCN-specific regions: Sequence locations=1-66,95-101,140-225
atggtacgtccttttaacatttacaagggtttctgccatatttgatggatttgtcctggaaaaacagggcaaatggctgaaaatattttacaatttggtgcttaaaatattaaaaataattatttaaagaaataatttaggtcaaggagttcgacggccgattgaacacgcttttggcccaggcaaaccattattcagtgccgactctgcacggaatcatgtcca

SEQ ID NO: 55121 - DNA, 2188 bp, Heterodera glycines
  Genomic contig location: Contig_ID=SeqID_4620; Location=966..3153; Strand=+
  SCN-specific regions: Sequence locations=1-663,692-772,814-1004,1027 -1322,1413-1608,1637-1800,1843-2087,2110-2188
atgtgccgagttggacaattgcgacagctaatgaagggcctaaagtgccaaaagccgataggacccgggaataatacggactggtataaatggggtataaatattaaatgaaaataccggaccctttccttacaatgaaaaatgttttgaatttaagccaaaaaaaaaatttgtcaaattttcctcagaatgtgacacattttgacactttttaggattggcggcctattttcgcaatgatggcgtggtcttggtcttgcctgatgccaacaattatggcattgccaaatttaacacgcattttgccaatgttgtgcgatgttttgagttttttctaaatttgtcgattatttactcttctgtcaatatatttatttcgtattttgtctcaatgttttttcttcttcacttagaaattcgtacttgttaatgaacaaagctttccagtgccatacatttgatttacttttcttacgtctgttactacatgagaatatgggtaagaaattttcataaaatcgacaaagtgggaaaatttcaaagacaaaattttaagtcccagaagagggcgaccattggccattctgtttgtgttctccatcatgagaatggggttgctttagtgatgaatttttctttgaatcggttggaattttttatggtcagtgttctgaaatttgtggagctaatcgattatacactcctaaatttgaggcttatcagagatcggaattccgagggtcaaaaacttttcggaaatcggaaattcttgaaaaaaatataaaatataataaaaatttttaaatattttaaggctaaatttaaaattcttaaccagccaaaaggtgatttcaaaaatgtttttgatatatttctttatgtattttgctaaaaaaaataattcaatggattttcattcaaatttttttttcttttcattttacattttttttagaaaaatttttgggtaaggggactattacacattttttccggcacacttgtttcaaaaaatctttgagaacatggggagggggcgggggtccgtcggtgccgaaaggcgccgcggggaaatttttttgaaaattttagttcaatttattaacagaaattggtcaaaaatttctgaaaccggaaatcggaattccgaccccaaaaatgtcggaaatcggaattccgtgacatccctggtacacaccactgtcagacaaaatgcaccgtaacgccagaattgaaagaattttacgcaaaaggcactaaatttaaaaatcaaaagaccattcgttatttggaacggacgggacacttgagttccaccagccaaatttatatttaaaaattaatttttggtattttttagaagtacattttcaaaaaatttttttattttttcatttgaatttttataatttccaaaaattctcaaacttttaatttttggcactattatttaatttctgcatttgtctgtcctcatgttttgcaaaattgaataaagcggtacgtcctttgatcattatttatcactaaaaaagcttatcaatggacaaattgggcacttttatttatttggtgataaaaatgccctccttcctcacattaataaccaaatattacttttttttatttttaaaatgaaactaattaaacgaaaatatttgccacccgaattactttttgagttaattcattttttgcctttcaaatgccgttgggctaataaaagggtttctgccatattcgatggatttgtcctggaaaaacagggcaaatggctgaaaacgttaggcaatttggtgcttaaaatattaaaaaaaataattatttaatgaaattaatttaggtcgaagcgttggatgacaaattgggcactcttttggcgaaggtggcacatgaacgtagaaatactttgtactgtgccattatacgtaagtttccgacatttcgatcacatcataattttcttatcgtatattctctaattatcgctccgtctccattaatccccccgtctccaattatcccccccccctttctgaggaggttgaaaaataatccccccggggcgataattagagaatatacggtatatatattgtcttatctatgaatatttttcaaaaatattttagggttcgagcccgtgggcggggatggcttttttgcgtgggcggggctcgaaccctaa

SEQ ID NO: 55122 - DNA, 137 bp, Heterodera glycines
  Genomic contig location: Contig_ID=SeqID_24391; Location=336..472; Strand=-
  SCN-specific regions: Sequence locations=1-137
atggctgctggaccattttgtacaaacgctgcgcaccgtcgcccggctgaaaatgttgctggatacggcgagcaaatgcactgtccccattgctgctactgcgaccactggtattgtgaagttgtgcctgcatatag

SEQ ID NO: 55123 - DNA, 1050 bp, Heterodera glycines
  Genomic contig location: Contig_ID=SeqID_24399; Location=147..1196; Strand=+
  SCN-specific regions: Sequence locations=1-511,536-606,629-1050
atgtcaaacagtttctttgtgtttttgccgagcaatgtaacggattatcccgacaatcagcccaacaaatttcgggtccgcctcccgaagcctttacattttaatggctcatgggtctgtgggctgcatagtattagttacccctactcatggtcaaccattggcacattggacgaccaatggattgacattcacttcaccgatcgccgtgctagtgatgaggacagacagcgggtgatcagagttccagtgcccagggcatcgcatagtaaggttgaacagctcagagattttttgactgtcactttgcgaaatcatagtggtgcaaagttgttgccactcccccgtgaggaggaagagaatcgcaatcggacaaaacctctcggttcgccaccaccgttgaagagagagaaaagagctgcgccagtaattaatgagagcggaaaacagcttgactcccccttattgtacgatggaaatgatcaaggtgggattgacgagtctccgcctcatcatgaagaagaagaagaagggacaattcaggagtctccgcctcatcatgaagaagaagaagaagaaggggcgattcaggagtcaccgccccattatgaggaaacaccaaaagaaactgtgaaaacgcccgtcacaccaaaagtgccgacaccaccgcctgtcataagccctactaagccatcaatagtaaaaacgccagctcctccctctgatacaacaacatcgcctcccacaactgttaagccaccagtaaccgtccctcctccaatcacaaaacacaataacgccgtccgctcctccagccacaaagccaaagaccgagcctccaccaatcgtgcaaccaacaactacccctcctccaagcacaaaaccaacaaccgtcccaccgccgaccgaaaagccaaagaccgtccctccaccagccgtacaggcaacaaccacccctcctccaagtacacaaccaacaaccatcccttccccgaccgcaaagccaacaacaccgatccctccactgccagcaataaaaaaagttcctag

SEQ ID NO: 55124 - DNA, 79 bp, Heterodera glycines
  Genomic contig location: Contig_ID=SeqID_24400; Location=1411..1489; Strand=+
  SCN-specific regions: Sequence locations=1-79
atggcttcaaaaattgaaacaaaaaaacaacaagtgaagcttcctcacgaaggacatctttacacattcgacaaaatga

SEQ ID NO: 55125 - DNA, 131 bp, Heterodera glycines
  Genomic contig location: Contig_ID=SeqID_24400; Location=54..184; Strand=+
  SCN-specific regions: Sequence locations=1-79,103-131
tatggcacggaaagacttccggtttccgacatttttggggtcggaattccgacttccgaaatttttgatgaaaagtcggaaatttttttaatttttttttttcaaaaaactagtaagttttgtacaatttc

SEQ ID NO: 55126 - DNA, 84 bp, Heterodera glycines
  Genomic contig location: Contig_ID=SeqID_4621; Location=95..178; Strand=-
  SCN-specific regions: Sequence locations=1-12,67-84
atgtttaattactttattcctttttttattattatttccaatccatttttatttttatttccatttacaaatgcaaatccatcg

SEQ ID NO: 55127 - DNA, 630 bp, Heterodera glycines
  Genomic contig location: Contig_ID=SeqID_4623; Location=304..933; Strand=-
  SCN-specific regions: Sequence locations=1-123,145-231,253-312,334 -386,408-630
atgctaatttcgtttgtgaaaagcgatcagaaaatgcaaatcagtgaatattcaaagcaaaaatatgaggcacaccttggcattgtgcattttatgcggaaaaattggcaatgtgacaaaattgaggagaaatttgaagaatatgaacggacagaatgccaaaaatatcgcaaatattttaacattttgtacgaatgtatgtacagagaatatgccggaattccaacagtgaagccaaaatttatatttaagaaagaaattgaaattgaaggaccactgatttatgcggcgaattgcttggccactatttcgcaattttattttaaaaaatgggtgggacaaaattatggatataaattaaacgaatttttcgatgataattttgaactaaaattgttggatgtggagagattgaattatgaagtgaaattggtaaatgaaccaaaattgccaattaatgaaatgattttgcaattggcaattgacacagcgaatgaatggcaaacaaatgaaagtttagacggaatattaagagaaaattttggcaaaaaattggaggaaatgcttaaaaaagcggaaaaaggaaaaaacaagaggaagatggctatgatgcggatgatgatgaaatga

SEQ ID NO: 55128 - DNA, 1445 bp, Heterodera glycines
  Genomic contig location: Contig_ID=SeqID_4623; Location=1324..2768; Strand=-
  SCN-specific regions: Sequence locations=1-730,759-932,967-1008,1067 -1254,1297-1337,1400-1445
atgggacgaattgtcgagttacaacgctcacacggggagattcgaaacgccaaaattcgattggccacaggaaaggtgctaagccggcccctaaatcgtctttatcccttggaagtgacttcctctgccgaacaagatgagagccaccagcagctgacaaacccgccgcttgaggaacatcacaacagaacccaaacagcggactcaagtccaatttgccagctgcgtgaccggcgcaattcacctggcccgactcattctatggtcactcgctcaaaaaccaaagcactggcctccgttctgtccattctgatgtgcctattttttggcgcttcccaaacaaacgccagtagcacgactaagccaaaacgtgggaatggccttccaattcgttgtcgtggatgcgaactgacctgcacaaaaaccggcgtggacattttgatcccaaatgggattgccaaattcttgctgtgttgtgccgatgggactcagtgcatcactcaatcaggcgttcggaaatcctttcatcgtttgcccaaggaacatcttcttttcgactacgattgcgaagcaatgtactggacgaaacggggcaacaagaaattggaagcatccaatgtccaggccgagatgcttgcgagctcatcgattgttggatatgccttgaacgactggcaaatcccgattgtcgacctgacgtgacattcggactcattggcggagcgagcttcttcactttcctcttccttttctggattctgccactgatgtgccacgtcaccatgttttggatcctacagcatctcttcaccctgctcgttcgcttattgtgttgtttttggccaagccaaaaggcaccgcagagagaagaatcccctctccttgccttctggttaatcctacttatgctcaatcacctttttaataattgcattattatttaataataatatataaattatataagtaaaacatagatttggttaatcctacttatggtcaatcaccattttaataattacattattatttaataataatatataaattatataagtaaaaaattgaattgaattatcctgctgtgatcattaacaattttcaaatccatttttactccgtttaaaaggcagtgttatttccattttttcattttaataattaaattttctcaattttacaataccctttgaaaaaaatcaaattgaattaattaatgcattttattataatccaatagaattagtaatgttcaaaaatttaatatcttttttatacagattaattttattttttgggtttactaaaaagcaggatttaaaaggtctttcagtttcatatttaaaatttatttattttttcatttcaaaatatcaaattaaattgttttatatttaaacaaacaattttcagaaaatagaaatattccaaaaatgcgaaataaa

SEQ ID NO: 55129 - DNA, 806 bp, Heterodera glycines
  Genomic contig location: Contig_ID=SeqID_4624; Location=305..1110; Strand=-
  SCN-specific regions: Sequence locations=1-124,147-224,271-500,522 -602,624-806
atggtactgacaattttggcaattttttgcttggcatttgttcatattggcatttctggcaaatacgataagtcggacgagcacaatggcaaatatggtgctggtccccctaatcttcatcaatttttgtataaactttaaaatataatctttcaattacagatgctacaacaagcaaataggacaaaagagctgcgacaaccaattttgtgaatgtatggaggtaaattaatttttttaataaattaaaataaattaattttaaaataacaactaaattttagagggccactgctggcaaaaaacgttgctcaatttgggaggggccaggcttctgtcgtcactaccgcttatacggagaatcagcctaccgcgcagcggctccgtaagtgttcattcattaattagaggcaattaatttacaattgggagatagtagagttaggtgttagatagttaagtgttggtccaacaaggctatgacggagtcagtcagagccaatcaggaaggggagctatagccttacatttttatggcatttttgctgggactaaacggatttcttgtaaaaaataaaaagttccaaatatggttattaatgtttcacccatttccagcccattttggagcagttgtggcaccgttttgaacagcgaaaaatatttgggatgtccttgcggcacgtacaaaacatgggaacgctgtggttttctgtacttgggctaccgttacctgtgttattcgtgctgatcacgaggccgcgaagaggccgagtgagtaccttcggtgcaggaaaattattaaa

SEQ ID NO: 55130 - DNA, 505 bp, Heterodera glycines
  Genomic contig location: Contig_ID=SeqID_24401; Location=432..936; Strand=-
  SCN-specific regions: Sequence locations=1-91,113-224,246-374,396-505
atggtagccatccctttagtcaatcttaagatgttgtccatcctcctagcaaacggtatggggatggtggccatccctctagcaaacggtatggggatggtgtccatcataggattcatcactatacgcagggattctgaggctttcccgaagaggtaaacgaaatctgatttcagattcgtgatcagcgtcctaaataacctctaaagacatatttctggaagtttttgggcgcgaaaaaatttccccactcgaaaaccatgtgcacccccctatggtcccgaattccaaaatcacttttatttttataactttttactaaaaaatgataaaaacatgaaataaaatttatcaaatagagcaaaaaattgcggatttttgggctatttttattttacaaaatatcttttcagaaccgagtagtgaatttttttctgaaaattcgaaaatttccagaatttctggaataactttttttatattcttgatagaaataccaaataaa

SEQ ID NO: 55131 - DNA, 686 bp, Heterodera glycines
  misc_feature (24)..(24): n is a, c, g, or t
  misc_feature (61)..(61): n is a, c, g, or t
  Genomic contig location: Contig_ID=SeqID_24403; Location=1374..2059; Strand=-
  SCN-specific regions: Sequence locations=1-66,98-190,212-258,289 -389,411-455,482-640,683-686
gaggacgacttgcaaagtgtgganagtcaaatgaggtgggtttttttcgattgacggattntaatcaaaatttgaaaaaaaaattatttatttttttcattttcaaaaagaattgtcgcgctgacttttgccttgatcgtcatgatcatcagcagaatgggaatgcagctgatgatgatgaatgttgtgatcaggaaaaactcaaactgattgaacagcaggagacaatgacgacggcagaggcacaaaatttttcggaaaatttaaaaaaaaattttcaaaaattttcaggcccccctcgaagcaaagggtcgtccccgtccagcaatgttacaaattcacaccgttcagccttttcagtcggcggagaaagtgaagagtccagcacccaatgctgctgctgacgaagcctttcttggccaaatgcgcgaaaaaagttggcacaaaaaatgccgaaaaaaatttttaaataaattaatttggccaaatttcagaaaaagtggccggtctgatcgcccgtttcaatgcttttgcgccgacgacggcaacagctgtgaataatgagaacgctgctggtggtggtggttcgaattcgaaaaaaattggtggcgccgagccgggcaaagtgggcgaacttcgccaaaaatttaattgagaaaaattttaatttttgcgggaaaaataaa

SEQ ID NO: 55132 - DNA, 225 bp, Heterodera glycines
  Genomic contig location: Contig_ID=SeqID_24406; Location=635..859; Strand=+
  SCN-specific regions: Sequence locations=1-84,106-225
cttcgtgaatttgttgacggagctgacttcatggagaggattcagcagattatccgagaagaggtgttcgctcaattggccttcttttctttaaaaataattcaggtgaaagcattgcaagtgaaagcgaaacgagtggacaagcgcgaaattgaggaggaaagggcgagcccggccttctcttttagactgcacatgaattttacaaagttattcggcttttga

SEQ ID NO: 55133 - DNA, 328 bp, Heterodera glycines
  Genomic contig location: Contig_ID=SeqID_24407; Location=512..839; Strand=+
  SCN-specific regions: Sequence locations=1-51,116-170,192-278,311-328
atgggctgtgccgcggcaaaaacacaatttgccgtaagtttcttagttctttttaattaaatttaatctaatttaattattttttattaaaatttaaaattttcttaatttttaaggcattggaggattgcctaaagggcccagcacagtatttcaacgacataagccaaagaagcagcagcagaagtgccaacgacgacgacgagcaggacgaggaaatggcaaaaatgcgggcactgaacgaagtgtgccggcaaagggcggaggagcaaaattcgtaaaaaaaaattttgaaaaatttattaattttcggtccctaattttaata

SEQ ID NO: 55134 - DNA, 561 bp, Heterodera glycines
  Genomic contig location: Contig_ID=SeqID_24409; Location=1379..1939; Strand=+
  SCN-specific regions: Sequence locations=1-143,165-228,268-305,338 -428,450-561
atgacgacaaatgatacggacaaaaggacgacagatgagacggaagagaacaaaatgatgacaaatgatacggacaaaaggacgaaaaatgatttggacaaaggaacgacagatgtatcggacaaaaagacgacagatgacatggaggaggacaaaatgacgaaaacgaaaaatggacgagacggcacttcaacaatttttgtgaatactatggagaacgatgagaagtcaccgtcatcatcatcatcaaattcttcatcgtcatcaaattaccaaaatatggatgctcatccggcaatggatgagaagcaagatgaggaggaggatgaagatgaattgccgtccccggcatcctcaaatgagaggagggacgacaatggaattttttgttcatccacgacgatgaagaacaacaacgaaacatcaccgccaacatcatcatcatcactggtgactgatcggaagaacatcagcatcccatcatccgcttcatcctcatcggcattggcactggtgaatgatgatgggcggaaaatgggggcacaattagtggtgccggcg

SEQ ID NO: 55135 - DNA, 1425 bp, Heterodera glycines
  Genomic contig location: Contig_ID=SeqID_24410; Location=296..1720; Strand=+
  SCN-specific regions: Sequence locations=1-357,381-684,706-758,781 -1045,1082-1145,1167-1425
atgccgagattctcgacctgctcggggtttgtcgtgaatggcacacggataaaacatgcaaaatgccaaggttttcttgggcaacaatggcatttgtgccgagttcgtcgggaatggaatggcatgatatagaaagttttttgaatatcccttggagtctcggttttttactcaagaaatttctcggattttttgcaggaccgcacgcgtgacggtcaatgtacgccttgcggacctgacggagcaagaggcggaacgcgagcgggaggaagcggtgcgcgagcgacaattggaccagcagcaccacaaccagcagtttgaggtgcaacaggacgagccgtccgctcaactggaagcggatgaggaggaggagcaggacagtgccgtggatgatcggcaccagagcagaatgtcaccacaacacacggcacaacgccaacggcacaacaattttgatcgggacagtgataacaacaggagggcacatgccgtgccaacattggcacttgatggcaccggggccaaacaacctttacaggtaaaaaaatcatggcatctaatgcattctaaaatgccatggcacaagattgccagatggtcagtacccatggtgtgccaactcatgaacagtgccatttggtgtgccaaagtgccaaaacatgactcatatgtccacattgaataattgaatccattatttttggcacgatcataggcatcatttattaacaaatgattggcatgccaataatgacaccttttgaaattttgtttaagtttggcaacaaatttggcgatctgctaccatccgatgatgacgaacggcaccagcaacaagcggttggcttggtgcgcttcagtgccgacaaatacacgttccgtgcgcgcggacctctcgcggaaggccaaaccattggcatggtgcatgccaaacgcatggacggcacggacgaggcatgttctgtgtattattactgtacataaagcttttacagtaccctgctccgattactgtacttgattttcacaaacgaagatttttcagttttaatttgttatttaaatttttatagtaaaatttccttttggacatgttgtaacaatttctgaattataacattagaaactgggatagaatgcaaaagatttttcaaatccaatcatttttattgaccattttttgtatccaaaggttcatttttggcacagctcatcattctcgagaccgtgtgccacttcattaaaacagtaatttttattttacccatttttcagattgaatttgccgtcgaggaaggcattgccggctttgtcggcgtcgacgccaacacgggacgcctttttgtcggcccatggcttttgcgtgaccgttttgaggaaatccgcttttcagtggctgcccaacatccgtccggacaagtgctg

SEQ ID NO: 55136 - DNA, 2092 bp, Heterodera glycines
  Genomic contig location: Contig_ID=SeqID_4625; Location=37..2128; Strand=-
  SCN-specific regions: Sequence locations=1-216,239-424,460-639,661 -951,978-1444,1524-1797,1819-2092
atggcactgtttttgcactgggagtttgctgaatcacacctggatgttggcacaatcatttaccagctgaggacacgttttgcgcgctttaaagtgcaggtttgtttaagaaatttcttttatttttttattagttcgaaatgattctttgacgaaaaggtttgggaaatttcaaaaaaaaaacttttaatcaaacctatcattgataaattttagtttaaaaagaattctgttttcaactccgttcagaaggaagtgagcaaagaattgcggtgcaaagcgcagaccaaaattgagggaatgttgctcaaatgcaaagtgcacttttgcctggccctccgtttcaacgattcgccaaaggatgtcgcttggctgtccaattattttcttgcaaaaattggcgaaaaacttggggaacagcccgaaaaggttgtttaaaattttaaatgaaaaattttacgacaattttccaggttttggacttgtactaccattgtgctctcgcgttggaggaggaaggcattcaatatttgaccaaaattaaccgagtcaaacaggtaatcatggacgatagccctgtccgtttcggtttgcgacattttggttatttcgatacagtcatttgtcaagaagtaagtaattctttttgaatttcttccaaaattttttcatttcccaactacgtctatcgacggcatttcttgatggcacaatattgtaaaattggttattttagataaaaagaaaaaaaattagattgaatttgaaatggcattgtaaaccataaattctatatcgaaatgaggaatttctaccgaaaggcgcaaaacgaaaccaagatgtacccgatatcatggattttctggaaactataccattttttgttgtttaactcaactttatttattaatgacattttgcaccccctaacctttcccaattttttcggctaattaaatttagtttattaatgacatttcacccaatccccccttttcagacgtactttgaaccgttggagattcattacaaagtgcatgcctatgccctgcgttatctcaaggcactcaattcatcgtcatttcctccccgcacatccgctcaatgtgcaaccgatttggccaacattcacgcctatttgacattgttccgttatcatggtgtacagcgtcgctgcttggaggacagtcattggtccgtctcggaattttatgataagcaatccattctggacaaaagtgcattggacaagaacaaccgacagattagtgaacaaccaaagagcattgatggccgccagctgactgcagaaatggataatggagaaattgaagatgtggtgagtaagaaactcactcatcacatacaattaaagggcacagtcataaccaaaataaccccaatcctctctctcccggtgtgtcatgacatcgtactataagacaattttttaataaattaatttttaccaaaaaaataatgaattttttaaaataaaaagtaagtaaaataaaataattattcaaacaattcacaaattttcaaaatatatgattaaaaggggggggggtcaggtgctgctgataagtgccgccgggaattttaataaaagaggttaaaattttcaaaaaaaatgcccattttccgccatttttttgggatccacaaaaaaaattgctaatttttcttgaaatttttccaccttctcccttggattgagcctaattttaggcatagggtaaaatgactaaattttaattgcttgtataacccttgttgtacaataattatattccaaaatgcctttctttttcaggtccattcattgtgttgtgcgtccgaattgcaacatgaaattgtgcgaatgtgtcgcactgctttcgacattattctgctccgatttccccattacaaagcctattttcgtgttgcgcgcgcattttttgatgaaaaaaattttgcccgttctacggacattctttttgacaaattgtttttgaccggacggaaacagagatgcaacaatttcttggaggtacaatggaaaatgtggatgaacccaatgtacttctgttcatttctttcaaaatga

SEQ ID NO: 55137 - DNA, 2616 bp, Heterodera glycines
  Genomic contig location: Contig_ID=SeqID_4627; Location=309..2924; Strand=-
  SCN-specific regions: Sequence locations=1-254,278-373,395-713,834 -1605,1627-1748,1772-2304,2333-2616
atgcggcagtctttgatgtctgatgagccgaatgcaatgacattgttggagcaaattgcgaccacggagacggaaatttcggaaaaccaaaacgcgatggagaggggggacaccgatgaacaacaaccacaaaacaatgagtctcacaatgagcaggtaggtgtggtcggtgaaatgcatagatgaaagagaggcagggggggggggaatcaaccaaaatcaatcaaaggggtccgagggaggggggatcactgccaatttttgaaaggggacccagccatgtgtaaaactgtaaaccacgaattttgattccgcacaccaattttggcgttttcaataaaaaataattacggaagggggaagggtacggcggaaaaattttgaaaaattgagttcaatttgttaacagaacattttagtaattgggtcccattcgaggaaaaaatttttgttttttgaattttctattaatgaactgttaagaaaattgttcgaattgcaaaaatttcaggctacaatttgggaccggcaaggagtgtctatgtcccaagaaagtgaggcagccgccggcaccaccgccatgccggaaactcaagacgaaatcagtttacgccgttctacacgtttattcgacgatttggattattttggaaactcaaacaaacagaggcaaacacaggccaacgattcacgcatggatgttcgtttacaccttttttataattttttctaaattataataaattactaatcgaaaattttccaaaaaaaaattcaaaaaaatttttctttggttttttcaatatattttattattaataaataaaaaaaaagttaattctttttaggcattgactttgatgggatttgatgaacaagagttggaagaacatcaagcttcggtgtccaatcaccggcaatccatgcagtttatgcccgatgccatcaacagcccgcaacagttgtcaagtgttgatgaacttttcgtcaaattgattgatgaaacatcatttgaaacgacaaaattcccggatgttctctacacttttcttgcttgggttgcttttgaacagcagccatttgttgtcctaacattggagcaggtcgaagcctaccggtactgcttttggttgttttttttcgccacgattttttcaaaaacaatttttgaagggtgggacacggcggtgccgatgggattgacaaaaactattttttagtgacgtctatgcccggtggagcagtctgttctgtttgtcaaattgttcattcaccgagtcagatttggcaatacaccaattggctgctgaactcggctcacatcgggcactgtccattctgcaggcattttatggccgacttttgctgcaacagaaacaaaaagcaacggcacacgcgtcaaatggcaaaaccattccaattagagagaatgctgaagaaaatggaaatgttacggaatatcaatttcaccgacaaacatcagtggacgacgatggccatgcacaacaaaagttgttgcttaccagcgacaacgacgcactgttccgctgggtgttccatcgaattcaagctgagcagcggcagacacgacagactgtggctggtaacaacaacaacaacagtcggtcccctacgggtgtgcttttgttttaaaaaaaattcatcaatgttatttgaggcgacccttccccccccctcgccaaaaaaaatttttcacacattttttgaccaactaacctaaaagtcttcaaatgtcattttcagcttttgtaaacatgcttattttcagttattggaagaaatgaaagcattaacaaaaatgatgataatcacttgggacaaccaaaagactgctcagaactctcgaccattcgcagacagttggaggtgcgctataaatggtaatttaaatttaacatctaaaatgctatttctaatatccgaaaaaaaaaaatttttgaaatgccaaaaaatatttaaaattgcttagaatttttaatttttttcgtgcccccatgctacgggcctgaagtcatattactttttttcaggttaattgccaaccttttgcccgacgagcttagcctgcccaattcggaggctttccacttcattcacacttacacacagcttacttctgctttggctctcatggagccggaatgggcactgctgagccatgccgagttcgacctcagctgtttgactgtccgaaatttgaaggaattgttgcgcaaaagggtgcgacaattccaactgcaacaaattgactacctaattgaagccaaacgatatgaggaggtcatattaaaaaaaaataaaactataaaatgaagaaaaagagtttgaagatctaaaaaacgaaacccgaaaaaataagaaaaatttaccgcaaaaacttttttgaaaataaaaaaatgcataaattttttttttaaaagtgttgtactacgataatttgtcatcggtcaaatttcagttgaaaaatgtcctcctccaccagtacgattggacatcggactcggaggatgcgcacataaagcagaaattgttgatgatccaatgcattcgtgagacggacaactctcttttggacattggtgaatggatttccaa

SEQ ID NO: 55138 - DNA, 2000 bp, Heterodera glycines
  Genomic contig location: Contig_ID=SeqID_4628; Location=59..2058; Strand=-
  SCN-specific regions: Sequence locations=1-221,246-509,542-962,984 -1015,1037-1275,1298-1610,1645-1681,1705-1751,1773-1943,1983-2000
atgtttcctccaattttaacaaatagaacactgaactcaaccaattcaacgccacttaatgacgatgatggacttcaacaacattcacactcattaagtcccataagtaatcaaaagtttcagcgcttttgcaatttagtggatccgatgaaaacccataaggaccttaaaatttgtaattttttttagttctttgcaaaattctatcgggtcctctaaactaatttttttttttatattaattacctaaatatttgttttttcaggccaatctgtagctgtaaatgttcacaccgattcgtcattggctgcttccaccgtaaaagaagcgtcaaatacacaatttaaactgttttacacttgccctgactgtcctcgtgatcaatccccggtgcgctctgagtgttcagattatgtggacgacgattggtcatccattgaagatggggacaatccacgaacatctcgtgaagcacaagtaaaactcactcataaactttttgttttcctaataatatatttattgtaattttttttttttggtacttttatattttgtggcccgaatttgagccattgaactcactgccaaaatgctggacctcctttttgtgcgagttccttctatccgtgccacaaaatgaaaagtgaaatttttttatgatagaaaaggataatttctgtttcggtcaacaaaaaaaaatcagctcccagcttaggtttaatcagctcttaaccgcccaaaaaatcgaatggagaatccgaagaatttttctttgttcttcctctaaaaaattttcaatgttatttttttccaaaattatagtctctatgggcgaaaaataacactgttttaatagttattcgccttaaactgactattttttcttctgaattttcgctaggcgccgtctggaatttttttttcattttcgtcattaaaaaaaaaccttttaggaagcggagattgaggacaaataccgaagtgctttgaactttttgcaagagggaaacattgaaagggctgtctccatattttcggcacttcttgtccacccggtgatgtccaaatatcacatcgctgactggtcaacatttgattggcaaaaatcaatgactgccggcgacggcacttcatcgcaacgaattgtgccaaatatggcaaaactgtatttcaacatcaatttggccatgagtggactggccaaggacccgttccaattttatgtccaggttggcaagtttttggcactttacctgttgagatagagccccaaaattttttttttttaaattactaaattcctccaaaaagggtccaccctttgcaatttttcggaggcctccaatagcaaaaattactaatttttcacattacactgtttttttgttgttgccaggctttaagtataagaccggatttcaaagatctgtggtttaattgtggacaatgtgccattcgtcgaagggattggcggtccgccgctttttgcatgacgcaatgtgaagacgaatttcgtgcgttggaagcacttttgctcgtccattatttcaacaacgattaccttagtaatttacaattttgtgaaaaaaaaaattgggtgaaattcatttatattttttaaaacaaaaatggactatttgtgttgtgtctgaccaacacttataccaaaactagagcaaattgggattgggttttttggacaaagtttatttagacaaaaataagttaaattggttaatgtggtatgtcaaaatgtgaatgaaaaactgagaagagaagaaatccaaatggtgtccaaagatcgggaaaagggttttaggagagaaaacacaagaaacaaaaagggttaagacgaagaatagtcggcacatcaaaaaaaagacaaagagaatgttttttgggaaatgcccgaggggatgggcgaagggattagtttgggataacaaattcaacatcaaagggaagaaagagagaagagcattgtaaagggaataaa

SEQ ID NO: 55139 - DNA, 570 bp, Heterodera glycines
  Genomic contig location: Contig_ID=SeqID_24413; Location=597..1166; Strand=+
  SCN-specific regions: Sequence locations=1-570
taggctaatagagcctgtgaagagctttcgaatgatatcaagattgttttattcggtccataacttcaagagttatattgactcaaagttggctcagacggagttggccagacggagttggccagacggagttggccagacggagttggccagacggagttggccagacggagttggccagacggagttggccagacggagttggccagacggagttggcccgttcggagttggctcagacggagttggccccaagacggagttggcccagacggagttggcgagacggagttggttcagacggagttggccagacggagttggccagacggagttggctcagacggagttggctcagacggagttggcccagacggagttggccagacggagttggccagacggagttggctcagacggagttggccccaagacggagttggccagacggagttggctcagacggagttggcccaagacggagttggcccagacggagttggcgagacggagttggctcagacggagttggccagacggagttggccagacggagttggctcagacgga

SEQ ID NO: 55140 - DNA, 484 bp, Heterodera glycines
  Genomic contig location: Contig_ID=SeqID_24414; Location=553..1036; Strand=+
  SCN-specific regions: Sequence locations=1-231,253-484
ctgttatatctgaaatgatagatcattaaatagaaaggaaggaaaacgtttgggctaactcttcgcttcttcagaagaaaatttattgatatcattgtcctatcagataatcgcgggcgtagaatttaaaaaaacaaagcaaaagcataatctattaaatgaactaattaaaagcagaattttttaagaatgtgcctgaatttgtctattaatttgtggcccgttaaatatgttttttcaataaaagcacatcaattttgaaaaaggacctagtgcagaaatgcgtatcgccattgtttttatatagacaatttttacggcgactgcctgaacctttcttgaaatttgagaaatttgttcaattactgacgcctttagatgtacggctattcttaatatatagcaaaatacagaacattttaatagaatagaatattttttaaatagatgggcatttattgcgaatatttgataggcaaaaaat

SEQ ID NO: 55141 - DNA, 682 bp, Heterodera glycines
  Genomic contig location: Contig_ID=SeqID_24415; Location=570..1251; Strand=-
  SCN-specific regions: Sequence locations=1-409,431-544,567-682
atggccaattggcaaatgcgcgagaggacaaaagccggcacaatgtacaaatggtaaagcagaaagagcggacggatgcgcaggtaaatcaccgccgcgtcggcaccgaacaacaaaatgtaaccggcacaaatggacgcgtcgagcagcgcgagcacgcgcgggtaaagcgtggcgggcgtattggcacgtgctaacgcggcgcgggaggagaacagcacaaaaagcatggcattggcagccgcgccgaacagtgccaacacggaggacagcgagaggaagaggaagcgtgccaaagtgtacatttcgtactgggggagagaggggaagggcatatcgccaaacgaaatttaaatttgagagataaaatgtacttctccacaaagttgttgctcttccgacccttctccatcatccattcccaattcttttggttaaatgatcgaaggggaattagccgaacgaatcagttgcaaattggacgaatgagttgaaaattggcagccgaaagcttttattggttaaaggaaaagcacatgccaatgcaaatggaaatggaaatgagcaatttgacgagccactaaagagtaaattcgatatgatttgaatttcgaagaaacggcgggggaggggaagaaatgacaatgattttctatggtacagcataaaatgagacaataaa

SEQ ID NO: 55142 - DNA, 956 bp, Heterodera glycines
  Genomic contig location: Contig_ID=SeqID_24415; Location=870..1825; Strand=+
  SCN-specific regions: Sequence locations=1-924,951-956
gtggagaagtacattttatctctcaaatttaaatttcgtttggcgatatgcccttcccctctctcccccagtacgaaatgtacactttggcacgcttcctcttcctctcgctgtcctccgtgttggcactgttcggcgcggctgccaatgccatgctttttgtgctgttctcctcccgcgccgcgttagcacgtgccaatacgcccgccacgctttacccgcgcgtgctcgcgctgctcgacgcgtccatttgtgccggttacattttgttgttcggtgccgacgcggcggtgatttacctgcgcatccgtccgctctttctgctttaccatttgtacattgtgccggcttttgtcctctcgcgcatttgccaattggccatcccttatatgtacgtgaagtgccttctccgaatgtgtgccatttttcctttcctttttaggctcattttcgccactttggagcgcctcgtttggattagcagtggcaaaatgtgcgcaattttagccccaattaacttttaattgccttttcagtcgaaattcgctcctccggcgaatgtattccgtcaaagggcgccatataaccgtggtaatttcgtcctttctgttctttgcactttgtgccaatggcttttcctcaggcttttactctcggcgcgtgtgccattctccgtttgccaacttattgggccaccacagtccacgaataccctcaggcagctttttgaattcaaatttattcaaaggcatttccaatttctgtgttcagtgcgacgactttttccgcacaaaaaccgccgggcccgccgattgggtgatgaactcgcgctttttctacgtgtacgacttccacttgctgtccatcgctcaaaccgtgttccccttcttcgtcctggtcgccttcaatttggtctgttctcggcttttcctcttcctttcccccctcccttttgg

SEQ ID NO: 55143 - DNA, 1045 bp, Heterodera glycines
  Genomic contig location: Contig_ID=SeqID_24416; Location=58..1102; Strand=-
  SCN-specific regions: Sequence locations=1-16,38-119,145-1045
atgcaaaatcagcctcccaagcatccctctctgttttccattgaccaaattctatcggccccaagcaaaaagccgcgtcgcggcttcctcatcaatgaattgcttggagaggtgcttcaagagggcggcagcagcagcagctcatcatcatcaaagtctgcaaaggactacgtcaaaaagttggacagcaccattgagcatgtgccccgcttccagtacagcaaagtcaagtcgcggttcagcattgaggatgtgccagcagcaaatcctgagggactcctggccggcatcttccagtactgtcttgacgcagcgatggaggagagtcgtggacgtggaattgaacccactcatctcggctgcatgatcagcagttcgttgctcaccggcggggacatccccattccggttcgacaaatcacagacaacaccgtcaacaccatcctcaaccagttcaccaaagtggcacagagcaagcagcagcaaaacgtcacactgtggggcgagccattcactgtggtggtgaccacagttgaccgtactggactgcccggccgaagggtgctgaagggcggtgctcgacgaagcctagcacctgtgcatcataaggtgacggaaacttgtttgattaaggtccaaacatcacaacgaaagaataatttaagtgaaaattttgttaagatttgcaaccccgacggacattgcctcttctacgccttgcaggcgacaatggtggacaaaacgtgcggttggccccgttggagattttacgactacttgcacagtcggaggggacaacagggatgtctgaggcgggatgctttacaactgatgcagcaaattggtgtacagaccggtcggaacacctatgatgctgagatttgtgtgccgcgtgtggtcgaccactggaacaacacgcagcagcagcaacgatttgcagtgttcatctttggctcatcgggacaatacaagcccttgtacaaatacatcaacgatcattacgacacccccattgtgccctatttgaacaaccagcattttgatg

SEQ ID NO: 55144 - DNA, 893 bp, Heterodera glycines
  Genomic contig location: Contig_ID=SeqID_24417; Location=1316..2208; Strand=+
  SCN-specific regions: Sequence locations=1-626,650-738,760-826,848-893
atggaattggatgaggaatccaaacacctttgtggaataaacacccaccgtggcctcttccaatgccagcgcctcccatttggcgtcaaatctgcgccgtctattttccaacatttgatggaccaaatcgtctcaggcatcccaggcgcatttgcctacctcgatgacggcataatcgcctccaaaacgcttgacgagcacatttcttcgctctacaagcttttcaaacgaattcaggaatttggcctcaaaatccaatgggaaaagtgcaaattcctccagcccgaattgctatttctcggccacgtcatctcagcgaaaggaattcgccccgaccccggacgatcagaagcaattcgccaaatgccgccaccacatgatttgagcacccttcgctcgttcctcggcgcattgaattattatggaaggtttataaagtccatgcgcgaaatccgcgaaccactggaccagcttctgcgaaaggacgtgaaatgggaatggaccgacgaacagcaaactgccttcaaaaaggccaaagaaatcatgctgtcggatcttttgctcacccatttcgacccgtctcttccaatcgtcgtggctgcagacgcctcaaaagacggaattggcaccacaatcagccacatttttccggacaaatcggaaaaagtcattgaacacgcgtcctgcaccctcaacgacgcacagaaaaactacagccaaatcgaaaaggaagcattggccctcgtttttgcggtccagaaattccaccgaatgttatttggtaggaaattcacacttctcacggaccacaagccattgctggcgatttttggctccaaaaagggaataccgatttatgcggcgagtcgtcttcaacgctgggcactgatcat

SEQ ID NO: 55145 - DNA, 65 bp, Heterodera glycines
  Genomic contig location: Contig_ID=SeqID_24419; Location=588..652; Strand=+
  SCN-specific regions: Sequence locations=1-65
atggctatctcttttttctcttggggatttgaccgcaaacttggtaccaacatttgccttctcta

SEQ ID NO: 55146 - DNA, 59 bp, Heterodera glycines; identical to SEQ ID NO: 52421
  Genomic contig location: Contig_ID=SeqID_24419; Location=116..174; Strand=+
  SCN-specific regions: Sequence locations=1-59

SEQ ID NO: 55147 - DNA, 59 bp, Heterodera glycines; identical to SEQ ID NO: 52421
  Genomic contig location: Contig_ID=SeqID_24419; Location=246..304; Strand=+
  SCN-specific regions: Sequence locations=1-59

SEQ ID NO: 55148 - DNA, 59 bp, Heterodera glycines; identical to SEQ ID NO: 52421
  Genomic contig location: Contig_ID=SeqID_24419; Location=376..434; Strand=+
  SCN-specific regions: Sequence locations=1-59

SEQ ID NO: 55149 - DNA, 59 bp, Heterodera glycines; identical to SEQ ID NO: 52422
  Genomic contig location: Contig_ID=SeqID_24419; Location=766..824; Strand=+
  SCN-specific regions: Sequence locations=1-59

SEQ ID NO: 55150 - DNA, 59 bp, Heterodera glycines; identical to SEQ ID NO: 52421
  Genomic contig location: Contig_ID=SeqID_24419; Location=896..954; Strand=+
  SCN-specific regions: Sequence locations=1-59

SEQ ID NO: 55151 - DNA, 1187 bp, Heterodera glycines
  Genomic contig location: Contig_ID=SeqID_24420; Location=1145..2331; Strand=-
  SCN-specific regions: Sequence locations=1-97,119-163,185-215,238 -268,331-345,369-1187
atggccaagggaatgacaatggaaatggcaacagaaatggcaatggaaatggcaacggaaatggaaaaggccaggggaatggcaacggaaatggccaagggaatggaaatggaaatggcaacggaaatgtaaatggccaggggaatggcaacggaaatggccaagggaatggaaatggaaatggcaacggaaatggccatggaaaaggcaaaggccgtgggccaacaacgccatcgccaacagtgagttcccaatttcattaattcccttttaattaaaaacataaaaaataaaaagctattagaaatttaatagaaatttatattaattgccccattaaattaattttctgtttcttttcctttttccatagccttcaccccccaaattccgtttgtgctatgacaaccacgagtgttgcccactatgggcttcgaatggcacctgcgggatggcaaagatttccatgaacaatttgtgcccggcctcatgtcgctatgacggatgccaaccgtaccctctggcgttctttcccggtaattaatagagaaaaagcgtaggagcgtgccaaatattgaagattaagcgccataaggaaacatctcgaaaaaggcttaattactatattaaggttgtttggacattcacttgcagtgcttacgctggtctttgcttgacctactcccgggctatgggcacggccacaaaggcaaccaatttaaattcactttgatctaagtggaattctcgactcgaaagtcgagaaatttttatcgtcctttgggggagatgttaaccaataaattatggattaattaaaagttaactatatttttatgaaaaattcaacccgaacacaaaaaaataaaatattttagggaagcctataaagcaaaagaatcccaagcaaattccgatgaaagaatgtgagcgtaacccgcatttcatggctcgtaactgcgcaagaacatgcaataagtgtggtgaggcaaaccgggagagatgcgcgtgagtcccttcttaatagcattgtttttgcactaattgcatttttaataattaattttgcgcttttttagaacactgacccccgtcgactttgtggatggggaagagtcgtactactgaacgatgcttcgaatataaacaacaaaataacaactgatggcttattgaatataattaaa

SEQ ID NO: 55152 - DNA, 404 bp, Heterodera glycines
  Genomic contig location: Contig_ID=SeqID_24421; Location=126..529; Strand=-
  SCN-specific regions: Sequence locations=1-63,100-264,286-404
atgggagtcgaaccaaggcagaaatcacagagaatgaaccaaattagactgtaagtttttcacttttttaagtttaaaagttaaattaaattattatttcctctcttaaaatatttctctaaattttcaaaaaaaatattttctctacccccctcctccccctcattcttaccaatgaataaaaatctcgtgtctcgttcaaaaaaagagaccgagacggcattaaaccaagagaatacgagacacgataaaaagcaacatcccatatataaataaaatctttaatatagcatggttttatgcttggtgaaacattggcgccaagttgcgtatttgatgaaggatggcctgcttctgattgttgtagagaacattatcgacttgactgctgcgcgattacaaaa

SEQ ID NO: 55153 - DNA, 1358 bp, Heterodera glycines
  Genomic contig location: Contig_ID=SeqID_24421; Location=581..1938; Strand=-
  SCN-specific regions: Sequence locations=1-23,45-121,144-152,174 -205,227-299,321-381,404-460,499-790,840-1173,1195-1197,1219 -1279,1315-1358
atggacgtgtaccgtgaaatgcgagcaaaggaaaaatgcaaggggaaaaccatttgcctttgcgaagccaaaaatttcccgtaagtagaaatcttctttaactgtacaaattaattaagagaaaaaatttcctacaacattttgctcgagaggggtggggggtggagtggctgaataggcattttgaaatatattattaacatttaaaagctgcattaaaaaattttcagtcagagttatctgaagggtgtttgttgtgttgtttgggggcaagaatgtgactgctgtaaaacggtaaaatttaataaaataaccagttatgcttatttgaaaaacagggaagacccaaatgcaagaaatgtataactgaaaaattggtacaaagtaaaaaataataataacgcgaatttaaaaatgcgaaagagaatcccgtgcaatgaatcccgggttgcaaacattgaataattagttaatgtttattaaaaaaataaataaaaagttttttggtctaaaataattaactttttttcgtctaaaaatacttaactattgttttaattgtactctacaatatttttaggaccctgaagttttacaacaatccacggtattatctcgaagaatgtttttaatatctttttctattttaatactatcattaggaagcgcatcgaaggtataaaacaccaaaatgtgatgctatggctaaaaaattgaactgcaaaaacacccagtgcaaattcgaatgcggaggtaaaaatgcagtcaatgttaccgtatgttgtttgtgtaataaaaagaaaagaaaattttaaatgataattatatatttttaatttgtttcgaataagcaaaatttttaaatctaaattcttatcaaggaaaaaccaaacaaattttgacgatcaaaatgggagttttcggaaaaaaactccaaaaaaaggggatgaaaacaccaaaaggtctcaaaatatgctctaataatatgcgattttttaagtattcaatgagacttacataaatgaatcttgtctggagaaatgctaccccttccctcgcttgtgcgatcataagtgccgcgctacaattgagatgaataagtgcaacattccttgctggagacctactggcaacctaccgtatgatcacgctcgaccattttgcaaagatgtaatatatatattttggattaaatttagaatattttaagtgattttaggtccgggaatttcggaatcttgtcacatttttgttacatgattagcatcgacaaaaattggattttgactctgtttaaaaagtgaaaaaaattaattgttttttttgtttttggaggttgaaaaattttcgtaaataaa

SEQ ID NO: 55154 - DNA, 812 bp, Heterodera glycines
  Genomic contig location: Contig_ID=SeqID_4630; Location=362..1173; Strand=-
  SCN-specific regions: Sequence locations=1-536,559-638,660-694,718-812
aatccgatgaacaaatggcgcttggacctttgtgggtccgccgggtcgcggacgttgatgctgagaagtgcagcagctgaccagagtctgaacccgcccggttataatcccggactgagcactacacaacaagtgggcacgggatgactaatgaccataacattgcctcatttaagaatgaatcggccaacagagccgagcaacagcagcagcatttgttgagcaaaagggcgtgggatttggccctgcagccggtgaaatccttgccgatgaatatgtgggtgaatatagggaaagtccggtgactgaatctaggctgccctttaggtttatgatgtacatggcgggcaacacaatctccattttcccaattatggtcggttttcatgactattggtcaaaattgacatttgggcggggaatggtgggtgctatgacggactttgcccatttgagatggtcgtaatgatggcgtggagaccgatgaaaactttgatgtcagtcaatgctgcttttaaaccgctggaggtgtctaagcaatgaaagtcccttttttaattcatccctttaagcaagagcatgtcggctcactttggatccacaaaattgtttttgccttggggaatttatgcgcaattgcattggccgtgtacaaatgtatgctttttcgttaactttatttatttaacgttaattatttcaaatttcaaggtcacacgatgggtcttctcccaaaccatgcttccgactggctcgattttgttcctcccctcgaaagagctcaatatgcactgtttaatgacatctaataa

SEQ ID NO: 55155 - DNA, 4069 bp, Heterodera glycines
  Genomic contig location: Contig_ID=SeqID_4630; Location=2585..6653; Strand=-
  SCN-specific regions: Sequence locations=1-56,78-135,157-392,415 -473,495-661,683-710,732-1530,1566-1761,1783-1848,1872-1921,1953 -2332,2354-3764,3786-4069
  Gene Ontology: Mol. function=NADH dehydrogenase activity
atttcaattgatcctgtgccaaaagtgtgccattactttcactttcattcggtttggcttatttttgttgattttgttctgttgttgctggtggcatttttcatccttttcctatccaaggccaaaaacgactctaaaagttggcattttctctgttattttggttacatttattctttcagagaatggtaaaaagggacctcaaatggaccaaatgctcgtagatgaaactctaaacaattcttcccttcctgacattgggaaaaatgaagccaaatttcgtgccaacgaagcaatggtccgagatgaacaaggccaactctctttttcgcagagatttgtcgacggattgacccgtcagatctctccgctttttctgctgtttgcttattttggctgcgttttgagtttttaccctttggctgagatggatgaaagtgatttgctctccgcccaaattaagtctgttgctttgcttttccatttcccattttcacaaattgtgaatttcagctgttctctgtccgctctttcgaatgaccgatggaagggcaatgagcatttggaaaattgtcgcgcgatccctcggattccgttttggcattacgccaattcgctcgccgtcgtattccatctcgcccttacactttgtgtggtttcgtactatttgacaaaattgcataagtcgaaaaacgatgaaaaagcaaaaagtggggaggaagcggaggacgacgacaacaaaaatgaattcgaaatggacactttggagaatggggaaagggaagaacgtcggcgaacgaacggacccagaacgaatcccagcagcagcgacagcaattgccgagcatcggtggctgattcgatgtattcgaatggatatgccgcaatcgattgtatgggatggccaatgggaaccgaactaatgattcattcattagcatcaacaaccaattcgatactgcataatgtggggaggaataggaggcgaaaactgagcagtttggaaggggcccgaggacggcacagatcgcgagtggagcggggacagttgtcgtcactcaggcaaaatgggccgaatgacggccccctcggaatgcatgccgccactccttcgctctactcggaatcgctctcagctgagtatgagctgaggaatcagcaactcgtaagaaacagaggaggaattgtgtccaaagtattctgattgccagcccatttctcccaatggctctttacccggcccaacatttcttggtgttcctcctcttcagctgcccgtggcagctccaactccacccgcgcccgtgatcattgtccaccattggcatcagtattgccccactggttcttgctattacttcctcaatttcattgcttttcgtttcttcagatggtgttcattctccacagaactgtggcagtcaccagccgaatgaggggggaggaaggaccgaatttgcaatgggaaaggagaacgaaattaatgggccggaggggaatagcggcaccaacggaatggaggaagggacggaaaaagtgaaggaggaagaggaggagacaaccagcgaaggttggatggcttttacgactactatttgcacattaacctaattgactacttattggcacattaaccgcttcccccccccccatcattaaggctcggattacccggtttccgatcacgacaccgccgactcaaacgatttttgctctgacaaccccgaccctgctgaagagcagttgtggaatggtcgtgcctttttaaaaaactaattttaatgctttttgtatgatttagaaagttgtcaaaaagccgctcaaagtcagcagcagtcggcgaaaatttgaagagagtgcgaaaactttggcaacaatttacactgactgtttgtgcatggcaactcattcaaaactggcctatttattttagaatttatttatttatttttctttgttcgtgcgtttcttttaccattaataagggtccataattttgtgcttttaattgtttaccctttgatctccatgtgaattctcccgcgttaattgtccaactcaattgttatcgttaaaaagcaattatgaataaaaaaaggtaaattattcaaatgcgtttctcccaatttatgttttgttcatttttacttcacttcccttcactgttaaagtgtgtttccctttttttggcttattatgtttgctaagcatttgcgcaatttcccttttggctgttcttttgctgcgcgtcccttgaggcgatactcaggtggagcatttcgttcattaattgtttcttcatacgtattcctttcattaagcccatggactgcaggtgcacagggacaacgagcggaacaatccgaacacgcctttccaatttacggaagccaatttggccaaaattacggtgctgttgaacaatttcccggagggacataaaggagctgctctcattcccgtgttggacttggcccagcggcagcacgggtggctgcccatttccgcaatgcacgaagtggcacgtgttttgggtcggccaacgttcacccttcaattagtcaattgtttcttagaaatgcctcgaatgcgcgtctacgaagtggccaccttttacacaatgttcaacagggaccccgtgggcaaatactttctccaggtgtgcggcactacgccgtgcatgttacgcggcgcagaagcaatcatcgaggcaattgagaagaaattgggttggtcaaaaaggcgaacttttaaccctttttatgcaaagcgaatttaggcatcaaaaagggagggacaacggcggacggactcttttcgctgcaggaggtcgaatgtctcggggcttgtgttaacgctccgatggtgcaggtctaattgccatatgggttctgctttgtaattttggtgtgaatttgacagatcaatgacgattactacgaagacctgacccctcgggacattgaagagataatcgacgagttcaaggcgggcaagcgacctttgcccgggccgaggagcggccgtttagccgccgagcccctcgccaaacaaacgacgctgacggagacaccgccggggcccggctttgggcttcagcagggattgtaaagatcgacgttgaacgattgaaaagacggaatagactcccttctctctttggtacacaaacgtatataagcgttctgctatttgtcactattatacaatacgcatcattaactttttgttgttttgtccatatatttaccatattatatttacagtatcaaaagaatatccttaaaatttctactgaagattttaatggaagctgaggcggatttcgattccggattgctcagtacggaagtgagtcatcgacggcgatccgcttcagtgtctgaggattattcggtgcaaaaaacgaacgacgacgccacggaatgtgagtgagttgttcaaccggttcaagggcagtaatactgacttttactggtcccataaaaaaaagaaaaaaaactgtttttttgcggttcttcggtccactcgggggttatcggggccgctgatcaagaatatgacatccatttcgaccaattactaaacccgggcccgaattcgaacagaatcgagttcaacttttcgaaatttggatttatgtttcgaatcagcgaccccgacaatgtccactttaatttggaaggggatttgggggcgttactcaaaaaccctcaaatggataatttttggtataatcaaaaaacataattttcaaattttgatcatacttatttgaattttaatcttataacatcaatcaattccgatagtatttgctttccccttttaggcaaattcgttgctgcgcaggtgttcctttcaattttcaagattaatcactgtctttcttaagttgggttactactccgatagatttatcccggctttcatccacgcgtgcaattcggagaagccccaccacagagacccggagatcactcgtggctattgggcccggacaaacgcaatcacttcgatggtcgttcaatttgttcaggcactttctgtccccattgtttccgattga

SEQ ID NO: 55156 - DNA, 186 bp, Heterodera glycines
  Genomic contig location: Contig_ID=SeqID_24423; Location=159..344; Strand=-
  SCN-specific regions: Sequence locations=1-186
atgggatttatcattgatgatatgaataaatgtctgtataggaaggacttgttaatgtgtctagaattgtcagatgaagcgaaaaagacgtttcagattgtcgagaaatatagagaagacgttggcactgcgtaccgtaacgcttatacacagtctgacctcggaatcggagaattagtcgataag

SEQ ID NO: 55157 - DNA, 76 bp, Heterodera glycines
  Genomic contig location: Contig_ID=SeqID_24423; Location=673..748; Strand=+
  SCN-specific regions: Sequence locations=1-76
atggcatccaaagcgtttggagttgctttcgtctggcgccaaccaaacggtggtcagatggtcctactcagattcg

SEQ ID NO: 55158 - DNA, 1475 bp, Heterodera glycines
  Genomic contig location: Contig_ID=SeqID_24426; Location=361..1835; Strand=-
  SCN-specific regions: Sequence locations=1-66,88-1475
atgccccctctgccctcaatgcgcgtcaaaccggccaatccctttgagtttgtcggtctcgattttgccgggcccaccccctctcggctaagcgacggatcactgaccaaggcgtatttggtcatcatcacctgtttcgtcacccgcgccgtgtacctcgaggcgactaccgacttgtcggccccaagcttcattaatgtcttgcgacgattcttcagccgtcgtggccgaccaaggcgaatcctgagtgataacgcccctactttcgtccaaaccagcaaagccctcgacattctaaccggcccttcggccgaaaccgaccccgtcacatttgccgcgcgccgaggcatccagtgggacttcattcccgcctactgtccatggatgggagcttgctatgagcgcctgatcggcctcgtcaaatcgtgtatcaaaagaacaatcggccggcggattcttgactacgacgatctgagtgccttccttgccgaaattgaagctagcgtcaacagccgcccgatcacatgggtgtcagaccaaccggactcggcaaaacccctcaccccgaaagatcttatccaacccggcctcctcaacgacctggacatcgtcgactctgacctcgactatgacgactgcctttccggtcccgagcgcctcgccgccctttggaaggcttaccgagaagccgccgaccatttttggctcaaatggagtcatgagtacctcctcgccatcagagagcgcgccgcatggactcataaaggtccccgccttcgaactcccgccaccccccacatcggccaagtggtcatcgtcgaaaccccggaacccgccccggacgccaccgtacctatcccgtctgatcaaagccccagtgactccaaaaacgtcgaaatgtctgtacatgaaatgccgccggtcccctcactttctggagaaccgacgatcagtaagcacagcggcatgcttacgcgacgaaaatcacggcttttcgcgatccctcccaccacaacaatgaccattgccactctcgtcactctcctgtgggtccaagcctccccagcacaaggaatctggccattcgatccggaccgtcccgagtcacccctaacatctaattgtgtcgggaatcacgtcaattgcacccgaaaaggcgtcaaaatctcgtcaaatcctgcggtacaaaaggtgacaatttgttgttcgaatgcctgctttgatcgtctcgccgcctctgagatcagctatgagttgtcctccgacctcctcgtcaacgagtatgtctgctccgcgacattcggtctctcttcgacccgcagctgtaccgccgaaattgcctgtccggcggtcaacgaatgtgaattgatcgattgttctatctgcatcgaccgacccgccaattggcggtgtaatccccggctctcccttgtcttacttctggtcattgggtcactgatcagttgtctgatcgg

SEQ ID NO: 55159 - DNA, 1679 bp, Heterodera glycines
  Genomic contig location: Contig_ID=SeqID_24427; Location=486..2164; Strand=-
  SCN-specific regions: Sequence locations=1-791,813-886,908-965,987 -995,1032-1583,1626-1679
gcatctgctcggatttgcaacacgaggattactccccgctgtacgcctggttcaactacatcgtcatcatcattatgctcccctctctctccgccttcggcgtcattaccaacgtggtcaatgtgttcgtttattcgcgctcgcgaatgagaaactcgtccaacacgtacttgctgtacttggcctgctccgacttcttcgtggtcatcaccggcctgttcatcttctgggtcgactcgggtcggcccttccccctttaatttcaccttttcatcgcttcattgttcagctcgttcctacatccctcaacttgtccagtctccgtacaccaccgtttacactcttccctttggtgccattgtgcttttggcattgtgccaattcctcccattgctttagggtacatggcccagtcgtgctccatttacttcaccgtcgcggctgctttcgactgttacgtttgtgtaagttcactcctttaaaaatgtcttttcatttctgattttttaggtttgctggcgctccaatgccaaaaggcattgtacggtaaaaagggcacaacgaatcgtcggttgcattgttttggcctccgtgctttacaattcactacgttttccacagttcaatcttcgccattgtatccacgagggaagcaaagttcggttggggggcaaagaatggcaaaggaaaggccgaaaagtgccgggaaacttcgaattcccattgaaggaaatgattgtcgagatttgccccaccactttgttcttcaacattaacaccgtttacaacggtctctcctctctcccccgtccttttcgctttatcccttctctctcccctcagtttatctttatatgatcgtcatgactttgcttcccttctcttggctgctcattctcaatgtgctgatcatttggtgcaaatcggtggaagcaaatcaaatgcgaaagaagaagaaaaggtgagcagtgaattgcctttggccattgcctcgcattaattaattaattattattgattaattaattaatctccgctcggccgattcagcaattgttcggtctcctccatccctaccaaagccgcccaacagaagaagcttcttgcgaccgactcgtccaagagacagctcagcgtgaacggcgatggcaaattccgccggtcgagtttcccccgagggccacagcaaagtttacggcattacggcccccatcggaactctcagcgataccagcgccagccgcatattgcggctgctcttttgggcggcactttggcccaatttccgccccttccgaaagcgacccctggctccgatgagaccatcacgatgattatggtcagtcggacggatcggtggaatgccatcggatggcgtcaattgtggggactcttgcaaaatctttccactgatcgatgatcagccgctgttttggcaggtggtcgtgctgtttttgtgctgtaacactctcgcccttatcgtcaatttgatcgagactttcttcgaacccgacgcccttctcttaaatcttctctccgatgccagcaactttttggtcatcttcaattcttccgtcaattgcgtcatttatgtgaatttcccaattttgtaaattaaatttattatccattttatttagctgattttcaacagcgattaccgagaagtttttctgttt

SEQ ID NO: 55160 - DNA, 212 bp, Heterodera glycines
  Genomic contig location: Contig_ID=SeqID_24428; Location=1..212; Strand=-
  SCN-specific regions: Sequence locations=1-110,132-186,211-212
cgctaattactattaatgacttcaaattagcgttcttccatccttccattccctttgcaggtgtattactctctcttcacttcactgctttctgtttgtctcggaaagactagcatcaacggattgatgcacaggtgttattgatattctgatggacatccaatgcgctcattgtcaggagtcgcatgttcatcttctccccactcccatct

SEQ ID NO: 55161 - DNA, 291 bp, Heterodera glycines
  Genomic contig location: Contig_ID=SeqID_24429; Location=1371..1661; Strand=-
  SCN-specific regions: Sequence locations=1-67,192-204,289-291
atgaaaatagcagtggggaaggaggagagacggaagagaaagagaggaaaaggaaaaattcgacggaagaaggagggggagaaagaggaggaaaaggatgataatagcattggggaaggaggagagtcggaagagaaagagaggaaaaggaaaaattcgaagaaggagggggagaaagaggaggaaaaggatgaaaatagcagtggggaaggaggagagacggaagagaaagagaggaaaaggaaaaattcgacggaagaaggagggggagaaagaggaggaaaaggatga

SEQ ID NO: 55162 - DNA, 96 bp, Heterodera glycines
  Genomic contig location: Contig_ID=SeqID_24430; Location=217..312; Strand=-
  SCN-specific regions: Sequence locations=1-96
atggccaacgcaatgtacgcggcacgggcgcgtgcggccaaggcggaaaagcgtcaagcgcagctgcgcaaggcggccagagcaagggcaggaaac

SEQ ID NO: 55163 - DNA, 1049 bp, Heterodera glycines
  misc_feature (1009)..(1009): n is a, c, g, or t
  Genomic contig location: Contig_ID=SeqID_24430; Location=646..1694; Strand=+
  SCN-specific regions: Sequence locations=1-1049
atgtcggaccatccagatgctgcgctggccgacctgtaagccgctcgaatttaaaatttcacaaaaaatcggattttaaatttttgcaattttcagcagctgcgtggcaaacgacgtttggctggacactctgttttggattgaccgcgctgaagttggcacgaagtttgcactgatcgacgcgcgcttcggcaggctggtggccacgcatttcaaactgcgcaaatggaagctgggcgagctgggcattcatcgggcaccaagcggatgggacaggggcggcacggcggctgtcaccgttatggacgaccacccgttgatgaatcgactgccgcttgccaagtgtcctgcaccgaacggcgtgattggcttccgtgccatctacatttggtcttagcgaacaaaatttttttgcaaattttcaaaaattccctaattttccaggtacgtcgacctggaagtgatcacatttctgcagtgcctgcaacgcgttctcaacctcggcactgctttgcagttcaccatccattcgaaggatgtccgctgctgggcgctgatgtcccaacgcatttggccactgatcgcgcacgctgtcaccacgctgcacgacatgaaggacgtcgacttcgcgctgttgcgtcgccatgtgtcgccgaatgtgctgttcgactgtgtcaagcttcgtgtcatcaccaacacgcacatgttcccggtccaaccgccctccagcgctgtgcacatcaacgaactgctccaaccgcctgccactttcaatgagaagccgaagcatcaactgttacgatggctgcacacaccgctcccagatggcagtcccaaaattttgactattcgcaagtggcgacgcgcgcattggtctacgctcacgtcgagcctgcgaacggtcggtcggaaattatttttttttgcgtttttcgattccaaattttttttttcaaattttccagtatttcgaagcgccgagtgccattgcggtcaactacgtcgtcgnttgtcatcgggcatcgcgtcgcaacatcgagggtcgttga

SEQ ID NO: 55164 - DNA, 535 bp, Heterodera glycines
  Genomic contig location: Contig_ID=SeqID_24431; Location=293..827; Strand=-
  SCN-specific regions: Sequence locations=1-356,378-397,421-535
atggctgattcttggcaaacagaaacgaaggacagtgatgaaggtggtgacaggacaaactcagcacacgaaaatgagtctggcaatgagaattggcgactttctgcataccaaactcaatcgacagaggaagtgcctttgcctgatgatttgtccgccattcctgtgccgacggaacaggaaatgaatccggcatggctaaaagcgcaagaagcacttcgttccatcggtggcagaccggaccaacaccaacaacaacacgaacagccgcaacaatttgagggcggaagttacgaggcggcagcagcgctgtacggatggccaccaaccatgggcagttcgttcaattcgtactatcatcatcagcagcagcatatggcttaccaagaccaacaataccagcagcctcaacaacaacaataccgtccacaacgtccgcaataccgtcaacagttcaggccgaaattgactggcggcggcggcgcgtacaatagcaatggtagaccggtcccacttgctcaagtcagcgttccag

SEQ ID NO: 55165 - DNA, 1466 bp, Heterodera glycines
  misc_feature (809)..(809): n is a, c, g, or t
  misc_feature (826)..(826): n is a, c, g, or t
  misc_feature (869)..(869): n is a, c, g, or t
  misc_feature (877)..(877): n is a, c, g, or t
  Genomic contig location: Contig_ID=SeqID_4631; Location=75..1540; Strand=-
  SCN-specific regions: Sequence locations=1-131,155-466,488-1466
atgcgagtgattcgcacaccaccgctgacgcggacaagagccttaaatcacggaatagtagttgaccgtgatgggaatgcgcaccggaccgggaatttcgaagcatttggaaacagaccgaactcgcccttagcttcgaatgaaaatgaatccatagcaaatgggaatgatgtgaatgatttagagcgaaccgcaaatcgtcgacttatcggtgtcggaatggaactcagcgcaaatgatgagcagttggagtatgaggaaatggacgcggacaacgaacaaaatgctaatggtgtggttctacaacaaaatttgagggaaaatgtgggaaatcaagtttggggtgaacaaattggtggagtggtagaagttggaacagtaaatgcaaatgcgaatgatgggccaatattttctacaccgcatgactcgcgcgattttggacttttacagcgcgatcttagactgcatttttctgaaaacttgagtttaattcccgaccgaaatcaaaggcgtgacatgaatgtcatgcaaaatcaacaaacggggcacagtaggaacaattttactgccattgaacgaccacagccaaacagttaccgaatgaatcaacaattgtatgagaatgccccgggtaatgctgaacggtaccgacctctccaaggcgtaagaccagtggttgccgaaaaccagcatcatttggttcgacaaaacccgccacctcatgcctacgctcacaatgacgattattatgctcagcgatttaaggcacaaaatccccaacaagctccccagttccaaatcacaaccanaatgtgcaattagaganaatcatccgattcagttcgaacaatatcagcagccagtccacnccggactnggtatttgatggcatgatggcacaggccattagaagcctagacagcttctcgtacacaatgactctgaactctattccgaatttggacggcaccagcggatcagacgcagtgaacgcattttttaaacagtttgatgtagcgacagaggaatggcctgagcataagcgacttcgcgctcttcgatcgaaatgctttggcaaagcagagagggcttacaattcagctattgccgaaaacccgcatgaataccagctaatcaggcggataattattcgacagttggacgacacagacgccaaacaattgacgtctttcgaccaactaatgcgcggaattcggcgccgaccaaacgagagtgtcgatgagctcgggaacagaatttcgggtttggtccgccgcgcttatccgggtttaaccgaacagcaatacgatgattattcaatcatgcactttataagagccatttctaatcccgagttggcgatcactcttgaaatgacacgcagacccggagcgacatttgatgaattcattgcacaagcagcccgagcggaagcaacgcaatcggctgccagaaattcgtttagg

SEQ ID NO: 55166 - DNA, 1194 bp, Heterodera glycines
  Genomic contig location: Contig_ID=SeqID_4631; Location=3306..4499; Strand=-
  SCN-specific regions: Sequence locations=1-323,345-609,631-1194
atggacgtcaaaaagtttggaaaccctctttacacaatcgatgaagagacatatttgcaattcttcaaagaaaatttgttattaattcttgactcagcccgtaaaaatgccgaaatttcacgggcggaaaccaaaaacagatatgatttacgtccaaatgtttccatgaataaatttgcagtcagggatcgctgcatggtcatttaccctggctctaaatcaaaaacacagcacaaaaaattacattggaatcacttcggaccatacgaaattgtcaaaacactcgaatcatctgctagtgttgtcccggttgataaaaaatcggcagaaccaattactgttccaatagaacgccttgtgcgcgttccaatcggtgtacccgacatttctacccttcctcatggaaaaaacccctaccgaaatattttagctacaattctattggccagcttaaaactttcaaaattagacacaaaaggaatttttggacagttcgaaccgctcttacagacgcaatttggggaaaattctttaaagtcatcggaaaaaatcgtcgttaatcagttagggacaactgacaatttaggagaacgaaagatgcagcagcgccagcagaaagaaaacgacggactttcgtggactatgaagtgtgaaggggaaacccacgaattttgcggaaaaattttgtgcggcgagttggacccagtgctggacgcgaaaactgagccgggcaatgtggaaattggcactcctctccaagcccttttgagtctgttcatccttcgttcgggtgcaacagtttcatcttcggcggctaaaaatttggtgcaactgattctcggcaccgaacccggaatggaattggtcgtctacgaaggagtccgtaaagacaatgtccgtgccggcatctttccaaaccatgaagacgtggaaagagtctggattttgtggtgcgagaaatgtgccgtggcaaagaaactcctccaatcgtctggattcgaccaaatccgagtggaaaaacgttgcaaaaattcaacagaaaactcggaattacttcaggttgtcgtgccggaagctgtctcaaaattgccggacacggaacgcgacggttggggctcactgctcgaggagaccggttggaccctggagaaagtacgtgcgcaagtcattcaccggtgccgcatctttgtctaa

SEQ ID NO: 55167 - DNA, 1442 bp, Heterodera glycines
  misc_feature (1426)..(1426): n is a, c, g, or t
  Genomic contig location: Contig_ID=SeqID_4632; Location=5..1446; Strand=-
  SCN-specific regions: Sequence locations=1-883,905-965,987-1442
atgtctgagctgccgaatctgtgcacacacccgaaaaccccggtcaaatgagcctccgcttagaataattcagactacggagcctcttgagcttgtttgcgtggatattttgtcgattggtccatcagaaagcggaaatcgctatgtgttggtctgcattgaccatttcacaaaatacgccatagcaataccaattccggacaaaagcaaagaaacgattgcaagccttcgtaaaggaatttattttgcagtttggagtaccaaaaaggctacacagtgatcaggggaaagaattcgttaacgaaactttaaatggaatttctgcaatacttggaattgagaaaaccacgacagctggttacgacccgcaagcaaacggagcggttgaacgagccaaccaaaccttaattaacatgcttaaaaagtccacttcctctcattggagttgggacgaacgccttcctttcgttatgttttcttataacaccactccatctgaagtcactgggtactcaccctttcacctgatgttcgggaaaattgctgatttcccaggagaaatggacgtcaaaaagtttggaaaccctctttacacaatcgatgaagagacatatttgcaattcttcaaagaaaatttgttattaattcttgactcagcccgtaaaaatgccgaaatttcacgggcagaaaccaaaaacagatatgatttacgtccaaatgtgtccatgaataaatttgcagtcggggatcgctgcatggtcatttaccccggctctaaatcaaaaacacagcacaaaaaattacattggaatcacttcggaccatacgaaattgtcaaaacactcgaatcatctgctagtgttgtcccggttgataagaaatcggcagaaccaattactgttccaatagaacgccttgtgcgcgttccaatcggtgtacccgacatttctacccttcctcatggaaaaaacccctaccggaatattttagctgcaattctattggccagcttaaaactttcaaaattagacacaaaaggaatttttggacagttcgaaccgctcttacagacgcaatttggggaaaattctttaaagtcatcggaaaaaatcgtcgttaatcagttagggacaactgacaatttaggagaacggaagatgcagcagcgccagcagaaagaaaacgtcggacgctccagccctgctatgaagtgtgaaggggaaacccacgaattttgcggaaaaattttgtgcggcgaagttggcccagtgctggacgcgaaaactgagccgggcaatgtggaaattggcactcctctccaagcccttttgagtctgttcatccttcgttcgggtgcaacagtttcatcttctgcggctaaaaatttggtgcaactgatcctcggcaccgaacccggaatgaattnggtcgtctacgaagga

SEQ ID NO: 55168 - DNA, 1109 bp, Heterodera glycines
  Genomic contig location: Contig_ID=SeqID_4633; Location=1991..3099; Strand=+
  SCN-specific regions: Sequence locations=1-48,70-327,349-370,393 -443,466-589,612-1109
atgtcggtccgcaaatgtcggtccgcaaatgtcgcactacgtcttgtaagagcttttcttttagtttgtcgactaccaatttttctttctctcccatgacaaatggtgtgttctttttcagaaggtggaacaatggcgccgcaatttctccaaatccgtaaataaacttacgataatacgtcatgaagccaaggaaagagtgcagttgttttttggttgttggaatgggcaattcaatgacaggccttattttgtctgcgttcatctttaagccttgtcgtgttaacacatggcccaaaaaaggtaattcctcagcggaaaaacggcacttttcaatttttaatttcagttcggcatcctgaatacgttcaaaaacaatcttcaaatgcttcaaatgttgttcaaacgtctcagacgcgaccaaaatatcatcaagataaacgaagacaaaatcattgatcagatcttcaaaaagacgagacatgaatcgctggtaagttgctacagcattacaaagtccaaacggaagcaccgtgaattcatgcagtccaaattctgtgacgaacgctgttttttcaatggacttctcgtccattttaatttgccaatatcccgaaaggaagtcgagggttgagaagtatttttttcctcccaatgcgagaagaatgtaatcaatgttcggcaacgggtatgcgtctttcactgtgaccgaattaattcctcggtaatcaacgcaaaatcttaagcttccatcacgtttcgggacaaggacaatggggcttgcccatggcgattttgacggccgaatcaatcctctgctcaaataatcctgaagcatcattgaaactttttcacgatgtgcaaatgcgatacaaacgaattttctaattcatgccaatcttcgacaagttcaacttgcgcaacattgcttttcgcctccaaagtaatcggaatggccgaataattgacaatcgggacaacaagttgtccattttttcctgatgtaagagttggctcaaatttcagttgttcatgaaaaccgtctcttccgattacagatacttctttatcatccagctcgcgcaggactgacaactcgacaagcgtag

SEQ ID NO: 55169 - DNA, 2836 bp, Heterodera glycines
  Genomic contig location: Contig_ID=SeqID_4633; Location=1..2836; Strand=-
  SCN-specific regions: Sequence locations=1-235,258-381,404-454,477 -498,520-777,799-891,928-1119,1153-1404,1427-1436,1475-1703,1726 -1787,1821-2533,2556-2805,2827-2836
tttcaatgatgcttcaggattatttgagcagaggattgattcggccgtcaaaatcgccatgggcaagccccattgtccttgtcccgaaacgtgatggaagcttaagattttgcgttgattaccgaggaattaattcggtcacagtgaaagacgcatacccgttgccgaacattgattacattcttctcgcattgggaggaaaaaaatacttctcaaccctcgacttcctttcgggatattggcaaattaaaatggacgagaagtccattgaaaaaacagcgttcgtcacagaatttggactgcatgaattcacggtgcttccgtttggactttgtaatgctgtagcaacttaccagcgattcatgtctcgtctttttgaagatctgatcaatgattttgtcttcgtttatcttgatgatattttggtcgcgtctgagacgtttgaacaacatttgaagcatttgaagattgtttttgaacgtattcaggatgccgaactgaaattaaaaattgaaaagtgccgtttttccgctgaggaattaccttttttgggccatgtgttaacacgacaaggcttaaagatgaacgcagacaaaataaggcctgtcattgaattgcccattccaacaaccaaaaaacaactgcactctttccttggcttcatgacgtattatcgtaagtttatttacggatttggagaaattgcggcgccattgttccaccttctgaaaaagaacacaccatttgtcatgggagagaaagaaaaattggtagtcgacaaactaaaagaaaagctcttacaagacgtagtgcgacatttgcggaccgacatttgcggaccgacatttgcggaccgacttttgcggaccactatttctgggttgaactgtcaaaaaaaaacaaaaaaaaataattttttcaaaaattgagtgactaagtagttttatttgtgatttttaccaagttgaacatcgcccttcaagagtaatcgatcaactttttgcaatcaacatcgaaagaacccattttttaaagaagtttagtttccatagataaatatattatgtagttgcacatttttaattttggacccatagttttaataacagcaaattacggacaatttttgagaaaaatataaactattttagtttttgtttgttaatttaattggtttgacatgccggaaaaaattaagctctcggttaactaaagcgtggaagtgaaacaagataaaaaattttcttggtataaaattcttgaactgacttttatatttaatttagctaattttttcgccaatttcacagtttaattataagttagaaattctataaaaaagaaagaaaaaagttatgtcaaataagacttgtctccaattgagacagatcgctttgcatcagcttaccttcactaatttcaatttgggaatattgaatttattaaaatttcttattatttttttctttatttagacagttctatcgagaaatagtggtccgcaaaagtcggtccgcaaatgtcggctaacccaaaaaagcaccttttgacattgacaataaatggccaagggaatgtcggaagagagattcggcaatttggtccggaagaaagtgcggtctataaaagtagaaacaaaatgccattccaagagaatcccaacccgaattgatctgatccatcagagagctcacttccgtcagcaaattgttcaaatgcagaaattggaagtggtcgaccgttatgcccaaatctgtcctcggctccaccaaaatgcaattctctggatattaattaacaatttaaaataaaaaataaaacaagtcagaaaactttgacagcttccatcggagtcgtccaaaagaattgagccgaaaatattcaaatcggtcaaaaaaggcagttcccacgtgtttggaccgaagtcgcaattggtccaaagcgacggaatggatagaatccattcgttgcgctgttcatggtccaaaaagaagtcggcattgtctaaacctaacctccaaaattaaacatacaaaagtcagagaactaataataattaacattttggtttttgttttcaaattctttaaagttttttgttgaaaagtttttgattcctggtaaattttttattatgtttttcgaaaggaaatgagggtggaaatcctcaagtccagtatttttagaccaaaagatgctaaaacattattttccctcaagggcattttttttgaaaataaactgtgaaggagtataaaaatgggtctacggtttccgcacaattgaaagaacagaccgttttttttcgagatggaatttcggcttttcttaagcaattcgtccaatagttttgtctccacggtgtttttctgggcccaatcaacgaatttaaaatgtttgtcgtccaatcggtctctgaacattatgggcaatggcaccaacggatcgttgaggagcatgaaattggagagaaggacggtggacgcttgcaaaatgagccgtttggggagacgggggtcattttgctgagagagagaggacggacagtcggtggagggagaagacaacacaattttgggcatgaacagctcgagtcggatttgagggcgaagttcggtattgccagcgacagaattggcacaaatttgaggggcatccttcacaagggagaacaaaggcattcaaattggggatttgatgtctcacaattgcgtttattatactttccattgcgtagaccaaccaacggaccgacttggcatcgggggacagctccaaaggggccatgaccaaatggacggagtcggggggagctggccaaaaagaatgagacgag

SEQ ID NO: 55170 - DNA, 494 bp, Heterodera glycines
  misc_feature (209)..(209): n is a, c, g, or t
  misc_feature (243)..(243): n is a, c, g, or t
  Genomic contig location: Contig_ID=SeqID_24434; Location=567..1060; Strand=-
  SCN-specific regions: Sequence locations=1-271,317-494
atgccgaattgtttggcggttgtgcttctaccaccgtcaaatgtaaatggcatttataaaggcacgcgggccttgacttatgaggtggatacagtagggccttaccatatctcatctttaatgattactaaaaacactagattaaatctttatctcgcgagaaatatccgtgcgattatgttgtaagtccaaaggcaaaaaaaaggctntggatgtcccggcggaaattttccgattatcctntacgacaaattgctcattttaactttgcatttataataataataataatgtaaacatatttttttaaattttaggatgattttaattggtttagtcattattgcttttgtgactttttgccttctgttgagcttcattagttttaggggtattttttgattatgctgtctcaggtctgtaattattatataaaaatttggacaacttttcagaaggaagaccatctttaaagcgcatgaaaattaaataaa

SEQ ID NO: 55171 - DNA, 1042 bp, Heterodera glycines
  Genomic contig location: Contig_ID=SeqID_24436; Location=553..1594; Strand=-
  SCN-specific regions: Sequence locations=1-25,47-383,405-1042
atgttcaagtcgagtgggaagatggtcttttggcaaaggttagtttcattcagttggatcgatcggtctctccatttcaaaaagtgactttcagttcaattacgtttggttacgcgacaacgcccgccggcgtccgtcgttggtccatctcgacctcaacacgcggccccaggaaatcaaatgcagcagagaggcactcgaagtgcaatggccgccattcattgcctcaaggcgggtgctttgccttttgctttctttaaatactgaccctttccttttatcattttagatacacttccaattttcttcgtgacattgccctcgatagccccgtggaaaggctttacggcgctcatagaggcagacaaaatggtcaatttggcaggtcaaagccatcgatggctggcccactcaatggccatttgctggctttttctgacgcgcgagtgccaattgaagacggaatcgaattaggcaaatgttactggggagaggaagcgcaagagccgggcacaatttggccgcacctcgccaaagtcccttcggttgttgcggtggacagtctttccgggccggctaggctttccttcgtcgacgttgagaaagtgctcatcgaaatgaggaagcgataccccaaacatttggtcttcctcgggacttgtgttctcgagtacgccgaggtatcacaatgggatttcctttgtggtgaaatggaaatgttttgacagggccctttcttcgcaactcatcccgtcgttagggtggacgaccaaggccatattctgccggtttgtactggcatttgcagcgagttacaaaatgttttgttcaccagtagggctttttcaacaacgccgcgcgttccagcgcaattaccgtccattccctggacgaactttacgagtcgctgcaaaagtttggccgcgtttgcgcagaaaacatatgcgacattcagctgatgcccggacaacgactcttcttcaacaatatccgcggaatgatcggtgcgccggcacagacgggacgaaatctcagcattaaa

SEQ ID NO: 55172 - DNA, 970 bp, Heterodera glycines
  Genomic contig location: Contig_ID=SeqID_24438; Location=1077..2046; Strand=-
  SCN-specific regions: Sequence locations=1-394,418-504,527-871,893 -897,919-970
atggaatctttaataaatagtaactaaattttcctaattttctccatcggcaccaccagacagactcattaattattttgagggtagcttttacgaaagtaaaatgacgtaattcatccatcatagttcattgatcaaccaacgcctttcaattaataagcaatttttttcaattagcgacgaaaagattttataaataattaatgaagtaattaatgtttggagtattattttttgacatccttttcaatattgtcccattccatctgccacaaatttgttaaaataatttgttcttcacagtatggcgcccccgaaaaattttgtcataagtatgaaaacttgttgacgggaatattcgggtcgttaattaggaatttgacatctatttcaaccaattccaaatccacacaaaagttacgacattttttgatgtgatacgagaaaatttgtcagattgtggaagtaagtgccaaaacgaaatttcaaaaaaaaacaactaataaacttataaaattaattatgaccaatttttgaaatatggatatggaggaccggcacaatgttcgatattattttttgtaaatttagtttgacttaattaatgattaacttttattctgttataactctcaaatcttaaatgaatcgaattcaagagaagaataattcaaaataatggaagaatttaaaaaaagttattgagtcaatttcttaaggatcttaaacggtaatgaaaatcaaaaatattcgcaaattgtggtaattataaatggtggtaaatagcgcaaatcatcataataattgaaaaaatggcattaattaattactggcaaaaatcttattgacaatttcttaaacaattaagcagttttataattataaattttaagtacaattaattgatccatcagttgctaatctgacgcaattgaaacctgaagcaaacatgaagaaatgcggtatttaa

SEQ ID NO: 55173 - DNA, 953 bp, Heterodera glycines
  Genomic contig location: Contig_ID=SeqID_24439; Location=135..1087; Strand=+
  SCN-specific regions: Sequence locations=1-437,459-953
atgccaaagaagacacccggcgaacactttgcccgtttggaaatgcttaccgaactgctccgaccgcaggagccgaacgcgcaacggatggtggaggaattggacggcggagcggacgaattgggcgggggtattattaattactacgccgtttcataaaaatgaccccgtgttatacaaaaacagttaatacaatagaaattcgaacctataatttttagcttatttggtaacattcgatgcataatgaagagttggaaacaatgatttaattttatatctcaacagatagcgttattaaaagttatggccaaaaaattcgaaaattggccaaaccatcaaacttggatttctctgttaaacatttgttttttgaactttatcttgtcaatcatatcgaatttgattaactgaccaagtttcaagtcattccaaaaattacaccataagttatgcaattttggtctgaaaaagtgctaattttctttgcccatccaaatttatttaaaattcgcattttttaaacgacgagacaatttaatagcttattttaagacgcgtcatcagggctttcgatttcatttattacatcggtttttatttcattagcaatttttggaaaaaagaaaaatggatcttcttttatgatgcgaacctaaatacaaaaatgacccaattttatcctgcttttagacaatgatagcattgactgtttcgcgcaacagtctctgcccgaggatgggccaacaacttcgagcagtgcagcgacggcactgttcggctacggttttggttggcaacggcacggcgtgctgggccgtttgttggccgacattggccaaggcgagttgcccatcgaccttgaggacccggacggaacaccgatcgacgaccgattagagtgtcttcacgcgttcgacgccgaccattttcggcccgagcattacttgtga

SEQ ID NO: 55174 - DNA, 494 bp, Heterodera glycines
  misc_feature (13)..(13): n is a, c, g, or t
  Genomic contig location: Contig_ID=SeqID_24440; Location=1173..1666; Strand=-
  SCN-specific regions: Sequence locations=1-32,108-179,247-383,419-494
gattgacagatgnatagctttttcatgattcggtggatggtggtgcatggccgttcttagttcgtggagcgatttgtctggtttattccgataacgagcgagactctagcctactaaatagttggctcattgcttctgtgggcacaacttcttagagggattttcggtgttcagccgcacgaaattgagcaataacaggtctgtgatgcccttagatgtccggggctgcacgcgcgctacactggcaaaatcagcgtgcttgtccttccccgaaaaggggttggtaaaccggtgaaaatttgccgtgattgggatcggacattgcaattattgtccgtgaacgaggaattccttgtaggggcgagtcatcaactcgctctgaatacgtccctgccctttgtacacaccgcccgtcgctgcccgggactgagccatttcgagaaattcggggacggttagtgttccggcttcggtcggtatgcagactggaaccg

SEQ ID NO: 55175 - DNA, 160 bp, Heterodera glycines
  Genomic contig location: Contig_ID=SeqID_24440; Location=1100..1259; Strand=+
  SCN-specific regions: Sequence locations=1-160
atgatccagcagcaggttcacctacagctaccttgttacgacttttgcccggttcaagccactgcgattaaatcggttccagtctgcataccgaccgaagccggaacactaaccgtccccgaatttctcgaaatggctcagtcccgggcagcgacgggcg

SEQ ID NO: 55176 - DNA, 184 bp, Heterodera glycines
  Genomic contig location: Contig_ID=SeqID_4635; Location=2449..2632; Strand=+
  SCN-specific regions: Sequence locations=1-1,44-184
gaattttttttattttttgaatttttttgaatttttaaaaattcccggttggtcccggttcccggtcccgaacaaaaatcgaggtcccggtcccgacttctcaggtcccggcaagtcccggtcccgacttctcaggtcccggcaagtcccggtcccggttttgcccaaaattcccggtcccgct

SEQ ID NO: 55177 - DNA, 1486 bp, Heterodera glycines
  Genomic contig location: Contig_ID=SeqID_4635; Location=1..1486; Strand=-
  SCN-specific regions: Sequence locations=1-241,263-411,433-593,616 -637,681-699,722-792,814-891,914-986,1030-1049,1073-1102,1125-1486
  Gene Ontology: Mol. function=proline dehydrogenase activity; Biological process=proline metabolism
cttatattctccctccgtctcgttattttcaattcaatttctcagcagttgcgcggagtgagttccaacgcctcagcgtttcagcaagtttcgtcaacttcgcttctctcggtgaccaagaaaacgcctgaacagttgcgcgccgaatcggaagaatgttataagcgactggatctgactttccagaatgctgaggaggcatttaaggttcgtctttatttagcaatgaaacaagaatagattaacaacctccctttatggactttgggccttatatttggcagacgaaatgtttacatttgagtcaaaatggtcatgcgggagggagtctttcaccaaaagttagcacctttaaaggtcttaaatcaactttagacaaggaatggccgtccgaacgcatatttttatgttccaactaaattttgttattttcgcagagcaaaacgaacagtgaactggtccgtgctcagctggtgttcgccttttgtcagaacaattggattgtccaaaacaacatgtcgttgatgcgcttggcccgcaaaatgcttggaaagcgcgcattcaatgcattgatgcgaagcaccttctacggacattttgtggctggcgaggacattggcgaggctggcaaaagaaaatattcattcaataattcaaattgaaataaatgacagttttcatttttttttaaacatgacctattttaaatttatattaaaatgctaaccttccatttctgaatgaacttttgatttactttcttggattctagttttttttcaataatgattcaattgaactcagaaccctctgaatatgttatcaataattaatttttaagtcccaaacaatttaaggtttcaaaaacggccactcgacttcagcgcttcggtgtcaaatgcattttggactacaggtgttgttgttgtgcatttgccaaccattaacaacggaacgtgcgataggggtgggcgagtggttaaacctacaaaaaccaactcaaaataaattactttttccttaaaatctgacccttattggtcccgtactaaaaatttatttatctgatttagtgtggagtcggacatttcggaggaggaggccaaagaaaaggcagtggaaggtctggacgaagaggaaacgcaaccactcccacccgtatgagctgttaatgttaaattaaatccatttttaatggcatttaggccctggacgtcttggccagcgcggttccgcctaaacatgccgcgcaattggaggacgcactcggtgatcaatcagtggcggaattggtggaccaaacgcacaaacagttcaccgtgcacaaggaattcggagaccgacgtgagcatgtcgtcagcgcacgtacatacttttatgtacgttttcatggcatttatggcacttatttcgttcattttgccagaatggttttaaagttgtaggactgggaaaacgtgaatttttgtgatttttttacgtcttt

SEQ ID NO: 55178 - DNA, 1061 bp, Heterodera glycines
  Genomic contig location: Contig_ID=SeqID_4635; Location=3666..4726; Strand=-
  SCN-specific regions: Sequence locations=1-247,276-495,517-856,878 -1061
  Gene Ontology: Mol. function=tubulin binding; Cellular component =prefoldin complex; Biological process=tubulin folding
agaaaaataattttaatgaaacccgaccaaaagagtgcaaaaaatactgcaacggcggaggaccaacagcagatcaaccgatttgcacgtcttcataaagcttactcggcagccaaagtgagttcaatttagtaaatgccgcgaaatttgaaattttatttccatttttcaaaattgataggctatttcttttttaatttttttgtcccaataaaattaactgataattaattgtgtgtgattgtaaatgggagtttttcaggaaaaacttatatcgttggacaacgatgtcaacaatttgaatgacgcttccgatgaaattctgctgatggacgacgaggcggcggccgattcgattccctttctcgtcgggtcggtgttcgtccatttcgaccaggttttacacaaaggggacattctaccaaaaatatttcaatacaaccatcgagaaaaatcattcctttttcttttttaaggacacagtgaacggtcggttggaactgctgaaagtttccactcaggcggagatggacgcattgcgttcacaagtcggaaccatggagagggagttgggcgaactgcgggcagtgctttacgcaaaattcggcgacaacattcacctggagacagaggaggacgaggagagcggcgatgcgacgagaaggaacgggagatagtgcatgaaagaggaagggcagagagagagagaaaggaaaagaaaaaacaatcgaattgaaatgggcgttgaaattgtcttctttttcccatttcccgacataaatgaaatgataatacctctttaatactttaaaatcttctggatttaggaggtcaaactttttcgtaaataatgtcacacaaaagtgatgagagaattgttgtttgagatccgtggcattcgctttcaaatcccttccactgccttttgcgtgtccgccaacaattgcttcatcaacacgtctaattctttcattgacgcatccgcaactgggtactaaatcgaacaaaaataaccacaaagttttcttggcaattcgattttaacctaattcagtgtctga

SEQ ID NO: 55179 - DNA, 45 bp, Heterodera glycines
  Genomic contig location: Contig_ID=SeqID_4636; Location=329..373; Strand=-
  SCN-specific regions: Sequence locations=1-45
atgcccccgtgccctccgtgtatgcccactttttgccctccgccg

SEQ ID NO: 55180 - DNA, 1483 bp, Heterodera glycines
  Genomic contig location: Contig_ID=SeqID_24444; Location=328..1810; Strand=-
  SCN-specific regions: Sequence locations=1-99,122-451,508-1004,1030 -1122,1149-1307,1335-1360,1414-1483
  Gene Ontology: Mol. function=signal transducer activity; Cellular component=cell wall (sensu Fungi); Biological process=invasive growth
atgaacgcggcgttggagcaactgttccaagcggctggcatggacagctccgcgttgatgatgggcctcggtagcatggcgacggcaccgccgccgaagccggcggcgccatcatcatcgcttcagcagcatcaccaacaacaccacagccagcaaaaaagtattgtgacgtcagcagcggcaaacatgcgccaccatcattcatctgctgctggtgctactgctactgcttcatcatcagtggtcagtgccggtggttcgtctaccaccggcgccgtttctgctgttggcacgacgccaacaaaaacggtgctcacaaaggtggagacggcaaagacaagtgcgtcgtgttgtgcgtcatatataatggtttatgtgtcaaatgcatgatggcccttttccttacttatgcaaaaacatcagtatatgaatgatccaataaaaaacttgcttaataaaaaaattattgtaattaccgttttttcaaaaaaaaaaattttaaattttgtacccctaaaaacgattttttcaacacaaaaaatatagaggatgagagaacttttggatcaattcccgaaatttaatccaactataaatttttaaaattacgagtcatttgcgaaattaacatttttcagtttcactcccgctggtcacctcaatgacggacggcataacaactcaactaaaacaacagcagcatcgtgccaccgaaagtccggcacgtaaacttggcatgtcatcaattggtggcgccggcaagggtctgaagctgaacgcggtgttggaaaagttgaatgcgtcgtcaagttcaagcagtacagctccaccagccaccaccaacagcagtgttgcgacgacgcccacaataccaaccgttacagtacctctaccgccaacaacaccaacaatcgctacagtaccacctctaccgtcatcatcaactacagttgctgatgttgttgttgatacagtgccatcatcatcaactacaactacagaaaagcaagcagaagcagcagcagcggatattgttgaatcggcagcaccagctgttgttcagcaacagcaaactgatcaaaaggatgatgataatgatcggacgacgactgaaccggaggaaccaaagcagcaacagcagcaggtggagacggtggtggcggctaatgttgaagcggaccagcagcagcaggaacagaaggcggcaattgctgtgccaccagaaacggtgacggcaccaaaaagtggcactgagtgtgacggtgatgatcatgagcatgacaacgacgatggtggtggcaaacatggacaagaggaagaggaggaggacaagcagtcgtcgtcgtccaaactggtgatggccgatgacaatgatgatgatgatgaggaggaggaagagaaggaaaagaagaacaattccgcggatgatggtgaaaaaaagaatgatggtaaataaatatagggtaatacaatagaaaataaa

SEQ ID NO: 55181 - DNA, 650 bp, Heterodera glycines
  Genomic contig location: Contig_ID=SeqID_24445; Location=1052..1701; Strand=+
  SCN-specific regions: Sequence locations=1-192,216-358,380-650
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattacagtacaggctatagggaagctattccggaaggattcggtctcccataaatctaggcgcatcggttcggggggactgccccgaaacaaaaa

SEQ ID NO: 55182 - DNA, 861 bp, Heterodera glycines
  Genomic contig location: Contig_ID=SeqID_24448; Location=21..881; Strand=+
  SCN-specific regions: Sequence locations=1-177,214-329,351-484,506-861
  Gene Ontology: Mol. function=chaperone activity; Cellular component =mitochondrion; Biological process=mitochondrion organization and biogenesis
ccttccacgaagcgggacacgccatcgtcgcccatttctctgaccattcgaatcctttgcataaagtgaccatcattcccagaggcacttctctcggccatgtgagtgtttcgcgtttgatttggaaaaaaacggttcattaattgcagacatcgcaactgccggacaaggaccgtcaccaggaaacgaaagcacagcttctcgctcaattggacgtgacaatgggcggccgtgtggcggaagaattggtttttggccaggaacacatcagcacgggcgcaacttcggacttgcggcgcgccacaaaggcaaaaagggggaattggcatgaaagaaataaaagcatttcattttaaggtggcggaacgaatggtgaaattattcggaatgagtgaccgggccggacttcgcgacttcactgttggacaatcaaaagcattcccatcgcaatgttctctttaaggtggaaccgattgaatctgagcaaggcttttgtgtggaaaggggcccgagcaccagcgaaacgatcgaccgggaaattgaaaatctgttgcagcagagccacgaacgcgttaaggaactgttgacgaagcgaaaggtggggagggggacaatatgaaagggtgtttggacaacagaaacaaagagtgtacattttaaaaatggcaatttcagaaggagcatcatttgttggccgaggctctgttggagcacgaaaccctgtccaaaaatgacattgagaagttgctcaagggcgaaaaagttatgaaaccgccgccgaccccgccgaaagggcaaaagcataagggacggacattggcaatcggaaagaaggcgaaggacgagggggggcgggcgtaa

SEQ ID NO: 55183 - DNA, 267 bp, Heterodera glycines
  Genomic contig location: Contig_ID=SeqID_24451; Location=1000..1266; Strand=-
  SCN-specific regions: Sequence locations=1-15,38-61,89-267
tataaaaataaaagtgattttgggattcgggaccaaaggggggtgaccaggatttttgggtggaaaattttttcaccaaaaatcttccaaaaacatgtcattagggctattttatgacgctgatcacgaatacgtgatcagattttacttttgacatcgtcaagacctcagaatccctgtgtgattggggattctgaggcatcattttgaggggggagggggcaggttcggatccggacggtgtaacattatttttctgtgcatttt

SEQ ID NO: 55184 - DNA, 448 bp, Heterodera glycines
  Genomic contig location: Contig_ID=SeqID_24452; Location=1048..1495; Strand=-
  SCN-specific regions: Sequence locations=1-135,157-288,315-397,440-448
acaattatgggggagcaaaaatccaacgcagaattaacgtttaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagact

SEQ ID NO: 55185 - DNA, 395 bp, Heterodera glycines
  Genomic contig location: Contig_ID=SeqID_4637; Location=441..835; Strand=+
  SCN-specific regions: Sequence locations=1-107,134-174,197-395
atggagaaggcctgcaacatttggagagattttattgattttagtgcgctaggttcgatgaaactttttaaaatataagcctaaactttttggcctgtttaaaaaggaattaaaaatttttaaaaattttattcatctcccttttgatagaaaaagcatcagagtgccttgattaacttgtaaataaagttttgtgtgtttcagagcactttctgaaaaaatacttatgaattaattttgcaaaaaataaataattaatgaaaaagtcagaatttcgaaaaattttaaaaacaacaagcgttggcattttttcaggtaagctctgctcggattggcctcccttcaatgggtcaatgtcagtaaaaatgcaatgggaaaagagtaaatctaaatga

SEQ ID NO: 55186 - DNA, 1928 bp, Heterodera glycines
  Genomic contig location: Contig_ID=SeqID_4637; Location=1026..2953; Strand=+
  SCN-specific regions: Sequence locations=1-113,135-324,348-407,470 -528,550-712,735-735,763-958,1022-1182,1230-1237,1259-1433,1477 -1621,1678-1774,1796-1895,1922-1928
atgtggtgccattggatggccaacggaaaaggattattgatacaacggtgggcggtatttgctaattatcagagggtaattaggaattgatttgctaattgtcgccattttcctttccagccctttgactttctgtgtccctattccattttctgtaccgtcggctgtcagtgctgccaaatcaaccacgcaaatgaccacctcttctcaatgccaatgctcgagtttcatctatgaaaattggtatcgtgcgcaggccccaaacctaaaaaaattccggagggaagatgaagaatttttttttttttgctcttcggtcttgaaattttttctcttatttaattttaatatgtccagctattttcttccccattctcctgatttctgaaattttttgagtctttgtctatatatatttttttaaattaaatatttctaataattcaaaaattacttttaaataaaatttgcataaattgccaaattcctaaattaaaatttaaattttgttgcattttcaggagccgtacattcctttcatggagaaagcatgccgtctctgtggctcggctgtcactatgctgtttttcatttttttgatcattgctacactgttcgacctcattgtgtaccgaatgtttgtgattcgagttttttatgccagcacattttcaatgcctttttcgagattgcttatccgtaagtaaactcaattcaatttcaaatgaatttagcaattttattttatttttaaataaaaatggaattagtcacaattaaaatcaatatgaaattgaactgttattaaccagggttcttgaccgaaacccacgtttaaaaaacctggattttttcacgacccgaaattttctttgaacgtccctacccaaaccccatcttccacaattcctgccctgaatttcaattcgggaatattttatttacatcccgataaatcaaaaattaatgaattatataaatttttatgtttatttaaaatttaaatttttttaattttaaagaatgctttcctattgggttcgacgatggtgctttaaaaattccagcgacaaagaaacaaaaatgcgaacggatttgcaaagaacagcgtcaaacaattaaatgtatcaatccgaacatcaaactcagattatatgagcagctgggtgggtggtggaagagaattttttaataaaacttaaattatttttattttttatattaaatttgcctaaaaaattacatgttttcatgttcctaaaattagaagccctggggggtttaatttatattccatatgactcattttaaatgttttgaggtaatacaacttggctttgtcaccttgtttgttgccgctttcccactagcacctttgtttgcgctgatcaacaacatcctgggtcttgaaaattcgaattcctatggccgtcaaaaaattttaaattttacaaaaattcttaattaaaattaattcagaaattacatggtttccttcaaatttactttttcatttactaaccctatctaatgattgattgatttcttttgatggtttttccactaattttttcaatgtttttatttatttaaagattactcaacaccttttcaatagaagttttatttttaaataaatataaatttttatttttaattaaaaaaaaatttttttttcaagacttctttgtcatttcccgcaatacaatcggaagcccagcagatgcccaactccgtcgctgctactccttgcgcctccaacccgttcaacaacaatcacttcccacaatcagatgcagaaaagtacaacaacaaacagtgttgaagtgcttcagaaaaatgagcgatgacaaatttttgctgtggttttgatggtcgacaaaaattccgaatgcttttttattttttaatttatttatttgatcgga

SEQ ID NO: 55187 - DNA, 4248 bp, Heterodera glycines
  Genomic contig location: Contig_ID=SeqID_4638; Location=181..4428; Strand=+
  SCN-specific regions: Sequence locations=1-3,46-346,405-498,520 -600,622-639,706-763,786-913,959-1165,1188-1310,1341-1446,1468 -1617,1641-1677,1703-1729,1752-2249,2311-2368,2390-2727,2765 -2943,2965-2967,2990-3476,...
  SCN-specific regions: Sequence locations=...3498-3577,3599-3693,3715 -3782,3804-3941,3984-4000,4044-4181,4212-4248
atgtccattttttattattatcatttaatcatttttatggcaattattcatggccaaatggcagcgccaatagtggccgaaagctacagcagcgccaagcaacagcggacagaattcaattatcaacaaaaattgcaatcaacccacccaccaacaatgaacgtaaggaaagctaacaaataagcactgaaaaatgccgattacaataaatagtgccatttttcgtcaaatttgggctatttttttgaaaaaattggcaaaaaaaaactttaattttttgtgcgcttttttttttattatttttgggaaatttttgtctcggtaatatttttcactttttttctactaaattttattaaatttgaacaattcaaaaaaaatttttgatatttttcaaaatatttccaatttttccctgatttttaccaaaaaaatatagcgttgaataataacacaaacattagctgcttaaagtcagtctgacgtcattccaaatgcattttttgccccctctctcttatctgatcactctgatcgcagattctacgccatcattgacgttcattgaacaaatcgggcgaatggaactggttcagtccattgttcaattcatggaaaaaattggcttaggaacgggcgaaaataataaaaaaagtaaaaataaatacattttaatatgaaattttaaatgaatttttttttaaagaaaaacagcgaattgagcgccgaagtgctacaaataaaaatttgaaagaacaacacagggaaatttttggcagaatggtgagacatttgggcgcaaccgtatgggtgccgaagaaatataacacacgttaccaaatccaacaaacatggaatcacccggaagcttttaattagcattattaaactctgttatatttaactgactatgaaaaattatattaaaaaaaacaatttcttaaattttgttttaatacatagaaccattttaacaacactgcctttgtccgaagtccaatcattcgacgaccttcttttgctaatgacccaccaattatatcaagcatcgatgctcgaccgatgacaattgcgagtaaagtttttgatttcattatttggatttccgggtttgtaccagccgtgatttttttttaaatgtatcattatttaaatcataacataattttgtgaatttttccattttcgaaaacccacaaaacttggcattaattatggttcgacctagtgtttcaattcggtaattaattaaagcctaaaattactaaaaaaaattaatcaaatacaaaagttcaaattaacagtgtttctaaattaaaaaatatatatatatatattatgctaattatggtgtaatgtgatcatttagaagaacaacgatgaacagaaacatcacaactcaatgaaatagcgccatcatttcatgaggcaattggtatttgttagaatattaaaaacatttttagcaatttaaattttttttttttgtgtaggtaaagaatggaaacaagcattgttcggcagaggtggcttattgacagaaattttcaattttgtcaacgataaacgcaaggaggatttggccaagaaacaagccgctccaaatttgaacggtgggcatataagaaaaaatttaaaatgtgaaaaaaaaagtgacgacaattatttctttgggggattttaattaattaaataaatttttgaggtagcaggaattaagttgctaatgaaaaataattttaaaaatttatgaaagacagcttaggtaattgaattaaattctgtaattcttcagtttatttggccataacttttcttacttgaaccacccatacattcttggtatcaacgtaaactaagagaatttttatatacaaaaaattatgtgccaaaagcaacagacaatttcttggatatacccgaaaaaaaagtggccatagaaactgaaattgtataaaatttgaaatccattagcagataaggccagcagggaattcagccaaattttggatgcattattgcgcaaggcgaaaagtggcaattttgacgaggaaccgttgccagaaataccattcattggcatttgcaaccgacttagctgtgccgacatttacaaagcattggaccaattccggaaaagtgaatttttctcaaattttcaggtaaacccgaaagtcttggcgaaatgtttggcagcaataaggcacaaaaaggtggcacaagtcgtgtcgaaattggagaaaatgtggtaaaaatatataaattacgcaaaataataattaaaaaacctaataattaattatttataaaggatggtgaaaatattggcattgatttttcatcccaaattgatggtttgtttgaaagaaaattcaaaaatttaaaataaaatgaacaaggtcaaaacaacacgtccaatgttcatccgccacaaattgctttatccattgactcgggcgcaccagattactacagttttgcggaacaaaaaattggcaatgccgaaaaagtggacaaaatacagaaaaacataagtcagattgaaaaattgctttatcttaaatttaaattcaaaatccttcgtttttaccaaaacaaaaatttttcacaaaaaaacaaagaattttttctattttagccagcaaattaaaaaaatatgttaccataaaatatatgatttcataacttctaaggttctatagaaaaatttctttgaaaaattctaggttaaaaaaaattttaagttttgataaatttttattttctcggaggaacgatctgctccggattggtattcattttatccaattgcacattttaagttgaattcacaaaaccgaaggtggaaagtgaaaaaaaagtgcagtcgtcaactcagacaaagattgacttcaacagggaattgcctgaaattgccgaggccattgacagtgtacccgagggtaaatttaaaaatattttttagacttttctaaaaaagttcaaattttagaggaagaatttccgggaggggacatgttggtttttgagaaaaatgaatggcttccttccgcgtcggctaatgacacaaaaaaggtgggataaaaaatggggggataactaacaataaatagggctcggaaaatacggatacaaaaaaatcacgaaatatggccataatgccccaaaatattgaaaaaatgtggaatggaaatatggacataaatcgcgaaatattatagaaaataatggaaaatatggatattgaaatccatcatagaagcttcaaaccaagctataaatatgtttttcaggcagcctagtcacagtccaggaaaaagttgggatttccatacaattccgaaccctaacaataaatgtggtggtgctgatttctatttaaaattccagcagtttgttctaacaccggtttttgaacgaactcatgaaaagaaaagaactcaaccatcgacgacggtaactgttcagcaacagttgaggaacacaaaaaacaaaattggacaaagtcatggcacaacaactgcaaaaagcacacagcaggttaagttgggaagatgaaagaaatttttttaactaaaaattaattcttttccttaaatacaaaattagagaccggactgtatcgataattatcggtcgatgttttcaatatgtatttatttttcggtatgttattgaaagatatcgatcgaaagaatttaaaaaagaacaatcgaattgatctaacaatgccattcatacatgtgcaaggggtgtctcaagccaagggccatacgacggacgattgggaccagggctgcacgcaattacggattgcggattacggaaattacggggttttgggagttacggattacgggttacggatttttgggatttttccgtaattttgatccgtaatttgacttttggattattttttcgagacgatttcttgtacgattatttttataaaaaacaaatttttctattttttatttaaagggctacgcgtatttcgatttatttaagaattaaaatagatttataattttttattatttgttgttaaggctatttgggtagttcgcctagaaaatagaggcatcacttttttgtcacacctatttttcacgcattttatgaaaattcataaaaccttagccaggtgaggggaggaattccccccttccccgcccgaaatgaaaaattaaaaatttttacaggaaaaattgggacttttaaatttttttttgtcgatttttctta

SEQ ID NO: 55188 - DNA, 942 bp, Heterodera glycines
  Genomic contig location: Contig_ID=SeqID_24454; Location=221..1162; Strand=+
  SCN-specific regions: Sequence locations=1-557,579-942
atggcccgtcaatttgatcaacaccacggatcaaaatcggttgagtttttgccaaaggatcccgttctacttttgaacttcaaccgtggaaaacgattttggctaaatggaacgatcatcgaaagattggaaaagtccccgacgtatcgtgtccacgtcccggctctcggaagaaacgtccaccggcacgcaaaccaactgcgacgccgttatcctcttgaggaggacggtaatgatacgataaggatcccaccccaggctcaagaagagcaagaccgggacccatcgccgatccgcgagcctcctccgcaaccgccaccaattcgacggactcaggcaaagcgacgatctccgagtcctcctttggccccgcgtcgatcgcaacgccaacggaaagcgccgatccgcttctcgccaaacccctgagggttcagcttaaagaagggaggtgttggagtgttaaagaatttgaatttggcgcccatcgattattgattaatgttgtgacgtgtcaatccctccccttattcattttgtttatttaagcactccctccttccccacttggttccttctccattcattttgctattttacattttgtactgcatttgacctccgacataaattgtgtttattattttattgtgtgtccaaagttgagacacaacaatggtaaatcctcgacgctttcgcgaaagttgtgaaaacaccatatcctcggttgttgctttgctggtagattgtgccgagctaacggcatttgcattttcgtcgatgtcactgtcaccaatgaggtcgcatccgccacagatgacttttgatccgtatccttcaccatcgcttgagagtgagcatggtggaatggcgtgacaagacctggagcattttcgacatcggtgagcaccagacgtgggtttgttgtaaaagcaacagacctta

SEQ ID NO: 55189 - DNA, 569 bp, Heterodera glycines
  Genomic contig location: Contig_ID=SeqID_24456; Location=1183..1751; Strand=+
  SCN-specific regions: Sequence locations=1-11,33-370,392-569
atggacaacgaaaaaagccgagaaaaagctgccgttgtaattccgcacaacagccgcaacagtttcacaaaaaaagtgagtgcgcctgagggttcagcggacagcggaatcggcggcttttcgtcgggagagaatagcggaggaagtggacctaatgagggtaattatcatcgcttatggatcaaggaggattttgaagaacaattgggtaaagagacccatcggcaaatcgaaacgacggcatccgatcattggcccaaggagaggggagagactgatcagacacaaagagtagacagaatcgagactagtcagaaaggaaggggaccgacagtcgagactttccaaggagaaagggcagagactgatcagacacaaagaggaaagaaggtcgagagtgatcaagcacgaagaggacatggaatcgatactgaccatagaggaatgggacagagagtcgagactgatcaagacgagagggccgagattgatcaaggcgagaggcccgagattgatcaaggaaagagggcagaaactgatcaagacgagagggccgggactgatcagag

SEQ ID NO: 55190 - DNA, 936 bp, Heterodera glycines
  Genomic contig location: Contig_ID=SeqID_24457; Location=1198..2133; Strand=-
  SCN-specific regions: Sequence locations=1-433,455-502,532-573,630 -658,680-702,772-799,829-865,890-936
atggtctttttgataatttttggacaaggatttcagattcaagcttctccgataaaaaatgtcggaatgcctaagaattgtgaaacttttttttttgcacttgttaatgatcgggacttagtctatgccattttggcttcaaattcgggtataaaaatgtggactgatttgtgaatttaaaatccttttttttgtgaccaaaacccaatttataaataattttgctatcatttttatagattatctgcgcttcttgtgcgactatcttagtctgattcagtgtgagggcggagtggtccaattggtgtccgaagaagagatggccaacaatgtgtccgccggcgttgagatgggtagcattttcgaattcgcaacatcaccaaaaatggaaaagttaaaacttattatttatcaaaatgtaaatcacaattacaatttttggaaaattaatttaagccattcatactcaaattttggttatctatacacaaattgaaagatgaaaatttctggcttttctcttgctgtttacttataattatgcgcgtcattcggcaatcaacatttccaaactaatttttttttcttatatttaaatacaaaatatttaaataatacttaaatttaatgaagtttttccactcttttttttaaattctttatatatttgttgtgttttatgttattcaaaatttgtgaagcataataaatattgatttgaaattgttttaaagattttttaaaattcttttcatttataatttaaattttgaatcaacggtaattttggaaaccaatgaaatttataaaatgtatatttaaatttttgcatcaatttataatccaaatagcctttggtaaaaacaatatttaattaataaaaatatttgagagattcttttatgaagaaaatgatgaaaaagctttgtgaataaa

SEQ ID NO: 55191 - DNA, 601 bp, Heterodera glycines
  Genomic contig location: Contig_ID=SeqID_24460; Location=245..845; Strand=-
  SCN-specific regions: Sequence locations=1-104,126-217,239-354,395-601
atgaaagcgacttcagcaatgttaaaattgatgttttcattcctttttataattatgatggattttacgactgaacaaaaaattttaatgggcgagtgtcaaaaaggtttgaatataaattttcaaaatttcaaatcaaacattagcattttcagacttttttgcaacggtccaccggttgcaagaaatggcaccggcattttttgctggaactcaaacacaaatgaaaaatggaaaatttttagaaaaagcatttgacacattgtgttgtattacaatcaaagctaaaaaggatgccatgaaaagggatgaattagcagaaataattggggaatttgaagcaaatcagcgcaatttttgccaacaattgaaaaagggccaaaacatttgggaagcgctggaaagttcggcgggcaatgccattgtaacagcggcgagaaatgtgaaagtgaacccccaaacatacgaagaaggatttcgaaaattgacgaaattaaaaattgtgagccctgaaaatcaaacagcaattggaacatttgtcaaacattgcattgccgcgttgaaaatattccgagaattcatcaccggtattgttaattaa

SEQ ID NO: 55192 - DNA, 321 bp, Heterodera glycines
  Genomic contig location: Contig_ID=SeqID_24460; Location=1822..2142; Strand=+
  SCN-specific regions: Sequence locations=1-164,186-321
atgaactgcaccgcgacagcaaaaactatcgggatgagagctggagttgaagtccaactaggaaagccgcacaatcatgacccttctccaacacgatgtgaagccgctaagatcaacagaagcgtccgcaacacagcattgtcatcacgtggaaatatgccacgcacagttgtgaatgaatgcctcgctggtgcgtcaaatgaagttattgcaagccttcccctaattctgtcaatggaaaaagctgttagtagagtccgtcatgcagccgggggtcaatttcaaataccaaaaacactcgcagatatcgagataccagcg

SEQ ID NO: 55193 - DNA, 330 bp, Heterodera glycines
  misc_feature (3)..(3): n is a, c, g, or t
  misc_feature (100)..(100): n is a, c, g, or t
  misc_feature (110)..(110): n is a, c, g, or t
  Genomic contig location: Contig_ID=SeqID_24463; Location=1387..1716; Strand=-
  SCN-specific regions: Sequence locations=1-192,214-330
atntacctccaaaatttgactatttctggaaaacttggcgatagtcaaagaatcaatttgttttggccacaatttacagcattgaatacatacacaaatnatataaattntaaggaaaattacgaaattctttgccatacctcgtaatgagtatagaaaatttttagatgctataacattaatatggcataaaattttgcatgcatgtgcatgaattgattaatatggattttatatacatatatttccatgaattatgttatatttgtataattattttatatttgtagcagatagtgctctcggtctctctagtcttgactgaataaa

SEQ ID NO: 55194 - DNA, 3049 bp, Heterodera glycines
  Genomic contig location: Contig_ID=SeqID_4639; Location=1206..4254; Strand=+
  SCN-specific regions: Sequence locations=1-81,141-674,731-735,868 -875,949-952,1105-1133,1155-1335,1358-1884,1907-1938,1960-2325,2347 -2415,2437-2616,2638-2983,3005-3049
atgtcttttaaacgcgtgaactccttccaacccaccgtcccattggccaagaaatgggatttccgatcaatcgggtaagtgatttttaataaattaaataaaaaaaataatttcttaaacaattataaatacaattataagataataccctttaagaattatttcaaaaaatttttttttgttcagaaataattttgctgaagaaatggaaaattataaattgatggattaccaatcgacaacttgcgaaaaatttggatttacgaaaaatattacggaatttcgtgtcaacccggatgtggagcgccccgatgaagcgatgaaggacgcaatcgacaacatgataaaggtggctttaaaaactacggaagaaaaaatgaaacgaaaagtgcggatgtttggagttgcaattacgggtgccgggcttgctttcccggtgtgggtgccgtatcgggcgtacccccagaataatgcggatgttatcatggaggagattaataagttggggcagagcggggacggggatgaaaataagaaaatgcttttattatctgagccagttactatgaaaattacttgcgtgaccatgcccagtggagaggggccgaggaatgtccacaaatttgactttggattcaaggaacaccagcggatagggtaagatttttccaattaataaaaataaaataaaaaatagaaaaaatcaaataaaaattaaaaaaaaaataaacaaagaaatttaaaataattatttctaaaaaatttaatgaagcaaaaaaaaaaattttttttttaaagaaaaaaaatgaaaaaaagcaacaaaaacccgaaaaataaattaaaaatattaaaaaataataatttaatgagccaaaaaataaataaaaattaaattttaaaaaatcaaaaaataaataattaaaaaatattaaataaataaaaaataaaatttaaaaaatcaaaaaaaaaattaaataataattaaagtaaagaaaaaaaagaaataattatttttattaagcaaagcagcaaaaaaaaaaaacagaaaaaaaaatttaaaaaataaattaaataataaagaaaaataaatggaaataataataattttattaaggattacaaatgcggataaattttgtttgttttatgctttggtggcgtcaaagctttatttggaagtgcatcgaaacatttttaatcgatttatgaaaaatattgtgagacagagggattcagctattgaacttttacataattgtggaattgatattaacgaatatagctatggtgtggagcaattgccgaatgttcagaaatattgggtgggtttaaatgaaaaaatgcaaaattaataaattttttcaggatgagatttaccccagaaagtaccgggttgttgcgtttgagaagtcagctgatccgcggaaatcgatctgtgttttgtggaaggcccctatgggacgagagaaggtcgtaccgatatttttggagaatggtcactgggatggtctgaagaattacgtctctttttttaatcgtgggagaaaattttgtattgattgtgagtgcttttttgacaaggatgtcaaacatactttcgagtgccgggcaaggtgttattattgcaataaagtgggcggagtgccgtgtcaaaaggagagtggagtgaagattgaatgcccaaagtgtcaccgttacttttacaattgggagtgttataattatcatcatggacatcagacttgcaaattatggaggcgttgcgttatctgtgacaagacatatttatttaacccgaagaaggaacatgaatgtggagagacttattgccagctttgtagtgtgagccatgaccccaagcgggggtgttatattatgccgatcgaggagaaggaggaaaaagatgtctacagaattgtagtttgggtaagttctacaaataaaatcaacaaaaagaagtctttaactccaggattcggagacttcgcaggatacaatttacaagggggaccagaaggagcatgttattaattatatttcggtgagagttacgtgtacggaatgctgtgatgacaaaaacaggacgaattgcaaaatttgtggggaggagaggatcaaggattggagcgaggcggagggacatgagccgaccaaggattttgtggagtggattttaactgcttttacgaattatgatacgtacatatttgcacataacgccggacgttttgacggtaatttcaaaatttaatttttaaatcctaaatttttaggtcattttgtttttaattacctctgccgtaccgggaagaacccgctaccgctcatcaatggattgaaaatttatgaatttaaagtgcaaaactcgaagaaacattcaaagctgatttggagagactcatgtttattgatgccggtgaagcttgagtcgctgaaggcgacatttaatttggactgtgaggacaagccctttttcccctattattacaacaagaaagaaaattatggaatacgattggaacatctgccaccgatggaggactattcgccgggatctatgaacaaggataaatttataaaattcgaaaaatggtaagaaaagaagggcaaaattaacaataaaattcttttgtttttcaggtacaacgaaaacaaggagacacctttttatttggatgaagaattgaaaaattattgccgaaacgacacggagattttattgttgtctattattgagtttaggaggatattgattaacgacattacgaaaggatttgaccccctgccgaggagttgtacgaatgcgggggttgcgatgaatatttttaaggcaatgtttttgttgacggagcagttatcgattgtgccggagaagggatatgagcggtgtgatcgcgccagtgtgatggcaataaagtatttggagtggaggagcaagcaggatggaattgagatacgacacgcggggaacggacgagaggtcaaagttggaaaatataaattggatggatttattgcgaataacggagctagggacaaatacattgag

SEQ ID NO: 55195 - DNA, 131 bp, Heterodera glycines
  Genomic contig location: Contig_ID=SeqID_4639; Location=1..131; Strand=+
  SCN-specific regions: Sequence locations=1-131
tatatgaccccgaaagcgcacggttgcgcacgggtgtttcccgcacaaacccatgcctatgggaggggcgcagccctttgatgttgccgcccggggacattttcccgcacaatcccaagcctataggaggg

SEQ ID NO: 55196 - DNA, 1353 bp, Heterodera glycines
  misc_feature (1287)..(1287): n is a, c, g, or t
  Genomic contig location: Contig_ID=SeqID_24465; Location=105..1457; Strand=-
  SCN-specific regions: Sequence locations=1-203,228-384,415-499,521 -1353
atgttggcaaaatcagtggaaatatcagtgaaaaaggcaaggactgatcagaggcacgagccaagaaggcaagaaacaattggaaggaacacagaagcgattggaagtgatcggcggaagaacggaaatggcaaacagccggagattattctgttggacgatgacgacgaaatggaggacaaacaaaaaatagtgatcaatttggacgacgatgacgacgatgaagaaatggtggatcaacaggcaaaaacgaatgatcaaacgccgagggcgacggaggacggaaatgccatggcaattgtgccgttcaattttggggacgatttgttggaagtgttaaatacggacccgacattttgggacgaagaactttttccaccaattcaacaaaatgaaaaaacccaaaaggaaacggacggcccgtcaaatgccaacattaaaaatgataacaatgataaggaagtgattgatatcgaagacgacgacgaaacagcgaatcaaactgataaaaatgataacagttataatcagttaatgataatgggaaacagtgaagcaccgattccgataaattccatgccaagtaaacaatcagaaaaaacggattcaaaaagcaaacagaaaaaagatgcaaaaacagtgccaaaaaaagatgcaaaaacagtgccaaagtctggtgaaaaccaaattggtaaaatggacgcactaaaattgatcagacaacagaatgccaatgccgcacaagcaaaacggacgagtaaaacaaattcaaatggaagggaaaatgtcaatgttttaatgccaaaagcagacgaaataaagggaatgccctcaaattcaaagtcaacgccaaaatcagcagcacaagttgagaaggcaaatcacaaccaacaacagagtgccaaaagaccacaaacagaaagagaaagctcagtgatgccaagttcaagtactggacaaaatgccaatgcagtgtcaaaagccagcgaagtgcatgccttaaaaatgtgtgttggtcattcctcaaatgccgtacagcagcagatgttaattgaagacgttgttggcacagtgtgcacggaaagtattcgcgcgtttgggcaaaatgccatcgattttggcttcatggcaaacgaagtgttcaaattgacattcaaagctaaaaatggagaaaaactcgccaatgagatcaatgccagcaaaggcaaattcagcgtaacaaaactgatcaaagatatgggagaaaaactgaaatattgtcgattattgggccgaattttggacganattttcgaggaaaatgccaaatttagtgccaaaattttggaagaattgccacggaaaggcggcaaa

SEQ ID NO: 55197 - DNA, 85 bp, Heterodera glycines
  Genomic contig location: Contig_ID=SeqID_24470; Location=152..236; Strand=-
  SCN-specific regions: Sequence locations=1-85
atgcacaaaatgcaccgaatcagcacaccggtgatccaaccgaacccatccttttccggctgtgaattggcagatgagccaaact

SEQ ID NO: 55198 - DNA, 1274 bp, Heterodera glycines
  Genomic contig location: Contig_ID=SeqID_24470; Location=316..1589; Strand=+
  SCN-specific regions: Sequence locations=1-226,249-254,277-371,393 -804,837-1026,1096-1274
atgtcctggattgctggccaagccgggctaagtcgggatttttttttaaattttaaacttcgcaaacaaaaaatccagacaatcaatgtggaattcaaaaaaaataaggaaaatttttgaacctgtccaacattgaatttgtaacgtactcattccaattaaatccttcgctaattgcttggcaacaaaatgccaaaaaaacgattgataaattaattaaaatgccaaaatatttggacagttttgggtggtgttgttgtgctgctttcatttctggtggttgtggtcaccgccatttcaatgtccgccattgcgaccaatggtgaagtgaagaacgggggctgctattatttggttggacattttgaaccttggttttttaaatcattttataatttcaagatttctcgctccttgggtcccgaatttggcggtagcattggcctcatactgtacattgcgaatacggtcaatgcggtatatcatttttgattaataatggctgaaaagcagcagccgattcaattattgattgagattgattagcttccacctgatcggaactgataaagcttagttttttaaatctgatcttgatctgttagatcgatttaattactgatcgagttcatcgaagctaatggctgggaagcagccgtttaagttattgattgatattgattagctttcttctgattggattgataagagttagttgttcgcatcatttaaatctgatattgttcaatatatttaaatttgatcactgatcaagttattaatagctattctaatctggctcaatgacctttcatttgattattttgtaatcattaatcaattttcagactatgaactgtgttgagccgcccgaagccatagttcgtaatgctgcatacataccatacggatgactgatgaaacaaagatgcgaccaaggacatgatcagcaaccctcctcaataacggcagaactgctgccgttgtcattcgatgaaaagaccataaagttgattttgatggtggtgcggctgctgctgctgctactgctggtatagtttgaactactactgctactactgctgctgctgctgcccattattgaattcagagaaaagaaaagttggtaaatttgcttcataattataagatgcggaaaattacgagtatgatacttcgggattaataagcagatcggacgagataatccaccaaaattaacgaaagggcatttcaaagattttaactttgaattcgaaaatactaatatgcta

SEQ ID NO: 55199 - DNA, 342 bp, Heterodera glycines
  Genomic contig location: Contig_ID=SeqID_24472; Location=108..449; Strand=-
  SCN-specific regions: Sequence locations=1-79,131-342
atgtcaaacgcggaaaagcccagccaacgcgtgtacccacacccagcggtgtcacaaccaccgcaagacaatgacaaagagcagcagcaatcggagcaacaacagaaggaggagcagaaacagcaacagccaaacgaaagggaaaaatcggcggaccaaagggaaacgaaagcggcaaatgacaggaaaatgatgcaccaaccgggcctcaagttggaccagtacagaaagcaattggccgcaatgaagacgaagggcgctgcgccgacccgtgattggtccccgcaagagactttgttgttgttggaggggcttgaaatgttcaaagatgattggaatcag

SEQ ID NO: 55200 - DNA, 478 bp, Heterodera glycines
  Genomic contig location: Contig_ID=SeqID_24473; Location=694..1171; Strand=-
  SCN-specific regions: Sequence locations=1-51,87-207,230-478
atgtcggggtcggagtttaacggagtcagcatggtagggatttggattttcaatttatatttttaaattaaattatagaaatttaagagagtgtatgtatatatgaaatactgtggcaggtgcttttcacactaatttcgcggcgctctttttcaaaaacctttgtggaaaattttggaaaattggttgcatttgttatcaaatttgtccaaaattaaaatttaggattttgagcctaagaaattttaaagaatattttgtcccgtcggtgccggtaatggcgagaaattttctaaaagtttagtggaatttacaaactgataattttatatcattttattttttagcaactactcaatccagccgccttatatttttattaaatttgcaatttcattttgcaattaaaactgactcacgaactttgaagtttgctctaggctaaagccgattttttggttttttttttgaaaataaa

SEQ ID NO: 55201 - DNA, 1957 bp, Heterodera glycines
  Genomic contig location: Contig_ID=SeqID_521; Location=2882..4838; Strand=-
  SCN-specific regions: Sequence locations=1-626,652-689,711-1957
atgtggggaacccttattcttgtcaagctcaacagattccaaaaacaaatcactgacgcgttagcgcctttcaccgttaccatgcactaccaacccaccaataactccatgaatcattaccagcgcacaaacccaatcgaacgggtctgtcgtcagcaagcggcggacgggcatttggtggtggcacgctagttaatcatagagacacatcctctgcgttgggcgcaaataacccgcgacggcctcgcaagctacctacacagaacacaaaggatgttaagatttctttctgcagttcgcacaataagatacaatataggatcaaaaaaatgcatcattaccagtttatacaatttgggattgttttcgattaaaaatttgtgctataaaatgtccgccttttgcaattttgtcatgttttttttcaggtggttaaaacgcgtctgcaaagttcgcatgggcacgaaatgcgacgtcaagtgcagctagaacgattgcaacggtggacatcatcgacaagttcgatcagttcagcaactacgaccacggcagcgtcgaacagcacagcgacaggttttttggaaaaaaaattttttctcgggggctaaatttgaaggggatcaatggcagaaaattcattttaaaaaacaaacgaaatgaaaattttgccgtttttcccaatatttatgccacaaattttgtaaaaccaaaaatttttttccagaaaatgggtttcccgcaaaaatttttttgttttttttcgtcggattaccgcctccaaaatttggcccaatttcacttaaaaatacatgtgaatgccctctttttacagcctcccgtttttcgctgtgccaagtcagtcaatgccaacaaaaaaaaacagaacaaattttactcggaaattgggactgagtgccgccgagcataaatttttccgttcgggcgcaaaaacgccgaaataaaaaaaagcaacgaaatttttagttgaaaatttactaaatacacgacaaaaaaataggtttcctcttagttagggatggcacggaattccgatttccgaaaatttgtggcctcgtggcctcggaatgccatccccgccatggacacaaaaaaatgccatggaacgcgtaaaaccgactagaaccggaaatttctgcacccactgcaaataaaaattgttttttttgttaagttacaccgatggacgtcgtgaaaattcgtctgcaaagccaagtgaggcccctcgcggagggcgaatgtttcctgttctcaaacggtttgcattttcaagaagttttggactttgataattttttagatcgtttatcataaattaataatttgaaaaaaatcgcacatttaattgggcaattttttgtctttatttaatcaatttttggttaaattttaggttggttttttcaaaaaataaataaaattttgagatccattggaccatttgtttgctggtccattttaggcttatataaaaaatttttacttaacaaagctaaaaagtagcaaattttgaaaaaaaaattggatgttcaattggacaatttgtctctgtttattccgtccaatggtcggtggtgggtttttcaggcatttttgggttccactgctattcgacatttcattatttaaggaccatttgggatttttgcggcccaaatttaatagtcggccttttgtgccaattcctggtgtaatttgtcccaaaaattggggaccagtcaaccaatttggtttcagtaccccattatctgggacagaaaaaaatttctgtcattttttggaccttacaatcagttaattttatctcgtcctgatccgtcttggaaaccatagttggttgcatcttattgaaaaaaaattttttttttcaggacgccttcgtgaaaattgttcgaattgagggacttcgttcgctctggtcaggattgtcgcccacaat

SEQ ID NO: 55202 - DNA, 3685 bp, Heterodera glycines
  Genomic contig location: Contig_ID=SeqID_521; Location=5401..9085; Strand=+
  SCN-specific regions: Sequence locations=1-443,465-1027,1049 -1595,1617-2179,2201-3180,3202-3580,3602-3685
  Gene Ontology: Cellular component=extracellular matrix; Biological process=heart development
ggagccgggcgaggtggactggcagcgaccggcgatgggagcgatcggcgcaggcaagggcgccgggcgaggtggactggcagcggccggcgaagggagcgatggctcccttgtgttgagtgctggcagcggtcggcgaaggcaagggagcccagcgaggtggactggcagcggccggcgaaggcaagggagccgagcgaggtggactggcagcggccggctcaggcaagggagctcctgcctgcacacagtatgtcccgtgaccctcatgctgaagttaagggagtgtcgtggtgcgtggcttgtacaacacatgacacaaacttttcttcgcgaaggcatgttggtcttaaggcaagattttgcccgggtccacgcacctgtgattcaatgaattagatttcccaaatttcatgcccatccacttcaaaaagccttttaaataccgaacactacccccacgcccctcccccacccatcttatttttaccatccaccataaccatgcccctttccacgcccatcatcacccgcaaccatctcatttttaagcctattttttgcctattggctcaatttatttcctacgcgcgcgcgcgcgtgttgaaatggtactgagctcaatttattttctacgcgcgcgcgcgcgagcgtcaagggcgccgggcgaggtggactggcaacggccggcgaagggagcgatggctccctttggctgagtgctggcagcggccggctcaggcaagggagccgagcgaggtggactggcagcggccggcgaagggagcgatggctcccttgggctgagtgctggcagcggacggctcacgcaagggagccgggcggggtggactggcagcggccggcgatgggagcgatcggcgcaggcaagggagccgagcgaggtggactggcagcggccggctcaggcaagggagccgagcgaggtggactggcagcggccggcgaagggagcgatggctcccttgggctgagtgctggcagcggacggctcacgcaagggagtccatcgaggtggactggcagcggccggctcaggcaagggagccgggcgaggtggactggcagcggccggcgaagggagcgatggctccctttggctgagtgctggcagcggacggctcaggcaagggagccgggcgaattggactggcagcggccggcgatgggagcgatcggcgcaggcaagggagccgagcgaggtggactggcagcggccggcgaagggagcgatggctcccttgggctgagtgctggcagcggacggctcacgcaagggagccgggcgaggtggactggcagcggccggcgaaggcaagggagccgagcgaggtggactggcagcggccggctcaggcaagggagctcctgcctgcacacagtatgtcccgtgaccctcatgctgaagttaagggagtgtcgtggtgcgtggcttgtacaacacatgacacaaacttttcttcgcgaaggcatgttggtcttaaggcaagattttgcccgggtccacgcacctgtgattcaatgaattagatttcccaaatttcatgcccaaccacttcaaaaagccttttaaataccgaacactacccccacgcccctcccccacccatcttatttttaccatccaccataaccatgcccctttccacgcccatcatcacccgtaaccatctcatttttaagcctattttttgcctattggctcaatttatttcctacgcgcgcgcgcgcgtgttgaaatggtactgagctcaatttattttctacgcgcgcgcgcgcgagcgtcaagggcgccgggcgaggtggactggcagcggccggcgaagggagcgatggctccctttggctgagtgctggcagcggccggctcaggcaagggagccgagcgaggtggactggcagcggccggcgaagggagcgatggctcccttgggctgagtgctggcagcggacggctcacgcaagggagccgggcgaggtggactggcagcggccggcgatgggagcgatcggcgcaggcaagggagccgagcgaggtggactggcagcggccggctcaggtaagggagccgggcgaggtggactggcagcggccggcgaagggagcgatggctcccttgtgttgagtgctggcagcggtcggcgaaggcaagggagtccatcgaggtggactggcagcggccggcgaaggcaagggagccgagcgaggtggactggcagcggccggcgaagggagcgatggctcccttgggctgagtgctggcagcggacggctcacgcaagggagccgggcgaggtggactggcagcggccggcgaaggcaagggagccgagcgaggtggactggcagcggccggctcaggcaagggagctcctgcctgcacacagtatgtcccgtgaccctcatgctgaagttaagggagtgtcgtggtgcgtggcttgtacaacacatgacacaaacttttcttcgcgaaggcatgttggtcttaaggcaagattttgcccgggtccacgcacctgtgattcaatgaattagatttcccaaatttcatgcccaaccacttcaaaaagccttttaaataccgacgcgtgttgaaatggtactgagctcaatttattttctacgcgcgcgcgcgcgagcgtcaagggcgccgggcgaggtggactggcagcggccggctcaggcaagggagccgggcgaggtggactggcagcggccggcgaagggagcgatggctcccttgggctgagtgctggcagcggacggctcaggcaagggagccgggcgaattggactggcagcggccggcgatgggagcgatcggtgcaggcaagggagccgagcgaggtggactggcagcggccggcgatggcagcggtcggcgcaggcaagggagccgagcgaggtggactggcggctcccttgggctgagtgccgaggaacgctgtgaatgaactgttttggtgctgcagattgaatggcagagaacggctttcgtgcgagttgtctgtcgtttgacgtgatgcaggctactgtggtgcagcattgtcgtggcctcaattttcggatgttgatgcgcgtttgagcgtgtaagtcgcaagtgaactcagagctaggaagctgatgttccgtcctgagcacgacgttaaactgcttccagggaaacctgggttttttcaaagctgaaacttgtctgtctgtgttttccaaatctgtcaatattttgaaagatgcaaattcgtgtttgtcatgaattttcttgatgattgcacgcgaatttcctactgctgatttttttgtgaatatgatggttttcaaaaaaacaatttttcattttttagctatttaaatgttctcctttattattgttttcttttgcctcctttctgcttcccgcgtcagctccatcgacccggcgggcgtgtcgctgccttcaacttccgcggaggtggccgcggatgttgatgcgcttttgggcgagatggtcgaagcggtcgcagcggaggttgctgaaccgtccggctcggaaacgttgaatgcggtagattcagtcgatttctggagaattgttattttttcgtattaggatgacgaagtagtggtcagcggcctatgggcgagtcaagcaccgggcggcccgtgctcaacaccggcacgcgacga

SEQ ID NO: 55203 - DNA, 5960 bp, Heterodera glycines
  Genomic contig location: Contig_ID=SeqID_522; Location=304..6263; Strand=+
  SCN-specific regions: Sequence locations=1-657,683-2286,2308 -2404,2426-2496,2520-2720,2742-3714,3748-5359,5381-5960
atgcagcagctgacttttccaccacccaatgatcctggacgtttccgtcctggtgagggttatatggcaccgtggtttgtctgttttcctccgtccaggtcctcgatcctggttgccgggcaactcgtttgaggctaagagacggtcaagcgaaaaaaacagacacaaactgtaactttacgtgcgacgttttttccaagctgtaactttacgtgcgaggtccgtcctgagcacgacgttaaactgctcccagggcaacctggatatttccaagctgcaactctgtcgtccgtatttccaaactgtaactttacgtgcgaggtccgtcctgagcacgacgttaaactgctcccagggcaacctggatattttccaagctgcaactctgtcgtccgtatttccaagctgtaactttacgtgcgaggtctgtcctgagcacgacgttaaactgctcccagggcaacctgggttttttcaaagctgcaactctgtcgtccgtattttccaaactgcttacgcgcgaatttacgcattatttcaacaatcaattggtttcccatttcctttattccaagcagttttttgcctgctccatagcgcgcgcccttattatttcatgcatttattttgtcgtttaaccatttcattatttttcacaatataatatattaataatttttttcccttttagccaggtattttgcgtgtttatttgcattactaattttcccattttggacagctttcatcttacgttctttatattgttctcagcttcatttattggtaagctgtgtgtctacacgcgttttcccaactaataacatccccatttttcagacttgttcttcttattatttgttttcttctatttttcatttatttttcattgtccttcccgatttgtcccgtctgaccccaatgccttcgggctccctctctcccctttccttccccatccttccccagccccgccccctatcccgactttcgccacgacccgtatcccaaacagctctctttagagctaaccccgctcctctctctctctctctctcgccttcttcgtcttgccgtttgacggttggcaagccatcgaagaaaggtcagcagcatttcttgtgtaataataatctcaaatatttacctttttacagccaaatttgtcccggcccctgccacggcaaccggctttgtcgggcccgcacggcgccttgcccgcccacgttcgccaactccaactggcgttcgtgtcgctgcgtctccggtccgctcgtaccggccgaaggacatcctcgccccgccgaatctccccaaggacatcgacttggggattttcaaaaagccgattgccgtatgtttgtagtcaataattaaacaacattttcttaaattattctcaaatttagggccgggactggagcgaggactgtgccacttgtgcggcattcatgggcgccatgtcagaacacatcgacacgtgcgctctggcccgccttcgtcacctgattaaggagatgaagaagtttgccgctggtgccaaagacaacttggcccactcgcgtggcgtcggcatcgccctccaggtgccaaagccgtggccggtggcagaggaggatggttggacgggcgtcaccatcccgggctgtgaggaaaaatcgcccgttgctgagccggctatcgctgaactgtgagtgcaaaatacatccttttcaccaaaattctttccttaacccacatttttaggcgtaagccgaagaagcagaagcttccaaaggtggtgcctgacaagcgccagccttggctctgcaacaatgatggccggccgattccgggactggctccggtagattcgttcatttgtttttctcaaaatattgtttccttttttaggttgcgaaacagttgccggtggctccgcttcgcaagttgccaactgacatgccgcgccccaaaaacgtgtaccacacgatcgttaagggcaaggtgaactgagtgcgaattgcaatcctttatttttttgcttattattttcaggctgtcgcgtcaatcaagcttttggagctgtcgaagatcgacaagccacgcgtgccgatcggctacgcgccaattgctcgagccgagaagccagcgcttcaaaaccgtcctgttttgaacgctgtgccgaaaccggtgctccgcgaaccgagcgaggaaatgttcgtcgttgtgggacaggtgtgttctgtgttttttaaatcaattatcgttactgaatttttttcactttaaggccatcccaaaatcggcggtggagaaggccaggaaaatgcccgacgtggtgaagaaagtgccgccaaccgtccgccacagaagaactgtgtggaactcctcttcggtcagcttcgtcgtcccgtgcttttatgtgcttcaacagtacatcaaagcaacgacttccgcggttgcgtcttctgctcccgctttgaagtcgtcatcgatgagctacgctcaagctgtaatcattattctttattttttcaaatagctttttctgttttagttaacgaagccgcttccgagcaagccacgtgctgtggtcgccagtgcacccggcattccgaataagctgcgttttgaagctccacgcctcagtgaggagccgaattggcgcttattcgtcgggacgggctcgcgtcgtaacaacatcacgacaacgcccaacgcaccaaagctgccgattctgcagaagacctatgcagaagcagctcgcacgcccaaagaagctacgaaaaagcctcttagtgcgacggctcgctcctttacccttggtgatttcttcatcagcaagggtgtaaggggcgcatcgaaagctgaccgatgtgcgctgacaactgccgaagctgctcctaaacgacagcgaggcggcggccgtgaatcgagccgaagcgctactccaacggggaacgaagagcagcacgcctttctcctggactgcttccaaagaagtccaacacaaaaggaggaagcgttcaaagcactgaagaagcagttcaagaagacggtttcaccgcggacctatggccgatggtggcagaatttttgtgacgggaagcttactttgagccaacgcggaagtgagttttttatatactcgttagttatggtaaatgccctaactcaataggaacatcagaacgcagccagtccgttcgagaaagtgtgtctccagcccagtcagttcagttggaagaacaacatcaagttccgcaggaattggaagctgcaggcaacccaacttatgacagcgaactgatacgcactcaaacaagtagcgcgacaaatgaagaacagcacgccttcctactggactacttccaaagaagtccagcgcaaaaacaggaagccttccaagcgctgaagcagcggttcaaaaatgttgtttcgccacaaacctacggtcgatggtggagcaactttttgaaaggtcaactcacgttgagacagcgcggaagtgagtttattatttgtccactttcaagattaatttctgtctgcctcaataggaccatccgaacgctcttcatcagctcgtgaaagcgtgtcgccagcccagtcagttcagttggaagaacaccatccggccccgcaggaactggaagctgctggtgatccaactggggacagcgagcttattagtgctgctgtacgacagaaggaactggatgagggcttcggtaaaattgtaaccaaaattctcttacctttattcccacattatagacactccatcatcgaaacaatctcgaagctcacgagggcaatttggcaagtcaaggaaatgcgttttctgcacaatccctttgaacgatgctgatggctatgcaatgttaaattgcggacattcatgccactttgaccagccctttgccgaatggtatttcaattattacatttattaaacaaaacgattcataggtataccgatgtgccgaataagaaatgcaaagttgcacggtgcaaaaaggcaacagttcttaaatgcaatgaatgttgtcaacgcattggtatgggcatttacgaaaccggctgttattgcgcggaaacctccgcttcagtttatcacgcggatgaattggaagcgaggtgctctttcataatgcaaatttgttattttagttttattataggctcaaagcaagcggtggcaaatgcccagattgcggcacgcaacaccccggcttttgcatgttgtgtcagcggctgttcaagctgcaggcaaatgggcttcgtcagagcaaggtgttcctgccttgctgtgactcttacactcacttcgaatgctggtagtgtttaatcattttggatttttaccccatttccttttggcaaattaggtattcgcccgcaccgaagcagagctgcccagcaaagtgcacaaagccgtggcaagtcgttcaggacatgcattaccagtaagcgactcatacattttctttcactagtatttgcatttgtattttagccaaatttgtggtgtccaaaatgctgctccgttgcctgcagtaccgaagccaagaggcatcgttggtggacgcccgctgaagaatgccaaggctgcgtcgccaacagagtccattccatcgactgttgacacgacgacggccgcggcttcggatgtttccgccaatgaatcccaagcgctgacggactcgcatcttatgccaccaccatcgttggctcctcgccgcagcacacggatcagccgacaagcgtccatcgcaagcaatcggcccagtgctgtggcgccaaagcccattgctccagtgacgcactgttgcggaaccattcagtctgctcactttggatatggctgcggttccaaaaaggcgaaccatctgccttcatactacaactcgcttcgggatcaagtgggtttaaagtatttgaatccagtagattagttcattctatgtaggcacaacacaattgccctcactgcaatgcgttgctgttggcttccgaagcagttggaccaaccgcctattcaaagtgctgcgcaaaaggacgtgtcaacttggcggaccgctacaaagcgcttcgtgctcggccagccgaattggacaacatcctccaaaacccggcggggcagtacaaaggctggagggactcgctctttcgccacgtgctgagatacaacaacaacttggcattcgggaacatcaacatcacccgcagcgaagagcgaatcgacttgcatcgaatcgtgaagtgcaacaacatgataaactacatgttgtgggatttcaacccacccgatggcggcaaaccccatctgcacggacaacttttcacgatccctccagccgatgcgcgtactcgcctgggcgaaatctctcgggaacattcgctggacgtaagattgacttatgtttccaatttcggttttattttttattttacttcaggaacagttgatggcggccctttacggcgttcttctcgcaaaccacaagcttgctgtggtctacgagacggcagcggagacgtaccgtcagctgccggaagaagaccgaatgcagttccgaatgctattggtggacaccaacaagcggggcacagagcgaagattggatgccaaagatgcgccggcaccggacaatttgcatgttgatgaccgggccaacctcaggcacatccatcctggacggcttgagaccgaaacggatgctggaagtcgccttgtggctcaagtaagcttcggcgtttggtttcatgtcatataaacagtgttcaattttttccagatttttctggactgcggagcgaatgtgatgccaccgagcgtgtacgacgtggtgctcacgggccgtgctaccaccaagatcgtgcacatgaaatggtggaacaggaacattgatcctgccaatttcccgctgatcttttccttcggccaatttggctacggtagagtgtttttgtga

SEQ ID NO: 55204 - DNA, 705 bp, Heterodera glycines
  Genomic contig location: Contig_ID=SeqID_4640; Location=2366..3070; Strand=-
  SCN-specific regions: Sequence locations=1-705
gaattcgtcaaagaaaatggcatcaaccacctcttctcagcgccgtacaatccgatgtcaaatggacaagcggagcgctttgtcgacacctttaaaagggcatgtcgcaaactgaagaaggagggcgcgaaaaatgtggtgaacacatttttgacatcatatcggacgacaccgaatgactctttgcccaacggcaaaagccctgccgaacttttcattctgcgaaagccttgcacaacattggatttgctgagagcaaaaccatcgccaccactgatcagagacgaggcgatggaaaagcagttcaatcgtcgttacggtgcaaaacctcgaaagtcttgtcttggcgataaagtttttgctcgtcatcgccaatcgcaatcatggcgcgctggaatcgtcagccaatgtcagggagtcatttacgaggtaaagttcccgaatggcacttccaaccgattctacgcaaaccaaatgacggcccgtcacatggatcaccaaggcaatgatgagttgaacattttcaacgatgcttttggtcttccgttggcacagctggatggtcccaacgaagcagctctgccagctgttcaacaagcggcacctgcacaagagacagacgaagcaattaccgaacgaagtccagtctgtgtcggtcgccctcaccgcaatcgacgcccacctctacgctacactccgagctga

SEQ ID NO: 55205 - DNA, 867 bp, Heterodera glycines
  Genomic contig location: Contig_ID=SeqID_4641; Location=123..989; Strand=-
  SCN-specific regions: Sequence locations=1-867
atgcgatttcttcgacagccgttggacgaactgctgaaacaggacgtggcttgggtctggtcatcggaatgccaaaatgccttcgacaaaatcatcgaagtgctgaaatctgaccaactcttgacccactacgacccggaaaaggacatcattgtatctgccgatgcctctgattatggaatcggagcagtgatctcccatcgttttcaggatggcagcttgaaagcaattgcacatgcttcttgctctttgtcgcctgccgaaatgaactactcccaaatcgaaaaagagggattagctcttgtttttgcagttcagaagttccataaatatctttttggaagacatttcgtcctgccaaccgaccataagccattgttgaccatttttggtaacaagggcattaaagcgtatacagcaaatcgcttacagcgctgggcactcatactcttggcgtatgactttgagatcgaataccaaaacacgtcagattttggtcaagccgatgctctttcgcgcttaattgcaaaagcgccagtgcccgaagatgaatttattgtggtaacaattacagaaagtgcaaatttggcaactgtgaatgcctttacggcacaatttccaattgtccacgaggacattgtcaatgccacaaaatcccataatttgcttcaggaaattaacggattcatcctgaaccaatggccaaacaaagcgaatatatgtcagaggacattttacaattccatcgaaggcgagaagcgctgtcattcgaaaacggatgcatcatgtacgccgaccggattgtcgtcccagcatcgcttgagacggaagtgcttaaaatgctacatcgtggacacccgggcatga

SEQ ID NO: 55206 - DNA, 1707 bp, Heterodera glycines
  Genomic contig location: Contig_ID=SeqID_4642; Location=33..1739; Strand=-
  SCN-specific regions: Sequence locations=1-830,852-1707
atgaacgctttgcaactgggtggaatttcagtgaacgcactgaaccaaccgagccgtcttgtcgaggcaccagttgatgtgaatggcaaacccattgattttgtgtttgatccgggagctgaaatcaccgtgatcgacgaagaagcacatcttcaaattgaacgtccccgattgattcaatgcagtgaaagtgccaaataccatgatgtaactgaatgcaccctgctagggaagggttttgcgactttcacgttcggaggacgcacacaccaaggacaattttatgtgaccaaaaagggttcactgaatttattgggaattgacattttggacgcttttggcttattggacacattcagagccaaagctaaaatggcaatgaaagtgaatgtggttcaagcggaaaggaaggaccgaatgaagagtaaatcccgtcgaagaaggacaccactttgcttgaccttcagtcaaattttcgcacgtttttgcagaaggcctgggccactgcacgaaagccaaagcccatttggaactgaaggcggatgctgttgccgtgtactgcaggccacgtccagtgccattcaacacacgtttgattgttgaggccgaattggaccgattgctggcgcagaaagtgatcaacccaatcgatcacacccgttgggccgcacctattgtggttgttaagaaggctaacgaagcagcatgcgtttgtgcagatttctctatgggcttgaacaacgcattgcttttaaatcagcatccattgccgttgcccgaagacatcttcacgaaattgaatggaggaaagattttttctcagatcgacctgaaggatgcgtatctacaggttgaattggacgagaagtccaaagaactgtgtacaatcgccacgcaccgaggatttccaattttttcgcttaccatttggggtaaaatcagcgccaggaattttccaatcgatcatggattcaattttggccgattgtccattcgcgtttgcttaccttgacgacatgatcgtggtcagtcgttcacatgaggagcatcgaaaacacgaacgaagttttcaagcgaatcggaaattttggattcctgatcaaacccgacaagtgctcattcaatcagaagcagatcaaatacctcgggttcgtcatcgataaaaacggaaggcgaccggatccatcgaagattaaggcgatttctgaaatgctcgtccctaccaatgtttcggagcttcgatcatttttgggaatgatcaatcattaccagcagtttgtgaagaatatgcaatttcttcgacaaccattggacgagctactgaaacaggacgtggcatgggtctggtcaacggactgtcaaaatgccttcaacaaagtgatcgaagtgctgaagtcggaccaactcttgacccattatgacccggaaaaggacatcattgtttctgccgatgcctctgattacggaatcggagcagtgatttcccatcgttttccggatggcagcttaaaagctattgcccatgcatcgtgctcattgtcgcctgccgaaatgaactactccaaaatcgaaaaagagggactagctattgtctttgcagttcaaaagttccacaaatatctttttggaagacaattcgtactgcagaccgataacaagcctttgatgaccatttttgtaacaaaaagggcatcaaagcgtggatag

SEQ ID NO: 55207 - DNA, 645 bp, Heterodera glycines
  Genomic contig location: Contig_ID=SeqID_4642; Location=1996..2640; Strand=-
  SCN-specific regions: Sequence locations=1-334,356-472,494-645
atggcagcaaatccgacaattgacgaattgacgaaattgctggccaaacagcaaaagttagtcgaacaattgctgaacgctcaacagacaaatgtcgcgccaactcaaacagcccaacttccagcgctttcaaatatggaatgttttgatcttgatgatcattctgggaagaacatcgaaagttggatcgaccgctttgtgttggccctcgactgttcttcgccaaacatccaagaccaactgaaagtgaagctggtgctgacaaaattgagcgagggagcctacaacgaatacagcaaattttgtctgccgaagaaaccgaccgatttagactttttggagacatcggcacaacttaaatgtttgtttgccaagccccaatcggtttggatagaccgatacgaatgtgacgatgaagacttccgtgctttcgtcaaccgccacaagcgactgcttcgcgattttgaatttaagaagctgaatgaagagcagttcaactgcctcatgcttctgatcgcactgaaatcgccgagagacgccgaactgaggaaacgaatttttggaaagttgacaacggacggcgacaaagcaaatgtacgacaatgtcgtcagcgatttgcagatgttcctgtcgacaattgctga

SEQ ID NO: 55208 - DNA, 1600 bp, Heterodera glycines
  Genomic contig location: Contig_ID=SeqID_4643; Location=396..1995; Strand=+
  SCN-specific regions: Sequence locations=1-209,231-280,304-364,671 -734,763-1048,1097-1213,1242-1251,1273-1393,1453-1600
atgtcgtattcgtattcagcgaccccgaaaagcctaaaacagatccgttttccggctttttatgagctttttagacttttggacaattcgtgggtttttactcttttggacaattcgtggcttggacaattcgtggcttggacaaaacgtggcttggacaattcgtggcttggacaattcgtggcttggacactttgtgggggcgccgcagaaatagaaaggaaataaataaaataagcggaacaattgagtacctttcccaataaatagttagtaaatcaaaataaaattttataaaattttcaaaacgataaaaagctattcttcagaactttaaaaaagagacagtaacaagagtgatttgattaaataaaaaaataataatattcaaaaacatattattattacttaagtagtgtgataatcaaatttaaaactgaataaacatttttatttataccaacaaaataaaaattaataaaacataactttaaataaatgtctatttacaaaatgataaatattaaatatgtaaaaaaaaattcggaattcaaagttatttcgaatattattgaaagaatatataaatatatttgttgttttaaaaaaataaacaaaaatttaatttatttttatattaaaaataaaaaaatttgaaataaaattatatgcaattaaacgggtttggttcttcggggtcaaaaattgttttcctccataatctatgtagcgctatttaagtcaaattttaaaaatatattcgttgtcgctgtcctcacaaaggatccaaagacaaaggcttggctttattattatatgcaatgaattcaaatggcttgtatttgtcaccggaataaatttgaacgatatttaaaattatgggtgtaatttgttaacagcttttcaccgaaaaaggaggatttttcgattttgagataattgtgttttttacttttcacaacgcttcttccgggcgcatttttccgagactttttcggaatggcggagaaaatgttaatgtgtttttccaaaattggtcattttaacgctttttgggttctctttttgaataaaaattttaaaaaatagaaagagagatcccggcgatgcctatcgacaccgccgggaaaaaaattgggaatttttgtgcaatttagtaccagattttgcaccaataatgcaataagttaataaaaacttggtataaaaggtcaaaaattaaaatttttgaattattttttcaaatgctcattttcaaggacttcttgaattcaaggatactttgaaaattttcacgcgagaagggcccaatttcatgtacgtccttgacattcaaggacggatggcagccctgctcatgtgttatttgaatcaaattttacccttaatcctgtaataataattatttttttaatatagttttaattaaattatatataaacattaaaaatactattgaagactcgggactcgaatttatgaaaacccattccgatccaaaaaccgcattattctattttaatttatacggactcttggactcagattatcaagatatttaggttggtgaaaatgaattcagatgtttttatatttatga

SEQ ID NO: 55209 - DNA, 225 bp, Heterodera glycines; identical to SEQ ID NO: 50965
  Genomic contig location: Contig_ID=SeqID_24475; Location=643..867; Strand=+
  SCN-specific regions: Sequence locations=1-225

SEQ ID NO: 55210 - DNA, 1400 bp, Heterodera glycines
  Genomic contig location: Contig_ID=SeqID_24476; Location=147..1546; Strand=-
  SCN-specific regions: Sequence locations=1-214,236-518,540-655,689 -718,920-1122,1144-1168,1191-1275,1297-1370,1392-1400
atgaagaggtacaaatgtgatttaaagaggtacaaaagtgatttaaagaggtacaaaagtgataaaagaggtacaaaagtgattagaagaggtacaaaagtgattagaagaggtacaacagagattagaagaggtacaaatttgatgaagaggtacaaatgtgatttaaagaggtacaacagtgataaaagaagtataaaagtgattagaagaggtaaaaaagtgattagaagaggtacaatggtgattagaagaggtacaaaagtgattagaagaggtacaatggtgattagaagaggtacaaaagtgattataagaggtacaccagtgattagaagaggtacaatggtgattagaagaggtacaaaagtgattataagaggtacaacagtgattagaagaggtacaatggtgattagaagaggtacaaaagtgattataagaggtacaacagtgattagaagaggtacaatggtgattagaagaggtacaaaagtgattataagaggtacagcagtgattagaagaggtgcaactgtgattagaagtggtacaacagtgattagaagaggtaaacagtgatcagaagaggtagaacagtgatgagaagaggtacaactgtgattagaagtggtacaacattgttaggagaggtacaatattgtttaaaattaaataaataaggaaacgtttttattaaaagttaaaaatcgagtgcattttaatttaaaaattttttaataataaaatactcttttattaattaaaaacaaccttggaaattattaattgaatatttatttaatttgaaattaaatgaatttttttttacaaattcaaaaataaataatgaaattctttaatttaaaaaaaataaatttaaataatttaaaagaaatcttcaaaaattaattaaaaacattgtaaaataagccaaaaatacaaagaaaaataatgttacaccgtccggattcgaacctgcggccccccccccctcagaacatgtcccagaatccccaatcacacagggattctgagggcttaacgatgtcaaacgtaaaatctgatcacgtattcgtgatcagcggcccaaataacccctaaagacatgtttttggaagatttttgtcgaaaaaattttttcactcaaaaaccatgtgcacccccctttggtcccgaatcccaaaatcacttttatttttgtatcttttattaaaaatgtgatagaaatgccaaataaaatttatataatagagcaaaaaattgcggatttttgtagtattttacttttctcaaatagcttttcagaaggcagtaacgaatttttttctgaaaaatctaaaatttccagaatttctggaataacttttttcatattgatgttagaaaacctaaataaa

SEQ ID NO: 55211 - DNA, 688 bp, Heterodera glycines
  Genomic contig location: Contig_ID=SeqID_24476; Location=929..1616; Strand=+
  SCN-specific regions: Sequence locations=1-79,101-383,405-688
ttgtacctcttctcatcactgttctacctcttctgatcactgtttacctcttctaatcactgttgtaccacttctaatcacagttgcacctcttctaatcactgctgtacctcttataatcacttttgtacctcttctaatcaccattgtacctcttctaatcactgttgtacctcttataatcacttttgtacctcttctaatcaccattgtacctcttctaatcactgttgtacctcttataatcacttttgtacctcttctaatcaccattgtacctcttctaatcactggtgtacctcttataatcacttttgtacctcttctaatcaccattgtacctcttctaatcacttttgtacctcttctaatcaccattgtacctcttctaatcacttttttacctcttctaatcacttttatacttcttttatcactgttgtacctctttaaatcacatttgtacctcttcatcaaatttgtacctcttctaatctctgttgtacctcttctaatcacttttgtacctcttctaatcacttttgtacctcttttatcacttttgtacctctttaaatcacttttgtacctctttaaatcacatttgtacctcttcatcaaatgtgtacctcttctaatcacttttgcaatcccaaattgcttcggatcgaaactccacaacccataa

SEQ ID NO: 55212 - DNA, 630 bp, Heterodera glycines
  Genomic contig location: Contig_ID=SeqID_24477; Location=458..1087; Strand=+
  SCN-specific regions: Sequence locations=1-89,205-630
ccatacatattttattcaatttcatgacgactcagaacagtgacgaagaaattggtgcggaggctttgcaaaacggacagaacaatggtggaggaggggaagaagcaggagcaacagcagttaatgatggagaaacaattgctggagaagttgaaggcaacaaagtgaaggaattgaaggcgaaggaaggggaggaggaaaaggcagttgacaatggggatgagtcggttgaggacgaccgcgcattcggcacaaaaacgccgccggcgtcgcaactgcgccaaacgccgcctctctcggccagcattcgggctccgaccgtgcgcaagcgttgctccgcagtctttggtgcaaggacgaggtaaatttaaattgttgtcttggagtttttcaatggaccctaaaaaattaaagatttcatcgatttttttcaaatcgactgcaattttgtccaaaatttttgctacaaaaacagattttcttaattatgtttagccacacttccactagtggcggcggtggtggtgggctgtccgcgttgaccagtgcgatgttgggcaagaagccacgcaagcagtccgtgctggacaacgcccagtccggctggcgctcatttgtgcaggaggaaca

SEQ ID NO: 55213 - DNA, 1458 bp, Heterodera glycines
  misc_feature (7)..(7): n is a, c, g, or t
  Genomic contig location: Contig_ID=SeqID_24478; Location=44..1501; Strand=+
  SCN-specific regions: Sequence locations=1-315,337-1315,1337-1458
atgttgnagacacatcacaactgggaatacgcatacggacaatcgacaaatctcaaatacgctcttaagtacccgttcaagggagcaagtttttcctatttgcgttgtgcaaatgaaaacaaaacgaatgtcgacgaaccggcttactatgccagaatgctttatcgttcacctgttgaggcctttagtcgcatcatgtcattccgctacgcaataatgtcacataatgtaatccctttatcaatccatttgccaggtcaacagaaaatttatacacgtcctggacttgaggcccaacaaattgcagaaatgttacaaaatggacaacttcaacttcctgatacagccctcacagcatattggaagcattggcgagcagatccaacattgaaaaatatcttatttgagaatatgcctgagaaattttcgtttaacaaaaaaaacaaaatctggaaaccacgcatcatttctaaggatccgaaaaggatggcaaaccgcagaccatgcattggacgaatttatcctatcttgcctcgggcccaagaactttttgccctttatctgttgacaaggcattttcccggtgaccctgatcatttgaagaaagtgggagaacatcaatgcgaaacgtttttggaatcagctcgacttcggggacttatcaaagactcggatgtttggatccgaacattgcaggaaggagccaactctttgactccagctcagatgcgacaactccttgcaagcatactcatttttggaaacacggaaaactgtgttcttgatggatcaatgctatggaatcgctttcttacgcacatgtacgactcaagatgcagtgagacagagaaagcgcggcgaatcgatcaagcactttcattgcttgagcgattgttggttcgccttggaaaacaatgctccgattttggactcccaacgccgttaaattcgattgtcaacgacccagatcgaggcgtaaacgacttcttctttcctgaaaatattgctgacgatgaacaagacgaatcagtggacacaagtgcatttgaacacgccaaacttaatgatgaacaacaacacttcttcaaccgaatacgcgatgtcgccgcaacaatgccgagtaattcaagcaagcgcttattctttttatctggtgatggtggaaccggcaagacattcctgcttaactatgtgctgtaccacatgcgaagattgcgtaagaaagtcattgcaactgcctcaacaggaatggcttcgactcgcttctattcaggcggcacaacagtccattcagcgtttcgattcggcataaatgttgaagttggccaacttcctacaataccttttgacagctattttggacggcgcattaccgaggcagacattatcattattgacgaaattacaatgcttgaaaaggttgttctggaaaatattgataaactctgccgaacatga

SEQ ID NO: 55214 - DNA, 403 bp, Heterodera glycines
  Genomic contig location: Contig_ID=SeqID_24480; Location=874..1276; Strand=-
  SCN-specific regions: Sequence locations=1-256,278-342,366-403
atgccgacacttcaagctgagcaacatccgccaccactgtcgccacaaacaaacaatgtacagcagcaacaaccaactgtaccgagtccgctgaacgagcgccaacagagtgtacaaccaacgcagggtgaacatccacaaatccgggcaaacgccatcttgcaaccaaacgtggttcaagcgcagcagcagcagcagcaaagtcatcagtttttggcacttgaccacgacaatgacgatcagcttttgaaccaaatttttttggtagtaaaaatgtaaaaaaaaatagacatatcaattacaggatctcaccactacagctgaaatggaacctatcgctttggacaacagcaacaacaacaatatggttgttaacgatttttggttttgcctatttgtttaa

SEQ ID NO: 55215 - DNA, 6791 bp, Heterodera glycines
  Genomic contig location: Contig_ID=SeqID_4645; Location=139..6929; Strand=-
  SCN-specific regions: Sequence locations=1-1088,1110-2237,2268 -2513,2536-3548,3571-3710,3732-3920,3942-4126,4155-5696,5720 -6484,6508-6553,6605-6791
atgggaattgccgtgtatcaaaaggcaacaactaattacgcaaaagcggaatgcaacctaatctttgccaaaagcctcgtcaagccgctcaaattggtcaaccatgacgcaacaattccgaaattggaacttcaagcactgacacttggcgtcaaagcggttaaattcatccaaactcaacttcaatttgacgacgaccaagtcatcttttggaccgacagtcaaagctcaattgagaggcttaaatccggcagaaaagcagatcgattcgtgactaaaatcacgcccgttcaattcaacaggcattgactattttggacctctcaaagtcaaaagaggtactgaaattgtgaagatctacgtcgctctcttcacgtgcctcgtcattcgcgcagttcacttggaaatagcagaagattactctgctgaagccttcgtacgcacatttcgccgattcgtctcaagaagaggactaccgatgcttatcatgactgatcaaggaacgaatttcgtggccggatcgaaagtcatccagcaacattggacggacacgctactccctgaacatgttcaacaacaaatggcacaacaaggcgtaacttggagattcaacacagcacacgcaccatggaaaggcggaacgtgggaacgactcgttggcatcacgaaaaatgctctccgacgaacaattgggaaaaacctcttgccattggacgaaatgcacacattgatttgtgaaatcgaaaccatcgtcaatcaccggccgctcacattcgaatctgaccaagagccttacgtttcacttcgaccgatcaacttcctcataccgtacaaccaaacggagaccaactttcccgtcatcaacgaggatcaccaagatccggactacgagccaacatccaacagtcgtaaccatctcgtcaccatgctgcgcaaaacaagcaacatgctcgatcgattttggacaacgtggagaaacgactacttgctttcgttgcgcgaaagcgaccgaaccaaatcagcgaccggacccctttaccctaaggaaggggacattgtcattgttggggacgatgacttacctcgttccctgtggtgtttggcacgagtgctaaaaatccttcgggggcaggatggaaagatccgtactgcaatcattgagataaacgggcaacaaaaagcacgagcaataaatccactttattcactcgagattccagaaatcaccgagtccgactccgaactgatcgctccgctcatggcatctgaggacgttctctcattagtcggaagcgacgaagagcctcaaatgcccgacaacttcaagataccgaaaaagaagaatgtgatcaaacgctcgcaacgcttcatcaccggacgaaaccacggcttacgagaagtgacacagagcgcaaaagacaacgaccccgtggaaggactactgtacgccaaaagacccgacaacaaactcaagctgttcaaggatggaacgctcaaagtactgctcgaatcaatcacgctcttcaaacgagaagacggcaagaagatggcagatggactgcttgaactctacggaaaaatcccaatgccagaatgggacaaacgactgagagaatgcgaagagaaactacgaaaaatggacgaaacgcgagagaaaaaagacaaagaaagacagaaacaacgaaccgaaaagcgacgaattgaggaggaaaaacaaatggaaacgaagaaaaggaaggcagcaaaagaagagcttatcgacagaagcgaccccgcagttgaaaggaaaaagcacgatgagcatcgaatccgatgggcagcacaacgaaaagcagcagtggatgaacttcgccaacggataaagctacgcaaaaagcaatggtcagtagtagacatcgaaaaagaaatgaaggaaactgaaaaggacgacgaagaacatctgcgagaattggcaaaaagtggaagtaaagaggcagctcgggcaatggaagccaaaccatcactacggcaacaaaacaacgtgcaattgattaagaagcaacaaagaatgtccgacttctatccgacagatggagaaaaagtcctggcctactgcgagaggagatatggcacaaatctcatggcatcatggagacgcaatagagtacaaactgagctaaaagaacttttggagaatgagcgcatcactctacagcacgtcaacggacaacccgcacttttgcatcggatcactgagcacaaaaaaggactttgtggagaatttgtcatcggaaaaatttgttcatggcaatacttggacgaaatcgaattcaaagtcgccgcggatccagaagaagaacaactcgctatgaaagaaaaatcgccaacgccagaagtggtggtcatcgacgaagacgaccctgaacgagaagcatcgatcgaaccgcaattcatcaccgagcgtgccggacacacaccgcctttactgtttcgtcatccgtcacccgagcctcaacaattcatgaagcaccgcgcagctcacactcctccacctccgcctgtacaacttcaacctgcgcaactaccaaccgaagcaccaatcgaagcagacatcgtcgaagaatatcatgcagccaaaagcaaagaagagaaatacgtcgacttcaacatctttaccgaatgtgacgacacgcacatctcctgcgcaagaaatgccacctacggacgaattgccgaagctgccaaccgcgaaaaaatcgaagaattcgcaaattgccgcgctagaaccttgttcgataccatcatgctaaattggctgaactgcaacctcaaccggcccggcaacgaaatctggactatccacgaacaacacacgcagtccttcgactcatcagaagaatccgccaaattcttctacgagcaacaaattgtcaagagtcaacgcgacatcggccgagataagcaccttaaagaagccatcgaaatatggcgatcatcgtgcgacaacttccgagaaatcacagatcagtcagcgtggacgcaacttaaattcaagccaatcaaatcggcagatcagcagacaacggaattcgacaaatggattgaaaggattaatcaacgatcgtgcgaaatcacagcacgcgaccgtgccaagaaacaatttccggatcacatttacttcaatgtcagaacgattctgatcggcgacaatacagccgaagcatttcaacaccattttccaaactctcgctggtacacccactttccggatcaacgacttcgacttaccactggaccgcaagtcaaaaatgtgatcttcacctacgaggccacagaagaagatatgatcaaacaactcgcgccattacttcatcgtttcaaagacgacgacattgaagtgaccctcattctcagcaaagaagacaacgctgaatggttatggcacaaacgagagctgattagactgacaaaacatctcgacacaggatttttcgtgttcaataagcgaattggagaagcaaaagaattggcgaatcgcatcaaaatgactatggatgagcccatgcaactcaatgatgaaccaacaacttcgccggccatcgaaacacgcggcagaaaaccgacacgcaaaagaatcaccgtcggacaacgaatgatcaatgcgctaatgttcatcagcctgttcattctcctcgcaagcagcacagcatttgcgaatccaatccgccaaaagagatttggtggagttggagtttggcatggaagtaacctagccaagcatctctggccacgcaacaccgacatcgaacaacgcacttcaaaattggcaccatccgtccaacgttacattcaacgagtactcgcactcaacgcaaccgcaactccgccagcaaaacaattcgccacaactacggcgccgccaacaacgagaaaaccaaacacaaccacaacacgcgcaacaccaactacgaaagcaacaccacgcacaactatcacgggcagaacttggcacacaacggtacaaccaacgacgcaaatagtaccaaaaacgacaacgcaacgtccaatcaccactcgctcgaaatttttgccctcatcgaacttgctagacaacgaaattccgcaggcaccggactactacctcgcacttcgaaaaaagggcaaaaagacaaacaatgtccaaagcgcgccgcaacttgctagatctgcacaacgaaaaggtgatccgatcaacaaaaatggaatggatgtcttctggtgcggcgacagaggaagcaccctttgggaactcaaagggtcggaaaattcgccgttttgccgcccgccacctgttttgaccgcgcattggactccgcttaccatcgacctgtacaccaaaattcatcggcctgatcaagttcactcagcatggcactgcgcagtcaaaagaacgacggagcagtactacacaaatctgctcggcgaccgcttcatcaccatcaacaaaaccatgatggcagtttcaaggacattgtgcaaacaaatggcactccatcaaatttgcccgttggcaaaaacggaaatgacgatttctggcaataacacgtggtcaacaaacgatgagttggaagtgaacttccctggaccgatcgagggattgttcaaaggactgcaacgaagcacgtcaacaaattgctttgcgcaaccggcaacactgttcatcagacgacacaacctgcaactcacgtcaccaatccatcacgtggaccattgcgcatacactacagaattttgccaactctcagacaacagttcgctgatttggaatgccaattgttctgataacaattgccatgcctgcgacttcaatcacgcagaagaaatttctggagaattcacgaaaatcccgggtcaaacttcagcaatttggatttcggatgatcgacaaaaggccttgacattcaccgacacacaaccattggaggcctgcgacggcaaactcatcgtcctatccgaacaaaatttcggcattcgaaaggaacagtacgaacgcatcatgaacggctactacaaacgagcaaaacgttacgtcgaaccggaacaactcgcctctcaactgtcagccgctcaaatctcaaccaacatggcactttcacaactctacctcaaagagtgccaacgcaacttccgagtcgcaaacccgacattgcaagcgcgcaaattgctcaaccgagagaatctccaagcacgatggatcggagagacaacaatcgaagtcttcccgtgcattaacgtcagcctgaccaacatcagctaccgtgcaacaaaagactgttacaaattcatcccggtcagaattcacctcccaaacgctgatagggatgcatttctcgacgccgaaatgcgcatcctttcattcacctcacatatcgctagctgctcacatctccgctatcattatctgcaactgcagaaaaatcccaacgcatggctgaagatcgacaccaacaccggaattgcaaagcaacttccaccaacagctgtccaagagctttacgaaacggtcatcaatcgatcagacagcgatttcgacttaaatccgctgatcttccatcaatggcaactcgacaacgacacggacaacgcaatgttcccacacatcgacgaatttgccgacttagaagtttttaaggacaagctggagcagcacaaaagcggacgagcccaagctctcggcgcacttcaagatggaattgaagggtggacactgaaattggtcaaggattggctcaacgagctggttaactggtggatccgtatcgcctgcgcctacgcaactttcttgatgatccgcgacctcatcattccatgcgcactagcctatctgctcaatcccatccgcatcactttcatgagcctaatcggattccgacccaaaagacaaccgattcggcagcgccgtgatcaattcgaagaaatcgtcccgctccatcgactttcaactcccccaaagcgcccttcacttcgtcaacgcgcagatcgcccattcacgcctatccatctggatttggatgccaaaagcgcgacgttccgctcaagggcatcaagcgtcacattggacacgccattcggacgatcacgaccgatgaaactggccgacgactaagaaggaaggaagaagggcccatcgttttacgcgcggaatgttcgaactggaggaatttttttctagaaaattctccaattctccgccaatcaaaaattagattggccattgacgtaattcatgtgacccccgccccgctcatttcttatctattttagtaattataatttgtggccccatttacgatttcaccccttttttctccgaagttttgcagaatttgtttgttcactcgtcccacctgtcactcatttacgcatttctccttccatttcacatgcaattcattgtcggcccactcacttttgcccatatttaagaccgatcaaaatcccctatcggcacattcattcgcaacacaacttggggaggaaaaccccacattcccccaaattcctcccccaatcgatcatttatgtaaaaattgtatttttcattttgtatttaaaatttttggtttaattacccaagtttgagtttgaggtccgtccgataaaacatttttattgttgctgtgcacattcataatttggggttaattgacctgcgccatcgccacacatcaccgtcctaacccaactgcacccgaaactaccgtgttttgggtatttgtcgaccgccaactcaggcgtactctgacatcttggcacatcgttacctaaataaa

SEQ ID NO: 55216 - DNA, 268 bp, Heterodera glycines
  Genomic contig location: Contig_ID=SeqID_24487; Location=182..449; Strand=+
  SCN-specific regions: Sequence locations=1-122,144-151,174-268
atgtttctgctccaaaacagcgtcaacaaaatgctattttctgctgaaaagctccaaattcgcactgattttcctcgtggtttcgagaaacagtacgccattcttggccaaataatgagggtattaattaattaattcaaaaactaaaatttttccggttttcatttatttttagaatgctctccacgtcgattccgaaaagagaacttttgacggaaatggacaattgctgaaattggctgccaacttaatctcccattaattaaca

SEQ ID NO: 55217 - DNA, 1249 bp, Heterodera glycines
  Genomic contig location: Contig_ID=SeqID_24487; Location=639..1887; Strand=-
  SCN-specific regions: Sequence locations=1-155,222-1063,1086 -1199,1221-1249
atgggcgttgaccagggcggctaccttaccaccgaaagcacccaatacaagttggtcaccacggtgattgaagctgcgatcagcttaggcatgtacgtgattgttgattggcatgttagcgcgacgtacacaacacaagcggtaagataaattggaaaattaatattaaaatttaaaatataataataataataataataaaattttattaatatatttttgaggttgctttctttacaaaaatcgccaaagcatatggcagttacccgcacatcctttacgagacgtacaacgagcctttggcattgtcgtggacaagtgatcttgtcccataccacaaaaaagtaaaaaatagtaatattttgtgcaaattagctaattaattgatgcttatgtgttgcaggtaattgctgcaattcgtaaatatgacacaaagaatgtgatcattctgggcacacccaactggtcacaagtaaaaataaacaataattgcatacaatttattgtaaaacgaacatttgaaaggacgtggacgttgccgctgccaatccaattagtggctactcgaatttaatgtgaatagaattgtaaatgctacgatgtgatatattttgggatttcattagttaatcttttttgacacattccacaaaggtacactttccacttttacgccggcactcacacagtttctggcctcggggcaaaactcaagactgcctacacaaaaagtggtttttggggtcataattggtttaaaaatgaatatttgcactaattgtcaggtctgcccatttttgtgactgagtacggcgcgtgcgaatcgtccggcgacggcacaattgcgaccagctccatgagcgcatggtggtccttcttggacggctacaaaatctcctattgtaactggtccgtctgtaacaagggcgagtcgtgttcggcattgaccaccagcgcatcggcgagcaatgtgaggaaaaatgaattgtgaatttcaaaaaacggtaaccaatggccgagactgtctgtgttggcaaattgcattcctcgaaatggaaaatgctaaatttttgtaaattttgtttaggtcggttcgtcttcctactggacaacttcaggaaaactgatccaagcttactacaagaagcaaagcaacggcaatttttttttttgctaatttggctaattaagacagaatttaattgcaggtgtcagctgctcaggttaattgctgcactaaagaaataaa

SEQ ID NO: 55218 - DNA, 292 bp, Heterodera glycines
  misc_feature (16)..(16): n is a, c, g, or t
  Genomic contig location: Contig_ID=SeqID_24488; Location=1..292; Strand=+
  SCN-specific regions: Sequence locations=1-292
agaacaacttcgaaancagtgccaaatgtacgttgaagtgacctctgcacagacgatgctgagtttttccggaacaacgatgaacaattggaagacgattttgttggggactttgggcgaagtcggtttttggcaggaaaaggattaattgtttttttttgtagtcaacacgaacaattatcagcagccatttcgacggcgcagaagagaggcgacttcggcaattcgcaacaaatacaaataaagaacagaagattaattggataattatttaaatcaactttttgtgttt

SEQ ID NO: 55219 - DNA, 682 bp, Heterodera glycines
  Genomic contig location: Contig_ID=SeqID_24491; Location=603..1284; Strand=+
  SCN-specific regions: Sequence locations=1-36,58-136,160-350,372 -619,642-682
atggccgatgatgatttagaagataaatatgtggcattaaaggcaaaggtccaagacttagaggatcgcttggccaatcgggtcccgaattatcttccccctggagttaaaatcccgaaatatgatgcgagcggtgattttttcaagtttttaaaggaatttaatgtgcttgcgacagcgagcaactggcatccgccggattgtgtccgctttttacctctgtttttggaaggggaagctaaggaaatttaccagaatatttcggcagataagaaaacaaattggaggacccttaccagtgaaatagcggaactgaccaagaaacttgatggaccaatgtgggcgagaaaaatgctgaataagacgaaaatgggaataaatggatcagtaactgagtttgcgaataaaattcgtgagttagttgagcaggcaagcccggacccgaactatacagttgaggcaagagaaagtgagagcgtacactattttttgaatggattaccaaccaaactaaaacggaaattattttttatggaaaagcccgatagtttaattgaggcaattgcgcaagcaaaaaaagttatccaagtgaatgaggaaattgagaaagatgaaaaaggggatgaaatgaaacaataaatagctgagctaacggaacaagtcaatgcaatttcgttccaga

SEQ ID NO: 55220 - DNA, 571 bp, Heterodera glycines
  Genomic contig location: Contig_ID=SeqID_24491; Location=1686..2256; Strand=+
  SCN-specific regions: Sequence locations=1-535,557-571
atgacatttttgacaatttcaatgtttctgtgctcatttttcgggactatttctggtcaataccaattatgttctgatcgagttcccaccacacccatttggttaccaaacgtaacagaatgttcagtaccggagtaccaaaaagctgacgagagaaaagttacactctttttaccggtccaaatcccaaagcaattcccagtttataactgctatcagaaaatgatgaaaatttgtacgggaaattttctttttttctggaaagacataaaaagtcaggattcgtacgtgaagggagtaagtcaccgagcttgtcagggatttaaagataacatgggacatacaatgaagagattgacagagaatttatggacaactgagaggccttcaaaagttgaatatgcatggattggtgaaagatgtgagacaacagtgaatgatttcattgaaaaaggacaaggcggtattctggatttttatttggtaacatcgtttggacataactttaatccgtacaacggatgggaagaaggacaaaaatggacatttatttgggaaattccggaaccaa

SEQ ID NO: 55221 - DNA, 616 bp, Heterodera glycines
  Genomic contig location: Contig_ID=SeqID_24492; Location=940..1555; Strand=+
  SCN-specific regions: Sequence locations=1-97,119-182,204-426,448-616
  Gene Ontology: Biological process=hermaphrodite genital morphogenesis
atggtcatcatcgaaacggaccacgcggcattcactgagaaggccaaacggcgaaggcgcgaggaaatggccaatgttggcattttcaatgacaataatagcaatgttgttgtaactgattctaccctatccttaggacctaattgaaatggcaaaggattcggaggagaaagcgcttgcagaagaaatggcacattcgctgcgcaattatgagccggacgaatccatttttggcgctcctcgggcacaatacggtgaattctttgacagactgacattttggcacttcattttcactacttttttttaggaaaatgggcttctgcagttcgtttgttggtcccaaagacgggccaaacactttgccaatacgaattgcccgagggagaggcggcattttggtattttttacataatgccaaaataacttttattcaattatagcattgaactggtccaattccgttctcaatccgactccacctttgtgcttgtcggctgtgccgttgggttggagttgcgaccaaaacggtcccacgggggttgtgtttacacctttttactcaccgccaatgggactcgattcgaatttattcatcggacggcaacgagtgcg

SEQ ID NO: 55222 - DNA, 767 bp, Heterodera glycines
  Genomic contig location: Contig_ID=SeqID_4647; Location=353..1119; Strand=-
  SCN-specific regions: Sequence locations=1-299,321-767
atggggccaattccctctgggcgagtcgaaagaccaattgacgaagctaatgaatggaaaacggacggaacactgagaaatgccaaatctgtgtgttaaggactccatttttaggcaaatagtttcatttacaattgaatatttaagtttttacttgttttaatacctacaaagcattaattaaaaaatttttttgcctatttttgtgcctatttaatgcctattttgcgatttttttaatgcctttttaggtgcctattttgcgactttttgtgcctaaaaacggaagtcctaatcatcacaatcacctgacgctgctcctcatccaaaccgaacatttggtcatcgatgggataataagtgtaaaaagtggcacggaggagggacaatggatgcggcggcattttggagggcggaaagagggaaaagcggagggagggggagggacggaagcggaggaaaagcatggaaaaggcaaaggcattgaaaaggaacagccgagtttcattatatacaaagaaaaagccactgattgaatgtgaccattttggaaggacttttgcacttcttatcaccaaactttgcactttttttcattttttgtttttcccattttattttatttcaattttcgcattttgcaatttatctttgccttcgcatacagaaagtgtcgtcgttttttttaaactttttatatgaattctgtataaaatatttggcgctgtatgaaaagtggccgtttttgaattttatcaaaaaataaa

SEQ ID NO: 55223 - DNA, 1436 bp, Heterodera glycines
  Genomic contig location: Contig_ID=SeqID_4647; Location=641..2076; Strand=+
  SCN-specific regions: Sequence locations=1-159,181-714,736-822,844 -866,888-973,1004-1044,1069-1093,1116-1160,1193-1253,1275-1436
  Gene Ontology: Mol. function=isovaleryl-CoA dehydrogenase activity; Cellular component=mitochondrial matrix
tttgccttttccatgcttttcctccgcttccgtccctccccctccctccgcttttccctctttccgccctccaaaatgccgccgcatccattgtccctcctccgtgccactttttacacttattatcccatcgatgaccaaatgttcggtttggatgaggagcagcgtcaggtgattgtgatgattaggacttccgtttttaggcacaaaaagtcgcaaaataggcacctaaaaaggcattaaaaaaatcgcaaaataggcattaaataggcacaaaaataggcaaaaaaattttttaattaatgctttgtaggtattaaaacaagtaaaaacttaaatattcaattgtaaatgaaactatttgcctaaaaatggagtccttaacacacagatttggcatttctcagtgttccgtccgttttccattcattagcttcgtcaattggtctttcgactcgcccagagggaattggccccattcgccagtgaaattgaccgtcaggaccaattcacaatgctccgcgagttttggcgattacttggccaaaacggacttttgggcgtcaccgttccggcggagtttggcgggtcggaacgcaattactttgaccattgcattgtgatggaggtgcatgattaccaatttattttttcaattactaatccaatacagtattttgtaaactcattttgttacagtactcatgtcagtgctctctctcttttttaagagattcaactatcaaaattcccacttagcagggcttccatttttatgtaaatacatgttttttttcctggattctccatagcctaattagtaggaaaaacactttcttttttgtgtttgcgaacaaaagtgggacttttatttacatatttttacatatttcgggctttttctacatattacatatgtacatatttttatacatattttagactttttcgcattttttcgtacatattttgcaatttttttttcattttttaaaaattttttgaaaatgtaccccaaaaattcgatttttttcaaaaaaagagatatcaaaaattaatttttaaaatactaaaaggtgattctaagccaatttaaataatttttatggcattttatgcctatttcactttttactaataatttttttccaaaaataaccattttaaaaattttatttacatttttttattacatattagggggtttttgtacatatttaatacatattttagcattttttatatgtatttcgcgatttttcttacatataaatggaagcgctgctaattaggcacaaattcaaaaaccaaaagcgttcaaacaaattttgaacctataaatatttgtgtgcaggaattgtcacgtgccagcggtgccatcggcctcagttacggcgtccattccaatgtttgcatcgaccaaatccgacggcatg

SEQ ID NO: 55224 - DNA, 505 bp, Heterodera glycines
  Genomic contig location: Contig_ID=SeqID_4648; Location=314..818; Strand=+
  SCN-specific regions: Sequence locations=1-160,182-505
  Gene Ontology: Mol. function=acyl-CoA dehydrogenase activity; Cellular component=mitochondrion; Biological process=energy pathways
aaaatgaacgcgcggaaaactgcggacggaagccattttgtgctgaacggcacaaagttttggataaccaatgcacaggacgcggatgttctggtggtatttgcaaaaacaaacagtgccaaagcgaaacacggaattacggcatttatagtggaaaaagtgggcggagaggggagggcgggggatcaatggacggacaaacattttaaattaaaaaaaaggaatttacgggcttttggccggctcagaagttggacaaattgggcatgcgcggctccaacaccggcgaattggtcttcgaaaattgccaagtgcccggtgagtttatttttgacacaaaaagaggacggacacacacacacacacacatccgttttggcattcagcggagaatgtgcttggcaaggaagactgcggcgtgtacattctgatgtccgggctcgattcggagcgattgatttttgcggcggcacccctcgggtaacgaaaaatttgtgcctcattt

SEQ ID NO: 55225 - DNA, 579 bp, Heterodera glycines
  Genomic contig location: Contig_ID=SeqID_24494; Location=123..701; Strand=-
  SCN-specific regions: Sequence locations=1-412,434-579
ccaagtacaagcaataaaagaccaaaaattgcgcaccctcaacaaaatgcagaactgcttgaacaaatctattttttgttgagacgaaaagaaaaatttgtgaaaatttatatgcgtcattggattgtcattgataatgatgccaaggcatttttttcggttgtcaaagaatttcttgacgaaatgccaaccgaaatcaaaaatttgtacaaaaatgaaattgaaaatttgaaaataaaaattgatgaggaacttgccaagcacaaatacctaaataaaaaagagaaaaacaagaaaaaactaaataaaattcaacaaaaaactgctgccgcttgtggtggaaaagttgaaaaaattgaactggaaaaaacggagatggacaaaatggaggaggctctaaatcaggacgataaaacctttttcaaatatcattgccaattgatcagtcgctcatctgatcatttaaaatttgtgcttgagaaactgtcaaacagcgatgactttgagccgatcagcagcataaaaatgaacattggaatgcaaattgatcaaacatattcggaagcattcataaagtaa

SEQ ID NO: 55226 - DNA, 142 bp, Heterodera glycines
  Genomic contig location: Contig_ID=SeqID_24495; Location=77..218; Strand=-
  SCN-specific regions: Sequence locations=1-142
atggcatttttggaagcatttgcccattttccgaactatgaatttatatggaaagttgaattgtctgatgaagatgccaaagtgtttgccaagtacaaaaatgtgaacccggtcaaatggatggaccaaaaatcgttgctaa

SEQ ID NO: 55227 - DNA, 818 bp, Heterodera glycines
  Genomic contig location: Contig_ID=SeqID_24496; Location=194..1011; Strand=+
  SCN-specific regions: Sequence locations=1-92,132-215,255-467,501 -728,750-818
atgaacaagcgcttgccgaatgagcttatttgggaaattgttgctgcaattccgataatgtacattttcggaggtgttgcaaaaaagccaggtaattttttaaaagtatttttaaaaaattcaaaattaaaggagctacgcgtccaccatctggcatcaccgttgtcaaccgggcgttcgagattttccgttccaagcgccatttttacttcttaaaaatagttggtaatatttaaaataacaataaatctaaatttttagatcgatcttgctcgaaattttgagaggctctgcgcactgaggaagttaccgtgcggagaattgttcatacagttcggcttcattcaatttggattcgaaaatgaactggaagacgccaagtgtttcgccgactttttggtgtacctatattatggacgatctggccctaccgttacgacgagagtcgtgacttactcggcggtaagaaaaaaatataataataatattaatattatttagccgattaaaattggagagctattcggtgccattctgacgcatgtgttgggaagcgcaaatccgctgaccatgaagaagcggactgcaggcggttatttgctgcgtcaacactttccgcggcttctccaactctcggcaacagaaatggcatcaggtggcattggtcaactggtccgctccgatgggatggaaatgtaccggctgatgaatccgcaccacaaaggagatgttggtcaattgattattattgaaacgtctcaacaccccggctcgtactattttaatttttcaatcgaataagtgttttttgtaattga

SEQ ID NO: 55228 - DNA, 1015 bp, Heterodera glycines
  Genomic contig location: Contig_ID=SeqID_24498; Location=983..1997; Strand=-
  SCN-specific regions: Sequence locations=1-596,619-848,878-908,930 -1015
cgttgagccgcttttacgcgaggcgaaaaaggtgaacaatcaaatgagtagaaaggatgttgttgagtatttggccacacagcgcacatacaccattcatagacaagcgaagaggcgctacaaacaactaccaacactcgcttctggactgcacaccgaatggcaagcagacctgtctgtctttgacaaattgtcgcgagagaatcacggctacaagtaccttcttatctgcatcgacacactgagcagacagctctttgttgagccggagaaaagcaaaaagagctccgacatggttgctgcttttgaacgcttttttaaacgctccaaatataagaacgtgaaaaacttttttatgtacacctcgccgcgaattcacgcagggatggcagagcgggccaaccgaaccatcaaagaacgcctttatcgctatttcacggaacggggtacccaaaaatgggttgatgtgatacagcaaattgtgcatggaataaaccactcgtacaactcaagcataaaaatgcgcccagttgatgtgaattttgagaatgccgaaaagctcaggaaaaaactcaagcagaacgctattggtgggacagcggaagcagcagcagcaaaacggaaacaaccacaaccacgttttaaggtgggtgaccgtgtgcgcattgagaagtacaaacacgtgttccaaaagggctacaccggacgcttcaccaacgaagtgttcactgttgccgaagtgcacactgaccgttttccggtcacgtaccgaatacgtgatgacgacggttccctgatcaagggccgtttctatgccaacgatctctgtcgtgtgctagtgcgcaaaaatgatgatgatgatgatgatgatgatgataccctatatgacattgaaaaggtcgtccgaaagaggaaaaagcaaggtgttgaatacgttttggtgaaatggaaaggctacagtcaacggcacaacagctggattcctgcaagctcgatgacatggaaaaatatataa

SEQ ID NO: 55229 - DNA, 490 bp, Heterodera glycines
  Genomic contig location: Contig_ID=SeqID_24499; Location=49..538; Strand=-
  SCN-specific regions: Sequence locations=1-490
atgttagcactttttgttatttacgtttacctgactgcttccttcacgcacatatctttagccaagattcgcactgaatcacaaattaaaggtaatttgatttaatcctcgggctgttagattgagtttttgtttctggactcgttttgcattgcaagacggtatggtaaaaaatttcattatttgtttttgaaaccatttcgcatttaaacagtttataagtttcgtactttaaaattttcaatttttaccaatctgcaataaaatttcagagagcgaatttgatgctttttttgtggctgacgaaattaaattgatcaattcacaccgaaacagtgccattgccgctcaactcaaaacggctaaggctggattccaacgcacaataaatctaattgacacaatgctgggcgaatggtatgttttacactgcatgtccgcttatttttcctattggcccgagtttcgggttggctctattgtactttag

SEQ ID NO: 55230 - DNA, 117 bp, Heterodera glycines
  Genomic contig location: Contig_ID=SeqID_24499; Location=1475..1591; Strand=+
  SCN-specific regions: Sequence locations=1-117
tttcttgcgcctttttccatcttcgtcatcttcaactttgtcggcaacaaatgaacagtcacaaattgcgccatcacaacagttgctcttcagcgcttacagaaatttgggtcttct

SEQ ID NO: 55231 - DNA, 597 bp, Heterodera glycines
  Genomic contig location: Contig_ID=SeqID_24500; Location=905..1501; Strand=-
  SCN-specific regions: Sequence locations=1-59,103-142,192-277,299 -419,584-597
atgacatttcgaaaatggaaaagagaaatgttggcaacaaaatattataaaagtaagggattttttaattaattcgaaaatatacaaaaaaatattatttaagagcataacacaaatgaggacaaattgcaaaagatgaagcaatatttaaaattaaaaaaggaaattcaaaaattaatgataaaataattgcaactgaattgggaattggacttcgcacattgctcagatggaaaaaagaatttgcttcaattttgggaaaatgattttttgaaggagtttatattattggtttgataagttttttgtgtgttatttgtacaattcaaatttagtcaattcgatttatccaattgtccttttttggcaaataagtcagtcattactttgtaaatcgtccgtaaaggtcaaaaataggcatttaatttatttgatcatttttgaattacaaattaatctattttttaagttaattttttataatattttataattcaataatataaataatcctattttatttttaaagaaaaattttcaaaccaattatttataaattttatttattataaaagttaaaaatgttaattgaataaa

SEQ ID NO: 55232 - DNA, 532 bp, Heterodera glycines
  Genomic contig location: Contig_ID=SeqID_4650; Location=480..1011; Strand=-
  SCN-specific regions: Sequence locations=1-155,290-442,464-532
atgtggagaaaaattgctggctattgtgtggttgttgtcgtcgcgtttggcgccggaattggcgtttggtgagtcgtctgatcccctttcatttaattaatttctaatgccatttttccatatttaggtatttgcgtaagatgatgcgtaagcgagaggaggaagaggaacaggaggatgaggcgccgccgggggacgaggcgccgccgggggacgaggccccgcccccgccggaggacgaggaggacgcggaaaatgacggcggacaggtggaggaggaagaggatgacggcgggccggatcagcaacagcagcaaccgaaaaagaaagcgcttgctgagttcatcacacagcagacgactggcggtgccaattagcgacgacgaaaaattaattaattaacggacgattggctttttgttcctgcacattttacaacttattatttcttttttgctgatttgttctgcacatttattcaacctgttctattgaatttaggctttcatcaaacattttttggaaaaataaa

SEQ ID NO: 55233 - DNA, 351 bp, Heterodera glycines
  Genomic contig location: Contig_ID=SeqID_4650; Location=2438..2788; Strand=+
  SCN-specific regions: Sequence locations=1-318,340-351
caaatggttcggcagtcctccttttattacatgattgtgggcaacttgatcgttattgcggttttcgcggacagggccttaacgagacgctactttggcaagaagatggagccgatggcactgccctcgtggaatgcttttgtgaaaacggagttgaaagaaggcagggaactgacgatgccaattagcgacgacggaaattaattaattaacggacgattggctttttgttcctgcacattttacaacttattatttcttttttgctaatttgttctgtacatttattcaacctgttctattgaatttaggctttcatcaaaaattttttggaaaaataaaatatgaaat

SEQ ID NO: 55234 - DNA, 674 bp, Heterodera glycines
  Genomic contig location: Contig_ID=SeqID_4650; Location=1532..2205; Strand=+
  SCN-specific regions: Sequence locations=1-674
atgctcatttccaaggacgtccttgtcatccaaggacattttttatttccaaggaagagagtcaaattccaaggacgtccttggcatccaaggacgaatgggagccctgccataagttaataaaaatttggtataaaagttcaaaaatttgtaaacttttgaatttttttctttcggatgctctttttcaaggacatcttgaattcaaggatatttccaaattttcaagtgagaggacccaatttcaagaacgtccttgccattcaaggacgaacccgaaccatgatctaaactattagcgtcatttcatttcgtatttatttttcagattttctcattttatgtcgtacagttcaagaaaggttgtcacattattcatccttagtcaaggcgccttttttatcgacgtatttatcggctacaaacttcttcaaaaacacgagtccgcgcgtcattggctgtactccaattgccccaacattttgcttgcttattacaacacgcgtgatcattactcggacaagggccaattgcctggcaccgaacagcgcaaagaagacgtaaaacggtggaaattggcggcggcgatcgaaaacgaaggccaacaaaaggagcagcatcagaagacgaggaagggcaaatctgcggacagcacaaagggcgaagcacagtga

SEQ ID NO: 55235 - DNA, 947 bp, Heterodera glycines
  Genomic contig location: Contig_ID=SeqID_4650; Location=4435..5381; Strand=+
  SCN-specific regions: Sequence locations=1-402,429-795,843-947
atgccaacaaattggccgccgcatggcattgacgactctgaacagcttcaacacttgcgaaccgatgccaacaatgtgtactttgccaaaatcttggaatttgatgacgaggaggaggaggaggacagcacgggacgagcagtgggaagaacgacgccgcagggcgcgcgaggtgagtgccaagggggaggggctgaggacaaaattttaggcttttatctaacaaaacaccctgccaggcatttttatgccgatagtatacctaattcaccctcctccggcagaatttgctacaaataaaaagaatatctctgcggcatttagtgactgcctacattgaacacattccacgtggtgaacaggccaagccgatgcaaccacaaaacggtgccgtcgatcatcctcattttggggaggaggaggaggcgaagaaggacaaacagctgctggacgactcttccgcagcggaagatgatgattattttgaggatgacgacgaaaatgacgatttatatacagacgaatcgacggagggacagcacgacattcggcaccgaatctcaaacaaaagcccgggttcggcacggcccattgcgacaaatgaagcgagccgaggattagccgacctaagctcgaaaacacgaggtgcggtgaactaagcacacgaaccacggcatggacacagcggtccaattttgggctccaagtacaaatatgctggatttttcgtcttagtggtctgtgagttagtcaccaaaaggggggtctcaagttcaattcctccttgtgtttgtgtataaatttcaattttttaaagcaaataaataaaataataataaatacagaacgccaaaagaacaaatacaaacagtaaaaggtacacactatattttacccttgattttatgaaatttttttagcttataacttggtgaatactagagcaa

SEQ ID NO: 55236 - DNA, 483 bp, Heterodera glycines
  Genomic contig location: Contig_ID=SeqID_24506; Location=585..1067; Strand=+
  SCN-specific regions: Sequence locations=1-224,273-483
atgaacagtgtgttggagggcatttacaatggtgtgccgatggtttgtgtgccattctttggtgaccaattttacaacgccgaatcattggcacgccaaaacattggcctggtggttgaccgtgaacaggacaagaaagctgtacaacagcagcttactgtagcactggccaaagcattgggacaaaacgaattgctggacgacaaattgaacaaagaattgtgaaataaaatttaaaaattttaattatttttgaattaatttttttttaagcaatcatccggaagacaaaattgatttggtcaaacttgaaaaggtcacgtatgaatttcgtcataaagacattgcaaaaacactgtctgacgtgatgaaagtgattgacgaagaattaaaggaagaaagagcagcttaaaaacggatttaggattggattgttggatttgaactaggattttcaaaaaaaaaaatttggaaccaatttaa

SEQ ID NO: 55237 - DNA, 575 bp, Heterodera glycines
  misc_feature (12)..(12): n is a, c, g, or t
  Genomic contig location: Contig_ID=SeqID_24507; Location=1039..1613; Strand=-
  SCN-specific regions: Sequence locations=1-50,87-174,225-280,302-575
atgactaatttntgagtcatttagaaatttttcatctcctaagttcttagaaaattttttttataagaaaatttaaagtaaaaattgttgaaaaatttttcagcaatttttttttgaaattttatgaaaatttactgtttttttgaaaagttttcaaaaaaacttagcaaatagttttttttttttttggaattttcttataaaaaaattttctaaaattttttccttgaaaaatttctaagtttgaaatttttttttgaaatttctgcggcgagatttcggccggcgagatttcagccggcgagatttcggccagcgagatttcgtcccgtccccccctggaattataggatttgcaatttcgaaaaattttaaaaaccctcctcattttcagaggcgagtcggctcggattttcagcgattggctcaacgacgccaaagcgcacttggaagtgcggctgctggttgagctgctctttgcccatgctcaggcgacgagaattaggacgacctattgaaaatggacaaacgaacgaaggaatcaatcattttatttgatgtgttttcaaaataaa

SEQ ID NO: 55238 - DNA, 345 bp, Heterodera glycines
  Genomic contig location: Contig_ID=SeqID_24508; Location=169..513; Strand=+
  SCN-specific regions: Sequence locations=1-345
atgggcaatgctaattattgtcaagatgagcaaaatgacttttttgtggccttgtttggctggtccttaaaatttgctgaattaggtatcctaaattttggcttcgtgggaaaaatgtgaaatttttagccattttcgccaaatttggcattttgagacaaatggcactgaccaataaaggtcctggacttatatttgttgccaaccgctatttaataaagctggggaaccattgaaaggtgcctgacaagctttattattctcaaaaaattcaaaatttttcaatggatacaaaaaaaatcggccaaaaattaaaaaaaattaatcccatcttattaataagta

SEQ ID NO: 55239 - DNA, 147 bp, Heterodera glycines
  Genomic contig location: Contig_ID=SeqID_24508; Location=981..1127; Strand=+
  SCN-specific regions: Sequence locations=1-21,44-101,123-147
atggcagtggccaaattgtacgcaattttggcacggcaaaaatcgtcgtcggactatgatggggaggacggacaactgatggacgacattgactacgagaaagtggccacaaatcccatgatcgatgcggcagcgaagcaattcatg

SEQ ID NO: 55240 - DNA, 118 bp, Heterodera glycines
  misc_feature (112)..(112): n is a, c, g, or t
  Genomic contig location: Contig_ID=SeqID_24511; Location=54..171; Strand=-
  SCN-specific regions: Sequence locations=1-118
atgacgaagccgaatgcggatcttcttggggtcacccagaatactcgtagagggcttttggatgacggactttacagtgcggatattcaaagccttatcccctggaaacggngattgg

SEQ ID NO: 55241 - DNA, 838 bp, Heterodera glycines
  Genomic contig location: Contig_ID=SeqID_24511; Location=274..1111; Strand=-
  SCN-specific regions: Sequence locations=1-119,141-206,312-690,767-838
atggcggagaaacaagccattggactaatgaagaagatggaagctaatagaaatgtgcaattaagtgaaaatgcaaaaaatattacaaaattaaaagaaattatcgaaaaaaacaaaaattcttcaaatttcaagaaattaacaaaggatcaactcaagaatattgtttatttgaagtttggcgaaatggcaaagcaaatgaaaggtttaaaaaatttatttttaaatgtttcgtcataatttttatttaaatttttttgaattaaaattaaaaaatgaaaataatttaattaaacaatgtattttatttacaggccatggcataccttacaataaacaacgatcaaaacgtgccgtcgattcttctccagctgatcagcttatgcttgacgttgatttggtcaccacgtgcatccttttaatcgcttatactatggtgatgttctatttgatccattttcatcgaactgatcaattattttttcacataatttttttggttttttgtgataattttattgcgaattgtctcctatttcaagcgaagccatggtaacgttttcccaaggttggattgctggatgatgatgacatattttgataattttatatgtcagtcatcattgctcgactatttaattttctaatcaattttctgatcaaatttttcagtgggagtatatgtttgtgtctcttctgtctctttttctctcttctcttttttcttgtgtgtcttttctgtttctttctctccttttttatctttgataaaaattttttgatgaaattacattgatttattgggaagtaattaattggttgaaagcaaaatattaaa

SEQ ID NO: 55242 - DNA, 415 bp, Heterodera glycines
  Genomic contig location: Contig_ID=SeqID_24513; Location=1..415; Strand=+
  SCN-specific regions: Sequence locations=1-328,350-415
tcttttggtcatgccattctccattttattgtttgatcaaaattgcgcgcaatccttctaattatttacatcctttcccaaatttatttttgatcagtcccaccctgaggggcccacaaatggcacctttcggtcaatcagtgccatgcctttttctgatcaaatgtgcacattctcttttgatcagtgccatttccccattcttctcttcatcaaattgccccaatttattttggtcaatcgtcttttggctatttcttttgatcagtgtcacccctccccatttatattgatcaattgacgcatatttcggctgatcagtcccatcgccatttttgatcaaattgtgcaaatttatttgatctgtcccattttccccatttccatttgatcatttgtaccatttttcattgct

SEQ ID NO: 55243 - DNA, 812 bp, Heterodera glycines
  Genomic contig location: Contig_ID=SeqID_4652; Location=545..1356; Strand=+
  SCN-specific regions: Sequence locations=1-49,71-199,221-358,380 -518,540-722,744-812
atggcacttgaagaagatgaagacctgcagcgaatgatcgaccaaggtccaggggagcagcggcagcagccgaagcagcgggacgggcaacaacaacaggagggggagcgacagggaaaaggagtcacgaggaggaagacggcagatgaggtagtaaaatccaagcacaactttaaaacaaagcttccacaggttttgcggaagaagagaaacaagaagatagagaaggcggtgggtcttgaaagggaattggaggaattgaagagacgcaggagatatgatcagaagccagaggggcgggagaaaattttggagacatgatcaagctctgacgttgacggaggatcagatgaaggcagtgtttgaagagcaacgccaaaggcgcgtgcgagtgaaattcgaagagaatgatcggcaatagcagacggagtatgagtcccgacctgttccattcttcttgggaatcgggttgagcgaaggggagagcagcagcagaaccactgggcaggaagcgggtggaggatgaaggaggaagcatcagggatgagatggcggaagagcaccaacagcggcatcacccgatgaagcagcaggaagaagaggaagggttgtgatgagtggttgtgatctgagagagcgcaagcagaagtttgaagatgaggagcggggatgggaggagatcaagaagagcagcgcctttccattatttgtaccattttacacctggcctccctccgcacccggatgcggttgtttcatttttattcttttacaccgccgggcggtttctttcctctttttattttttctga

SEQ ID NO: 55244 - DNA, 158 bp, Heterodera glycines
  Genomic contig location: Contig_ID=SeqID_24514; Location=714..871; Strand=+
  SCN-specific regions: Sequence locations=1-70,106-158
ccgagaaagttcattttgcttgtggcgaacaggaccaacggttggaaaatgaaggagaagccataagtcggggggaggaggaggaagacgaagaggaagtggagggcggacagtccagcgacagttcgtacgtcaaggtcattgcctttgcggacgga

SEQ ID NO: 55245 - DNA, 92 bp, Heterodera glycines
  Genomic contig location: Contig_ID=SeqID_24515; Location=1..92; Strand=+
  SCN-specific regions: Sequence locations=1-92
tcttgtgcactttatgagtccaatcaattgaaaatactcggtttttatacaataactttgttcatgttcgaacaaaccctatctttttggta

SEQ ID NO: 55246 - DNA, 58 bp, Heterodera glycines
  Genomic contig location: Contig_ID=SeqID_24518; Location=1..58; Strand=-
  SCN-specific regions: Sequence locations=1-4,26-58
gggcttcgccttcggcttcggcttcgagtgcaaagccgagcttcgcccagccctgatc

SEQ ID NO: 55247 - DNA, 411 bp, Heterodera glycines
  Genomic contig location: Contig_ID=SeqID_24519; Location=521..931; Strand=-
  SCN-specific regions: Sequence locations=1-30,52-183,208-411
atggcaccggcattttttgctgtgactcaaacacaaatgaaaaatggaaaatttttagaaaaagcatttgacacattgtgttgtattacaatcaaagctgaaaaagatgtcatgaaaagggatgaattagcagaaataattggggaatttgaagcaaatcagcgcaatttttgccaagaattgaaaaagggccaaaacatttgggaagcgctggaaagttcggcggggaatgccattgtaacagcggcgagaaatgtgaaagttaacccccaaacatacgaaggatttcgaaaattgacgaaattaaaaattgtgagccctgaaaatcaaacagcaattggaacatttgtcaaacattgcattgccgcgttgaaaatattccgagaattcatcaccggtattgttaattaa

SEQ ID NO: 55248 - DNA, 2061 bp, Heterodera glycines
  Genomic contig location: Contig_ID=SeqID_24520; Location=28..2088; Strand=-
  SCN-specific regions: Sequence locations=1-737,759-904,926-1458,1480 -1662,1684-2061
atgccgtctccaaaagacatttcgtcactccgatcattcctcggcatggtaaaccattaccaacagtttgtcaagaacatgcgcttcactcggaagcctttggacgacatgctaaaggatgacatcgaatggaagtggacggaagaacgacaaaaagcattccaaaaattgaaggaagtgcttacatcggaactgctactcacccattatgatcctaaatttgacataattatggcagccgatgcgtcggaactcggaattggggccgtcatctcccacaaattcccgaacggtcaaagtaaagcaattgcacatgcctcaaggtcgctcactccagcagagaaaaattactctcaaattgaaaaggagggcctggcattaatttttgcagtgcaaaagttccacaaaatgatctacggcagacacttcacattgcaaactgatcacaaaccgctgatcaacatcttcggaagcaaaaaaggcattcggcagtgcagcgcaaatcggctgcttcgctggtcacttactttgctggcctacgacttcgacattgagtatgtcaataccaacgagtttggtcaagccgacgcactgtctcgcctgattgccaaagaatttgaatgtgatgatgaacgagtgatcgccgcgtgtaacatcgacgaggatcttggaactgttttggatatggcaaagcaaattctgccaatcaaatttgaaaatttggtctcagagtccaaaaaggacaaaacaatgcaaattgttatgaaattcgtcagagacggttggcctgatgaacgcaaattgacgccacaatcagaagaaattgagcttttcggcagacgaaaagccgatctgacaattctgaaagactgtctgatgtatggcgaacgaattgtgatccctgaaaaattccggaccaaaattttgacactgctacacaagggccatcctggaattaaaaggatgaaacaactcgcccggcagtatgtcttttggccaaaattggatcaacgaattgaggaattcgtcaagaattgtgcaccgtgtcaattggccgctaaggcaccgacgaaaacggatttgcactcatggccaaaatcaacgcggccatggcaacgaattcatgccgattatgcgggccctttcttcggaaaagaatttctgattgttgtggactcatattcgaagtacccggaggtattcgaaatggccactaaatcagcggccgcaacaatcgaacgactgcgttatctcttcacgcgtcacggtataccggaaacattggtaaccgacaacggaacgcagttcgccgccagtgaattcgcaaaattcacagaagcaaatggaattgcacatctcttttccgcaccgtacaacccaatgtccaatggacaagcggaacggttcgtggacacttttaacagagcatttcgaaaaataaaaggggagggagtgccgaataaagaaatcatcaacacattcctggtaacttaccgcacgactccgaacgattcgctgccggacgaaaaaacccctgccgaaatgctccttggccgaaaaccgcgcacaacgattgatctcctaatgccgcctcttccacagccaacggagagagacacaaaaatggagcaccatttcaatcgccggtttggcgcccgaccacagaaatttgtgtcaaataagccagtttgggctagacaccgactctcgcagaattggagagctgggacaatttgtgattgctccggagtcatctacacggtcaaattccccgacggttcgacaaatcgctttcatgcgaatcaattgagaaaccgggaaaacaccgaaaatggccacgaaccattggcaattttaaatgaggcattccatctgccaatcaccgcaccgaacgttggaattgtagggcaggaccttgagccaaggcctgacccgatcaacgatggtcaccaggacgagatcgaacccgagcaggcccctcgaagcccgacaccgccgcaacaagcgccgcgccggagtggacggaaccgccgagcccctgatcggtactcgcccggatga

SEQ ID NO: 55249 - DNA, 1000 bp, Heterodera glycines
  Genomic contig location: Contig_ID=SeqID_24522; Location=446..1445; Strand=+
  SCN-specific regions: Sequence locations=1-60,82-231,254-298,322 -650,672-943,965-1000
atggccactgttctgtcaaaggatttgctcaacaaatggtcgtgcagcgtatggtaatcaaatggaaaatgattttttattgcaacaatttccccgtttttttggtaacatcatttcaccaacttttcatttttcagcacttttgacaattggccaaccgccccaaagtgcacaatttgcggccgtttgcgttccggcggcagcgcaaatgaaagcgaagtgcggcaaattcaacaacagaagcagcagaaggcgcaacagctgaacatcggtcgcaccgggcgtcagcgatcggtgggaaaaaattaaaagcaaaacaatagtttcggggggggggaataaaattgggggtccgacggcgccaagtttttatatttaattctttcgacactttcctttatgccctcccccgtaaaaataccaagatcccaacaaaggaatgcacttttcttgggtggttttatgcgctaaccaagaatatggagtcaaaaaatatcaccgtcttaatttgaaaaagtgatccgcccgtccgttccggcacaaaatttgttgggttttaactttttgatagagaaaagtcgagaatgctgaaactaaattaatcgattcctctcgatgaaagaacgattgataaagaaatgatatacctatgttatttctttttaaattcatagacaaaagcatatattttgcagtgttgagccatattgttgatcaacgcctgaaattaccatagaaaagtgctttcctttgttgggcttttgattttattatggggaggacggtataacggaaaaatgccattttttcatggactaacacaattttttagtaatttttttcaaattactgagcttggtaatatgccacaatgtctaaaatggtgtgcaattttcagtttgcattgtctgcgaatggtcggaaacagcaacagcacaaggacgacgccgacgatgagcaacaccaccaccacaagcacagtgaccaggacgacgagtga

SEQ ID NO: 55250 - DNA, 362 bp, Heterodera glycines
  Genomic contig location: Contig_ID=SeqID_24523; Location=335..696; Strand=-
  SCN-specific regions: Sequence locations=1-247,270-313,335-340
atgctaaatgctacacattttgcatttgcatttcaggtgcttttcctgtgcgtcgtcggcactcaaatcgcaatggcaagtgaccggtaggtaaatgtaccgtattatctctaattattaggaagcaacttttaatgacgaaaaatcccaaaatagttaactaaaatagtgagtagaaatgccaaaatagtgaagaatagtgacaaaaagtccgaaatagtgacaaatagtcacataattttcagccaaaaattgagcaaaaataatttttattcactgattgcagttgcaaatgagtaggactgggatttgtaagaccaaaaaacccaaaagagttacctaaaaaaaatttttaaattaaa

SEQ ID NO: 55251 - DNA, 817 bp, Heterodera glycines
  Genomic contig location: Contig_ID=SeqID_24524; Location=95..911; Strand=+
  SCN-specific regions: Sequence locations=1-181,204-308,339-351,423 -738,765-817
atgacgacaaagttccggactccgtaagttgggccccgaactctaactttttctttgtcaaccaaacccaacattgtttctatcaatcgaatgctcttcacatgctctattagcctacatggctggggcccaaccgaagtgaaccccaaaattcactaatttttttaaatcgcaaaatattttgtaaaacggaattttcattactgacggattgttcttcactgacagattggtcttgattgattgtctattaaataattttctggagactttctgctgagtgggctaggaatgaaagagacgctgcaaaagttatgaatttgaattgaattgagttttttagttaattggttttttaaataaaaaaattccaaaaatttttaatttgtttttcaaaaactttttattactttttatatattgttcaggaagcaacttgatatgcacggaggaaatgcaaatttagccgacattactcatgggattagtgccgattcaaatttcaatttcatggttggccataatcactggcgccaaatggtcatattacataacagaaagtggtttgcacaggtcgaataaaaactcaccagaactgaatttattttttgggcaatcatcaagaattggtatcccgatgaaaaaaatgctgaaatttggcggcattttttctaggcttataaaatgcgttaacctcgaatctgaaagattttgaaaaatcatttattttgtctataactttttaaaaatgaagtttcttgcaaaatgagagcacagattcatgacctacgcattttttatcccaaacccattgaaa

SEQ ID NO: 55252 - DNA, 798 bp, Heterodera glycines
  misc_feature (602)..(602): n is a, c, g, or t
  misc_feature (680)..(680): n is a, c, g, or t
  Genomic contig location: Contig_ID=SeqID_24525; Location=17..814; Strand=+
  SCN-specific regions: Sequence locations=1-128,157-798
atgtcaaatgatgcttttattgccttctgcaaaactgaaatacgggaaaaacgagaaacacctaaaattgagccgaaaagaaaggaaaggccggtaaaacagaaagttcaactgaaaagtgaaatcaataaaaaggaaaatgttttgaaaactaaggaacaaaatgctacagtatctgttttaccgaaaagcactgtaaagctggtcaaggacagccaacaaaaaatgtcaaatccaattaaaattttacctcaaagtacacaaagtacagtgatcacaacttctaaacctcaagtcaaactctccacaacagtaatgcctgttacgacaagcaccactccgaagccaattactgttcaaagggttataacatctaccagttatccaaatgttaattatgatggacattttgagacaatttcagtgaaaaggcctcagaatgagcgaatttatcaggcaaagggaagagagtttaaaaatttcggaagtcgttctgaaagcactaccacaaaaaagcctattactgtcacaaaagttgggacgaatattccaaaaaatttgaccgtgtctaaacctgttaaaattcacaaaattgaaaggcncgttggtgtcaactgcgacaccaacaaaaatctaacaattacacaaaaacccaaaaatggagtcaaaaaatctcatcntcgtgccggagttcagaaaaattgttaccacaaccataaccacttcaacggtaaagcccatggtaacaagtacttctgtcactacgatttctacaaaagtcacgcaaaatgcgagtga

SEQ ID NO: 55253 - DNA, 409 bp, Heterodera glycines
  Genomic contig location: Contig_ID=SeqID_24528; Location=97..505; Strand=-
  SCN-specific regions: Sequence locations=1-409
atgcctgcctttttgagaagtgtgcttttcctctgtccttcgtttttcccacttttcctcccttccaatggacaaaaacccaacaaaatccaacaaattggcactccctgcacaaattactatgatgggaagactgactacggttgtgatgagaagagtgagaaattgcgcatttttgtagtcgccgacgcgggcggaaaagaggacgaaaataaaaagcacagtccgacgaagggacaacaaagtgtggccaaactgatggccgaactggccgagaaagaaggactgaatttgatgctgaatttgggcgataatttctatgagaatggagttacgaaagacactgtcaacgaactctttaaaacggtcggattggcgtcagcagagtgccgggaaaaaggcgttccgg

SEQ ID NO: 55254 - DNA, 861 bp, Heterodera glycines
  Genomic contig location: Contig_ID=SeqID_24529; Location=722..1582; Strand=-
  SCN-specific regions: Sequence locations=1-861
  Gene Ontology: Mol. function=growth factor activity; Cellular component=extracellular; Biological process=cell-cell signaling
tcctcttctaatcagtattgtacctcttctaatcactattgtatcttttatcacttttgtacctctttaaatcacatttgtacctcttctaatcactgttcttcctcttttaatcactgttgtgcctcttttaatcactattgtacctcttttaatcacagttgtacctcttttaatcacagttgtacctcttttaatcactgttgtacctcttctcacactgttgtacctcttctcatcactgttgtacctcttctcatcactgttgtgcctcttctaatcactgttcttcctcttttaatcactgttgtacctctcctaatcactgttgtatgttcttatcactgttgtacctcttccatttacttttgtacctcttttaatcaccgttgtacctcttctcatcactgttgtgcctcttctaatcaagcacagttgtacctcttctaatcacagttgtacctcttctaatcactgttcttcctcttttaatcactgttgtatgttcttatcactgttgtacctcttccatttacttttgtacctcttttaatcaccgttgtacctcttctaatcaccgttgtacctcttctgaccaatgttgtacctcttctaatcacttttgtacctcttctaatcgctgttgtacctcttctaatcactgttgtaccacttctaatcgctgttgtacctcttctaatcacttcttctaatcgctgttgtacctcttctaatcactgttgtacctcttctaatcgctgttgtaatcactcttctaatcgctgttgtacctcttctaatcgctgttgtacctcttctaatcactgttgtaccacttctaatcactgttgtacctcttct

SEQ ID NO: 55255 - DNA, 1116 bp, Heterodera glycines
  Genomic contig location: Contig_ID=SeqID_24531; Location=50..1165; Strand=+
  SCN-specific regions: Sequence locations=1-673,698-1052,1074-1116
atggccagaattcttaagcttcagaggggacgagacggggaaactcgttccaccctcattttgcttaatggaaagggaaaatggagggcaacgaaccaacttttcccaatggaagttcaatccgaaattccagaaactcagctcatcgcattcatcatggacatcgacatggactcagtctcactgcccggaagtgaagacgaagcttcagagcgatcggcacccaaatttaaaattccaaagaaacgccgcgccttcttgcgaccgatcggtcaacagcatagccctttgcaagggcctcgtcgaaaaaagatggaactcggcgactccggactacgcaagctctttgcggcgataagcgaagagcaaggcggcagcaaggcgacgacaaatgcgataacggagagccgacagatggaaaaggccccggagcacgtcagaaaggagcacgacaaggaaatggccagaagacaaagagaaaaggtccaacgaataccaacggaggaaatcaggcagaaattggccgctctcccacacatcacggtttcttcggaaaatgccgaaacacagagaaaggaacgaaaggagaacgaagtgcgtcgcaaaaacaatcagcagtccacaagcgaaggatggaagcaactcgccaagcaactggattacgacttgatggatgagcccgatgaaccagccctggaacggcgaaaggctaccgaagaacagtcggtaaaatgaagagaagccgaacgacgtcaaattgcacggaaaaaaggcatcgtgcaaatgaagaagcgcgcaaaaccgctgaagtttcccaccgaagatgaaaccttgctgagctacgtaaagcggttttatgacaaggataattgggttctctcttggaaaagccgacgtattctggacgaacttcatgacttggagaacgaaggacgttggttcttataccacgcagcaaatggcgctcaactcactatctcacgaacgttcgatggaacacgaccattgccgaatttcgatatgtggaggaaggacacctcgtgaatctgactccaaaccaagtcatcatccgccaaacggttccagatgagcccgaagagagtccagcgagaaata

SEQ ID NO: 55256 - DNA, 1616 bp, Heterodera glycines
  Genomic contig location: Contig_ID=SeqID_4657; Location=140..1755; Strand=-
  SCN-specific regions: Sequence locations=1-372,394-769,792-1135,1159 -1426,1451-1544,1566-1616
atgtctaattttctcaaccatacgctgtcttcatcatcgacaatcctttcggcggcggccgctggtgctaatgaaacgaccgaacgatttcgactggcattggtaagtgtcagtttggtttaatattcggtatggtcttctttttcaaaatttctgctcttaaaaccctttcttgaccctatccttgcctaattttgctgacaggaacgcggttaaatgtccttttaccgataattggaccggatttaccattcttactaaccaacttctctcttccccgtgtttatggtatttcccaatttcgaatgtattcctcctttaaaattaattgatgattttcctttccagctctgtccatgtgtactgctccaacttcttcccccaacatttcctccattttcttcatttttgtctctttctttaggatgactttgtcactgtccatccccatttgacttgtgcactcatcgccgtctccgtctcgttggccacccatttggcgctgttcgtcttcgcccgtctctttgactttgcgttggcaaagtttcgcccatttgtccgtcgttgtcgtcttcgtcgtggaggaggacggtcattccgcgttcacatcagcgagtaataccttttattttacgtttttgtaagttcttccaattttatattgaaaatatgtttcagcaaaccgttcgaatattattttgaagcattttttgatgcgaaatgcaaaattgggacacccattctgaccaaattctggtccaatgtgaattgtttgtttgaattccaaagttttaatgcgttttttatacaaaatttttttttcaaaaaaattccctgaaaaatgtaattataggaaaaaaatctttaaaaacccaaaatttctcataagaatttatttgttttgcgccttttcacagtgcgccactgttgtcatccaacggaccgttcattcactcacaatttacgcaacatcagcaacgggcgagtggcaaaagccaactgctgcacaaagtgccaacaattgaagcggatggcggagacgacgacggtggcattgccaacgctgaaaaagcgaaacggacgacgacgcccgtcgccacgtctcgacaacgtcaccagcagcgcgggttgaggctgagcagcagcggcagcggtggtcgcatcggcacgcgacggacgacgacgacggtggacaccaccggcgctgccgcaaaagcggtgccggaaaccgctgccgggagcaaagcggcgccgaatgccaaagagacgacgacggccaatttttggacggacccgaacaaattcgtacgctttgttattgctgtactgtctgacaatgagccgatgaaatatgccatcccatttttgtgtacgcaatttgcaccactgaattgtgacaaatttcagttttcgttgacaaccgatgacgaggaggacgatgaggaggaagggaagaatggccgccgttccgccgctgggattgcctaacttttggacataccaatagcaataattacctaattagcaatattaattatttacgattttatttttacacatattatttattccgcctaattttgacccagaaaattgctttgaaatcaacaaataaa

SEQ ID NO: 55257 - DNA, 454 bp, Heterodera glycines
  Genomic contig location: Contig_ID=SeqID_4657; Location=2316..2769; Strand=-
  SCN-specific regions: Sequence locations=1-337,359-454
atgtcgacaacagaattcgagatcatcttgacaccaaatctgagcgtctttatgccaaaattgacgctttatctgcccaagttcaacgacttgggctggcaatggctacgcttccgaatggaaggtctgtcatcacttttggtcgactgtctgtggaggccgtgcccggacattttagagcttactatgtttaaattcgaatagcaattccattgaaaacgccaattaatcgaaaatcatttactgtctgtccgggactaattaattataaggggaacggatgaagcagacatttgggatcatttgtcaattttcagccacaccacaacttgatgaaagaggacaacgaacgacagaagaagagaaggcattttgcacacacacattagcctcctcccgtgatctcctcctcaacaatgttattgataaaagcggaacgaaggatagaaaataa

SEQ ID NO: 55258 - DNA, 769 bp, Heterodera glycines
  Genomic contig location: Contig_ID=SeqID_4658; Location=1417..2185; Strand=-
  SCN-specific regions: Sequence locations=1-368,391-515,537-615,637 -667,692-769
atgatcgacaagactgtcgatgcggctgctaagaccgtcgatgcggctgccaagagtgctgccaagactgtcgatgcggctgccaagagtgctgtcaagagtgtcgatgcggctgccaagaccgtcgatgcggctgccaagaccgtcgatgcggctgctgaggtgataataggcaccaattccagagccaataatcacagtgcagatgaacaggaagtacttccctaaagttatcgatgagtgaaaaatataaacatgggaaaacattgagctgatcgtaattttttggcggcctccttgcacgcgtcgcggtcctaaatttgcagaagataattttcgacgtcgtccattctacccgttggctgtttctttccagcgtgtcaagacgcgctgtgatatcggcgtaccgcggttgtcggggctgttgggcgacctggattggttcaactcgggttgccgcaagagaacgcctacggggttgttgtggattgcgcataaagttcaaaattgagccgataaagataataaataatatttcggtagaatacgagctttgcttgcttagaccggatagaattcgtaaattttcaggacaaagtgaattaaatataagttttggactttgatttttcatgttaataagacaaaattcagtatactacgcgctaacaaaagaaaatttaaaaaatgcaaataataactactcaaaactggcgataagtgacaaaattattcaaaacaaagaccgaaacgtttaaaatgaattaaa

SEQ ID NO: 55259 - DNA, 1642 bp, Heterodera glycines
  Genomic contig location: Contig_ID=SeqID_4659; Location=457..2098; Strand=-
  SCN-specific regions: Sequence locations=1-89,132-149,190-327,350 -372,401-1190,1212-1341,1364-1485,1527-1642
  Gene Ontology: Mol. function=poly(A) binding; Cellular component =nucleoplasm; Biological process=regulation of transcription from Pol II promoter
atgcgttcagcggccgcaaaacgggcggcagccggtgccaaaggcggcgcggatgagagcgacgaacagcggaggctggaaaaaataatggaggaggacgacgacgaggaggacgaggatgaggaggaagaaaacatggagtcactatcagaggacgatgatgaagaggaggaggaagacgaggaaaggtgtgcattattactaataattggtatggagtaaacaattatttcaaagggctgaagtttggttccggtttttcgagtagttttttttctgttttaaagttgttacgaaaattttgcgtttgcattattgtttgatgagaaaaaaaaatatattattttatcctgaaattcgttctatgtttagtgacgaggacgaggaggaggatgaggacgtctcggaagtgggaatgatcacagcggaggacgacgatgacgaggcacagcacatccgtgtgcgcactcaacagcagcaagtgcagccggaggacgaagactttatgcgggactttgaccgattgatggttgagtcattacaggtctttaaaaagagcgtgcttttttgattatctaaatttaatatttcagtccgcacccgccacgctgcacggaccgatgagcgatttggccgttccgccgcttgtccggcaaaaatttgagcggaaactcaaatttggtaaacatacaaaatctcttttgcatttttttttttattacctttcgcctcgattaattccaaatttagccgatcccactgagcctacaacggcgacgccaattgatcggcccgcttctcctgctggtgttttgactccttcccatggcgtttcgtctgtcgttcgtcaacaacagcaccatcaggaggtatgttttatgtgtgttgtacatcggcaataaaataattgccaatttaacagactccacggatggcactgatgctccgtgcttccgctgcgaaagggggcggcagtggcggggcaatggccaaggcgggcggagtgcagttaaaggtgtgtaaattggttgatacatttgattcaagcatgacattcattttcctaatcaaccatttggtttactctttatttattgctcccattttactgtgacaggctgtgcacattgcggaagaggtggccaatatggacgagaaatggcgactggcccaagaggcgcgcgaacgtgaccgaatggaaatgaaaaaagtgagtaggatttgtttttttttctttgcgtgccataaatgtgaacccacggaatgccgggttggtttcagttcaatgcgcacgtttccgtgccaatgaggtttaagaagccagggatttccagacttttctcagttgaccaaatccaacaatctgataccacagaaagcttaacatgttgaaaagcttttctaagctattgcttggtgattagacaatttgcaaaaaagttataaaatggaaatagaaaaaaaattcgaaatttttgagttttttcttaaatgttgggttttaaatatatattttcaacaatttatttccaggtcactttggccatgaatgagcgcatcagcgcggacgaagaagcggaacgtcgtcggcaaattcaacaaaaactgttcacgtatcagcagcagtcgcccaccggcggtg

SEQ ID NO: 55260 - DNA, 254 bp, Heterodera glycines
  Genomic contig location: Contig_ID=SeqID_4659; Location=1571..1824; Strand=+
  SCN-specific regions: Sequence locations=1-128,157-179,202-254
atcaatcggtcaaagtcccgcataaagtcttcgtcctccggctgcacttgctgctgttgagtgcgcacacggatgtgctgtgcctcgtcatcgtcgtcctccgctgtgatcattcccacttccgagacgtcctcatcctcctcctcgtcctcgtcactaaacatagaacgaatttcaggataaaataatatatttttttttctcatcaaacaataatgcaaacgcaaaattttcgtaacaactttaaaacagaa

SEQ ID NO: 55261 - DNA, 1330 bp, Heterodera glycines
  Genomic contig location: Contig_ID=SeqID_4659; Location=2167..3496; Strand=-
  SCN-specific regions: Sequence locations=1-151,188-373,403-1058,1080 -1224,1247-1330
atgagcgtgatcatgcaagtgatgcatgacaagtcatccaacattgaagacgctcggcaaaaagtgggtgagaattagcggaaatcgtcgggtcaataatattacttactctaaagtaatggttgagactgaaaattctcgagattgctcctaattaaatacaattaattaattgtttatttattttgcaagattttgttggaaaatgcctattacgcggtgatcccgcccgacgagcaggcatccggtgctcgggcagtacgtgcgcatttgccgcctgagtacgaatttgtacgccaacaattggccaccgaatttcgtgtcaacacttttcgtcgcatgaactggtccgatcccggctttgcaggtgtacaatttaatttataatttttaaataaaattcggaatcacttctatcgacgttagaatttgccattcgcctcttgtccaactcacaacgggtacaatttgacgaattgccacggctcgcttcgctggtcagcgcactgtctgatcaccacgattgggttggagtgcgcgtgttggacgaagttggtaattttgggacctttctacaatgttttttggttccatggtttcttttgtttctgtttactgctaaatcaccaagacagaaatcgtcctatgatttttgatttgaagatgtaacataactgaaaaaaccattttattggttgctctacctgttcaggtgctcgagtttattcgtctgtccatggagttgaacatgacgcgtcttcagcagcgaaccatttgctcggtggcctactttggccaactgttcaactacaacgtgtgcaacacggccaccctttttaaggtcgattatcattgtttacttgtcaacccaatcatcattatgcatccgatattccaggctctttaccaactgatcacttttgccattgcgccatgccccgttgacggtcctgaccatttggtggttcgtctccagcgcattcggctcgcgatcactctcgtggacactgtttgcgagttcttcgtcagcggcaaaagcaaacggcggatggaccactttctgtgcttcttcttcagattctgtttgtcaaaaatttatccccaatcaacaccaaaaatataattttcgtaaattgcagactacgaaacgcgcgaggcctggtccgaacatattgaagtgctcgacgaatttccggaagatgtggaaaatttggtggacgatgtcttgaacacttggcgtaaaggcgaacatttccccaaggggctggccgaggcccacgaaagagtggccgaggtggagcagttctacaaggccaaagtgcggtgttga

SEQ ID NO: 55262 - DNA, 131 bp, Heterodera glycines
  Genomic contig location: Contig_ID=SeqID_24536; Location=496..626; Strand=-
  SCN-specific regions: Sequence locations=1-131
atgagcacactgatgacccacccagacaattgcagaatgggcatatggggtggacttgcccaatggaaagagattttgagtgggatgaggggtaaagataatacaaaagtggaaatggaaataagggaaag

SEQ ID NO: 55263 - DNA, 967 bp, Heterodera glycines
  Genomic contig location: Contig_ID=SeqID_24537; Location=811..1777; Strand=+
  SCN-specific regions: Sequence locations=1-104,128-356,378-541,570 -658,695-967
atgcacagtaacttcaatgttcagtgcttggctaattgctttgattgtttggctttcctgctcaaattgacttttcaaactgtgccattctgtgccggtgcccgcatggccagcagcagcagcggccaagtcgaacatggcacgggcaaagcccaaattgtacggacactcgtcctcataagtgatctccattttcgcaatatcttaatggggtaatttgggcaatcattgtgtattaattagtctctcataaaaaatttcctgcaaaaaatattcctttaattaattccaaatttgcatttgccataatttgatcatataattactcctcagctgccgatcgatttcgtccacaatttgtgcttctcccccgctgggacatccgccgcgagaggatagatcactttttaacccatccacagtacttttcgtcattgaacatactgtagacgcgtcctcaccggcagcagagaaagtgccaatgtatttggacatcacagaaaccacttgctgactgcccgggcagcacgggaaatctgtgaaatttaaatatattaattaattattttctttttgaagattttggtttacttggcattgcattgcaacagaccaaaaagacaatcgagaagatggagagcagtagagaagacatagcaaaaaatattttgttttatttaataatgaataatttggtattttgttgtttttctgcccgtttaaatacccccctttttatttccttaatagacgtggtttttattagactaaaacatacaaaaaatctttttgcggaaattggtggatttttttataagctttcacgtgaattttaaaagaaaccgaaaatcgttgacaattttttttatttatttagcttttattttaatgtgtgactttatcaatctatttgcttcatgtcgaaattttatcttattgtctaaattttgctgcaaaatatttttca

SEQ ID NO: 55264 - DNA, 939 bp, Heterodera glycines
  Genomic contig location: Contig_ID=SeqID_24537; Location=527..1465; Strand=-
  SCN-specific regions: Sequence locations=1-86,115-278,300-528,552 -681,708-939
atgtcttctctactgctctccatcttctcgattgtctttttggtctgttgcaatgcaatgccaagtaaaccaaaatcttcaaaaagaaaataattaattaatatatttaaatttcacagatttcccgtgctgcccgggcagtcagcaagtggtttctgtgatgtccaaatacattggcactttctctgctgccggtgaggacgcgtctacagtatgttcaatgacgaaaagtactgtggatgggttaaaaagtgatctatcctctcgcggcggatgtcccagcgggggagaagcacaaattgtggacgaaatcgatcggcagctgaggagtaattatatgatcaaattatggcaaatgcaaatttggaattaattaaaggaatattttttgcaggaaattttttatgagagactaattaatacacaatgattgcccaaattaccccattaagatattgcgaaaatggagatcacttatgaggacgagtgtccgtacaatttgggctttgcccgtgccatgttcgacttggccgctgctgctgctggccatgcgggcaccggcacagaatggcacagtttgaaaagtcaatttgagcaggaaagccaaacaatcaaagcaattagccaagcactgaacattgaagttactgtgcattttggacacccaagcaaaggcaaaccaaataattttaaataaatatttatttgaaaacttaaaagattattttcaaggaaattccgcgcaccaaaatgtgccgagtccgagccatgtgattaccaaccctggccaacaaagttcggttggccatggaaaggaagacgaaccgttgtcatccgatttcgacttttgaggaaatagaaaaaaggaattaattagaaggaaaattcatagtacagaaaacattttgttgattatttatgaagaatatttatttgttt

SEQ ID NO: 55265 - DNA, 422 bp, Heterodera glycines
  Genomic contig location: Contig_ID=SeqID_24543; Location=610..1031; Strand=+
  SCN-specific regions: Sequence locations=1-314,346-422
atgatcaatcgtggtaatgacactgacgaatgggctgtccaaaaaggagatgaacgaggcatcgtagcggaggtaaattgtgcatttttcattgaaatgaatctaacgaatggattgctcgcatttctttctgaaatggtcaccccctccccttggaagaattttttggtaatatgtagtaaggctggtctccctcctttttcgaaaattttttttatgttttcaaaagtcatgaaaaatgtttccaaggcctcgggggtcgcctgatcacgaatccggcatcaatttcgccaattccggacccgaattcgaacaaaaagtcgaaaattcaaattttcgaattttaggtttttgtttcaaacttcagaaatgaagtaaaagtcaataatgattcaataaaagatcatttaaactacttttag

SEQ ID NO: 55266 - DNA, 1490 bp, Heterodera glycines
  Genomic contig location: Contig_ID=SeqID_4660; Location=392..1881; Strand=+
  SCN-specific regions: Sequence locations=1-33,64-89,111-111,147 -157,309-408,430-505,527-1216,1251-1490
atgcgaacggaggaccaacagctgttttttgctggcggggagggagcggcggcggcggaagagagcggaggaacaaaaaacgacggaggaggaagagagactgatgaagacgaggagagcgacagcagtgatcacaatcatcatgaccaacagggacagagaagagggaagaagaagagacaacgcaagcagcagaggagggaagcagcagccgccagacggttggaggaggaggagagagaacagcagcggcaagacggagaggagcaggcgcagagagaggaagaaacaggagacggtgatgagagagcacgttgtgtggcggcggaagagaaggagaacaacaacagcggaaacaacagttgtggtggaagagaaggagagtgctacgaaatagcggtggcaacggaagaagcagagagcggaaacatcaccgtaaagaaggaagcagagacggccaagaaaaggaagaagggcaaacggacggatgagcagcagcggaaaacggcagcagcagcaggaggccatgaagagcaacagtcgaaaggcccggtgcattgcgagtgcacgcgctgtggagccgagttcgaatcgaagaccaaactgcacgcccacctgcgcgacagtggtcacgcgacgctcaagacggtggcggacaaaattggggcggcggccgccgactcggcgacggacagcggaggccgacggaggcggaaaaagaaatgacaaatggtggtgaaaacgattctataaaagtgctgtcggtatgttgttattttgttgcacattattgtcgagtatattatacaacatttgtggttgaattttcgataatttttctctcttccatttcgacaaaaaaaaagaggaaaacaatttttttattaagaggaagaaatgagaaaaaaccatacatgaaatagtgaggggggggggagaccaaaaacaattgctcttcaaaaccgcttttttattgtggcgcgctttttccaaaaaacttagggaacaggggcgccggcggtggtgtaaggtcaccgccgagaaagtttgaaaatttggtgatttgattatcacaattaaatgaccaaccaacaggaggggtcgaccccccccccccctatttcatgtatggagaaaacaaaaatgaaaaaaggagaaaaggtcgtcatgaaagcatcgaatttgttcagcaaaaactccccaactgtccggcgtgcttaaatgtggggacaaaaaattactgtttgaaaggtgcatttttcgagtgcgaccatttaggcaattaaatttaaatccccccccccccgaaatggatgggtttcatttttcagtaaaacttaattttaatacgcgcactttttcgttgagctccttaaactgtgatttgacccgaccaccacactttgtcatcggcgcagtgattgcagcggctccggcggaaacaaatatagactgaaaaatggggaaaaaagctgactctcaaacaaaaa

SEQ ID NO: 55267 - DNA, 1645 bp, Heterodera glycines
  Genomic contig location: Contig_ID=SeqID_4660; Location=3918..5562; Strand=+
  SCN-specific regions: Sequence locations=1-168,190-206,228-468,490 -748,780-898,920-1001,1023-1207,1243-1342,1371-1645
atgcaaatgtcatcaacttctgcttgtgaacagaaatcatttcccgtagaccaaaaggtacgtggaggctggtgaccaaaaaataatttaattctcccaaaatttgtcgaattttgttaattttgcggtaatactggagaattggtgtcccggcgaaaaattaattgaaaatttttctttttctaaaagtcgttaaaatatatttatggaggttttctgtggtcgctgatcacgaatctgacattaattttgaccaattttgaatcccaatacacgaactcgaacaaaagtgaaattcaaaattctcacacacaaaaatcaattttgaattttcgactttttgtccgagttcgggtttgggattcgaaattggtcaaaattaatgtaaattaatgtcagattcgtgatcagcgataccgaaaagcccagaatgcatgttttcatgttttcttagatgaaaatttattttaaacaacaagtatttgatgaaaaatcatagacaaaatcaatgctttttcgaattttgagcccagatccgtaataaatttgggattttttttaatttagaataaaacgacgggaacaaagcgaacccgaacaattgaaacaataaccgttgctgaagagacggacaaaaacgaagaaaaagtggacaactcatttgacaaaaagaaacggaaaagtgcaaaacaaagagtgccgacgaacccgacgaagttggcaccgtcaacagcggaaaacggcacggaagaaaagggaaaacaaaaacgaaatcaaaagcaggggcaggtagagttcgactacgaaatgcgccgggttttgccacctcagaatttggaagtgacagtgaagaatggtgagatggagagagaggatttggcattggcacgactttttagagggatttggcaccagttttaaaatgattttggcaccgctttttcaaagggtttttgcgacaatttttatgacgaattttgcaccgtcttttagcgactcggaaacccttttaaagcatttctggcaccgttttggaaccacttaagacgatttttgcacctttttggggcggtttttgcatttttgagcgattttggcttataattgggggacaatttctcttttaacccgatttctgattttatttaggtgttcgttatctacagccatattggtatgtctttttggatggtaacagcgagaggacgtaaatattaaatttttcttttcaggggccttttttgcggttattccaagcggcgatggattggaaaaacaattgccgaagtgtacgccaccgagttcaacaaccttctccacccgctttacgcggttttcactcaaaattaaaaaaaaaaaacattttttttcagcaagccgcttgccggaagggtcgcatttttgtgaacagtcggccaattttcagtgcgaaccatcgcattcgtgacaacgaatatttcttgcacataaatcacagggtttgtgttgtttttttgtgtttggcgatttttccctttttagcggcctccagtcttttatcctcatttttaaggacggatcttatttttagaaaaaggatgtaaaatgcaaatttttgatggtgtcaaatgaattttaaacgaatttcaaaaatattataccaaaa

SEQ ID NO: 55268 - DNA, 1427 bp, Heterodera glycines
  misc_feature (166)..(166): n is a, c, g, or t
  Genomic contig location: Contig_ID=SeqID_4661; Location=231..1657; Strand=+
  SCN-specific regions: Sequence locations=1-232,254-460,500-770,792 -876,898-930,952-1218,1240-1368,1390-1427
atgcgtcggtggtcagctgcaccatcgtcaccggtcggacccccccaatccggatccatctccaattccctggccacccgatcatttgtgatcggttgtacaatgacgagggatggggtccggagaaagggcaaggcggccaatttacggtgaaagaaccccgganacaggtgggtgcactttgggcaatggacaaaatatgtcccccgataattaaaaaaattacgatttaaaacaaaattatgagggtgggggttagtgaatgtccccgaaatctgtaaactctactcgatttcccattttttcgtccgcaacattttcagttggcgcacgacattggcacaaggcattcaaaagacaattggatcattgaacgggacgaagagtacgagcagcgcattcgacagattggagaagacgaagaggttggtaagcggagattggataagcactcgtcccgaaaatttaaaacatttgaatttttatttattttttttttggaattttactccccccccccccctcatccaattgaatttcttgctccctaaaagaaaaacattttccctagtgcgcggtggacgagttcgacctgaaaaatttggacgcctgcctcaaggcaatgccggcctttgacccgctctgctggggctgtgcaatcaaaaagaagcgggaaatgcaggaaaggtgggtggtgtggtactgtgtaatattgggggggggggtgtacagtaggggcagaagggaggctatacgataaatcggtcaaattttaaaaactttggaaaaaactgcaagtgcctggggagggcgtgctgccttttttggtgatttttgagccgccaagcaaatttttttccgattaacgtggtactgtattaatatgggggtatggtaggcgtggatgaggcctgatactgtaaaccggtcaaatttaaattttggaaaaaacgacatcattcctctaactccgaatggaccattctgcttttttgagcggatttttagtcaaacaaattttttttcgccgatttttaaatccacatttttgggttttgtaaatttagcttccacatgccaattttttattgttttttttgtacagagattggctgatggcgctgcattgtcatcgctattccggcgacggatgggcctacgaggcgccgttgcccgactgggccaccaccgaaattgaagctgacagtgatccgcaacagggggaggaggaggaaaatgccatgaatggcgacggcacggacaatcaacaaaagcagaggaggagcagcagtacaacaacaacaccagcaacgacaaaaacgacggcgggggaagaaacggtgccgaaaagtgtggcaccaccgacggcgatgacagaggaggaggatgaagaattggtgccgaagaatgcgcaaaatgctctatga

SEQ ID NO: 55269 - DNA, 1204 bp, Heterodera glycines
  Genomic contig location: Contig_ID=SeqID_24545; Location=95..1298; Strand=-
  SCN-specific regions: Sequence locations=1-147,181-355,378-603,626 -709,732-836,859-933,956-1118,1140-1204
atgattcaaagaacagaaaaaggaacagcaattttgttggaagcctcaaaaaaagaggctgaaagggcatggaaggaagtttcagtattggtagaggaagctgatgattattccaaatctgctcgtggagcccttaatcgggcaattaaatcccgagaaaaggccccctatgccccaggggttcgagaatggttcgtaaaaatgtcagattgtatctgggaaatttacaccgttctggataaaattaatgcagagtctgaaagggttgagacgatgtggcgtgagattgaacattctaaagatttcgatcagaccacaaaacttgaggagaaagtatttaagagtttaaacgaaaccaagaagttgcatttcgagtcccgtcggattcatactaaaatattggagcaagaaagcagagttcagtctatagtgttgggatttattgagcttcacgagtaaaatggaggcaattcagtataattgtcacgtaattaacaaatttgggatcaaaaaacatattacaaagtttattttttccggtacatctgattatgaatttaaacaatctctagaaaaaatattagaaaatgcatatataaaagaattagcaaacttcaaatcaattctaaaactacaatattctaattttctagtagccttgccattacggttaccacaggaaaatacaattgacgttctgctagaacagcctatattttcaaacttttttccattggatgatactgtaatttttgaaataatcattgtatctctaaatgtaaaaaatgacgacaattgaccaagaaatgaattttataaaaaatcgaattgtaaactggtggaaaagggaaagaaaaatgatcaaagaggcagatagtgtagttatttactgtaataatatttctaaatatgcgaaaatttttacaattattgcctttggtgcaccaggaatacatgtgttgtatgagaattttttagattctgttataaaaattcgggtgctatatctacaaatgtccaacgaatataaaaacatttccaattctttaagcgaggttgaaaaatgtagtcttaaaaaatgtcaagaaaatgaaattaaatcaaaaaaaagttttataaaatgtttcaaaattagaaaacagataaaaagtctccgaaacaatgtggatgaattgtttaaaaaaattcaagcatgtgcaataaa

SEQ ID NO: 55270 - DNA, 1767 bp, Heterodera glycines
  Genomic contig location: Contig_ID=SeqID_24547; Location=139..1905; Strand=+
  SCN-specific regions: Sequence locations=1-157,179-333,375-525,564 -691,845-855,991-1032,1124-1622,1644-1767
atggccccttttctgtggagcattcccttgttggccattgtgtgctttttaagtgttggcataacagcgccaaacagtgacaacgagcagccaaacgatggagcaacaactgctgttgagcaaaaacacatagaaagtatggaaattagcaaggggcaattaggaatttaatcattttaatctcttaattgaagcatcctggaattaataattaatttggtcagttttaattagccaattagaatttgcgggccccaaaaaaattgcaataaattaattgggacacacaaaaagaccccaatttcggatttttgcaaatgtaaattattggagaattttatttaccttttgaaaaagtttgaacttttaaaccgcgtttttttggcctcgaaattcgtgcatcgaaaatttggcctaattttcgagcatcggcttcgagaagtaagccgagcttcgcccgtctgtccctgttttctatagcggatttctacagtataattgggcgcatgttttgtccattgttctttattttggattttctaataaaacattccttcatcaaataaaatggtataattctaggttaccgaattgcatattaaaaataattagtcctaattcacaccccaagatgaggaaaaggaagtgcaaattggaaaccatttggacaagaaggaagtggagaaggggaaagaggaagaggaagaagatgatgattgcaaaaagaaaaaatacaaaaagaaaaaaggagaagaagacaaaaagaagaaagataagaaaagagaaaaaagaagaagacgatgaagatgaaggaaaaataggaaaaaaaggacaaagagaaaaaagataagggcaaaaaagataaggacaaagagaaaaaagataagggcaaaaaagataaggacaagaaagagaaaaaaacaacaagaaagtaaaaaaggaagagcacgaaaaagagtaaaggcgaacaacagacaagaagaacggaagtatttatctcttcaagctcttttcatcatagttttcatgtgcctatctttctatcggcttcttcttttcttccggccttttctccttcctttctttgcttccaattctctttttctgtaactcttctttttttggtacgcataaattgaaaattctgctggtgctttttagtgctgtccgaaagtctcggttccgactcaagaaaagtcgggtttttggtctcgaatcgctactagagaaaatagtctcgaatagagcttctcgagaaagttacgagttcaaagaggggcggagagttttttttaatgagtttcaattactttctgtgcatttgaaaattccacttctcctttcctctctttttatggaaaataatttctatgctcctgaaaattttgataagccgcacaactaaattattccttctggcgtagtatcaaagatcccatacattataagagacaatctggaaatatgtcccagacatatgtgaacaaattgtctctaatggggatcttttgaaaatcaaattcatggtcaagagtgacataggcacaaacgtggcgtaagcagctcatataatcgcatgcagatgagtagagctgaacattaaataaggagaacatcatcggcatcattatagataatattgataataattttcaagagttcccagagtgatcatcagaacggacaataatcagaaacaaaagcagacaatgtcaatgagtccgagcaaattcagcatattacataacaaaatattcatatacgtga

SEQ ID NO: 55271 - DNA, 704 bp, Heterodera glycines
  Genomic contig location: Contig_ID=SeqID_24549; Location=89..792; Strand=-
  SCN-specific regions: Sequence locations=1-401,424-704
atgtcctcaaacagtgccactaccacgacgagcacggacaatggaatttccctcgttgaggccgacgaacgcggcgccgaagggggcgaaggcgacgatcagctgaccatcaactcgttgagttcgtcgttgagcagcagcacggcgacgacggacacggagggcgaaagtgagtggagagattggggaatgaggagggaggtgttaatcgatgttttttgttacataagttttcggggtcggataaatcctttttattattaaatgttaaatttacgatttgtgcttgcagtgatacaagacatacaattcgaggggttttttggtccgaaaatgattattttttcattccctatttaataagtgcatttcatttgttcccaaaggcggggcgggcgacggaggacgaaaaaggaaaaagagacggggcgacgggtcgtttagccgcgggagcagtgcgaaggaaatcgaacagtttgacgaggacgaagcggcggaggacgcccttttggacgacgaagcgccgccctacgcggcgaaaacgcgcgaccgcgccattggccgactgatcgtcttcagctgcattctgttcaccgtgcctctgactctgatgtacaccacatatcgctttttcttcatcggtaacatttacaattagcaattttaaagcgttggatttcattcttttgaatttggccaataaa

SEQ ID NO: 55272 - DNA, 1991 bp, Heterodera glycines
  misc_feature (516)..(516): n is a, c, g, or t
  Genomic contig location: Contig_ID=SeqID_24552; Location=59..2049; Strand=-
  SCN-specific regions: Sequence locations=1-81,119-282,306-659,701 -894,916-983,1005-1090,1112-1832,1885-1933,1969-1991
atggcaggtaatccttaaaaactgtatttcacctatttcaaataccaaattcttagtaaaacttttacaaaaattctattcaataaataatataaataaagcatttatttttataattcttccatcctattatgcacgtccttttgaactgtttcacgacgaccatcataatgtttctaatcggtaattaatacttattttattatacaatatattgcgattgttacagtttggcgttgtgttattgtcggttctgcggttagcatcaaaactttgaatgaagtgattgaaacaagctttctgatcaacggcaacgacgatcagctgttcgatgagcaaacaaatgccgaattaatccgatgccatgaatatttcttaaagacgtcaattttagatacacttgacatgattttgtcaaattttgtagaactgattttgttaattggctttacgaatgtgcataattttttgaaaaagaatttcaagaagaaaccgaatgttttctggaattcgttnaaagaatcaattgacaacataaggtttttcacttaaaattaattagttccaaaatttactagataaattttccagcactgacggacccaaattccttatcgatcttaaaaaatctgttaaaaatcaaaaaattacagacaccctaaaaaactattaaaaaaaattaaatttatattaaaaaattgaattcgttagctaaaatagtattaacaatttaatcattttttattttgaaaaacttttttaagttttgctaaaaactgaatggttatgttttaattgggtcggtccattgcaatttaagtatacttcttcttctaaaaatgcccttccaaaatttttcgttttttttatcggtttgattttgcagtttcgaaacacgaattgtgccagaaataatgtgccaaacagtcactggcacccaggacaaccgcagcagctgcgccagcagcagcaaatccagtcgaccaatgtttgacgacagtgacggcggcggtgcgcatggcttaaaattgtttcaaagttgtttgttccatcatgatcagtacgacagatgggaaaggttgtacaatgaagagcagaggagagaatttttggaaattgaagaggaacaaatttggcgggaaatgccaaagcgaaagaaaataatggcacaagccgagcgagtgggtgccgcactgctgtacacaatgatccatatggaaatgagcaagttgttcgagagcaagcaggtcaaaagcgaaagcagcagctggtcagcgaagtccgcgcgggctatgtcgcaacttcgagaaaagcttaagcgcgtggaaaagccggcggttagccgccgtgccaattcggtatttagtagtaggaaacagcctgaacttgatggaccataaaatctaattccgatctttgttactttggtatttattatttgggttgtttatgcttatttatggcgcctatttcagtctatcaacctgcaaaatttcaaaaaatttagttaggtttcaaaaagttatggttaaaaagatgtgaaaacctggttgcttgtgtacttttggccataactttgttcaaacttggccaatttttttttttttggaatttggtgagctaatagagttttaggcctatcgagtgatgccaagaatgtttatggttgagtttgagagacttttatttacttagcaatgttccggattttattttaaaatttttgtgatttatagaaatttcatgaaaaattcaatttattttgaaaaaatagctttaaaaccgatttttaaaaaaagagattttttacggcattttattcttattcactctttttaaataatttttttatgaaagcaaaaaaaaaatttatttacatattttggtatgtacatattaggggtttttgtcatacatattcttgcatatcttgaaatttttatatatatatatatttttttttaaatacaatttacagctctagaaataaa

SEQ ID NO: 55273 - DNA, 1942 bp, Heterodera glycines
  Genomic contig location: Contig_ID=SeqID_4662; Location=1449..3390; Strand=+
  SCN-specific regions: Sequence locations=1-384,406-439,472-567,589 -595,636-959,981-985,1021-1443,1465-1645,1667-1686,1709-1808,1841-1942
atgaataagggaacagttgagaaatgcattggcagagttggaggtgtacatcaggacggagccacgacggacggcgtggaacgatggacggcaaaaatggtgaggagcagtagcgcggaacaaatcgaccttaaacctttcttctttaatgagttttcgggtcaaaaaatatccgattctgatcatatcagcagattaggagaatgcaatggcatttgctttagtgtcccaatttttttgcgagtaattaaccattattaaattattaacccaccaaaatgccaaaaaaggtgcccactgaattggtttttgaaattgctaattttgtgcagtgccatcggaaatggacacactttcgtgtgtccagaaaaattgactacccaatggttaaaaggatgaaaaactggctaaaaaccctcaaaattgcggttgtaaattcaaaattaattttaaattaaacaataattaattgttccaatgcctttagattgtccaattccgcgcagcatttgaagaactgtgccacaacgtggtcaaatattcacaaaagaatcagcgcaacttgttccagcggatctacaaaggcaagacaatgttttaataaaaactttaaattaatttagttttaaaattaagagtttttcaaactgtcgctgattggtcgaatgccgaatgtccgtgccattgagagtcttggtctgagcccgggggacgccaactatgtgggttttagctgttaaatcataattggttcacagtctcaattcacgggttctgttggtctcgacttttgggggtatacgttttgcccttctcggggtcttcggtcattcacagtctcaatcaaattttgaattcttggggcccggaaattggggatctacttttgatgatcccgacttttggtgacccgacacattattctccgtctaattctcgatggcattctttttgcccttgtcggggtcttggccttttggctacccgacttttaggcatgtgaaaattgggggcccgaaacatgggactatacttttgaagatcccgacttttagtgacccgacttttgggtacccgacatatatgctccgtctaaattcttggtgtccttccttttcccttctcgggatcattggcctttccaagtctcgatcaaatttttaattctgaatacaaaatcatcgttttgccatttcagatcactcagttgaaggcggcttgtcagggtgttgtggacgcgtgctgtgaatcgaactcggcgagtgcggaggcctttgcttttctcactaaccgtatgtttgggagagagtactgtacttttgaataaaatctaccgtttttagacgtcatgacactgaacagtatggttttgggtggaatgccggaatagaactggtcaacaactctgctggattcaaacaacctgcaggacaaaacccattgaaaatttaatcaaaaaacaaattttcgaacgtccatatcttttttctactcatgaatcggttagcatttgcttataaaaagcttctcataagatctttcgatttataccaagattttccaatttggttgtcaaaacctttcagaagctcattttctgaatggtgtgttaagtgaaatttcataccatttagcacaaatttaatgggttttggttaaaaaatttataaagtgtatggcatagtgtttaatttttaaaaatttatttcagtgacgaaacacaaaaaagaattatcactcacttttgccgtttcatttcgtatttaatcaatcctttttcattggcacattcggacttattccttcacttttgtatttaaaatcatttgcatttaaattgagccccgtcactttttgtcaaatattttaaaattttaatgttgacaagtaaacagtttaatcctttcattcatttgctactttcacattacttacaaattta

SEQ ID NO: 55274 - DNA, 562 bp, Heterodera glycines
  Genomic contig location: Contig_ID=SeqID_4662; Location=3763..4324; Strand=+
  SCN-specific regions: Sequence locations=1-161,186-282,304-421,448-562
atggaggaatcaaatggtcaaattatgatggtaattaaagacatttaaaaattcaattagcaaaacattttttagcacagggaatttgttgataaaacacattgatgatgattataaactattcgagaaatgattaagtaaaaaatgcacgagaaatgttcaaaaacaaacaaacatttaaaatctgatcaaaaattaaattactaaagctgatcagatcaacaatgggaactgatctaaggagaccaaaaaattgaaaaaagcatctcattaatataaatgctttgttttttcagatcagttcccaagtgatcgacattggacttttttaaaaagaataattgattgaaatttttgatcagaaaatttaaaatgtgtgaaattggaagatgagaatgagagaatgtgttggagcatcgactaattagttaattaattaatcaattagctgctggtgccgctgacaatcggttttatcggcctggacacttgcaaagcgactgaattgccactggaacgatggaagtgacggcggaatgctgaaaagggcggaaatgaaaga

SEQ ID NO: 55275 - DNA, 921 bp, Heterodera glycines
  Genomic contig location: Contig_ID=SeqID_24554; Location=619..1539; Strand=+
  SCN-specific regions: Sequence locations=1-39,61-417,444-457,479 -732,754-921
atgacggcactgcattttgcggtgtccaggcgcaacctgcagatcacgcgcttgctgctctgcctgggcgccgacccgaacgtggccaatgcgcacggggacacgccacggcatttggccgccaaattgaacgagtaaattttttttttggggggcggggaggttaataattcatttttgggcctaaattttcggtacttcgtgttttgctacccctcccccctcgagggcgggtagcaaacaaaggagtatcaaatttttgttattcttcacccaaataaaggaccccaaaagtccaactctcgtttttgtcctcttaaatatgtcaaaatttttcagggttgatttgctgaaaagtctgatcatatgcgatgctcggcgttgtccactcaccaaggtaacaagcacagattttgctatatatataaaaaaaaaatttttttctttgccttccaaaaattttttcatggtttcaaattgggtaaacacatccatctctcacgttttgtgaatccacaaatacgcatttttgtgttaaaaaaattcgtttttttccccgtattttaggttggctgtgtgtccggttgtgtcaacgagaagcagttgcacgagctgaagaggacgtccaccagttcaatgcaatcatccgccaccggcaacaccacttcaacatcttcgacggcatcgtcatcgtcgtcaagcagttcaacaacatcggcagtggcgtcggccaccgcagctgctgctgctgctacggcaccaccagctcaaccagcaacctcttcacaaccagcagcaggagcatcaacaacggcaccaaagccggccagctacacgtcggtgacggtggaggattttgagaaccgggcatttgacaaggaacatttccgcttcaacaaactgttggacattcagcacaat

SEQ ID NO: 55276 - DNA, 355 bp, Heterodera glycines
  Genomic contig location: Contig_ID=SeqID_24554; Location=1..355; Strand=+
  SCN-specific regions: Sequence locations=1-101,123-265,287-355
ccgaaggattcgatctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatc

SEQ ID NO: 55277 - DNA, 1249 bp, Heterodera glycines
  Genomic contig location: Contig_ID=SeqID_24555; Location=618..1866; Strand=+
  SCN-specific regions: Sequence locations=1-226,261-376,407-517,574 -642,664-956,998-1249
atgccacagacagcaacaatgcgtgccatcgtcatcattggccttgtctcgagacatgttgtcggcacagcagcagccctgtgccaatggtggagtgtgcgttgatctgtgggatcggtttatgtgccgttgtccgagaccatttttgccgccacgttgcgcggaacagccgcccgaggcaacgtttggccatggcgaccagccgtccaattgcgttgtgagacggaataaattttttaaaatttaaatttaaattttttggatttctggtcccgtgattcgggtatattttttgaaaaaataatccggattaggagttcgtcctgaaaaacaggatttttaatcctgaaaccatctaatttatagaatttttgccataaaaacctattaaaaatttcaaatttatgcatgttttggatcaatttttgaaactctgtcattagtaaagcttttctgggatgccaaaccgaaaaatttgttttttgaagctttaggcacatcccattttattttcccgaaaaaaaaaaacttaaaaattataatttatttttgatttcaattttttaaaatattctttcagtatgcgttgagcacggaggacaaacacgtggtggccgagaagacgcaaatcagtgtgagcaattaaaatgtttgttataatttgcgaaaaattgaaatttaatgggggcgggggtcagttacggtaccacaaagtgcacgacatactgtctcaaattcgcactaaaaaattcaatataacgataaattaatgattggttacggtacccatagtgccaggacctactgtctggaagttcatattacgaaattaatttaaatattttgtgccattttatagtctttaagtgatttatgtatttgattttgcatttcattttttcacaacaaaaaaatcccggattttatgttatttttggaattgatagaaatttgacaaaaaaaaaattttttttttgaattttagaaaatttattttgaaatatgaattagtctttttgtcccacagtttttgctgcgcacggctgaccatcggcacggtccaccatcctctccagcgcttccgggcacaatgccattgttttatattggcgaaacatttggcgcaggcgccagcaccggcgctgaaccggacaccagcacattcattgcggcacagctgcgcaatggtgtgccacaactgaacgcacggctgggcggaaaacaggcgcggaatttgttacctttttta

SEQ ID NO: 55278 - DNA, 249 bp, Heterodera glycines
  Genomic contig location: Contig_ID=SeqID_24556; Location=241..489; Strand=+
  SCN-specific regions: Sequence locations=1-14,36-123,169-249
atgcaatggatggctttcaatctgcaagaaattagattggcaatatgtggtagtaaaaccccactcggccgcttcgcggccgagtgagtactttaggctcaggaaaataattaactggggttcattatttatttattttttgcaaaattaattcataaatattttttagaacgtgctctgaaacgcaccaaatgttaattaaaagttaaacaaggctctctgatgctttttctatcaaaagggagatga

SEQ ID NO: 55279 - DNA, 298 bp, Heterodera glycines
  Genomic contig location: Contig_ID=SeqID_24556; Location=1..298; Strand=-
  SCN-specific regions: Sequence locations=1-23,45-118,147-298
ttttactaccacatattgccaatctaatttcttgcagattgaaagccatccattgcataccggttctcggcacagcaaagcactaatagggtgtttgactcacttcaaaaaataattcattacccaaaagttttttacaaccacttattgccaatctaatttcttgcagatttaaagctatccattgcctgccgggtctcggcacagcaaagcactaataaggggtttgactcacttcaaaaaataattccatacccaaaagttttttataaccacatatagcccatccaatttcttg

SEQ ID NO: 55280 - DNA, 471 bp, Heterodera glycines
  Genomic contig location: Contig_ID=SeqID_24556; Location=707..1177; Strand=-
  SCN-specific regions: Sequence locations=24-102,149-149,175-330,357 -439,461-471
taaaaatttttaaaaattttattcatctccctttgatagaaaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagtgcgctaagttcgatgaaactttttaaaatataagcctaaactttttggcttgtttaaaaaggaattaaaaatttttaaaaattttattcatctcccttttgatagaaaaagcatcagagagccttgtttaacttttaattaacatttggtgcgtttcagagcacgttctaaaaaatatttatgaattaattttgcaaaataat

SEQ ID NO: 55281 - DNA, 388 bp, Heterodera glycines; identical to SEQ ID NO: 51536
  Genomic contig location: Contig_ID=SeqID_24557; Location=82..469; Strand=-
  SCN-specific regions: Sequence locations=1-20,42-275,297-388

SEQ ID NO: 55282 - DNA, 582 bp, Heterodera glycines
  Genomic contig location: Contig_ID=SeqID_24558; Location=197..778; Strand=-
  SCN-specific regions: Sequence locations=1-86,108-582
atgaaggagaagcggattcaacaggaaaagaaccgcttcatgagaaaggatgtcaaggccgtggcacgtgcggaagccaaacgtgcgaaagaaaagacaaagaccgcacagacagaggagcaagacaagtgcgaaactcgaaaagattgggaagaacgaagaatgaagacgcatgccgaacggatggaatggttgaagaaggcgccaactgctcaaagggaacggaactccacacagagtgacccgagacgacactccatatctccgatacgtactgaggaaggagaagtggaaatcgtggcagaaatccgtggagagcggccaatgccaaaccagttcggaaagcggaagcgccccaactactcgatttctcctgatcggagatggaagcaaggaagagaacgttcgagatcaccggtctcgcagtttccaagaaaccgacggcgcctaccgtactccatttcgccaatcagaagaccacaccaggaagaagtacaactggtcgaaccagcgccatcagtggagatcatccggaccgtggcggtgaaaccgcgaatgaaaagtcctaccgatgcggcttga

SEQ ID NO: 55283 - DNA, 765 bp, Heterodera glycines
  Genomic contig location: Contig_ID=SeqID_24559; Location=106..870; Strand=+
  SCN-specific regions: Sequence locations=1-102,124-258,281-486,510-765
  Gene Ontology: Mol. function=hydroxyacylglutathione hydrolase activity; Biological process=sulfur metabolism
atgcatcacgcgctcaacgaacgccttgccgctttgcccgacgaaacggtaattaacaaaaaatcgggccaatcataaaacactttcataaggtaattcgtgaaaaaaaaaaattttttttttctcagcctttagaaattgttttaaattttagatgttttcaattggtaatcggcagggaagttcccctcccccaccgaaatgaaattttttcgaattggcaattagaaaattttgtattataacctttaaaattgcaaaaaaaaaaaatttttttttaccggcggcacctagcggtaccatctgaccccaattttaccttacaaattcgttttttttaattttaaccccgaaatggcaatttttggcacaaaacaaatgcatattcctattttttcgacggtacaaaattcttcaaacattaaagttaaaaaaaaatttccaaactttttatacgtatatcaaaattcaatgttgttttagttggtttactgcggtcacgagtacacggtggcgaatctgcgcttcgcgcgtacgatggagccgtccaacgaagccatccatcaaaagttggactgggcacagggccaacgggaggccgaccgctggacggtgccgtccaccattggggaggagaagcggcacaacgtgttcatgcgtgtgcactgcagcgccgaggtgcagcaacggtgcggcaccggcaccgacccggtggcagcgatgggccgactgcgcgagttgaagaacgcgttcaaggaaaaatga

SEQ ID NO: 55284 - DNA, 409 bp, Heterodera glycines
  Genomic contig location: Contig_ID=SeqID_24560; Location=60..468; Strand=-
  SCN-specific regions: Sequence locations=1-49,79-79,106-125,152-409
atgaaagtgttcaaattgaaaaggtgttcattttgatgatttcttagcgttttatttataattttgaatttattttaacagttttgtcacgattggattcgccacgaaggaagtgccattggacgggtcaattggtcaaattttgaacagttacgggtaccgaagcgatggctcatttggctgtaatggcatcaatcggccgtgcaaaatgccaatgtcattatttggttcgtcattttcccccgtggcaatgcaatcggcggacgtggaaatggcatacaaatcatcggagttttccactggtgacgtggtcggatgtggcattttcttggatactcgactgatcttcttgacgaagaatggccaacgaatgggtgggccaattaaaatgaaaaaacaaattaattaa

SEQ ID NO: 55285 - DNA, 231 bp, Heterodera glycines
  Genomic contig location: Contig_ID=SeqID_24560; Location=582..812; Strand=-
  SCN-specific regions: Sequence locations=1-8,30-151,180-183,217-231
ttgctttagtgacgtcatcgggcgaccattcgccgccggcggttgtctcagcgaaagttgcaaaggtgggaaggaaaccttaattatttcacaaatgccatttaatttcaggaagtgcctaattcgcagcaacaaaatggctgggatgccaaagtttgccacaaagacatcgaaatcattggggaaaagcaattgacgatcaattgcaagggcaacagatttggtatttaa

SEQ ID NO: 55286 - DNA, 1849 bp, Heterodera glycines
  misc_feature (1821)..(1821): n is a, c, g, or t
  Genomic contig location: Contig_ID=SeqID_24561; Location=1..1849; Strand=-
  SCN-specific regions: Sequence locations=1-213,235-357,437-475,552 -587,631-803,840-1005,1064-1323,1354-1498,1553-1601,1623-1655,1720 -1766,1795-1849
  Gene Ontology: Mol. function=alpha-glucosidase activity; Cellular component=lysosome; Biological process=glycogen catabolism
acaaaaaaaagctaattgacctttatcattgtaccatttccttttttaagccaagcaaatcgcaaaatttggaaattatagtactaaaaacatttgcgtcgtgttattccattttatgtaatccatagcaaattaattaattgtttacagtacaatccgaccgtgccaatgtgttattatccgccaaataagggttacacaatccagtcaaacgtgccgggcaatttgaaactgaaatggacatcaaacacactgaacaatccgtacagtcgtccaaatttggacattgaagtgcaatatcaaaaaatgggagatggaatttatgtgcgcattggaacagaagacaggtgaacaagcaaaattattataatgataaaatatataaaaatagattaaatattgttttaattattactaaaatcaatttcaattatttgaagcaatttaaaaatccatcaacaattcttggaatgcctaaattattaaaattaacataataaaattattactaattattgttgttatacaaatttttaaaaaaaaattaatatgagaagtgcaaaaaacgaaattataaattgattcccaatttttaagattttttaattataaatttaaaattgaattttagatggcttcccccactgaatgagcttcgcaatccgtccaattttgaacaagtgatttcatcaaattcactgagttttgaacttggtaatgccaatgagcctttctcatttaaaattcaacgaaatgattcaaacaaacaaagcatttgggacacatcgattggtaaaactaacaaaaaaaaattattgttttttaaaaaatcttttttaggtggccttgtttttggtgaccaattcatacaaattgcaacttttttgtcatccgatcgcctttatgggttaggcgagaatatgcaccatgaattaaaggtaattacagtatgcacctgaattttaaaactaactacagtatgcaacaaacatattttgaccaatgaaattaaatagttaaataaaatatgggttataataataatttttaaatttgaaatttagcatgatttttccatctataaaacgtggagtgcattttcacgcgatcaaggaaatgaatattatgtaccgggctcatacaatggatacggtaatgtttttttttgtaaatttcttgaatctacaaaatttaggggtacatcccttttacgttggtttggagccaagcggaaaagcccatggtgttctgattttgaattcaaatgcacaagaatatgtcactgggccgggaccgcattttgtttacaggtgtttttttttgtaattatgaaaaaatattttctgttttttgaattgcccaataaaatttggaaaaattgattaacattaagaaaacatgaatattttggctgacattatatgtattattaaggaaatgccgattttctattctcctgttcattgagttaggcacgaaaaagacacaaaatatgcacattaatttttaaaacattttttaaaacaaatttttttaatgaatatttttttttgcaatagaattgaaaagaaatctgtctttaaaaatttctgccaatttttcatttttgtgcctatttaattccctatcgcgcggtatccgtgttcatccctgccttataaattatttatttaattgatttcctttaaaatatcttttttagaaaaattaaaaaatttacaacaaaggaaaactatctataaatttgcttagtttttttttagcactatattatttttattaattgatttattagaacgatcggtggccaccttgagctgntcttttttcccgggcccaacggcggagg

SEQ ID NO: 55287 - DNA, 168 bp, Heterodera glycines
  Genomic contig location: Contig_ID=SeqID_4664; Location=1310..1477; Strand=-
  SCN-specific regions: Sequence locations=1-168
tgtttgccttaattttaacttattacatagagaaaacggcaattttaataaatttcacctctacatttgaaacttttttccccctattttcgcccctatttcgcgaattttttgcccctatttaggtccctaaattggaatttttcgcccctaaaaatccccacccta

SEQ ID NO: 55288 - DNA, 494 bp, Heterodera glycines
  Genomic contig location: Contig_ID=SeqID_4665; Location=920..1413; Strand=-
  SCN-specific regions: Sequence locations=1-342,365-494
atgttttgtgccaatttgtggtgccgttgcttctgcttctgctgcgcagcttttctcgccatttctgatcagtgagtgatcagtgccgccgaatgagaccattggctcggcaggagatttgagagggatgcattaaaaatgcttggaaatgatcaggcaataagaacctttgtaatcgcatatgatatgagatggcaaagaacaaaaaaaaatgatgaagatttagtcaattcaatcaatttttattttttggtataaaagatgaagacggcagtgccaacagatggtgccgtagaaaatttgaaattttttgttgaaattattaatttttttttaccggtctcatttcattgtcagtctttggtattcttctgtattttcatttcttgggcaaaaattatttttttacagtatgccaagcttgcaattgaatatgcgtgatcactactgatcagaagtggcgaaaaaagctgcgcagcagaaatagaaataaa

SEQ ID NO: 55289 - DNA, 457 bp, Heterodera glycines
  Genomic contig location: Contig_ID=SeqID_4665; Location=3145..3601; Strand=+
  SCN-specific regions: Sequence locations=1-457
atgttcggcataatgtgccgtccggttctcttcatggtctgtgcctgtttcgtattgttttttgtgcacatcacccaacctgaactgttcatgcccaaccatgccccaaccgatgaaaacgaaattccaaacatcggaaaagctgaaccggatgcaattggccgctttggacatgagcacccgcgcaactcggacacggaaacggaaaagcccgcgcacggattcgatatcggtcccgaattttcacccgttttggcatttgaataactaattttttggaaaatgaaaatgaaaaggccaaggacaggattaagacgtggaaaaaatcatgaaaaaatagttaatcggcttaatatccttgttcaaggacgtcaaaaagcaaggacaggagaaaagactttggaaaaccctgactaaatagttaatcagcttcatgtccttattcaaggacgccgaa

SEQ ID NO: 55290 - DNA, 962 bp, Heterodera glycines
  Genomic contig location: Contig_ID=SeqID_24564; Location=468..1429; Strand=+
  SCN-specific regions: Sequence locations=1-502,527-709,734-759,782-962
  Gene Ontology: Mol. function=GTPase activity
gaaagagtactttggctgatcgctttctgcagttaaccaacgtgatttctaccgaatctgatgcccaatacctcgacaaacttgaggtcgagcgcgaaagagggatcaccgtaagtaaatgaacggctaatttatagaggtggccactcgaataaaaagtcaaaatcatttttcaaaattcacatttatgttcgaatctacatcgaaaacattgagagatttttttagatcaaagctcaaacttgctccatgttccataaggtaaagaaagatatgcgtatttcatttttatattttatttacatttaaggattttatgctcaatttggtgtaagttgaagactgcttgccttgccttttgtcgtctaatcagccattcattcgtatcgcggtcataatgggtttttaagcgaaccaattgggtaaatggtatcatttgattggcttatgaacaactttagaaattacaattactacctaattattagtattagcaaatcagtaaagaaaattaatgaatggaatggcagttagatgataaaaattatcggacacttttttttcacatttaagcgatactcctggccatgttgactttgggtcggttagtactttgattttcatttatttttgtttttttagcttcgaggttaaacgttctctcataacctgcgacggagcaattttgctagttgctgctaatgaagtgatgaaaataaaacattttctctaattttacaattttagggtatccaagcgcagacccttttcaattttcattcagcctttgagaataatttgagcatcattccagtcatcaataaaatagacatgaaggcaaatattgccaaagttgaggaagaattacaacaatcgtttgggtttcatgccgtcgaaatttttaaagtgtctgcaaagacgggaagaaatgtaccgaaacttttggaggcaattattcagag

SEQ ID NO: 55291 - DNA, 1230 bp, Heterodera glycines
  Genomic contig location: Contig_ID=SeqID_24565; Location=521..1750; Strand=-
  SCN-specific regions: Sequence locations=1-63,86-259,281-1230
  Gene Ontology: Mol. function=hexokinase activity; Cellular component =membrane; Biological process=cell glucose homeostasis
gcttctggcgttgttggggagaacgtcgtccacatgctgcgcgacgcgttcaagcgacgaggcgacgtggacatcgacgtggtcgcactgctcaacgacaccacggggacgatgctcgcctgctccttcattgaacaacactgctacgtcggggtcattgtcgggacgggtaagaaaactaattttttgttgattttcatttaaatcccctattttttcttttcaggctgcaatgccgcatacatggagcgactggagaatgtgccgaaactcaagggaattgtcaactccgcggaaggtagaaatgggaggtgaagggtggccgtaaaaggcactaatttttgaaacaatttcagatggtctgccggcggagatgtgcgtcaacacggaatggggaggattcggcgacgacggcgcactggaccaattcctcaccatctacgaccagcagttggaccagcagagcctcaaccccggccgacaacgcttcgagaagaccatctccggcatgtacatggtgggaaagttttcaaattgaacaacaatttatgttaaaaagaattttcagggtgagatcgtccgtcttgcgctggaggacttggcacgtcgcggcctattgttcagcggcgacttcactcgaatttctgaacgcggctgcatctccaccaagatggtgtccgacatcgaagggtaaaactgtttgttctaaaaaattgcttaatttcacttcatttgcaggtttatgcacagcaccgacgggaacccattcgccaaagtcggcgagatgctgcgtgccattggtgagttgtcatttgatcatttttagtcattcaacatcccaatatcccatttcaggcatttcgaactcatcggccgccgactgtgcaaatgtcgcctacgtcagctcgttgattggcacgcgcgccgcccatctctgtgcctgtgggcttgccgccatcctcaaccgcatgcagaggccccgcgtgacgatcggcgtcgacggctccgtgttccgcttccacccgaccttcaaattcaacctggaccagaagatcaaggcgctgttggccgtcaaatgcgaagtgagtttcaagttctaatatcatttcggaatgattaattttcccctaatttcagttcttcatggtgctcagcgaggacggaagtggacgaggcgcagcagtcgcagcagcggtcgcattgcggatgaatcgtcttgtgggagcgtga

SEQ ID NO: 55292 - DNA, 58 bp, Heterodera glycines
  Genomic contig location: Contig_ID=SeqID_24568; Location=477..534; Strand=+
  SCN-specific regions: Sequence locations=1-58
gaatttggtgctccaatatccaaatgaagctcacatcgacgagctcaaaggcatttga

SEQ ID NO: 55293 - DNA, 274 bp, Heterodera glycines
  Genomic contig location: Contig_ID=SeqID_24569; Location=192..465; Strand=+
  SCN-specific regions: Sequence locations=1-48,70-117,139-192,214-274
ctcaacgacatcggtctgtaccacgacagcgcaccgcaccggtccatgtgggagctgaagccggagtaccgcaactacagcaaacagttggccaagaatgtggagcaaaaaatgcagcaacaacagcagaaggacggatgatggcgagaaatgttcataaaatgcaatggaaaatgaatggatttttttaaatttggacgggttcatttgcacgaaaaagtgttgcctaaaatggatggaacgagggcgagaaaacagcactaaaaatatttaa

SEQ ID NO: 55294 - DNA, 645 bp, Heterodera glycines
  Genomic contig location: Contig_ID=SeqID_24569; Location=866..1510; Strand=+
  SCN-specific regions: Sequence locations=1-72,94-111,146-175,215 -248,274-645
  Gene Ontology: Mol. function=small monomeric GTPase activity; Cellular component=membrane fraction; Biological process=gastrulation
atgttttctctgttccgcggggcgtacggcgaaatgacgcgcaaagaggaatattttgtcgcactgttcggcttggacggtgcaggaaaaacggtgtttgcttaaataattatgtaaaaattccttatttttggatggcattttccacaaaaaagtgatacgtgccggccgtatttataaaaaggaatacaaatttaattaaaaaattaacaatgggccaccaaattcagcgtcgatttaaatgcctatttctaaaatctttcctaacaatttttccattggattaggcttatgttgagcgactgaaagcgcactttgaccggcactaccggtgccggaatttggccaaactgtcctccaccgtcgggctgaatcgtaagtttttacattttgccaaaatttacatgttttgtaaccgatttgccattttgttcacagatgtccgtgtccctctcgctggtgccgtgctcaatgtgtgggacctcggcggtcaggcggaactccgtcccctgtggcactcttatttggcggaatgccatgccctcatttttgtggtcgactcgtctgatgtgcagcggttgcccgaagtgtgcagcgcattgggtgggggcactgaaaaagcgaaaaaatggggggggggggggg

SEQ ID NO: 55295 - DNA, 91 bp, Heterodera glycines
  Genomic contig location: Contig_ID=SeqID_24570; Location=313..403; Strand=-
  SCN-specific regions: Sequence locations=1-91
atgacggttgtcattggtaatgccatgtgctattggttggtagggatcatcaccgtgtttttggctgtcaacgatgttaccatggtgtacg

SEQ ID NO: 55296 - DNA, 1184 bp, Heterodera glycines
  Genomic contig location: Contig_ID=SeqID_24571; Location=164..1347; Strand=+
  SCN-specific regions: Sequence locations=1-333,356-549,572-1040,1062 -1184
atgcccagcaaagagaaagtggggacaaaaagagacggacgaattgaccttttaattctgttaaaggcaatcgaataccttcgtcatatcctcgacaattcgtttcgcatccgtcgtttggacctgaacatccaagtctcaaccgaattggtggtcaatgacattttggacgttttgaatggccatggtgaggagttattttgtagcattgttaatgataaacctttattctttttagctaaagtacaacttgaagaactgttcgtccgacgtcgttatgtgggcagcaaattctccggtctcgtgccgctcattcggtcgaatgccaaaacgttgaaacaaattggcaaaattggtttgggcgaggctatcaaagcactcagtgacgaggtgagtcacttttacagtatttgtacaatcctatcccattttgtgccgtttcagatccacctcgaacgtctctcgttaatcaacttcgacctggtcgaacaagaccagcgtttggacagcgaagaattggcccaaaactcgcgcttttacattcgtcggttggctggcattggcaccacctttgaccacttgtcctacacttgtttcaccggtttcgagatcaccaaaatgccagccctcaacatgctccgtcagtgcaaggtgtgccattcaaaatcaacatttgctgtaacggcaattcttttgatgccatttgcaggtcaaaagtcttcgtctgacgatgcaaagcggcgtggccatcaaagacccggaactccctcgcccgctgttgccgatgatgcagcgaattcaattggtcggcggaatggacgcgtcgtcggagagactgtcgttgctgtttcccgccctggaggagctcgaaattgaaaagcaggacctgatcactggccaccgactggaaaagcgagcgcgcgtcctctccaattacgcgcccgactttgtcggtgacgcatataattctgtcgcggccgcttgctgaaccatcggtggacgacgtaaagccatggaagacggagaagcgagcacattcctttcttttgacatttctttgtcagtatcgttccattgatcttattcattcgttacattatatgctcatttaactgtaaaatcaggacatgatcttcaccatccgtttgatatgtatgttttttaaatcattttccttttgacaa

SEQ ID NO: 55297 - DNA, 897 bp, Heterodera glycines
  Genomic contig location: Contig_ID=SeqID_24572; Location=144..1040; Strand=-
  SCN-specific regions: Sequence locations=1-239,290-577,601-621,643 -724,757-855,878-897
  Gene Ontology: Mol. function=general RNA polymerase II transcription factor activity; Cellular component=nucleus; Biological process=anti- apoptosis
gatacatctgtgagcaattggatggaaccgttagtcaaccggatcgtcagaaagccattcaaaactttcaacggcctgattcggacgtgttcgcttttcttctgacaaccaaagcgggtggtcttggtctgaatttaaccgccgcagacactgctatttttctcgattgggacttcaatccgcagaacgacaaacaagcggctgcacgatgccaccgcatcgggcaggacaagtgggtcttatatttatttttttttatttatacaaaaaataaataaatttttttaatcaaaaatgtttgactttttttttctcaaaactctgtaacaaaacctttagattccctcataaagaacaaaaattcttcggatcccttctccatttttcgatttagacctgttaaaatcattcgtctcgtggcaaaacatacggtggaggagctgataaagcagagagccgcaaagaagctgaagctgtccgagaatgtcttgggaaccgacgaaaaggaaggttttcgagtatttcttgttcctaggtttttttttcaaaatattttcaggcccttcactaatgtttgacctgtccaaactgttgctagaggggctcaccgacctggagaaagagcagaagaagcacacacagtttcacattctgaccgacaaacagcttgaagagcggttgggtcgaaccgaccaaaacggacattggcaaataaaggttggccatattttatttatttattttttgataattttactttttgacagggcgacgacaaagaaaacattgaggatgagcaaatagaagatgaagcggagggaagaacgctgtacatgttcgaggggtatgactacagtgaacagcgagcagctgctgagaaagcgggcattgccttgg

SEQ ID NO: 55298 - DNA, 911 bp, Heterodera glycines
  Genomic contig location: Contig_ID=SeqID_24573; Location=1446..2356; Strand=+
  SCN-specific regions: Sequence locations=1-424,446-450,479-911
atgcaaaaagtaagaaaaataaaaactaactttcttaaagaaatataaaatgttcgggttttgtaattaacggttggggaggaaccctaacttaaagtctttttaaatttgttaggaaacgattgtcacggtttcggtaatgagattttcgtccatataacttttaattctattttgaattattaaaatcgtgcttaaatccatagaatttcaatttttaaatattctattctattcaattgggaggaaaacgagaaattttcagtttttttcagccctttactagacataaaaccaccggagaaaaccctgctctgaatatatatatatattggagaggcaaccaaaattcttttagaggcagacaatttggaggatacgtgcaaaggaatccaaattttattccattgggacaaaatcggacttggaatgggaattttggaaataatacggggagatttgagaatttccgacctcaaaggggaaattttgggaatttccgagggaattcaagaggaagaggaagtgaaaggcaaaaatacaaaataaatgccatttcggatgaggcggctcagccttcggtatccaactcccgaaggtccctgaccccgacaatgacatttttgacaatttcaatgattctgtgctcatttttcgggactatttctggtcaataccaattatgttctgatcgagttcccaccacacccatttggttaccaaacgtaacagaatgttcagtaccggagtaccaaaaagctgacgagagaaaagttacactttttttagctgttcgaatgccaaagcaattcccagtttataactgctatcagaaaatgatgaaaatttgtacgggaaattttctttttttctggaaagacataaaaagtcaggattcgtacgtgaaggga

SEQ ID NO: 55299 - DNA, 3714 bp, Heterodera glycines
  Genomic contig location: Contig_ID=SeqID_524; Location=235..3948; Strand=-
  SCN-specific regions: Sequence locations=1-260,282-567,599-1426,1448 -1622,1644-1663,1685-2267,2289-2318,2359-2790,2812-3202,3224-3714
  Gene Ontology: Mol. function=helicase activity; Cellular component =cytoplasm; Biological process=mRNA catabolism, nonsense-mediated
ctaatgcccaaaaaccaaaagtcaaaacgtttctccaaaaagtcttcgtctgcgtcggcagcattgtcaagtccaccagcattgttggacatctctgctctaccaaacccggtctatgaagacatctcatcaccggaaggatcggtcattactggcgccgtggtagccaatacaattgtgtcaacaattgagccaaacttggacaacgcagttctgacaacgctttcgccggaagatgttgatcggatcttcgctgatgatcccgggatggcagaggaggttggccgaactgatcgagtatctgaaattggtccacagattaagagtatgttggataattcggccttcgggccatctgtcatgaatgagacccgtgcactcggcacgaatgagagcacttttgaagagattgcggtgagtagcggggctcttgaaaccatgggagcaatgatcagcgttctatccgtacagggagaggaggagagattgattgaaagagcaattgaagtgattgaagagacgcagaaaatgaaaggatcatttgggcaaatgatcatgaaagagatggaaaatgagggagagaagggtgaagaggaagcaaatagggacctcggtccgtctgtcatggatgttgtcgagattgaacggagccagggagttaattatgtgttggaagtggaccaagatggaattgaagtgtttaaggagaaaaaccccttaggcaagagacgccgaaatctgagtgaagacgaaaacggtaaagatatggaaaatgagggggatgacggaggaagtggacggaaaatggttatttgtcaaataacggacaaaatggccattgccattcggtttggcggaaaaatgaagggtccggatattatcggaattcctgagtcgttcgagttgggtgtacagctcagacttggtgacattgtgtttgtcacaagttatgccccaatcgagcgctttcccgattggctttctaatgcctttaagatcaatgccgaagccgaggccatgacagtctcatccgttcttcaaaattccttggaaaagtgcatagggattgtaatgagcatggtgagagaaaataaggatgtgccaagagcggtggacgtggccttccccgagagtcaagttctccagcgactgtatcaacaccagttggacagcacaattgacttggccaaaattaagcctggagtgcttataaatgtcacgttcgtgcgcatccatcgcccttccgacattgccattggccctaagggcatttacatcacaccagccgattttgagggagtttctgaaagggaattggttgttcaccaaccatgcattggcacggggattagcggttttgttaatggttatgagttccccttttcgacaagcactgatttgaagctatgtgagcatggaattgcggcagctgtgtccggagcactgctaaaagcaaaagcagagatggaggagttcaccattcatacggcgttgttcgtcttggaaagcggaaaagacaatattgtggtgacttttgaacattttgtacaggaaaaacgtaagtttgtgaatttgaccaaaatttgggaaatcgatgcagcggttacagccaaactaaaaggggccaaaaagccttgtgctgttggacgcattttggacgtccacaaatgtgttgtacaagaaatgtttgtactacaggcaaaggttcttctcatgtttcaattggctcggaaatacgatgccgagggcgactttgagcgcttagcggaaggccatgaggcgtcaataactcctagtgaatcctttcaggctttggagttgagagttgagcgtttttatggccacatgttcagctgcatgtcgagcgggtctgatgggaccagccgcatttggaaaatccttctggcacagaacaatgttgaaaatgaagacacctcttcggaagttttggcacgaattgagaggcaccccgccttgcggaagctggaaggtggccaaatacgcacggccgaactaatgctcgacaatgttccgagagtcgtggcacagcaagcgccgcctggctcagggaagacatatacattggctgcgattgttgctgccttaatgagcaacccaaaaaacaaaattctatgcttagcaccgcttaacgtagcggttgtcaaaatgtgcgaagaattggtcggggccttacaaaccgaaggatgtgatgaagttcctttggcgttattttcgggaaatggcaaaggaaaatacagggattatttagacaaaattgcagggaatttgttggaatcagtggtcacttcggaagatttctggaaaaaactcgaacagaaggagaaaagggaagtacacagatatttgcgggatgtgaggaaacgcccgcggattgccaaggaggcgctgatcgcggaatacgtgctgaacttggaccggaggcgagttctgtgctgcactttgggatttgctgaacagattggccggctgatttgtgaacggaacatcgtggtgttggacgaggctggtcagggaccattcgtgcaagtctgctcaactttgtcggctctctgtgagataaaaaaggttttggtaaccggggaccggtaccaattggcggtcaacatgcaaagcgttcccgagccggttagggtaggatttgggtttgacacagttctgataaatttggacaaggctaaagcggtggataggacaacactgctgacaaattaccgttctcattggcagattgtggcctgtgttgagcacatggcgtacaaaccccacggggaacgccttcagcctgggccgggttctttcaggatgctaatcgatttttggaaaatgccggtggcggaatcccctcttttattgatccaccaggaatcactaatggaaccggaactgacgagcttttcggcaacaaacagcggacaaactcgaacagtactggacctcttggccttgttggacggattccccggcagcatccgcataatttccttttatgctgggcaagctgcgcagattggcactgagctgaaagagcaagggtttagtcggtccattgtctctgccactgcagacgcaatgcaggggcacgaggccgatatcaccatcgtcacgacgacagtcaccaagcagcaacagttcagcaattggcaacgggccaatttttcaaaggatcgtaagagtgaattttggggtgatgcccaaagggtgaatgttgccctttcccgtggaaaacatggactaattgtaataggcgactttcttgaattgggaggcagcccaatttggtccagatttctgaataaggccattgagtttacggtggtaacttccccgtctgttgttaagtccatcaaaagcccgagttcgagctacgtccgtggacttttagtcgatgattctggtgaatcagtccaaaactatcgttttcatgctgattggttggcacccggtcgttcgtcttcaaccgcggctgttctgtctcgaaatgggaggccattgaacaatttaaatcgaccaaataatctcaatttccaaaattctcctatcaaccaatccagggacatctccaatccgccacttccttctcgtcatgttcagcgcgaattttcacgaactcgtgcggaaattcgatgttggcgttgtaaccagccgggccatgtctccactcgttgcaccaatccaccagcacggcagaactga

SEQ ID NO: 55300 - DNA, 3180 bp, Heterodera glycines
  Genomic contig location: Contig_ID=SeqID_525; Location=1232..4411; Strand=-
  SCN-specific regions: Sequence locations=1-354,376-407,430-602,644 -1676,1699-2121,2147-2412,2435-2994,3018-3180
atgacggcattcttagcgaagctccggattgacgcgagtatagtccccttgaaaaatgaaaaatccgaagttgacccttcatttaatattgatttttctaaatccgttgccgaagggaaagacttagattctttaaaaaagctagttgaagagttctcggatatttttagcaaaagtcagtatgatttaggatcttttacaggaggagaacaccattttgtcacaacaacaggtacgccaatctcttcagcaccaagacgaatgccttacaaatacagtgatgagctcaagaaacacatttcgaagctgttagcagctggtgtcatgattgagtcggatacaccatgggtcacaccatttgtggtggtacagaaaaaggatggtggaatcagaccatgcttagactttaggaaactgaatgatgtcatggttcccgatagatatcccctcccacgccttgatgcaatcatggaaaaaatagggaattgcaatttttattcttcattggacctctccagtggctatttccaaataaaattgtcagatgaatcgtcatggaaatgtggtgtcattacggaagattgtgtctaccaaatgttatacatgccatttggtttaaaaaatgccacagcagctttctccagggcaatgactaccgttttattgggattagaagactgtgctctatcttatgttgatgacgtgttagtattcacaaaggatggcactctaaaagatcacctgagttcgctaagaaaagtttttgagcgttttagactttacaatctaaaacttagtccaaaaaagtgtaattttatcgcaaaagaaatgcaatttttgggctttactctttcagctggcggttatagaccaaccatgagcagaatagagctcataaaagacatgccaattcctggaaatgtcaaagaagttaaacgcttcctgggaaaagcaggtttttaccgtagacatatcaagaattttgctacgatagctgaaccccttttgagcctttcgaggcaatctgtcaagtttgaatggaaggaggagcaacaaaaagcttttgaaatgcttaagaaattcatttccgagtctccaaacctaatttttccaaattattccaagccttttcacatctttacggacgcctcagggtctggacttggcggtgtattaatgcaaaaaaatgaagaaataggcactttctcggctatctcttactgtagccgaacattatcggcatctgaaaggcgatggccgacggtacaaattgaaatgtgtgcaattatttacgcactgagagaatttagaccatttatttttatgagtgacattgaactgcatactgatcacaagcctttggcctatttactcaaaaaagcggaaacccatccccatttagctcggtggctcgttgaactccaaaattatcagattaaaattgtccatgtggcaggtcggcaaaacacactggcagatgccttgtcacgtgcttctgaggatgtgccaattaaggaggttgatggtttgccagagatggaagacatagtccaatttccaatatgtttttcggttcagtcaagatctcatatagtttttgcaccgtttgttaatacgataaccctgaggcatgaggatgggaatagctatcagatagatttggccgaagaacagaggaatgaccctgaaattttggcatacattgattttctgaaaaatggatcatttccggctgatttctcggaaagcgaaaaggaccaactttcaattttggcatgtaatttattgctaaattccggagttttatactttaaaattggaagtaatgtcccgcgaatttttgtccctgtgtcattacggtcacttatttttgaatccttccacagttccccattaggaggagggcacatgagtattaaaaaaacattaaaaaagtgtaaaaagtatttttggccgaggatgcattcagatattgttctctgggtgcaacaatgcataacatgccaactccgacataaccccactccagcttatcgtgctgaaatgcaagtggttcctgttaatactctctttgccaaagttggattagatttggccggaccattccccacaactgttaagggaaataaatatttgttaaatataatttgctggtttactaaatacgtaatttcggtcccactacctgatgctaaaggccgaaccatagctgatgcctttctaaagaactgttacttaaaatatgggggttgtactgaactgattagtgataacgcaacggcatttacttccgaattttttagagaattttgtacaatgttatacataaataagacatatgcgaccccgtattggtcccaagggaatgctattactgaaaggacttttcgtacatatcacaacattttgtctaaatatatcaccaaggaaaacccagattttgacgagtacattgaatttgcctcattctgttataatacgtcgtgccattcatccaccaaagagacccctttctttttaatgtttggtcgggaccccattttctgtgttgatcaaattttggacgttcgcgttcacagtcaagttgatttcaaagatgatggcgaatttactcacaaattagttacgactttaagaaaagcatggaaatgtgcggcggaggcaattgaagaagcacagaataagatgaaaacacaatatgacaaaacaatgcgacagcccaaaatcagcgttggcgatagggttttacttagaaactatgccggaaaagttggcacttccaaaaaatttcaccttccttggaagggaattttcagggtagttgagctgaatggtgtccatgctaccataataagctgcatttcaccgaaccagccaccaaaaaaagtacacgtcaatcaaataaaaaagtgctttgagctaatgggccccccatgcacatcgccaaaaactcctaatgacgagcaaatagtgccggaaaaattagcagttgatgatgaggaagaagtgcagagcaatgaaccgtcagaagctgataattcgaaccaagaaagcagtgaatcgaccgttacaaacagacaaaatgtgaccaaccaaacagttgcagatattagtggtgacaaaagatattctctgagaaatcgattggctataacaaaaccaaaacggttcactgaatga

SEQ ID NO: 55301 - DNA, 1791 bp, Heterodera glycines
  Genomic contig location: Contig_ID=SeqID_526; Location=5..1795; Strand=-
  SCN-specific regions: Sequence locations=1-32,56-147,170-348,370 -1193,1215-1478,1504-1791
atggatgatggaatgaatatctcggttattgataaaaatttttgggctgggaaaacttcagtcagagttcctgatatggaacgtgctcaagtcgaattgaaaaactttgaagaggctgttaacaggtgcctacgaaatattaaccgacgggcatgtgccaacaccaaagccttaaatgacatggccaaccaagtcaattcaaacctgtcagtattgcaaacgcagcttaactcattaaccgatatcaaccctacggcaaggaattcattggctttcacaaccccacgcgagcgcagtacgagtcggaatccacagcacgggacaagtaacaactcaagcaattcaagtgaagacggagatgagccagagttaggggcattgaacacgttgactggtgtaagtggacagttagaggtatttggtgatgaatcagttgtcgcgtttgatcaatggtcggaaagattcagtgattatgttggggctttgggaaggaattggactgaggatgaaaaagtcgctcgcctcaaaatgtcactcgttggcacacctcgccaactcttcaaacaattaagccaaaatgagactgcaaagttggacaccgcgataactgcccttcgacgtaaaatggattcaccccaaagacgtgaattaaccaaaaggacgctggcacaatgtaaacaacgcgaaaatgagaccatttcagaattcattaagcgtttgacaccgttagttgaaatagtcaattcgtccttaaatgattcccagaggaaggagaaaatttgcgaagaatttttggacagaattaggtctgacattggtttcttaatccgcttagtagggctaaattctgcaaaggatttagaccaggtcaaggcgcaggctgaagaattagaagcacttttggcagcggaaaagggaacaatttctgacacattgaggggtacggtaatggcattaaataatcaaaggcaagtccatactgatcagaggcctgatcagtctcccccacatcgattttctcgtgcaaacacaaccccattgggaaatcgacactcgtcaagagggtattcgaacggcagaggccgtggcggttacagaaataggacaccaagccgtaaccgatggtcaagctatcatcaacagatgcagagccaaagaagatggagcaacagacccgtttgtcactattgcggccgaactggtcatattgcttcattttgccgcaccagacaagaagaaatggcgcaccgtttcagccgtcccaatcataatttcagaaataatggagctcgatttgatgaccaacggagaacgaattcatcgcaggagcagctgagaaatgttactgttttggattctgatgcacttattcgagccatagctaatttgagtgtgaatgaatcacggccctcgggcgttactgtcaagaacgaaggagcgggtactctcaaaaccctggctgtggtagaaaccccgaaaaagacagaggaaccaaaatcagatccaaaccctgtacctgggacaagcagtgatagcttagttcccatcagaattcgaagttgggaaggaattgctcccaaaatttctaaattctccaaattcacaatgattatggtgatgttactgacgatggttattccaaacatgtgtcaaattaatttggctattcctatgccgaaaggtccaatgatgtgccaaacacaacttgtgggccatttatgggctcttccgtcctttctccctgtccaaccctcaggcctgactctattacggcaccagtcagaggtttaa

SEQ ID NO: 55302 - DNA, 589 bp, Heterodera glycines
  Genomic contig location: Contig_ID=SeqID_526; Location=3597..4185; Strand=+
  SCN-specific regions: Sequence locations=24-183,215-466,508-589
atgggaaaaagggggaagaaaaatcgcaaaatgcgaggaggtaaggggggggggggggaaatgtgtgcaaagcaattggggacaaaaaggtgataatgtacttatttaataactattttggttttttatttcgcaatttttcgtacataaatttcccagcctcagtgatgatgttgcaaatggaataataattttaagtaattattttttaattctaaagccgagacaattagacggaatttaaatgcgtagaattatgcagaggagtcgaaattgggcctggaatttattggcttaattttaatttgaagacgcaacaacaaaatttttcggccgatcaattggacaaattggaacgcaaatttgccataacgaaagtcgcaaatgcttctgagtgtgcacaattggccgtggaaactgggcttacggagaaacaagttgaagtagggtttaataaggaaaaatctataatttaaaataataataataattattaaattaattttaggaatggtttgacagtcggcgcctttcactgtggcaagcattcataacgaaattcgtatgtgtaaattgcagaattttggaa

SEQ ID NO: 55303 - DNA, 2718 bp, Heterodera glycines
  Genomic contig location: Contig_ID=SeqID_4668; Location=486..3203; Strand=-
  SCN-specific regions: Sequence locations=1-493,517-2718
atgcatcgcgaagtccgcgaactaatgcatatgcaactgcacagatgcagtgatagttggtgtggtccacgtgaccccaactttgggcggtgtaaaaagggcttcccagccccgtactcgaaatgtacgatactacacccggacaggcccgcattgtattaccggcctagcccaaccgacggtggtgcccaaattgaggtgaacggcttaatatacgacaactcgcaagtcgtgccgtacaacccatacattttgctgcgttaccgagtacaccacaacgtgttattcgcatacggtaacaaagcgaacatcaaatatgcactcaaataccctttcaaagggcctggacattgttatgtcgagtgcaaagaggagtccggcagcaaaatcggtatcgatgagccggctcaatatgccaaaatgaacttccgtggtgctacggaagcttttgcagttgtgcattcaatgccatttgcaaaactctcgcaccaggttgttcatttgtccattcatttgccaaaccagcagcccgttgtatacagggcattccaacaggtgagcaaagctgaggaaattcagcgaggcgagctcccagagacgccatgctctgcctattggaagcaatggcaaaacgaatggcagcatgttccatcgctcaaggacatgctttttgaaaaagtcccagagcaatttcgatgggcaaaagaccgatggcttccgtataaaaggaagcctgccaagaggcccccaatcggtcgtgttgtacctgtccctccaacggaccgggaaagatttgcactttatgcgttgatgcgtcactttcccggtgatccggaccacttgaaactggtcaatggacagcagtacaacacctttacagaggccgctctacagcatgggcttcttgaagatgaccaaatttggcacaaaacgctcggcgaggcagccttgcatcgctggccggaccagatgagatggctcttcgtgagcatccttgtctttgggcagccgagcaatgccatagaactgtgggacaagtataaagaccaaatgtacaacccacagggcatcaccagtgcggctatacgccaagcacgcgagctgcaagccttagccgacattgattggcggttgcactactttaacttaagctgtgtgcactgtggcctgccagatccaccaaattcaaaagctaaaaataccaatttggcagttgaagaatttttctttggtgatgatggtctgaatatgccgcctggccagccaaatcaaaggccacaacaaaacaccccacctcccctcaataacgaccagcaaaaggtctttgatgctgttgtgagggcaatacagtcggacccgaaggaccagactgtgccgcgccgtttcttcattttcggcgatggaggtacaggaaaaacattcctgtttggtcaaattatcaaacgcttgcgaaagcccccatacacctataaagtgctggctacggcatccactgggtgtgcggctatcttgctgccatatgggaaaacagcccattccacgttccgtctcggcagagaagtctcgctagacaagcttccaagcattccgcttgaaagcttctttgctcgacggatacgtgaggcccagctcatcatcattgatgagatcaccatgcttcacaacacggtgatagaggtcatcgaccgagtgtgcaaagaaatggcaattccccagcacaaggacctcctcttcggaggaaaaacggtcatattcagcggtgactttaaacagtcactaccggttgtgcctcacgaaggcctaactgcacaaattacggcctgttttcaaacctctccactgttttgtcaattcacgactatgaaattgacaataaaccagaggttgggccaagggcagcaagcgtacttgcaaatgtgccgccaaatcggcctcggagagaccggagaacacttctggattcctccgcagttcctcgtaaagagcagggaagagttgatagactttgtctatcccgacttccaaagactccttggaaatgacaaggaactgctcaatcgtctgatcctcgcacctcacattgacacgtgcgatgagatcaacgaaattatgatggcgaacgtgcctggtcaagtgcgcgaatatttgtcctcggacaaaccgcttgacgagcggccactggacatcgatgaaatcgagttagaagtggcagcgttgaaccgacgcacagactctgggatgcctccccaccgtctgcgactaaaggtcggaagcgtcgttgtcctccttattaacaaaagcgataaggaaggactgatcaacggcactcgcatcgttcttgaagaacttggcgacgatcgtctggtcggtcgcgtcattaacagcaacgctgttggtggccaagttaagttcttcatcgaaagaacacgcaatgtctacgaggacaaaacgcctggcggcttaaaatatgagcgtttgcagtttcccatcaaacctgccttcgccatgaccattctcaaaggtcaaggtcaaacaatcagcacggtcggaattgaccttgaaagggacgtgttttctcatggtcaattgtacactgccttttcaagggcaacggactggaacaacgtccgagtgtacgctcccagaagggagaccgatgcacaagacagagtcaaagtgctgaatattgttgcaacgaaaatgctcaatttgcaataa

SEQ ID NO: 55304 - DNA, 1450 bp, Heterodera glycines
  Genomic contig location: Contig_ID=SeqID_4669; Location=94..1543; Strand=-
  SCN-specific regions: Sequence locations=1-441,463-1450
atgccttcaaaacaaaaaaatcaaaggaagaagaaacaagagcggtaccgagggcagatggagctatctgttagcccagatcgctcacccgtcccagacggaagtgcagatgagaatggggtggcatcacacccgggcaacaccacgcccaatattggtgctttgcaattaagcaccccggtctcttccattggaagtaaaagacggagtatacatccgaaaaccggagcggagccattcatggcatcgcaacacagtgcttcatctgctgatatacaaagcacatcggccactcaaaatgatgagtcatcgcctcgcaataaaaaagggaagatcgacaattttgatcgacccatgtctgctcttgaggcaattgctttgacgccggtttccacgcaaatgaaccgtggagggcgaccatccaaaaaaagaggcggccatgcaggctcaggcaggagcaaagctaatgattccatgagcgagagctcgtcaatggatctgagctctgaagctaccacatcggtggcccttttgccaaatgtgcctgaaaagataaatttcagcacagtggcaattaatttcgccacatcgcgaaatatggcctgcaaaatccggagatgggccgatgttggcctttacgagcgtgatggcgaaacatcacaaggcccacgatctggcccaagattcattgagacctgttggaatgatctgacacagtttctcaatgatgcctttgttgtcgagtatttggcatacttggcaagtatatcacaacgaaaagtggtcgttgttgatccagttgtgtggcaaatgggcatagaccgggtcatgcaatataaaaaaatgacatttgggtatgaccctaatgttccggcagaagtcatacttttgccagtacatttccctggacactggactctaattatccatgatgtgcaatttggcactcattttgccgattctttgcctaccccatatggcaggttggatccgcaactgacggataaaattagaaagattatttctgacattttgccgtcaacagttttaaccgggatttttaatgccgtaaatctgacggttcaacacgatggaaatagttgcgggtacttcgtgtgcctgtatgctgaatcatggctcatgaacaatcgcacgtttgttctgccagatttgtccatcaattatgaaaagcggcgcatattgtggcacattaacgagctttatggcacagacaatgtgccatatcatccgagggaaggggtaccaactccttgcccaattgtctatcgacatgcggatgaggtgcagtcgacatccaaggccgctgagccaatgaaaatcgatgagcatgatgacataatgattatcgaaccacagacgagtggacaagcagttaatactgttctcacccaggcccaagtggctggtgaaaaccaagttgacacgcttg

SEQ ID NO: 55305 - DNA, 1474 bp, Heterodera glycines
  Genomic contig location: Contig_ID=SeqID_24577; Location=1..1474; Strand=+
  SCN-specific regions: Sequence locations=1-6,31-72,95-1474
  Gene Ontology: Mol. function=ubiquitin conjugating enzyme activity; Biological process=anti-apoptosis
ccgcacttctgctggagaaatgcctgcccatttgctggacgaggcggtcgctcgacagatcagcgcgtcggcagtgtttccactgatcaacgcccatttgagtgagttggccaaattaaggcatcgatcactgatcggttgcctgggaataattttgtgatctttaaaatgccgtcgctctcttaggcaatgattcggtgttggacgtctcccaacacatgccctttttccaaattctgttggaattgtgcgccgcgttggcttccgtcccggcactgctcccaaagattgttttgccgcaagacgcacacggaaaatcaatcgcgaaacagctgatcccgcagtttcggaacaacctgaacaattaccccacactgatgagtggaatcagcgaagctgacttatcattcatggactttattcgcaaagtcaacgattattcggaggttggggaagacaaaaaaatgatttccaatttaaattttaacttttcaggtcatcattcgtttggcacggcaatttgaacgtcaaattccagcggaaaagcgcgtcaaaacgtcccattcccatcgctatttcacccgcattggcgccgaccgcgtgcgacgactgcgtaacgcgtcggcgactgtgccatcgtcgacgggtccgagttcggcggttggcagtgccattgcgtcaccgcaagccgacggcttcggctcgcagttgtcgtctccttcagcccaatcgctggtctttttcggcaacttcgacgtctccgcgactgtctctgtcgtagcgcgacagcgaagcgtcgcaactgcaacgcaaagacaacggacagccgcggcacggcgattgagcacgcaacaattggcggaattggacggacagtcgccgagcgagcagtacagggaggtgctcagagagttgcagatgagcacatacaggtgtgggcaagcctaaagggtgcattcatgcttattggatcgtgaaatggctttaggttgctcaacgatgccgggaagctggtccacgggttcagcttcaaacgcgaactccgctccgtgaaccccttctccagctcaaacaaagacaggaccaaacggatcgcaaagtgagttttccggcgagtggggcagagcatcggcgtgtgatcgctcactgactgatcgctgatttctgatcaccgctgggattgcctctgggttctactctgatcactcccccccccctctcccctcagggaactcgcttccatgcacaattcgctccctttgaatgcttccaatgcgattttcgtctgtatggacgagacacgatgtgacattctcaaggtgagcatggtgtgctgatcagttgacaattgaccaacccttttcttccctttggccaggttttggtcaccggtcccgacgacactccgtacgaaaacggactcttcgaattcgacgtgtttttcccgtccaattacccgcaacagccaccgaag

SEQ ID NO: 55306 - DNA, 395 bp, Heterodera glycines
  Genomic contig location: Contig_ID=SeqID_24578; Location=890..1284; Strand=-
  SCN-specific regions: Sequence locations=1-188,212-395
atgcgttggcgtccggacaccgagtacatggtcggcttggcaaattaccagggcatgagtatggtcaagatgaacttctttctcgattgggtcgtcggcgacaaaaagtgagtttttttggtgcaaattttggatctttttttcccagcgcaaaccaaaaaataaactgaattttgaaaaatttccgcaaaaatcttactttttaaatgaaattttcaaaaaaaatttaccgttatttcagcttcatcggtcagggaccagcccccccccccatccctttttcatctccatcttttaatgtagcgtgctaaataagctgtttgggtcggggcctattcactgctttccttcaacaatatttccaaagtggagacaattcactcagcaacaataaa

SEQ ID NO: 55307 - DNA, 371 bp, Heterodera glycines
  Genomic contig location: Contig_ID=SeqID_24579; Location=19..389; Strand=-
  SCN-specific regions: Sequence locations=1-371
atggatttaattctcgccactgattggatgaataacgcttacccggaaatggaacaggacaaggctaacatgtcaccaaaggaagaccctagttggattagtctcattgatgaagaggaaaagcgggagcctataagtggccttgcaatttatataacatattcattaacaaagctgaaaatattttcgaaattatagatgttaaatgtcgtaacaataatttcaattaagaatccttaaccggtatgctcgtcctttcctttttaaccgtggttaaggtaaccgtggtttaatctttcttaagaaatcttaaccacaactcgagttgtggttaacgtaaatttatttagtaatttaaatagtaaaataaa

SEQ ID NO: 55308 - DNA, 312 bp, Heterodera glycines
  Genomic contig location: Contig_ID=SeqID_24579; Location=452..763; Strand=+
  SCN-specific regions: Sequence locations=1-38,62-74,96-261,283-312
atggaggaaacttttgatcatacggatgtacagtttcgtcatccattcacaatgattgtgtcaggaagtacgcgaagtggaaagtcggaatggataatgagattattacgtaacttgaacaaaattatttcagtaccaattgagcgtgtattgtattgttacggggagctgaatccgaatattttaaatttacaacgcaatgggagaattgacaatataacagtcactgttcacaatggagttcctactgaatactacattaaaggaaatgccaaaaaggaaaaattgttgttggtgttggacgatttattg

SEQ ID NO: 55309 - DNA, 457 bp, Heterodera glycines
  Genomic contig location: Contig_ID=SeqID_24581; Location=521..977; Strand=+
  SCN-specific regions: Sequence locations=1-457
atggtaaagcacgttttattggagtatgacactgtggtttggcttgacacttcagtggttttccataaaaatgatttcaaacgattttttgaaccgatgcaaaacggcaaaattggcacggtgcaaatcccaagctgtgagtgaaaagaatggaccttttaaaattaatgagtgaattataaactaattatcattttttagttgctctccacacaatgaatatgtcaactcatcctggtaaaacaaaaaacattttcaatggccttactttgtaattcaccgcatattcccaggaatgtacgaatatttgccaatgtacaccaattttgagccgaacagaacatacgaactgattggaacttataagcccatcatcaaaaccgaccccccacagttcgagacaaactttgtgattatgcacaaatccgagcaaacgcggcaagtgatgaaatggtaa

SEQ ID NO: 55310 - DNA, 450 bp, Heterodera glycines
  Genomic contig location: Contig_ID=SeqID_24581; Location=1..450; Strand=+
  SCN-specific regions: Sequence locations=1-40,289-342,364-450
tgcttatgatttggaaacggtgacaaaaaacaaagaaccgttaaaaaaatgtttaattttactgtaatttaaattatttttaaaataaaatattttaatattaaagaaaatatttaatttaaaaatttaagaataaaaaattgtttttttattgtaatccaactaaaattatttatattaaaaaataaatttaattcattaaatgaatggataaaaaaattttaatgtaaaattaagaatttattcaaaaataatttttaaattaaattaattcatttaataataaatcagctagttcaaacttcgtgaaatttttgtacttaaatccgttttctaataatcttttttcctttatttctgaagatgaatgaattggattcggtgtgcaatttcgaatggcgaattttcgatttcagtcaaatggtggaaggacgggttcgccaccttaaa

SEQ ID NO: 55311 - DNA, 53 bp, Heterodera glycines
  Genomic contig location: Contig_ID=SeqID_24581; Location=1234..1286; Strand=+
  SCN-specific regions: Sequence locations=1-53
atggctttgctttgtgccgccgagcccgactgtatggtgccaattggacagac

SEQ ID NO: 55312 - DNA, 658 bp, Heterodera glycines
  Genomic contig location: Contig_ID=SeqID_24584; Location=71..728; Strand=+
  SCN-specific regions: Sequence locations=1-181,212-628,650-658
  Gene Ontology: Mol. function=chloride channel activity; Cellular component=integral to membrane; Biological process=transport
atggctggtttggccgtttccctcgtgcgcaccttcgccccgtacgcttgtgggtcgggaattcccgagatcaaatgcattctgtccggatttgtcatccgcggatacctcggcaaatggacctttgtcatcaaatccgttggtcttatcctggcctctgcttccggtgcgtgttcattggtggaggatttatttattttttgcttctttgagacttaccagataaattcataaaacattgatcaaagcaattcaaattcagggctcagtcttggtaaggaggggcccatggtgcatttggcctgctgtatcggcaacattttctcctatcttttcccaaaatatgggctaaatgaggcgaaaaagcgcgaaattctgagcgcttccgctgccgccggtgtttctgttgcatttggcgcgccaatcggaggagtgatgttcaggtgatgatttcggtttaacaggcttatttattaaaaaaaccaaaacctactcattctctttgaccaatggttttttttagtctggaggaggcgagttattattttccgctcaaaacgatgtggcgctcgtttttctgcgctttggtcgccggtgttatccttcgttttgtcaacccgttcggaagtgatcaggtgaatgttttcttggaaagcaa

SEQ ID NO: 55313 - DNA, 603 bp, Heterodera glycines
  Genomic contig location: Contig_ID=SeqID_24584; Location=410..1012; Strand=-
  SCN-specific regions: Sequence locations=1-25,59-82,107-200,223 -257,279-293,315-603
  Gene Ontology: Mol. function=chloride channel activity; Cellular component=integral to plasma membrane; Biological process=transport
ccctaatccaatttattttgactaaatttttccaaaaacataaaattatcattttttggacaaaagctgttaaaacgcacttaaattttcaaaaaattttccccggctgcagctcagagcaaaaaaaaaaaaaaaaattagcctaccaaatgaacaaactgccaagaacaccgccgaaaatgcccaacattgcgaacggaatcagttccatgaatgtccaacgcatggaatagtccacgtgaaacagcgaagtctataaaagaagaaaatacactattttttatttgctttccaagaaaacattcacctgatcacttccgaacgggttgacaaaacgaaggataacaccggcgaccaaagcgcagaaaaacgagcgccacatcgttttgagcggaaaataataactcgcctcctccagactaaaaaaaaccattggtcaaagagaatgagtaggttttggtttttttaataaataagcctgttaaaccgaaatcatcacctgaacatcactcctccgattggcgcgccaaatgcaacagaaacaccggcggcagcggaagcgctcagaatttcgcgctttttcgcctcatttagcccatattt

SEQ ID NO: 55314 - DNA, 537 bp, Heterodera glycines
  Genomic contig location: Contig_ID=SeqID_4670; Location=227..763; Strand=+
  SCN-specific regions: Sequence locations=1-280,302-378,400-537
atgtacggcatagtggtaagcggcaaacgcttgccccgccgcgacgcgtacggaactgtcggagtcggacagacaaatgcgaatggagccgatgaaggaggaggcgtggttctccacgatttccctgaaacgaacgcattaactgacaacgaacgaaatgggaaaatggaaattgtcaaattgcgaattcagtcattgtcagcggtggacatttccgatgatttcgatcagtgcgagtgcaacaccacgccggtcgttgacgccgccttgtctcagcctgtcttccagcaaaggcaaaacaatttccagaattcgctcgcccattttcttgacaagttcggacaaacatcggacggccatctaacaaaaaatgtgaatgaaaagcatttagaataccaaaattggacacacgcacttgctgacgatcgacgactgcacttgacagacagtgaagcatcagctcaaacattggcttcatcatgtcgcgaagagtgcgcggtgtattggcaacaattacctgtttaatggaaaagtgaa

SEQ ID NO: 55315 - DNA, 534 bp, Heterodera glycines
  Genomic contig location: Contig_ID=SeqID_4670; Location=1080..1613; Strand=+
  SCN-specific regions: Sequence locations=1-340,362-444,469-534
  Gene Ontology: Mol. function=translation factor activity, nucleic acid binding; Cellular component=ribosome; Biological process =regulation of translation
ccatcgtgtcgtcttctcccgtcgtttctgaggtcattttgccactaacccctgaaaaccaaatttacgaattaaatttccattatcaaaagacctgacacaaagaacagaaaatcgccgagcaatttgaccgatgcttgccgaatccgccagttctcgtggatcagcgcggattggagctgtgggatcagcaactttcgagcgtgcgtggaagaggcggtgatcaaacgtttgcccgcaattaacgccgactcgcggacgtattccgtttcatcagccaaagcctggcaaataacagaaagacagttaaatattgtgctgcaatgaatgaatcaccttcagaatggaaggaatgattttggaaaggaatgggatgaaactgaaaaagtattgaaaagttaatttaggagaagttgaaattggactgaccgatctccgaaagccatgggcaaataaatgtacaattggatgtacccatcgcgaatgtgtggctgagtcgtgggtgactcggtaatgcgaataacgccgggcaaa

SEQ ID NO: 55316 - DNA, 548 bp, Heterodera glycines
  Genomic contig location: Contig_ID=SeqID_4670; Location=850..1397; Strand=-
  SCN-specific regions: Sequence locations=1-548
  Gene Ontology: Mol. function=translation factor activity, nucleic acid binding; Cellular component=cytosolic ribosome (sensu Eukarya); Biological process=regulation of translation
cacaatatttaactgtctttctgttatttgccaggctttggctgatgaaacggaatacgtccgcgagtcggcgttaattgcgggcaaacgtttgatcaccgcctcttccacgcacgctcgaaagttgctgatcccacagctccaatccgcgctgatccacgagaactggcggattcggcaagcatcggtcaaattgctcggcgattttctgttctttgtgtcaggtcttttgataatggaaatttaattcgtaaatttggttttcaggggttagtggcaaaatgacctcagaaacgacgggagaagacgacacgatgggctccgaggccgtgaacaaggccattgtgcggagcattggacaacgttcccgggacgaacttatggcggggatttacctcgcccggtacgatgttgttctggctgttcgccaagctgcttcccatgtttggaaggtcagagccaacattgttttcactttatcatttttattatataaaaacggcaaaattgtcagaaaaacctactcaatcattctctcattttgttga

SEQ ID NO: 55317 - DNA, 1583 bp, Heterodera glycines
  Genomic contig location: Contig_ID=SeqID_4671; Location=40..1622; Strand=-
  SCN-specific regions: Sequence locations=1-1018,1040-1583
  Gene Ontology: Mol. function=translation factor activity, nucleic acid binding; Cellular component=cytosolic ribosome (sensu Eukarya); Biological process=regulation of translation
atgtcgagggggttcttgtgcttccatgtttattggtcacctcagttaggcttggcttccctggccgattgcgtttgctcctctgccgaagtggtgcgactcgtccgtttgattgtcagcgaaggattggctgaccgttcggaaaagtgtcgcgacattatgcgcacagcggcaaccattgcgatagaaaaggcaattccgtcgtctttgccttctatttttttccaatttaagcatggttcgcattgtgtcgacgaactttttcctattctcgaaaacgaactgtcgcaaatgggcgtcgctgagaagaaaaaagggccgtcggaggaaatcgagcgggtgacgacgggacagttaacgattggcaacattcaaagcaccttttcagaatgacaatctccgacagggattggtcgttctcatcggcaaattggcgcagtttttgcaaggcgatgactcaaaagtgcgcaaaatcgtcgcacgactcatcgaaacgctgtccaccccttctcagccggtgctaataaattgttaattgttgaccaattaagccgttgtttaggtccaagaagcggttgccgcctgtcttcctgcgctaatgccgtctctgcgtgccgatgccaaagcgttgatggagaatttgtttctattgttgaccaacgccgaacagtacggcgaacgacgcggcgcggcctatggaattgcggcaattgtcaaagggctgggcgttgtcaccatcaaagaaatgaatgtcagtgaacgtctgaaggaacttttggcccaaaagcaaaatgccctccaccgcgaaggcgcgttgctttgcattgaaatgttttgcaggtaaaaccaaacattggaaaagccaaatttgacatttcgcttcagcacccttggcaaattgtttgagccctatttgatccatttgctcccaaatttgctgaatatgttcaatgatacgaacgaagccgtcagaagggccgccgacgacgccgcacgagcgatgatgtgacggacgcactctttgcaccttcttttttaccaattactcaaacatttaggcgttttctttccgcctacggtgttaaacttttgttgccgtcgcttctcaaagggttggacgatgactcgtggaggacaaagtgtgcctctgctgaactgttgggtaaatgcaccatttaattgcacttttatttatttatttttgtttttgttttaggggcaatgtcaaactgtgcccctcgccaattgtccacctctttgcccgccattgttccgaaactttgcgaaactttgaccgatacgcataacaaagtgcaaaaagcgagtgaacgcgcactcaaacaaattgccaaagtcatccaggtggaatcattttgatatttcaatttgcactcattcatttgcttccttcccccgtttctcttcagaatcccgaatgtctcgccatcagttcccacttaatccaagcactcgtcgaccctccgggcaaaacaacttcttgtctacagacaattgtgaacaacaaattcgtccattacgtcgattctccttcgttggctctgatggtccctttccagtcgatt

SEQ ID NO: 55318 - DNA, 599 bp, Heterodera glycines
  Genomic contig location: Contig_ID=SeqID_4672; Location=3566..4164; Strand=-
  SCN-specific regions: Sequence locations=1-315,344-599
atgtcttcacgaaaccaagcaaattctgtccctgcatctctttgggataaatgtgttcagaatttggccaaaattaatgtaaatgattatctgaatattagtgaacatgaaatcaaaatatttgaaacgccagacgggaaactttacaatgaggaagtgattgagaggtattttattctctgtttttatatatatataacccatcccttcacagaaatatggaattttatgatacgaaaaatgtccgacgagatccaagttaccgaacatttaaagaacagattgaagccctggaggcacttaacgaacgtgcgaaaaagaacagagaaaagggaattctcagcgaaaaacagaaaaaggctgttgaacaggaattgaaaatagaaagggtatgccgaaattatcgaaattttggggaaaattgttcaaaattaaatatgatcttttgatagttgatgacaatgtctcaattttaggagattagatcaaggcttaagaaattgcacgattcattcgaagagacaattaaatcgcttttcattgcgtgtaaaaaggagccgaaggtatcactaattgctgtcatttccgtcaatctttaa

SEQ ID NO: 55319 - DNA, 289 bp, Heterodera glycines
  Genomic contig location: Contig_ID=SeqID_4672; Location=2756..3044; Strand=+
  SCN-specific regions: Sequence locations=1-289
gttaattgtttgataaataattgcacaacgtcaatgcctccattatttcccgaagttgttctcatttaaatttaatagataattttgactgtacatttaatcatttagaaggtagagagcattcgtcacttgtccacaaaatcttgggaggcgacatttacgaaggattatctctccaatgaaggccaactccgttttctttcgcgcatgtgttacctcgcaatggcacattaccttttgtaccgtggagtgctccccaaaggagttttcaaacgccgaaagctcgaag

SEQ ID NO: 55320 - DNA, 262 bp, Heterodera glycines
  Genomic contig location: Contig_ID=SeqID_4672; Location=4376..4637; Strand=+
  SCN-specific regions: Sequence locations=1-89,114-262
tggctcaaatgatcttttattgaagcaatgttgaatttcagttcgtttccgtgtatttaaacaaagtttgaaccaaaaatgtgaaaatcgaaaatttgaattttcgactttttgttcgaattcgggtccgggattaggaagtggtctaaatgggcgccggattcgtgatcagcgacccgaaaaccccataaagtgtttttatgacttttgaaaacacaaaaaaaatttcgaaaaggggggggggcaaactgaactaattacc

SEQ ID NO: 55321 - DNA, 707 bp, Heterodera glycines
  Genomic contig location: Contig_ID=SeqID_24585; Location=268..974; Strand=-
  SCN-specific regions: Sequence locations=1-406,430-603,625-707
atggtctgctgtttcacatttctttggcatcattgggaccgcttcaaaaaacgacgcattcacaaaaagaaaatgtaaaataaaaaaaattgtcggaatatttcccctaatttttcagttttatctccgccgactgttggctttcagtgttcgaattgcttccgccacgtcaacttggccatggcattgctctgatcagcaatcgttttgattgttacgttgatgaacacttcaaaactcgtcgatggtcgtttggatatgtgcaaatttggcgctgcaaaaaggaaacgaatggcacaaaggaaatgcaaattttcaatggccgtggcgaagcaatggaaattccgcaaaaatcggtgccaaagaaagtcattggattccaacaccttttgataaggtgaaaacgaaaaaaaaataataattttttttctgatgactttttcagttacatcgaccgaaatgccatcgaatttctgcgccgtttctcttcggtttttgcaaattatggaattaatttgagtgttcaaacaaaaaatgatcgtctttttgaacgcttcttgctcaacgtttggccattgctcaaagacgaaattcgcgtgatacttttgtggccaatggatctcaaccgtttgcgacgtttcgggcactcggctattctcaccgattgtccatcactacgagtagtctttgacgcaatttgtctatag

SEQ ID NO: 55322 - DNA, 1060 bp, Heterodera glycines
  Genomic contig location: Contig_ID=SeqID_24586; Location=162..1221; Strand=+
  SCN-specific regions: Sequence locations=1-672,694-860,882-1060
ctcgaggctgggctcggttcttttcgtattgatgccaaattcggtcacgctcaatcatcattagtcaataaaatcccaccgatagtaccgatttttgcttgccagcagatgaacattgcgtgccgtacggtgtgtgcgaagctgcggtttgtttggtgggactgctccgagcgaacaatgcaggtcagtcagtcacagtcccgacaatacgagaagagagcaaagtgtgctgttttcaagagtcgggttcattgttagttttttgggtctctgtctcgattctgggctcaattttcagtctcgaatcggaatctcgatcaaaaattgctgtttccgacctcctaaagattaccgtaacacggcacgcgtatatacagtataaccccgtggtgttgtgacttttgggtttgggaaattagacattttttcaccatttcccccattttgttgcccattttcagtgatccgaacgtgcggcaacgaagcgcttggctgccaacgcaatttggaccggtgggctcacatctgctcgtgcgaagaacacttttgcaacactttcctcttccttcggttggacaaaaaaaaaatgccgtgcgtttttcgatgcccaaaaaaatcaaaaaacgcagggcgaacacaaacattgacattgggatgagaaagaacccacgagaatcactgaaaccaaatctaaacatcggcggccaaaaattggacagaataaactctcacagagtccccatcctttcggctttttgccctaattcgggcagagaatggacaaatttcaaaaaaccgtcaaatattcgcaaatgccaagaattgccacgtgggtttgccccgggggcattttgccactgtttccttggcattcccttttcgccgttgatgaactgaacagctccaacttcgcgtgtcattcccatttcccataacagatggcgacgaacggaccatcaagaactccaacatgctcacgcttctgctcgtcattgtgccgttgtccgtcggtgcggcggccgtcgtcgtcgtggcgattaattactattgccacctgtgc

SEQ ID NO: 55323 - DNA, 1520 bp, Heterodera glycines
  Genomic contig location: Contig_ID=SeqID_24587; Location=72..1591; Strand=+
  SCN-specific regions: Sequence locations=1-265,288-499,521-850,873 -1417,1440-1520
atgcaggaattaatgcaggagttacaaattaatgagaaacaaaaggcagctgacgttctcattccaattttgagggacaaaattgaggcattagaagagaagttagacataactcacaacacggatggtgacactacctccggcattggacccctctcaaggagcgtgccaatgcgtaaaaatttgccaaaaactgagcttaagagatttgatggtagtccatctcagtggataccattttgggattactttcgtacaataattcatgaggactctcatgtcccaaaaattgataagttcagttatttagactcatgcattgaaggcaaagccagtgcaatcattcagggtattccaattagtgagagtgggtatgatgatgccatagatttacttttaaaaacctacggggaaaccaaacgtctaattcgaacgttgaaccgggaacttatgtcgcttccaattagtgagtcatttgaagacgacgagtccttgtacttgaagtctgaaaagatttttcgacaactgatttcaatgaatcagaatgtcgaagatggtatgtattacagtaacctggagggcaaaatgtctccagaggtgttagataagtactgtgttatcaaggatgccgaagataatgatgattgggatacgtcaaagtttcggaatgcattctcacgtgcattggaccaaataaagcataggcaggaattaaggaaaaatgtgattgagcccaaaagggacaaacatgaactgaccatgtctttcacggcattttccaagaatgataagtaccaagggaggaataaatttcctcaaaggaattcggatcaatcgccccctcgtgggcggaaatttgaaccaaggaaatttcgtgatcagaggcacgataatagtgactcatcagtcagccattcaccaatgagggataggaggaattctccttatcccaaaagggattggtcaagttcaccagagcgtgaaaaatggaagaaggatgagcagagaaaatgccaattgtgccaaggtgagcacagtgcgagtaaatgccataaatatatggatgccctctcacggcgcaacaaagtattaaaaatggaattatgttttatttgtctaaggactggtcattgggcaagtcaatgtacgttaaagggatataagtgcaacatttgcaatcgggcgggtcatcacatctcattgtgtagatccaaagacatacccaaggataggaggaatagtagttcagaaaattcaccagttcggtcgaagataaatacgactcaagacttctcagagtctgaagaagttgaaaaggaaataacatcggtcacttcgtgtgttacaagtaaaacaacgaaattgtctttgctgaaatgtaaatatgttaccatttataatccagaaaatccaaggcaaaggaaaaggattttggttttcatggacgatggaagtcaaaagacatacatttcgactaaattggctcaaattttgggtttgaagccaattggtaatcaaag

SEQ ID NO: 55324 - DNA, 2018 bp, Heterodera glycines; identical to SEQ ID NO: 24588
  misc_feature (926)..(926): n is a, c, g, or t
  Genomic contig location: Contig_ID=SeqID_24588; Location=1..2018; Strand=+
  SCN-specific regions: Sequence locations=1-16,38-134,161-555,577 -1038,1061-1184,1206-1221,1243-1597,1619-2018
  Gene Ontology: Mol. function=NAD-dependent histone deacetylase activity; Cellular component=cytoplasm; Biological process=chromatin silencing

SEQ ID NO: 55325 - DNA, 1128 bp, Heterodera glycines
  Genomic contig location: Contig_ID=SeqID_24589; Location=201..1328; Strand=-
  SCN-specific regions: Sequence locations=1-250,273-615,665-749,771 -1128
tgcgcggaatgacgacaaccttcgctggtcaacaaatgccattgacgctggactttgttcgctgaaaccgagacggtgccgtgccaagaccgaagttccaacagaaagtgccatcgtccaacatctttggtcaacaaatgccattgtcgctgggttttgttcgctgaaaccgagacggtgccgtgccaagaccgaagtgccaacagaaagtgccatcgttcaacatctgccaccttcactcattcccatgccaacaaacacaaagaacaaaatggacaaatcgccaaaacagaacggaacaacggcagacgacgaaaatggacatcgaaatcggcgactgcttccaaacgaactgatttttgagttggttttgtgtgtgccgagtaccaaatggcccggacggcaactgctgctcacttcttcacttgtttaccgtattattgcggacagtaaaaagacacaaaattggcgaaagcctttgccaattatggtattgtaatggcacgaacgacggttgggggcgtttgcggtgtttgcctcgggcaaataaatgcttttccaaccaaaataaccattttgaaaagcaatgaaattttggaataagctaaaacactgaaaaataaactaattttcaattttttatgatattaagtaattaatttttctttcatttcgcgtttgtcatctctcatccttttcactttcactcacttacatttctcatttatgaaatacaaagattatgctaattaattctaatttaattacaggccctggacaacaccttcttccacaaaaatttgaccggatttaaggttacaaatgccattaattaagttttgggaaaagttttcaagttcaaaatgccggcagattttccctacaccgaattatgtgcacaaaactgcttttcgctaatgctataatattccatgatttcagatgtttccactgatcccgcgttggcactcatattcgggcttgttcttatccgagctttcagggcattacaacagatacatgcatttgagtaccgatgaggagacacatgtcgagtcgaagacatttgctgtggtgattaccatcgacccggcccatttgcctgaaggacgaactgtacaaatggcg

SEQ ID NO: 55326 - DNA, 1252 bp, Heterodera glycines
  Genomic contig location: Contig_ID=SeqID_24590; Location=1..1252; Strand=-
  SCN-specific regions: Sequence locations=1-108,135-206,229-335,357 -408,455-495,519-859,881-1252
aagctgaagtggtgcctgcgcatcgatccgaaaggcctcgacgaagaatccaaggactacttgtccctgtatgtgctgctcgtccaatgcaacaagacggaggtgcgcgccaaattcaaattctccattctgaacgccaaacgggaggagaccaaagcgatgggtgagtgacgggcggagggaattgggacggcacagaaattgccatattttaaaaaaatttaatttccaactaaaaataagttaaattgggcatttattacgcgataaaataaatcagcgacggtcccattggccccctaagataccccacactcgaaattttaaggaaaaatagtattttatagtttttatgttgaatttgcgagtttccttgtcggtgtaccccctccaagacttcagtcacccaaattttcaaataaaaaaataaatcattaaatttttcaaaaaatttcagagtcgcagcgcgcctaccgatttgtgcagggcaaagactggggcttcaagaagttcatccgccgcgactttttgctggacgaacagaacggactgctgccggacgaccggctgtccatcttttgcgaagtgtccgtcgtcgcggacactgtaagtgccacattttttgggcggctcctactgaattctcggcatttccggattgaattcattttccgtccccaatgttccattcggtggccaattttcccccttctaggtgaatgtcaccggccagtccaacatgatgcaatttcgggtgccgccctgtcgcctctcggacgacatgggcattctgttcgagaagggcttcttcgccgactgtgtgctgtcctcgggcaacaaggaatttccggtaaatttttcttccctttctgctttggttcctggcccaatctttgttatttgacaatgagaattggtactctacccccgattcttaatttgtttttgcattctccctgagaatttttccttcgtcatggtttctaattcctcctccctccgaaaacgataaaaaacagaaaaaagcaatttactttttctttgttttccaaccttcttacaaatagttgttttttctataaaaacatcaggaaattaaaaagattaaaaaaatacagtaatctgaccaaagtgaacggctattaaaaacgaggtcgaatacgggcggacccgtacacaggtttagcgacccgtagtaaccgtatttttccgaccggtacgggttttactgactattcagatttaaaaatga

SEQ ID NO: 55327 - DNA, 207 bp, Heterodera glycines
  Genomic contig location: Contig_ID=SeqID_24591; Location=146..352; Strand=-
  SCN-specific regions: Sequence locations=1-47,97-110,132-178,200-207
atgagaataaattcccagataaataaacgaaaatcagtaagaatgtgaaaaaatattcaattattttttaattacattgaaataaattataaaattcagtttaagataatgttttttgtcattcttctcgtatgccaaacatcgcttggaattggtaaaatgatggcgggatttttataagaacacattttcaaaatatccaataaa

SEQ ID NO: 55328 - DNA, 360 bp, Heterodera glycines
  Genomic contig location: Contig_ID=SeqID_24591; Location=2076..2435; Strand=+
  SCN-specific regions: Sequence locations=1-122,172-249,280-360
atggcctttctgctgaagtttgttctgctcctctcaataatggcaattttctgcgactgtatggaccccggcaaaaatgggaaaaccaaaaaaaaaggtacagaaattagctggagaaaaagaataaattcaaaataaaataaaaagaaatttagaaaaataattttttttcttttgaaattttagacgttgtaaaacaaaaagttgacgaaacgaaagttgagcgtaaggaagaggaggggaaaggtgaaaaaattaatttaaaaaataaatattttaggcgccagtgaaatgaacaaaggcaaaagcatcgttatggctgactccaaaaaggaaggtgaaaatattgttaattaatta

SEQ ID NO: 55329 - DNA, 361 bp, Heterodera glycines
  Genomic contig location: Contig_ID=SeqID_24591; Location=2520..2880; Strand=+
  SCN-specific regions: Sequence locations=1-234,256-258,280-361
atgccagtccaaaagcctctcaaattggcagtccaaaaaacagtccaaagggcactcaaattggcagtccaagatccattagcagtcctaaatcaacacaaattggaagcccaaaaggcattcaaattggcagtccacgaaaggaaaagaccaaattatcttcagctgttggctcttctgatttcaatgttatcgacgaatgtaggaagtcataaagaagcaattagaagacacatatataatttatttaatttagcaaaagaagcgaaaaaaccaagccaattcaaaccgagtccgtccagaagccaaaataaacgcgaacagcagcgactcaatgttactattggagaagcgggaagag

SEQ ID NO: 55330 - DNA, 90 bp, Heterodera glycines
  Genomic contig location: Contig_ID=SeqID_24592; Location=1..90; Strand=+
  SCN-specific regions: Sequence locations=1-53,75-90
atgctacagtcaatacagccgcaatacgcgcccttgcgcatcatgacgcgatttgcgcaacatcagcagacgcgacgggacagtgatgga

SEQ ID NO: 55331 - DNA, 352 bp, Heterodera glycines
  Genomic contig location: Contig_ID=SeqID_24592; Location=1636..1987; Strand=-
  SCN-specific regions: Sequence locations=66-66,98-104,133-294,325-352
atggttcgattagtctttcgcccctatacccaagtcagacgatcgatttgcacgtcagaatcgcttcggacttccaccagagtttcctctggcttcatcctgctcaggaatagttcaccatctttcgggtctcagcgcatacgctctgtctccgccccatcgcatgcgatcgagacgggactatgttgcgccccaacaccgcagtgccagggatcacacatcagctccgtaagaagccttcactttcattgcgcctttgggttttgaacacccaatgacttgcgcatacgctaaactccttggtccgtgtttcaagacgggtcgaacagatgaccggcttttacaccgagaa

SEQ ID NO: 55332 - DNA, 69 bp, Heterodera glycines
  Genomic contig location: Contig_ID=SeqID_24592; Location=1890..1958; Strand=+
  SCN-specific regions: Sequence locations=1-1,33-33,62-69
atgaagccagaggaaactctggtggaagtccgaagcgattctgacgtgcaaatcgatcgtctgacttgg

SEQ ID NO: 55333 - DNA, 1354 bp, Heterodera glycines
  Genomic contig location: Contig_ID=SeqID_4673; Location=3134..4487; Strand=-
  SCN-specific regions: Sequence locations=1-222,254-314,343-368,506 -1354
caaaagcgggctgcagttcgcgcaggtggccgagttttcgctcatccaacagactttgacggacaatcgcgtgagcctttcttttggcgtgaattttgtggggaaaatcctcttgagttttggacgaattctatgaactttgagaaggaattaatttgtaattggagggctaatgggggaaaagcagcagaaaatgttaaggaaggaaatgagcgacggacggacagagaaaagggagaaaaggcggggggctgaaaaggacgactccccgcgccgggggcgacttccccaattcaactctctccccgcattgctcttctcttccccttcccctccttttgttcgtcgttcttttccttctcttggctaagagtgaaaggaagagagcgaagagaacagaaaaagtgcaggaggagagaagcagagaccgagaaatagcgaaagggaggagagaaagacacacaaagcaaaagaaaatgaaaagaggggaagacagaaggacagattgccattggaaatgccattttgagagtgccaatgggcagaatgaaagtctgtacaaaacgctgccctaatgagggggaagtcaatcgtaaagagatttgtttaatcaaagattaggataatatgctgattttaacattacatttaacttttcctcggaatgaattcgaatcgaattttcactaccgtagtccaatggcattccgtctcgaaacccgtggtttcgcttctgtgctccgccgattgttttgttgaattttcgcccgtcccttgggaagtgccgtcgatggtctaattaagcaaatgcttttgttggcagagtgcccacattgtcaccggctcccacttcagccaagtgttccgactcggtttcaaactgaggtccttccgcccttccgatttctgtgaattaattcccccatttttcagattgatttgcaaagctcgcggggaccctcggcccaaaatcaaatggtttaaagagggaatggaaatgcaaccgaagcgaaacgcccattactacgaaaagccgctgggaaaggatgaaatttgggtttgtccatacattcgccagattaggactgatttgcaagttttgtttagagcaaattggagatcgatccggccacaatgggagaccaggcaaggatggggagggaggggtaattagccaataatgaccaatttggctgggaatggatgcaccttcaccgagtgacatttcatttcggcacattaactgaccacaagggcgaaaaaacggaacaattgaattaagggcatttacgcatgtgtggccaacaaccaacacggagtgatggccaagaatttcaaagcggaataccggtag

SEQ ID NO: 55334 - DNA, 634 bp, Heterodera glycines
  Genomic contig location: Contig_ID=SeqID_4675; Location=259..892; Strand=+
  SCN-specific regions: Sequence locations=1-126,150-634
gagcgtgccctcttctttgagttggaagcggtccttcagtttgcccagcgttccgccgattgtttggccatttacggcgctggtgctagtgccgaagttcgtgcagcactgcaaaattgtgatgatgctgacatacaaaatgcttctttcgccatcgtccgtcaattcgtccgtcgcattcgcaaatattttgaaacggcgcaacgaattgaaaaggtccgttttttcctattgaaacggacaaaacaaactcaattgataggttcgttttctaatttaggtggtccctgagctgttgtgggagctctgttccggccctttgcctcccgttgagcagctcgactcggcccaggccctctgcaaacaactcgcccgactcatcgatttcgtctttcattttgacacaatgaaaatgaacacacccgcgatgcagaacgacttcagttttttcaggtgctctcgctcttccaattgctcttttttgactccttttccttaaggcgagtgatttcgcggagcgaagcggcggcgcgcgaagcggagaccgactgttccctcgagttggccaacaccatttcgctgttcctcgcctcgcccactccgatgctaaacgcactgacaaacgcaacagccg

SEQ ID NO: 55335 - DNA, 849 bp, Heterodera glycines
  Genomic contig location: Contig_ID=SeqID_24597; Location=873..1721; Strand=-
  SCN-specific regions: Sequence locations=1-545,655-849
  Gene Ontology: Mol. function=structural molecule activity; Cellular component=cytoplasm; Biological process=cell cycle
cgccttgaacaaaatcctttcccatccgacaatgccggtgagcatcgccgcgggcgaggaccgcaaaatccgtttcttcgacaacaacacgggtgagaagctgggaagactatttgtatagcaaaatcgcttaaaaaatagacaaaactaatggtcaaataagtcagtctttaccccacccctaatttacttttttttttaatcgttttgtgcgattaaaaccaattcttttggatctaaaaagcctttcttcatttactccggtccaatgacttttaatgttggtataaacagtcaatttgtccaatggcattttttcgccttcaggcaaactgatcagtgcgcccatggcacacgtggagggcgtgtccacgctggccatcgaccccaacggactgtacatgctcagcggttcccatgacggctcaatgcgactttggaacgcggagaagcgcgtctgtctgcaggtggtgagagggcggcgctgaaatatgtgcacacttttcttccgtcttttcccctgtcgttctcgcccctgcattatcttcttttctgtttttcttttcctttcctttcttcctgtctctttttctttcgtctttccccttcattatctttttctccgtctctgttcttttttactttttcttttctgtcaccatctctttcttatcactattttttctttgacactctttttcaacgtgtggccttaaattccaggaaattgctgcccatcgtaagaaatttggtgccggagtgatggccgtcgctttccatccctcacggcaactgatcggctcttccggggcggacagcttggcaaaagtgggtattgttataggatat

SEQ ID NO: 55336 - DNA, 91 bp, Heterodera glycines
  Genomic contig location: Contig_ID=SeqID_24601; Location=178..268; Strand=+
  SCN-specific regions: Sequence locations=1-91
atggtaagtagtaattcgtattagtcatcaaatttaggaggaaattagtgatcagatcgctgtggttgatcagaaaattagcgaaaagtga

SEQ ID NO: 55337 - DNA, 1414 bp, Heterodera glycines
  Genomic contig location: Contig_ID=SeqID_24601; Location=788..2201; Strand=-
  SCN-specific regions: Sequence locations=1-832,861-863,886-921,943 -1312,1336-1414
cgcgttggacttgctggagacgacggaccagcaacagcagccgtgccatgatgaccgtggcagtgcaacgccgcgcgacaacgcgtcgccgcccccgtcgccgtccgcgttctcccacccacgaccgtcgcagctgcaatcctcgaattgggccagtggtggtgttgctggtactgctccaccaacaccggcgacaatcattggcccctgtccactgctggactctaagcgaaagtctgttagcaacagcgtgttgtccgtttggtacgtgttttttgcggtgcgatttttgggcgcggcccaattcagtctgactgagaatggccatttcagcgccgtacttttggccttttgattgtttttttctgatttttgttcgtcattttttctcttctcaattggtccgtgtcctgcttcatttgtggcctcagtgttacagtactaatgcatactgtgctgttcatcttctcacggatatctaatcatgtttttcgattcattcagtcccgataggtccacttcttaatcagccaagggtccttggcctggaccgggctagagtacagtctaaccagtttatagacgaattactgtcttactctgttcgggttacggtgtctttaatgtttatttgctttattagatcagttgtattttttgtttgcctgctgttgtttctctaagttcttagtcgttaatatttgtgctgctcgagagtctcggtcaccaattcctgctcgccctctctctgaaaattccggctctcgatcagccctacttagcaaagtgcagttgcacagtcataaaatcttattaattgattagaattttatgtctgtctgtctgtctgtctgtctatccctaacagcagtagtgtctctctctgtctgacttttctgtgatattctgtccaattgtcccaaaagcattatctttcaaaattcaaatttctttttttttgcagggatctgttagctgtcaaagtcactgttcgcttcaaattgccttcctgcgtcggactcggctcttccggtcagtgccgtttttgcccatccgacaaaattggggtgaaggcactttgaccaaaattcaattcccggcctcgaacttagtcttggtgcctgattttttctctcaatagattcgggcaaatattttagccaaaaatatccgtccaaatttgtgttccacccaaaatgccaatcccttccctcctcaggtgcttattgcgtttgcattgcggccgccctccttcagacggccggcctaatccccccgccttcggtgtccgccgaatcggacgaactcacttgggacgagtcagtgctggacatcatccgcaagtggtcttccgcagccgagtcgctgatccacggccgcgcctctggcctggacgcggccatttgcacttatg

SEQ ID NO: 55338 - DNA, 544 bp, Heterodera glycines
  Genomic contig location: Contig_ID=SeqID_24602; Location=12..555; Strand=-
  SCN-specific regions: Sequence locations=1-144,166-320,342-544
atgtacgttgaagctgttgtcggacttctgcttgttgcaagtgtagtagtagtaggaagagagcaacaacaaccctttaacgcaacagtgtcgcctccacaagttccatcagaacgagtaacttaattaagggataaaccaaggtgtaattagttaatttaatttactgccaatcgttgctccatatcccattgtttcacaccaaccatcccgacaagaatgggttctttgtacaaggttgggattttggatagtttttgtcgaggttggaactgtagaagttgaagtttttcttgatctagaagttgtgtccatagaagctgaagttgccctggttgatttcgatgttggaacagtagaagttttagtcgttgaacttgttgtcgaagttggggccgtagaagttgtacctgttgtcgacgttggagccgtagaagttgtacttattgtcgaagttggagccttagaagttgtacctgttgtcgacgttggagccgtagaagttgtacttattgtcgaagttggagccttagaagttgtaccg

SEQ ID NO: 55339 - DNA, 549 bp, Heterodera glycines
  Genomic contig location: Contig_ID=SeqID_24602; Location=1..549; Strand=+
  SCN-specific regions: Sequence locations=1-214,236-390,412-549
  Gene Ontology: Mol. function=transmembrane receptor activity; Cellular component=cytoplasm; Biological process=Rho protein signal transduction
acgtcgacaaccggtacaacttctaaggctccaacttcgacaataagtacaacttctacggctccaacgtcgacaacaggtacaacttctaaggctccaacttcgacaataagtacaacttctacggctccaacgtcgacaacaggtacaacttctacggccccaacttcgacaacaagttcaacgactaaaacttctactgttccaacatcgaaatcaaccagggcaacttcagcttctatggacacaacttctagatcaagaaaaacttcaacttctacagttccaacctcgacaaaaactatccaaaatcccaaccttgtacaaagaacccattcttgtcgggatggttggtgtgaaacaatgggatatggagcaacgattggcagtaaattaaattaactaattacaccttggtttatcccttaattaagttactcgttctgatggaacttgtggaggcgacactgttgcgttaaagggttgttgttgctctcttcctactactactacacttgcaacaagcagaagtccgacaacagcttcaac

SEQ ID NO: 55340 - DNA, 551 bp, Heterodera glycines
  Genomic contig location: Contig_ID=SeqID_24602; Location=689..1239; Strand=+
  SCN-specific regions: Sequence locations=1-73,95-126,148-368,390 -469,550-551
atggagcaatggacttgtgaatctgctgcatccattggattgtgtaaagtgagtattaaaaaagataattcgatttaaaaaacaatttttaataccgagtttatatgaaatagttccgcaagaaatttaaattttcacaatttatatacgctttttggacctaaaaagttcccattataacctaaaagacaacttcaaggaaatttcaaaaatatatctcatcttttatataatatatctccatgcaatacttctcttattgaaagtcgctaaccaaagcaatggcattcaattgttgttggacatgttggaagaaagcagcagattttctaccactactttaatgaagaattcctaagggtgattttgtatataaatttttacattttttactactatatggtgcggaacaatttaatgagtttcataggttgttctgaagaaattatttgtctttgtctaattttccataaaaagtaaatttttaattttagctaaattacattagattatacatttaatatttattttacatttaattttatttttga

SEQ ID NO: 55341 - DNA, 1514 bp, Heterodera glycines
  Genomic contig location: Contig_ID=SeqID_24603; Location=176..1689; Strand=-
  SCN-specific regions: Sequence locations=1-351,373-576,599-1180,1202 -1457,1480-1514
atgaaaaaggacgtcgtttcggcgttagttcgaccaatcattcgtcattctttcagcacggcaaaagtattttgcttcgcttgggtcatcgcgtttaatttcggtctttttttgttgatattttgcaattattcattcctttccataattgctcttttagctttgcttttgcgtcctttccatgcgtcgcttccgtcactttttgctttttggcacttttccgactttttcctccctctctttgcgcgggttttaatccttcgtttaactccgtttgttgtcactaattttctcatgaaggtgtttggtcaatttaactgtggagaaacgtttaaatttagcccattgaatttgtcatgccaactgttttttatgctgccacagaaggattgagttcgacaatgacactgacaaatgcactcgagtcaaacgatccgttgacaaaggttttactttcgaatgcaatgccattttttgtccggtaaattacaatttttcagttttttgcgctttatctgcttcaacgaatgtgttcagccaacacttcgacgcggaaacccttcttcgcattgagtcaacctggtggtgataatatgtcttttcatggttttgattgtttattaaggtggacatccacgaaattggcattctctccgtgatgtcgccattgcgcacgtacgcaatgtccgaaatattttccaaatagccactcatagtaaaattctggtgcattcgccgggggttggaagtgcgtcacatgagcaagtctttggccgatgcgtccgttttcgacactttggaggaaattgacgaagataatgctaataaatcattggtgaacagaaatggcagccttttgttgaactcctcgacgggctcaaccggcgtactgaacgaactttacgaggccaaacactccttttttgttcccccttcgctcaacccgcgctcagctggtccttttttaatgccgaaaagctgttccatccccaacgtttattttagatgcttttctttccgaacgcgtccattgccgtcgtcgtctgattgttgtgccgcttttttgtgatttcattgtcaacagatgcaaagaattgctttttgctcctgcaccgattgtctcttcctacgacaccctttgcactttatatgcgattaaaggtccgtctgtccttgaaagttttgaaaaaagttcattttaataaccgattggcatttagctctttccaaagtgatctctcactctcttcatgaggatgaattcggagttgtgcagaaggacatgagtaagtcgctttccgaactgacgcgcctttccatttccatcgacgcatttgtgagggccaacggagtgagtccttttgcaagggtgggaggcggacagaaaaatgccgcggatcgtgcatttaaaaaacattaaattctcaccgaattttcacaaattaagcatgcgtttcatttccccctcaaaattttttcgtaagaaaatttcaattaaaatttttttgaataaa

SEQ ID NO: 55342 - DNA, 793 bp, Heterodera glycines; identical to SEQ ID NO: 24604
  Genomic contig location: Contig_ID=SeqID_24604; Location=1..793; Strand=+
  SCN-specific regions: Sequence locations=1-793
  Gene Ontology: Mol. function=helicase activity; Cellular component =cell wall (sensu Fungi)

SEQ ID NO: 55343 - DNA, 531 bp, Heterodera glycines
  Genomic contig location: Contig_ID=SeqID_24605; Location=309..839; Strand=+
  SCN-specific regions: Sequence locations=1-17,39-350,526-531
atgttcggcaagcgcgcaaaaagtcaaaaagttaaaagccacgtggacggacaaactgaaaatgttcattttcgcgacagtcgccattttatgtacggacaaaaaaaccaaataatttcattttttggcattaaaaagaccaaatgttcatttgtcagtgcttctgcttccgattcgaattgtggtcgctaccattgcgactcttttcgacgaccacagaacgttgggacgggcaatacacagatggaaagtgacacgcaatggggggacgaccgccggcggaaatgccatgagcacaaatggggacggagccagaaactgacgaacacggcacgggaaaggaggaaattaggaggaaggaagaggaggagacggaggaggaaggagaggagaaggaggaggaagaggagaaatgagaaggaggaggaagaggagaaaatgaggaggaggagaagaggaggaaggggaggagaggagaaggaagaagaggaagaaaatgaggaggagaaggaggaagaagaggagaaatga

SEQ ID NO: 55344 - DNA, 364 bp, Heterodera glycines
  Genomic contig location: Contig_ID=SeqID_4677; Location=797..1160; Strand=-
  SCN-specific regions: Sequence locations=1-364
aaaagcgttggccaacgaagccgattgatgatgacaatgattacaggcacaaaaatgggagagaggaggacggtgccgaaaatggtggtggcagaggaggcggtactgacttggccagcgcaaaatgtcgctgcggcggcgcgacggtgtgcgacgcgttgaacgcaaagtgtgcaaaaatggtttttcaaattttggtgtcgaattggaccggtaaaacggggatggttaggcttttcaaaaaaccgtgaaaattgggaaattgggcgtgggttaaaaaaactgtttttttttttgtaacttcattttctcccaattaaaacagagagaggcgattggttttttcggcggtggcactcagcaa

SEQ ID NO: 55345 - DNA, 1655 bp, Heterodera glycines
  Genomic contig location: Contig_ID=SeqID_4678; Location=780..2434; Strand=-
  SCN-specific regions: Sequence locations=1-829,852-1010,1033 -1168,1190-1248,1278-1329,1353-1417,1440-1481,1507-1546,1568-1655
atgatctcgcaggttgtttccgtcgtcccagcacttcgtcggcacaagttggtggagcaagcacttcgtcggcacaagttggtggagcaaaggaaggtggcaaaaccaaagacagtggagggaagaaggtggtcgcaccgaagaaaaagaagaacggatgagcaaagaaatcgcgcatcacgaaaaagaagtgaccgttgattttgatgttttcatgcgtcaatttcgtattgttgatgatggtgctctgttgtcgttgaccataaagtcttgttaagatatttcttcttgggtggcgattatgaccgcatttcatgatagtttagcgttttgattgaaatcagcagtttatgacttgagttataacgtaatgaaaattgaaactcaacttttagtacgttttctccttaattttattgcatagtttaatctttctgattgattccacacctccgacaatatgaaaaaaaattttttttttttgctgcacctccaaattttcgccgaaattttccctaaaaaaatgttgtccgcgaaatcttgtcctgttccggttttttcaatgaaaaacgaaccgttttttgcttaaatctggtgtaaaagtagtatttttttccattacgccttttttttattaattttgcattttaggcttgaacgtgatgggaaattggcggacgctcgtgccaagtttggccaactgttggcactgtgccccgaccaccagggcgcgctggacggcatcgcacggttggacaaaaatgatgacaacatcggcggcacggacattgaactcgtcgagctgagcgacgacgaacacacggaccatgatgacgacaatggcaataatgatggacataacagcggtccgctcaacaacagtgatcggcggaagcgaaggcagagcgaaaacggcaccaatcgacggcacagtgccgccggcgaaaacggcagaaagtcgcagaacggatgtcaaacagagggcggagcagggagagtgaaaagacgagagacaatgagcgaggaggaggcacagagaaacagacagaagttggccgaaatggaggcattcattgccaaactgaagggtgccggcggaggaggcggaagcgggacagcaaaagttacaggcgcaggcggcagcgagaagagatgagaagcggagcggacacagacacgcgcacacacaattctgatcatccccactctcacactgatcactgtgtattgatcgggaggggggggggcaatccgttcattcattcattcattgaggatcaattcagccatggaataatatcatgtgtaattaaaaaaaaaattagaaaattgttgttgttgttgttgttatttcaccacttctgtctctgtctcttctgccgatttgttgtcatccttttcattatcgcgattatatatttttgtttatcaccaatttgttataatattgtcgtccctgaaaaagattaatgagattgccagcaatatttatttatttatttcattcaaaatatgttgtgaaaaccaagagaaaatcgaattttccctattttttctttccctgattttccgtcctcgcgaaaatttcagcatcaaaaataatttaaaaaacaaaagaaaatagggtgatggatgacaaaaagtgaacaaataaa

SEQ ID NO: 55346 - DNA, 178 bp, Heterodera glycines
  Genomic contig location: Contig_ID=SeqID_4678; Location=1003..1180; Strand=+
  SCN-specific regions: Sequence locations=1-80,104-155
gtgataaacaaaaatatataatcgcgataatgaaaaggatgacaacaaatcggcagaagagacagagacagaagtggtgaaataacaacaacaacaacaacaattttctaattttttttttaattacacatgatattattccatggctgaattgatcctcaatgaatgaatgaatgaa

SEQ ID NO: 55347 - DNA, 938 bp, Heterodera glycines
  Genomic contig location: Contig_ID=SeqID_4679; Location=1..938; Strand=-
  SCN-specific regions: Sequence locations=1-62,88-652,674-767,790-938
ccatttgaccggaccaagcgcttttacaacatcagcgactacataagcagtaagtgtttggtggtctctttcctctctcctttctgtgcgccggtgcggttgggccccaaaatttcgtttcccccacccgtttgagccaccgtcgtgtccattgcgcccgccagcgaagagttggagttggaaattgacgagaacgaggtacgtgggtggacggggacggacatttgggcccaactttccgattcatgcaattcaaaacggtagctacaacgaaaaagcgttaacgtggccgattcagtaccattttcttgattgaggggcgaggaattcgaacaaatgacgtgttttaaatgaaaaatgggatttctctttcataaccctttaaattgccaacccccgtcacccctcggccattttcttctactgacaataccacggtgcttcttggtgcatttttttgacattcattgtgacgagacgattcatttcccctttttacaaattgaggcaatccttacacagcaaggcatcccggcgtattgcaggtttttgcatttcgattattaacactaaatgtgccattcctgtagtacatttaaaaatatgacaaccatttagccgttccaaactgttgtttttctgattttatgaatattcaattttatatatttttcatggaggagagattttcccaattttagtgacactttcaaaaatacttgtttttctacgtatttaatgactttttgaagccatttttggctatgatttttttataatataaaataactttcttccaaattcgaatcgaaaaattattaaaaaaataggcaaaaaattaaaatttcaacgcaattatttcacccctcgccgttcagggacttcgatcggaccacatttgaacacagcgagcacatccaaatcgtgcgcgacaaccc

SEQ ID NO: 55348 - DNA, 567 bp, Heterodera glycines
  Genomic contig location: Contig_ID=SeqID_24607; Location=1..567; Strand=+
  SCN-specific regions: Sequence locations=1-276,298-387,409-567
  Gene Ontology: Mol. function=cytochrome P450 activity; Cellular component=extracellular space; Biological process=leukotriene metabolism
cgaatccatcggtgtgcggctgcgacccgactgagcatttcggcattgagcagttgggcaggcttagcttcctggagtgctgcgtcaaggaaatcctccgcctctaccccagcgtcccattcgtcgcgcgtcgtctcggctccgacacaatcattggcggaaacaaaatccccgcgaatacccaagtgttgctgaacatctacttgatccatcgggagcctgaacactggccgaacccggagctgttcgacccggacaggtggcatttggcaactctttttgcggttctttttatttgtcattttattaattttaagattttctcgtgagaatatgaagggtcggcacccgtacgccttcgttcccttttccgctggcagtcgaaattgcattggccaacgcttcgcccttctcgaggagaaaacgatgctcgtttggttacttcgcaacttccgtatcgaaagtctgctccgtcgcgaccaaatgggcttgaaacccgaattgatccttcgtccgtccgtcaaaatttctctcaaattaacaccccgactttaattgtttgaaagt

SEQ ID NO: 55349 - DNA, 815 bp, Heterodera glycines
  Genomic contig location: Contig_ID=SeqID_24607; Location=846..1660; Strand=+
  SCN-specific regions: Sequence locations=1-331,353-815
  Gene Ontology: Mol. function=Hsp70 protein binding; Cellular component=transcription factor complex; Biological process=G2/M transition of mitotic cell cycle
ttggacgatttcgcagatgcggagaaaattggggagggcacttacggaatcgttttcaaagtgcggatgagggccaacggagagaccaaagcgttgaagcaaattcgactgaacaggtgggctggggcccatcgagttgctccgtctgtctttgttttattgttccgtaccaaaataaatcgttttttgtaccgtttgccaattgttttttcctcctgtgccatgtcaatgaattggcacagatttgtccattaagtgggaatgacggtgtgccgagcacttgcatccgcgagatcagcctgctcaaggagttgtcccatccgaacatcggtctctcctctccccctccctctgtttaaattttcatttccattccttcttcatttcccctcttcagttcgtcttgacgacgtaaaaatacacagtaatgaatggcattaattccttggcattttctccgtgtggcattttcagagggccgtcgtctctttctcgtcttcgaatacattgaccaagacttgaaaatgttgctcgagcgtctctcccctcgttctgtgcccattaattacgttaaggtctttcttctttttttcgattttccattttgcttgaccatttcttcgtcaaattatgccatttcccttccgttcagagtttcgtctggcaattgcttcaggcgctcacttactgccacacccatcgcgtcgtccacagagacctcaaaccccgtgaattgtccgcttcgataatctgttgcttacccccaacacctcttcagagaatctgctggtcaagaatgacgggaccattaaact

SEQ ID NO: 55350 - DNA, 941 bp, Heterodera glycines
  Genomic contig location: Contig_ID=SeqID_24608; Location=99..1039; Strand=+
  SCN-specific regions: Sequence locations=1-273,312-941
atggaaattggagctgcgaatgttcggcaacccatcgaattgtttcccaaaagaacggaacggaggatttttcgcgaaaatgtgaccatgtttttaacaagaaagagaacgactggggctttccaactttcattgcttttacggtgagtgacagtcaaaagaagagttacggtcgaaatattgaaaaaactcagtttagtacagaaaactcattcgttttacacccaaaaatgtttagcggtcatatttttccgcaatgcttttgggtgaaataaaaacaacaaaatgagtttaaaaatgcaaatatcgcaaccattgccaaactcctttctcgtgaaataaatttaaacttaaggaattgatggatccggacgagggattttacgacaaaagtgaggaaaaagtgacgttggccattgatttaactgttgaagaagaaaaagggacaaaaaaagcggaaatttaccgatgaatcaacccacccaatcactattttctgttaattgatctttttgaaatttatacaataaattcggcagcaaattttttttcgtaattatttattaaggaaattttctcatgaatattaataaatatatttctttattcgttttcgagtagagttgagcgggaacgggacctgaacacggacaactgagtaccgaagttgaccgggaccgggaccagtcccgggtttttccagccaaaaattcgcggtttttcaacccgaaaaggtcccggtcccgggtttgcccaaaattcccggtcccgctcaactctattttcgagatattagattttgtgcttttccatcattccgccctcactaccataaaaatatatgatttacgataaattacaacaaacttttctagggtgatttgatgcgctaattaagaatgacgtcaaaaatttaagagttatctatgattttttcaaaa

SEQ ID NO: 55351 - DNA, 436 bp, Heterodera glycines
  Genomic contig location: Contig_ID=SeqID_24609; Location=601..1036; Strand=-
  SCN-specific regions: Sequence locations=1-208,235-436
atgtcgtcgtcatcgtcctcgatcagtgtcagtgttcagcaccagcaaaacccaacacatcaacaacaaatgatggtgcacaacaatgccaacgatgatgccaattccgccaatgccaattttgccgctgttcttggcacgggaggaggagagggcgcgtgggcgcaactttgggtcagtttttggtatattttcttattgccagtcgtaaattgttgttgttgttttttccctcaattttggcatttctaatcagttgtcactatttttatatttgttttcacccggattcaaaattattttcctgaaattattaaaaaatgtaaattccttgaaaattttcttgttcctttagatttttttttacttaaatcttttggtttaggttatgtgtgacaacttttggtcaatttttggcacatttctcagccgttaa

SEQ ID NO: 55352 - DNA, 2211 bp, Heterodera glycines
  Genomic contig location: Contig_ID=SeqID_24610; Location=48..2258; Strand=+
  SCN-specific regions: Sequence locations=1-80,102-102,124-139,222 -234,257-299,321-980,1014-1054,1076-1105,1163-1255,1277-1426,1630 -1767,1872-1891,1942-1995,2019-2069,2091-2178,2210-2211
atgtcaatttatagagcactaacagtttgcattaaaaatgccatctctgaattcaataaaaggttaattaagcaaaaagcgtaaaaaataaattacctatatttgatttaaataaattttacagtaatttttactgcactataattaataattaattgaccttaaaattttgaatctaaaaaatttaaaataaacaaataatgtaaaaacaaattaattttgaaaccgtttaaatttttcctcatatttgtttaaattaacaaatgcaaacacagacaaccaattagtcctggaattaagccctaaaaaatttgcaactctgcctattttaactaaaaacatcaattttatagatataattaacataaaaatctttgaataaatcgacattgaaaacgaaaattttaaatgttcttacattgatttttttaatttattcaatttctgagttagcaccactttttctgatctttttctttcgttaaattaattttgatcataatctccaaaaataaattttgtttgatcatttgatcacttttagattttctccgtcaaaaattcacagttctgaaaaagtgcatgaattgcaacgatcaatctttacaaaattgatcacttgcactgtgaacaaagccaacaaacaccatggcacaacaaatgatgactttttgtccaaattgcattttgacgttttggcacaaatctgtgaagcggatgatcaaatgaaagaaattgtgttgaaaaacagtaagccaaaaagcaaaaacttaaaataaaaaatatagaaattcagaaaagcatttgaaggattttatgaacgcaaattggtataaaaaattatctggtttgcttgagaaggtaagggtaagaattattttattacataattcattagttaatttgaccactttttggccagagctccgttcttcacattttttttttaaatctcattctgctgaagggcaaatcactgatttagttgaaaatagatttttccattttttatctcacattttattgcactaatctctcattgaaatgccgaaagaaaaattaaaataatagtgattttgttaacacatttagccaaacacctagcaaaataaatataaaaattttcaaaatttactataaaaaataaaaaatattttatttaggaggatgaatatttttctgtatccgaaagttttaacgaatctgacggttcagaaaatgaaatatttgatgacccatcagaaacaatcattgaggaaaatgaaaattcaaagaatttaatggaaaaacattcaattaaaaatatgaattttgaatttggtgaaaaaagtgcagaaaaatgtgaaaacaaaaatttcaaaaacaatttaacaacaacaaaaatggatgaaaaaaacagtgacgacgaatttttggcattaaattcagaaaatgaagaacaatggacaaagaaaaaagagcagcagaacaaaaaagcaaaaaatattaatgtaagaaaaaataaaaataataataattcggagaaagaaatgacggaacaaaaaaggaaaggaaaaaatggcaaaaataaattggaagaaaatgatgagaatttaaatttaaataaaaaaaattatggtaaaaagaaaatgatggaaaatttaactcctgaaaatgtacaaccgttaattgagcggaaaaatggaaaactttgcaagaaaatgtttagtgaaattggcgtcaacaaattagcaggcaataatttttcttaaattttttcgtttttcgttttttttaaattttttattttgtttctatttataagattttaattttaaataattttttattagaaagatagatgttaaatttaattttttttttaatttttagatttgctggatgaatcaattttcaaaaagatttttgaaaattttttggaaaaacattgggaaccccaaagcatggagaagcaatgcttggaatatttaggcacaattgcattatttgccagagcaattcaagcaaaaatgaattttattgaacaaatgtcgaaacattgggcaaataaatcggtgaatggaattgccaaaaaatgggaacattttatttttaatgaagaaattttattcgaattcgaacagtttgtacaaatcaaattgtattttctgcaaaatcagcttgatgaatacgcttttgagtaaatatattaataattcacaaattaattca

SEQ ID NO: 55353 - DNA, 654 bp, Heterodera glycines
  Genomic contig location: Contig_ID=SeqID_24612; Location=130..783; Strand=+
  SCN-specific regions: Sequence locations=1-67,90-220,243-368,413 -440,475-654
atgtattcgtctttaatcatttatcaactatttaaatctaacgtgtaagtggtcaccccttcgttagatattttatttattaataaaaagaagaacacttaattgccctagtcaacaaaaggagaatgaattgattatttgtgccccccccctccactgctcgccctcttttatttttctgctgagtaattttgaaaatacggtactttgcgttatgccacactttcccgccccctcccctggcggtgtgacccacgcgtttgggcgccggcaggtttttccactatagcttttttctttggcatccaaatccaaaaatcttggtatcattcgaaagctcttaacatgctctattagccttaccaaatgcaaaaagattttcaatcctggaaaaaattttatgaagaaaaaacttcaaaaatttcgactttagctctaactttatataaaaaatattgattaaattttataattccaggatattgaagtagctttattcgtttaaacagattaaggaaaatttaaataatgataagtagagcttccatttttaggcacaaaaaatcgcgaaataggcacctaaaaaggcataaaaaaatcgcaaaataggcattaaataggcacaaaaaccctcaaataggctaaaataggcaa

SEQ ID NO: 55354 - DNA, 624 bp, Heterodera glycines
  Genomic contig location: Contig_ID=SeqID_24614; Location=800..1423; Strand=-
  SCN-specific regions: Sequence locations=1-105,129-624
ctgctgaggccgccggcattggcgaagtgtttctgttccgtcgtgccacagcgctggccatcagctaccgtatgctgtacttggacgaggatgaggcccaactgtgcaagcagcagcagcagtgctcttccatcgatgggactgagacgggcggcgctggcgcggagacggccgcgctaatcattccgttggacagcagcagcgacagtgataaacagcagagctggggcgaaaaatttgtggcaattttgttcatctgcgagtattgcatcgaggtggtggcggcgacacattaggcgcattaataaattattgtggggttaaaaccggcaatttttttaaacgaataataaaatttatggactaaaattatttttgcgtaattttgcaattttctctcagctgtccgtttatgacttccatcaccaccatttggcccgtctgatctcatcaaagatgctcattctcactgatccaacagcccaaactgatctcatcaacacatttttgcgacgccatctcaccatcttccgtttcaaactgttcaaattgttaactgccggcatgccgaagcaaattgcagccattgtgccgacaatcaaaaaacacattggtgcccattga

SEQ ID NO: 55355 - DNA, 2831 bp, Heterodera glycines
  Genomic contig location: Contig_ID=SeqID_4680; Location=1766..4596; Strand=-
  SCN-specific regions: Sequence locations=1-263,285-871,893-1097,1120 -2143,2165-2264,2286-2493,2531-2605,2639-2658,2682-2831
atgccgctgttgcccatcgccgtgttgctgctctcctatttgttgctcccttctccgaatgatcgatcagaaagaatgattggacagcaggacaagtatgttgtgggcacagtcaatcgggtcaaatttaaaacccaggagaacagactgaatttgttgatccgttttggattaactgatcgggaccgcactcaatttaaaactgatcaagaccgggttcatgttttgagctaatcactgatttcggattcatgaaagctccgtttgaatattccccaacccttgactgttcttagcttcacattttagtgttttttaccgaaaataatgaggagagagaattagttttggtgaacttagaagtctcaattccattttctagtcaaaataaaaacatttgtcatcacaaaaggccccttctggaggaccctttggttcgattgcccaccgatgttgtgcccattcattatgaactccatcttaaggtacagaatattttcgccaattttctatcaatggcattatgtttgaggttaattgcttctcaaaatgttaggtgtatctgccctttcgcccttctctgttagattttggcaccaaaaatttgtcggtggacggcaatttgcgtctgttgcttttgtgtcgagcgccaaccgatgtgctgatgctacacgcaaaagcgctaagcttagagcacgtcaaaatgggcacttggccggacgaaatgcgtcaattgacggggccaagagtgtccgagtggagagaacttgccgggggaaacgatttggtggagttgaagttggacaaggcaattagcagcaaatgaataagaaatgatggcaattcggattatatccaattaattagtaatgattaaaaagaaaagctgtaacggaatcggaaaaatattgcaattacaatatttaaatgcctttttaagcaattttaataattatttctcatttaaggcacttttgcccggtcggaagtatttgctggaaatcgattacaaagcaaaaattggaaaagcacacgaaggcggactgttctggggcagttacaccagcgaagacggagagatacggtaacgggccgaaatttgaatttaaagggcaaaatcctaaaaatttggaaactcgcattacgattgatatgggtttgattgcttatcccgctgagattgatcacaaatgctgatcaagattgttggccgccacccaaatgcaaccgctggacgcgcgtcgccttttgccatgcttcgacgaacccagcttcaaggcggacttctccatttcggtccaacatcctgagggcactaccgtactgtcaaatgcgccactttcccattttcggagaatggaaaggtcgccccgggaattattttcgccctaaatttaaatttccaggggttggagcttgagtctgttcgaacgaactcctaaaatggccacttatcttttggcacttactgtcagcgactttaagcacaaagaaaccaactataaggatgttacggtatgccaaagtgagatttggcttgggcataatgccaaacactaaaaacaatcgactgaatggaaatgaaacggtttaaaagattcgagtttgggtgcaaccatcgaagcttgcgcacacggaacatgcgttggaagtttctgtccgatcattggaattccttgaggaatattttgacataccgtacccgttgaaaaagcttggtatggtattaaaatgcaatgcttttaatatttgttcttttttttccttttagacatttttggcgtcccatttttgcgtgtggcagcaatggaaaattggggactgattatggcacgccaacagaatttagtgtatacggacggagtgcaggcaaaaagagagagacaatttgtcaccgatgtattggcacatgaaatagcgcatatggtaaagagaaacaatcaaaaaaagaaaagaaaaaagggcacaaaatgaaaaagtgagagacgtatcaaataaggaaaagaaatacgaattaaaatttttagaaatgcttcattttggatattgaatgcttttcatgtaaaaaaggacatttaacttgtgggaaatgaaaaacaagtgcctaatttgaatatctttaaaattaatttcagcgttatataataatagagaccggatttttcagcatcaaaaaatgctaaattaagcacgaaataagcatgaaaatggcaaaataagcacaaaaatcgaaaaaaagcataaaaatttggtgctttttaggcaaaaattttatcagttaacaataattctccatttttcttttcccactgacaattctaatattttcttagcaaaaattgacattttgaaatcaaaaagtttgtcaaggaaaaaaattttgggggatgaattgagagaaaatttttcaattaagcacaaaaataagcactaaaatgctaaattcagcacaaaaattacatgctcatcattaagcacgaaaataccaatttaagcaaaaatcagcaagaaaaaattgaacttagaagcctcaaaccaagttagaaatgcgttttcatgcttattagcacgctccaagttagcaaaaatttcagcaaatgcaacaaaacccagtctctaataataaatgatattttttgtcagtggtttggcgatttggtgaccatggaatggtgggacgatttgtggctcaacgaaggctttgccacaattatgggcatgaaagcggccgattatgccgaaaattcaacgtcgagaacagttaaacggcgcttttaaaagagatgtccttttttgattccatgggaattcaaaaaaacccatagaataaa

SEQ ID NO: 55356 - DNA, 802 bp, Heterodera glycines
  Genomic contig location: Contig_ID=SeqID_24617; Location=309..1110; Strand=-
  SCN-specific regions: Sequence locations=1-82,107-289,312-802
catttcaatctctgggactcaatccaccaacattccaatcaacgggactcaacccaccaacattccaatcattgggactcaatccaccagcattccaatcactggcactcaattctcctacatttcaatcactgggactcaacccaccaacatttcactgggactcaatccaccaacattccaatcactgggactcaatccaccaacattccaatcaacgggactcaacccaccaacattccaatcattgggactcaatccaccaacattccattcaacgggactcaacccaccagcattccaatcactgggactcaatccaccaacattccaatcactggcactcaattctcctacatttcaatcactgggactcaacccaccaacattccaatcactgggactcaaccctccagcattccaatcactgggactcaatccaccaacattccaatcaacaggactcaatccaccagtatttcaatcactgggactcaatccaccaacagtccaatcaacgggactcaatccaccagcatttcaatcactgggactcaattctactgcatttcaatcactgggactcaacccaccaacattccaatcaacgggactcaacccaccagcattcaatcactgggactcaaccctccagcatttcaatctctgggactcaaatctccggcattccaaacaatggactcaaatctccggcattctaaacactgggactcactcaacccaccaactttcaatgacattccaatctctgggactcaacccaccacatttcaatctctga

SEQ ID NO: 55357 - DNA, 123 bp, Heterodera glycines
  Genomic contig location: Contig_ID=SeqID_24619; Location=1304..1426; Strand=+
  SCN-specific regions: Sequence locations=1-4,53-123
gctcaaaatattaaatgtaagaaatttttatgatttttttaaataaaaatttgatagctttacaaacgaaatatgaaatccaaatctaagattggtgaatccgttcaattaaaatgctatttc

SEQ ID NO: 55358 - DNA, 582 bp, Heterodera glycines
  Genomic contig location: Contig_ID=SeqID_24620; Location=469..1050; Strand=+
  SCN-specific regions: Sequence locations=1-208,230-413,436-582
atgcatttgcatatttttgacagccatgctaatgaggatcggatgtgtaacgaaaataatggacaaacaaagggtggtgaaagaaagaggcaaaccaaatgtgattttgatcagttacggagctttggagttgttcatggagaaattacaaggaatggcccatacagaacaatacaacagcaaacagtaacaaaaaggtaggccagccgacccttacctttttgaaaaagagggcacattaaaaacacaaaaaagtgccgcttaaaaataagaggttatttggatgatggtccaggccaatgttaaaaaaaacaacaagttcaaggaggttgttgaagaggcattggcgaaacaacaccgtgtaaaatgaaagaagcgcgcaattgaaaaagagtaatgatcaaagtattaaagcaaattgtgcccaaaatttttgttagtcggcaaatatttgaacgggaggagagattgccgaatggacaaacatttcacggttctgttcaacgaaaccacaaacagcagaagaagaaaggacaagatatcatcatcaaaaatggacaaaatcaaaacttataaagggaa

SEQ ID NO: 55359 - DNA, 1105 bp, Heterodera glycines
  Genomic contig location: Contig_ID=SeqID_24621; Location=19..1123; Strand=-
  SCN-specific regions: Sequence locations=1-74,96-634,674-884,907-1105
atgaggaatcgatcaaacaatgaacctagcccaccgaagcgccgaagaatgccaaacatcctcaaaagtggaagcaacaacaacaacaacaacaatggcaaaagacgcaattttcggcactatgtacgcgcgctgaacaccgacgtagcgttcaacaaaaaattcagactaatgaatgctaaaagtacattcatgatccagactctaccatcaaatcctgagtcgcttttgcgagtcatttttggacattgcatacaatcgtcattagatgaagctcagagacgtggaattgaaccgagtcgacttggtgcaacaattacttcacagttattggaccctgacatttggattccgatccgtcagataactccaaacacagtggacacaattttgaatcgcttcttagatgtggcacaatcaaagtcgcgggaaggttcactgtggggtgcacccttcagtgtaatagtaaccactctggacactgtcaatctaccgcagcgggatacaattactggtcgcggatccgaacaccgaacgctaaaaggagcgtatcacatcataaaagagaaaaatctgctgaggattcgtaataataataattcctattgtctattctacgcgttggagatcagcagaatctatcactgcatggtgatgccaaaacaaactttcagtaattatattaacaaaatgcattcacaacaacaagacgctgagcgcctaatgctcgatgcaggaattccactaaaccaagaaaggtatgacgccgaagtgtgggtaccacgtgtagtggaccattggaacgcagtatacccggagctaaaatttaaagtattcatcttcggcacaacgggtcagtacagacctaaatataaatatggaccagaagaattcctgacaccaatatcgctctattacaacaacgatcattttgatggcatccgttgtggagttggaacagcaatttttggtcgcgactactactgctttgcatgcgaattgccctttaaaaatgcggacactcacaaaagttcatgcattctgaattgtaaggaatgtggtcgaattggtgcggggcggccatgcagggatgatggatttaagt

SEQ ID NO: 55360 - DNA, 607 bp, Heterodera glycines
  Genomic contig location: Contig_ID=SeqID_24621; Location=100..706; Strand=+
  SCN-specific regions: Sequence locations=1-118,141-351,391-607
gagtgtccgcatttttaaagggcaattcgcatgcaaagcagtagtagtcgcgaccaaaaattgctgttccaactccacaacggatgccatcaaaatgatcgttgttgtaatagagcgatattggtgtcaggaattcttctggtccatatttatatttaggtctgtactgacccgttgtgccgaagatgaatactttaaattttagctccgggtatactgcgttccaatggtccactacacgtggtacccacacttcggcgtcatacctttcttggtttagtggaattcctgcatcgagcattaggcgctcagcgtcttgttgttgtgaatgcattttgttaatataattactgaaagtttgttttggcatcaccatgcagtgatagattctgctgatctccaacgcgtagaatagacaataggaattattattattacgaatcctcagcagatttttctcttttatgatgtgatacgctccttttagcgttcggtgttcggatccgcgaccagtaattgtatcccgctgcggtagattgacagtgtccagagtggttactattacactgaagggtgcaccccacagtgaaccttcccgcgactttga

SEQ ID NO: 55361 - DNA, 1046 bp, Heterodera glycines
  Genomic contig location: Contig_ID=SeqID_24622; Location=114..1159; Strand=-
  SCN-specific regions: Sequence locations=1-93,310-347,485-503,565 -579,607-762,784-814,837-870,892-1046
atgattagaagaggtgcaaaagtgactaaaagaggtgcaacagtgattagaagaggtgcaacagtgattaggagaggtacaaaaattgaatgcaatttattataaattttaaaaaataaattagtcattccttttattaattaaaaagagaattttgaaatgtacaagaattgaatatttaaattaatatgaaattaatttttataaattcaattaaaaaaaatatgaaattctttattaaaagataattattattttttacataaattcttttattattaatttacaacaaatctttaaatataaattgatacaacagtgattagaagaggtacaacagtgattagtaaattcattaaattaaaacgaaaatattttttaacaaatttaattaaaaaaatacatgaaattctatcaattaaaaaaataattaatttaaacttataaaatttatttatcaaaaaaaattaaattaaatataattttttatttattaactcaacaaaatattttaaattaattaaaatcattgaaaataaaaccaaacatttaaatttattaaaagtaatgaaaattaacccaaaaaatacaaagaaaaataatttacaccggccggattcgaacctgccgcccccccccccaaaagatgactcagaatccccaatcacacagggattctgaggtctaaacgatgtcaaaagtaaaatctgatcacacgtattcgtgatcagcgtcataaaatagccctaataacatgtttctggaagatttttggtgaaaaaatttttccactcaaaaatcctggtcacccccctttggtcccgaatcccaaaatcacttttatttttgtaacatctctcaaaaaagtgataaaaatgccaaataaaatttatattatagagaaaaaaattgcggatttttgtagtattttacttttacagaatgacttttcagaagggagttctgaatttttttctgaaaaatctaaaatttccagaatttctggaataactttttttctttagaagatagaaattccaaataaa

SEQ ID NO: 55362 - DNA, 549 bp, Heterodera glycines
  Genomic contig location: Contig_ID=SeqID_24623; Location=1512..2060; Strand=+
  SCN-specific regions: Sequence locations=1-320,342-381,404-549
atgaagaagcattttggcttttcactgttctccgttggcattgctgctgggctaatgccaatgcttttcatgctgatgataatgccttcatccactgatggccatgaggtgttcgtgatgacaatggatgaacagcttctcgaagagcatggcgatcttttaaccattgagttgaaaaagggagcgagcgccatttatgtggcaactttgaagcgcaagatcgcggaagagattgacagttttcactctattcgtactatttatgcacatcaactgacaattagactagacatggtagccattatgacattgcgcttgatgacaacaaaacaatgaaagattatggcattggaagactcggaatcgtttatgcttcgacttttgaatttgaaattttcgttttgcatggtggcaaaccgtacaccatcaagatgaacaatggaaacacggtgcaaacactgaaacaaagaatcaaaagcagaattggcattccgcccgagcgccaaacactgagactcaacaatccatatgccaaagtgcttgaggaca

SEQ ID NO: 55363 - DNA, 472 bp, Heterodera glycines
  Genomic contig location: Contig_ID=SeqID_24624; Location=633..1104; Strand=-
  SCN-specific regions: Sequence locations=1-82,184-234,256-472
atgagtgtgcctttgaaagtttctaacgatgatgaagacagcttggcagtacttgcagtagtgcaagtacgttttcgaagtgtttttaattaatgattaatgaataattaaattaaatttaaaatatatattaattaaacaatatattatcatgaatgatcaaatttatttaaaaaataataacatcaatgacaatgatcaattttatccaaaaaaacattaacatgaataatcaaatttatttaattattttatgcttcggcctgccaagcccttcttctgcaggatcggcggagaaagttgatgaatcaggggcctgatcattcgattctggtgttcgaaaaagcaaccaagtgcaacagttgctttttgaaagaagaccctttgccataatcccctttttgcttttttgtgtttattttgaatgtgagttcgagtaaatttattgttgctataattttgaaggaataaa

SEQ ID NO: 55364 - DNA, 1365 bp, Heterodera glycines
  Genomic contig location: Contig_ID=SeqID_24625; Location=553..1917; Strand=-
  SCN-specific regions: Sequence locations=1-70,94-1365
tctgaagaagatgtcgtggtcgcatttgcttcatccaatgacgtgtttgatgtcgacgaagcagcaacaaattatgttcatctgacaactttggaacaattgcctgttgaagccgaagaaattcgcgatcaaactgctgcagatgatcttctacagcaagtgttttcgtatgttcgaaatggttggccacaaaagtgccccaccaacgaattaatgccttatttcgttagacgtaattcactcgcttttgtgggcggatcctttttgacaggaaacagagtcataattccgttgacgaccctccatttcgcacacccgggagttgttcgaatgaaggcactggcccgaaaacacgtttattggccgggtttggatcatgaaatcgaagtcatggtaaaaagctgcttggactgccagctagcagcaaaacttccccaaaaagctccattgagaccttggccgataccggaagaagtgtttggccgaattcatattgattttgcaggcccttgtcatgatggcaacacatatctgatcctggtggacgctcttttgaagtggcccgaaataacgcaaatgagaacaacaaatgcggcggccacgatcgatatgttgaacaaaatctttcatcgctacggagcgccgaaagaactcgtgtcagacaatggaccgccattctcatcttacgaatttcgtcaattttgcaagtccaaggggactaaacacacattttctcccccttatcagcctcattgtaatggacaggctgaacgcatggtcgacacattcaaaagacaggctaagaaaaattccacatccaaaaaacaaaattggatttcgggattcctctttgcctataggacaacaccgaataatattttaaatgggttttccccagctgagctttttcttggtcgttctccaagaactccgttgtcgattttggcaccttcacaacaacaaaacaaaccggaacaaaatcgtcagtaccaagacggaatgaaaaagcagtacgacagccatcacggtacaaaagatcgacaatttgtgcctggtaactcggttcttgctttgaactatggtaaacacagtaagccaagttggttggaaggcaaaattttaagtgggaaaggtttgatttggaaggtaaacattccaacattgggaattacggtcactcgacacgtgaatcaattacggtcttttgttccctaccaagcaggaaaagttcaaaatgatcagatccatcagcctgaactgatccacgaacaaaatttgccagccgaacccgacgaactgagcccacaaacgccgaaaaccgtccgttgtcccccaactccacgtccagtccgtgaacggcgtccg

SEQ ID NO: 55365 - DNA, 681 bp, Heterodera glycines
  Genomic contig location: Contig_ID=SeqID_24626; Location=96..776; Strand=-
  SCN-specific regions: Sequence locations=1-582,604-681
atggcattggcatggccaaaatattggcattgcatggtcaaaacaatgccaaattggcatggccaatggcacattgacatggccaaaacaatgcaaattgatgactcatctttttattttctcaatcttagagaccttcttgcgtttgctactgaacctgttcaatgcacgttggacaaactgtacgaacagttcgaaccggatgatgccggcggacccttgttggagaagctggagatgaagcggggcattctccaggcacggggcccatttggaggccattaattgggctaattaagccaaaagcaaagcaaacggaacaaatataatttaatagcaaaaagtcaatgccattcataaaacgatatgtccatataattttggcactcaaacgaaaagtgatttaaatggatttaaatgcgtcgtcctttagctgatcgaaggcctctcttacctgcacaacaatgccaaaatgttgcacggcaatttgacaccccaagcgtgtgtttattgccgctaagcaattttggaaaattggaggccttgccttttccgtagcggctaaaaagggggttaggcaatgaattttaaaaatttagaattcattgaatttttcagaatgtttttccgtgctttccttggaccaagaaattcccgccttgccttcagcctgatctcgac

SEQ ID NO: 55366 - DNA, 908 bp, Heterodera glycines
  Genomic contig location: Contig_ID=SeqID_24627; Location=24..931; Strand=-
  SCN-specific regions: Sequence locations=1-777,799-908
atgcccatgtattcaaatgcgtctgccgcggcatacgcccaatggtactacaacgcggcggccgctgctgcatacggggccggaggatatctgtcataagacatattagtctaatttatgatttcgacccatcaacgattgatttttcttttcatcaagtgcttcattttcacccgcgtattgatgagaataaaaaagttatttgtgagaggaaaccagaataaattcgctccgttcctcgcccctaaatatggcgctaattcaccaaatgcaccccagggttttggctttttctaattttaatacatcaaatcttaaattattctggcatatagtacgcaacaacaaaacaaaaaaaaactaatttaggagagataaattggatgtccgaaaatttttgagtggttttttttcataagaatttaacaaaaaaaatttttacatttttagcacacgccgatgcctttggccttttgattaaacaaaacacgcagaaaacttggttcgacgggaaagttactaatatagcactttaaaattaacaacataaaattccactacattacatttgaatattaaggtgggtcactgtcggctattcggctagaccgcttttggacccatcaattttaagcccccaaaatgttttgtaaggccagttttggacctctctcttggcccaataagccggttttctggttaggacccgtcgggcttcagcttttggcccaaaaagccggtttgtttcggttcagtgaaacggtcgccgtgacccaccctaatgacactaattaaatttaattggagctttgattcattcggttgaagtggcttgctgttgctgctgtccatttttgccaatgtcattctcttcgggagatttgcacttaattgattaaaaaaataaa

SEQ ID NO: 55367 - DNA, 836 bp, Heterodera glycines
  Genomic contig location: Contig_ID=SeqID_24628; Location=93..928; Strand=+
  SCN-specific regions: Sequence locations=1-48,77-154,178-225,251 -631,653-707,729-777,799-836
atgggcaaaattggaactggaaaatgtgagtttgctataaaaattgagtaaaattataaatgcaaaaatttctaaattattttagaaaggcacttgaacaaaaagttaaagcaccagggaattggtaggcgaacagaaggcattgaaggaaaaagtgaccaaaattgaacagaaaaacggtaacggtagagaattataatactgtaatataatggcttagaatttaattattggaatattaatatttatcattaaaactggcaccacttaaataatttgaccattggataaaaacaaatgggagggattattgtggattttctataaaataatgtttatgaactcaggttatgaaacctgttcccatggattcggaatcactgtgttcacaaattaccatccattttgacaaattttccgaattatttatcccaaattcgaacccgattcaagaatccagaattggtagaaaccataaaaaaagaaataaccataaaataatttgacaactttaaaagctataaccttttataacttgacaacaattttaaaaaattaattgaaaatttgttacaaatttcagtttcggacggtcatttgaaagcaattttggagagaattggtcaattggagaagcagcaacaacagcagacaaaaggcgaggagaaattaaaatgaaaaagtattcaatcgaattaaatgcttccattttaaatttaaaaattaatccgatttttaagctactggggggcaattgtcaaagattttggaaaaaattggtgaaatggaaaaacagaacgaaaacacggacaaaggcgagggaattttagcgaaga

SEQ ID NO: 55368 - DNA, 403 bp, Heterodera glycines
  Genomic contig location: Contig_ID=SeqID_24628; Location=1063..1465; Strand=+
  SCN-specific regions: Sequence locations=1-87,171-253,275-403
atggaaaatgatcagaagaacattttggaaagaatcttcagtgaattggagaagcagacaaagaaaaaggtgaatgaattggaagagaaaataaaaataaataaatttaacggtaaaaataatttttaatttatttaataaattattatataataattattaaaaaatatcgaattatttatttcaggggtttttaaaattccaagaaaattgttattttgtgtcaactttttggctctaaattttaatgtcttacaattagtaacatttttttggcaaaaaaaaatcgtttaatttcggcagaaggcattccaagaagagcttgagaaaaaggtcacggaacgaattgtggcagtgcagtcgaaggttgacaaaatggaaatggcacatcaacagcaaaagg

SEQ ID NO: 55369 - DNA, 1198 bp, Heterodera glycines
  Genomic contig location: Contig_ID=SeqID_24629; Location=199..1396; Strand=-
  SCN-specific regions: Sequence locations=1-102,124-295,321-973,995 -1045,1067-1198
atgctcggtattttcgtctacggctctttggcggactatcgccgtttcgtcgccgaccatccgacatttgtgcgtgaccaactccgggtggaggacgagcaaacactggagacaaaaatgaaacagttgacactgattttgttggccgagaaggcgcaggtttttattttaagcaatagcgatagaactctttttttgtggtcgaaactttattaaaacgcagaaaattaaacattttaaagaaaatttttaaaaaacaaaaatgggatgaatccgtgccattaaatggaaggacaaactataaataaatattttttcttcaatccatcagcacatcccattgaccactttggtcaacgcgttagacatttcggaccgcgatcatttggaggaatttatcgtcgatgccatccacgcgaatgccatccaaggcaaaatcaacgagttggacgaccaactgatggtcagcttctaccaacaggtgaccaatcttttcatcaggtctaagcctccgactcgaacaacaaaattttctctaattatttccaatcgaagaaagtaaaataattaaatttcgatttcacaaagaaaactataattgttctcaattttggggagggtacaacggggaaatggagaaggcaaagtatcatgccccagggattcgctcctttttgtaaaaagttgattaaattgatgtattaatgaataaaattttcagcgagtgttccaacgtgcccagtgggaacagctgcatgtccgtcttggtgccctgcttgaaaatgcgcgttggttccgtgacaatatgcaatcggtggttgcagtggaagaatagcgaaagtcacataggacgaatggagcgttttgttattgttttcgtcattattattgtttttctattcatgttataatgtcgtatcgctgctatgtgttcatcccctgtctccatatcgttttaagtggcaaaaagttgttatatttaaattattattaagttttgttgggttttaattttatgatattttggcatttgcttccaaaagcggttttaaaaaatgtttgaacccgccgatatttatcggaccaacattatgtcatattttcgctggtcctacaggaaatattaaaatacaaatcgatagttgatggctactgaccattggttatattcatatgcaactatgtaacacaaaataaa

SEQ ID NO: 55370 - DNA, 797 bp, Heterodera glycines
  Genomic contig location: Contig_ID=SeqID_24631; Location=42..838; Strand=+
  SCN-specific regions: Sequence locations=1-797
gacttaccagcacttttgtcggcgccgttctttggtttttggaacagcgcaccgcctttcgtcttaccaccgttttctccgcttgcatcgacgagttgtgccgtcaacacaagtcgcccggggcggcctcgcgttaccgctttttgctctgggcgaccgtgccgtccgcgtcgttgcgacggcgcgcatcactgtccacgcggtggggctccttcacgagtatcggccacgtcgaccaaacggtcggatggaagcgaaggcgacggacgctgcacagagaaccgcgcgagttggacgtgtacgagttgcagcggcgcggtgggctgcgcaaggtgaagagcgcgtcctcgcggcgctggtccttcctcaaccgcacgatcagcccctgctcgggcgcctcgtcgcctggcctcccctccggctccatctctccctctccgtccgacatcgtcgaaaacggaatcacgcccgaggcggaggaaaacgcgctgaacgaggcgatagcggccaactcccacgacagcaccgctacaacaatggcgggcggctcctcctcatccgcttccggctactgctccaacatctccggcgcttcggcatgcactcgcttatcggcatcatttacagagccggaggacccttcggcaccatttgacccgccgccgccaacgccccacccgagggggcccaactcattggtcgtgatgccgagaaatcatccaccaacattcactttcgatcggaatgttttggaacaaaatgaattggacggcgatgacgaaagggcgaaaaaatga

SEQ ID NO: 55371 - DNA, 727 bp, Heterodera glycines
  Genomic contig location: Contig_ID=SeqID_24634; Location=1082..1808; Strand=+
  SCN-specific regions: Sequence locations=1-550,582-727
atgcgaaaatttgagctttcgactttttgctcgaacccgggttcggggttcgacataggtcgaaattaatgtcagattctgattctccgacccttaaaaccacttatacaatgttttctcgaaaaaaaaaattttttggggggtataaactggaaaagtacctaaatttctaatacattttccccgcattttcagttggctgtgcaacgacatttggatggacattttgccgctttttcgtcgtcctcaactcggccgaaaattggcacttctttcgccacgtttcaacgcgttggtcgacaaacatttcgacagcaaaaacgaactgacaattttgaaacaaatcagaattgacaagatgaaaacaatgccgaaactatgtgtagttaagaggggcattggaatttttaagcaatttccaataccagaccatccgatgcacaacaaactccgttttagcaagcttcagattaagtaaatcaaatcgctgacctacaaaatgtccaggccacgaaatgtcgacaagagtaaaaacccacgaaatgtccagaaaaaaaaacaaaattaaattttataaaaatctggaaaataagttcaccgactccgaaaaccctaaaatagacttacagacttatttttcggatttttataaaatttaatttcgttttttctggacatttcgtggcttggacacttactttgtgggggcgccaatcaaattcaaaga

SEQ ID NO: 55372 - DNA, 1107 bp, Heterodera glycines
  Genomic contig location: Contig_ID=SeqID_4684; Location=1268..2374; Strand=+
  SCN-specific regions: Sequence locations=1-131,169-449,471-650,673 -748,772-878,910-946,970-1107
atggcctgtgcctgtacctggatccaggaaaaatacagggctggatccaggtacatgttgatctctaatctacacccataaaacacagtcaaaatcgggaagtttcaaaaaaaaattctagggggttgtgaattttttgaaaatttgaaaaacccattggaaggtaaaagtttttcacttttttttgtaaaatttttgatcaaatttttaccttttttaatttttggcttcgcgccaaaacgtgggcgccaaaacgatcctggcgccaaaacgtcggcgccaaatcgtcggcgccaaaacgtcggcgccaaaacgacccagtcccgttcacaacatcgctattcactttggcattttccttgacatatttcaccatttcgtccggcggtgtgccactacgatgacggacggccacatagcaatcgaattcttggaaaaaattaagaatatgagaaatcattttaaattttgtgacaacgagaaattcgggaagagagtgtatgttcataattaatggggtgcggatttttaggagcgaaaaagcctaaaatagaggcccaatttaaaaaaaatgtcttttttttgtcttcaaaaaacacaccagcaggtccaaaagggtggtggaataatcatgtgtaaaaacgacataggatttgtttttgaattttaaaacatggatggatgataacaattcgactccttccccgtcgatcggcggcaaccctgggctactgtatgtttgcttacgataattaaattttaaaaaaatttcagaatttccatactgtcaaaactggtggtgatgccgcattgcagaaacacaagcagcaaaagcaaaacgtttcctacaaaggcagagcaagacgtgtggtgatgcgtaattattaattcattaattagttaattaatgggctaatttactaaaaaaaaaaaaattcaatttcgttttttaaaattgtaaagttgttgttctaaaaaagagtgatccccactcctatgttccaagtctggcacgtaaccctaaaatccgttaattgacaattaaattttttgcaggaaaaatatccgagagctttaaaaacaaaaaaaaagatttttcgttatata

SEQ ID NO: 55373 - DNA, 1261 bp, Heterodera glycines
  Genomic contig location: Contig_ID=SeqID_4684; Location=2494..3754; Strand=-
  SCN-specific regions: Sequence locations=1-5,33-340,455-478,500 -506,529-533,562-645,670-746,768-989,1039-1261
atgacggaggaggaggaggaggagggggaggacagtgccaaggaggaggacgagaatgatgaggcggcaaaatgggacgaaaaaagtgccactcctgactcttttatgggctttatcattgcctcatcctcctcttccgaggaggaaaagaagtgagacggcacaatgatgacaaggaaagcgaagaagggatgagaaggatgaagaagaggaacatacggaagagaagaagaaaagaaatctcgtgatttgaatttgatcaaatgagcaaaaaaaaatgacaaataaaacaatttgtatttgatcagtgtatgtgaaaaagtgataaatatttatgcgcaaaaataattttatttaaatttattcattaaataaaaaaaattaaataacccaaaaaaatattcacatttttgcattaattattattttttaaattaaagtgattaaaaaaaatcggacctgaatttgaaggggaactcttaaaattttctgctttaaacgaaaatatatttgaattttcatatttttgcatcaattattttttgtttttaaatttaaattgatcagaatcgttttcaaaattttgcagtggaatatagaatttttggcctcaaggaaaacagtgtttgagttttccactaattgcattaatttttatttttgaaaaatcattaatgtgatcagaatcgcaccaaattttgcaggatacttcgaatttttggccttatggaaagtggaaagtattgtttcaatattccatttttgcattaattttttaattttatcaaccataactcatcttaaactgatctgaatggggtttacgggattaatcccgcgggatcacatcccacaaaaaaattgaattctatcccgcagctctggatctgcaagtttgaaatttccggtctctactttagcacccaattgtgaaagttgtgaaagtcaattagtgtgctgccaattcattcaaatttattttttcccagaattaaattaaaaaaatttaactaaatcgtatttaattatttttatttacaaatttcaacatgatcattttacatattttccattttcattttttattgaattgctgatgagttttttttttttttgcccatttccgaccacagaaatttgcttggaaagctattagaaaagctaaccatttgatttaaggcacaatcagcagagaaaagtggacaaatcatcacattttttaatactatgaaaaaaaacagaaaattccgagcaaaataaa

SEQ ID NO: 55374 - DNA, 1138 bp, Heterodera glycines
  Genomic contig location: Contig_ID=SeqID_4684; Location=3955..5092; Strand=-
  SCN-specific regions: Sequence locations=1-148,180-404,426-456,480 -616,666-702,724-1108,1132-1138
atgttcaaatacccaacaattgtgctcgtgttgatcaccttcatcatcctgcacattgctgtgcccagcgctgaatcattcatcaatctgtcggccgtcggagactttttcgctaatttgtgggactcgcgcggtaaggcaaaatgccaaaaaaacttataaaaaatttttaaaaatttcagcggacaactgtttttacgcggcccgctaccatggcaatgtgtccgaccaattccatgaaaaagtcaaatattgggagattgaggatgtgcaaaatgtgagcgaccgtcggatctccaaggattgttcgggctcattctatgggtgccagacccacgcgtgcattgatggtgcgaaattttctttaattaatgactttaattagggtaattaaggatgtaagacttttaaattaaattttttggcaattttagttaggataattaaggatttaagattttaaaattaattttttttttgcgattttcattaggataattaaggatttaatgtttcgtattttttgatgatggttttaattagggaaattaaggagcgtttttaaattccatatgaaataaatttattacagtattcctctacccgctaccatatgattttattagttaattttaattatccattttcaattattaatttaattacccaatttttttgttttaattttacagcaaaagggaaccccgtttttgtgttcaacttatgtgcttcttcggctgctgcttccggagagaacaacactggtcactgctctcaccctgaattggaagaactttgcgccatggaggggggcaaatcgaaatgtgccatttgcgagaatggcatgtgcaatgaggcgaacattgagctgcaaaatgtgatggggctggacatcaacggcaccattggcacggcggtggtggagaatggcacgaaaagtgccaaaacgggcgagaccggcggagacacgacggacgacggaaacagtgccacaacggacgcgaacggaaatggtggtgacgcaacaaccgataaaaatagtggtgccatgattcgggcgggaatttttagtggagagaaaaactcaattaggggtctacggcggggattttttaggggagaaaaaaccccaatttag

SEQ ID NO: 55375 - DNA, 1424 bp, Heterodera glycines
  Genomic contig location: Contig_ID=SeqID_24637; Location=216..1639; Strand=+
  SCN-specific regions: Sequence locations=1-122,144-265,287-425,447 -844,866-1424
atgaaccgaattctgtcggatgacaaaaagatgtccaagaaggaaaaggacgaacgcattttgtggaaaaagaacgaagtgggcgactacgaggcgactctttttgccattttctacaacaatttggtctgttttccatctttagcaccattagaccgaaattagaagaattagtcaattaatactatacaatgcttatttcactttccattcctattggtgccccaatctcagctctttttcgtgctgctcgtctttctctcattcttcattctctactccatttcgcccatcttcaactgtcttgtctcgatgtatggcgctgcgggcattgttttgctattctcaacttcaaagaagtaaagtgatgactatcattccgataatgtataatttgttattcgggagtaaacaattaaagattgttgtaatttattttaaaaagaatagcatatacatcatttgaaaatgagttacattcgttcgtacaataaggaggattcagttggcctacattgcttgttgaatgcagccaatgtcttttcccgttttcatatctgaatcccttgtttttcttcatattattgtacaattcgatcaatgccttggtaatagtaccgatggtagcccttactcttcgagaacaacttccaaatttttctcgaatccgggttcggggttcaaaattgagcctaaataaggctagaatcgtactaagcgctcggattacatctgaaaataattttctcaataatttaaaaaaagattttcgggaccaataatctgtagcattgcagccttagttaccctagcgttttaaatccaaattttcgtgtaactttttgcaaaaatctagatatagagttccattgacattgtacaacaccggcaaatttattctataaaagtttcgattgtacaacatttgcgtcgtattcatttgtaattgtccatctccgaatgttaatcatgctttcacactgcaaaattttttgtctgattaagagaaccacaactttgattaggtccaattcatcctcctaaattttgtttattatgctttttgacttcacgcattttcaaataatagcctaaatttccaggggacaaaaattagaaaaaaacccgagaatgaaatacctaatactgaaatttacatttgatttttataggggttgaacaatagaaggcccgggcctttaaatagcgaatttacggatcttgtttttttaaatgattttttttctttttagtcattttctaaaatgatttttttgtcacaaaattaattaaattttctaagcagtgattttaatttgttgattttactggaatattatcgttaaaaataagaatttttgcgctaaaagtgtgtttttcgtgcgtttctctccaacaaagcagtagaaaaaatagttaaatca

SEQ ID NO: 55376 - DNA, 75 bp, Heterodera glycines
  Genomic contig location: Contig_ID=SeqID_24638; Location=1628..1702; Strand=+
  SCN-specific regions: Sequence locations=1-75
attctctgatcaacaatgctctcaaaaaaacttttccagactatcttgaacaaatctccaaaggttggttgtctg

SEQ ID NO: 55377 - DNA, 574 bp, Heterodera glycines
  Genomic contig location: Contig_ID=SeqID_24641; Location=1061..1634; Strand=+
  SCN-specific regions: Sequence locations=1-56,83-163,210-210,236 -391,418-574
ggttcgatgaaactttttaaaatataagcctaaactttttggcctgtttaaaaaggaattaaaaatttttaaaatatttattcatctccctttttgatagtgaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaatatttattcatctcccttttgatagaaaaagcatcagagagccttatttaacttttaattaacatttggtgcgtttcagagcactttctgaaaaaatacttatgaattaattttgcaaaaaataaataagtaatgaaaaagtcagaatttcgaaaaatttaaaaa

SEQ ID NO: 55378 - DNA, 2753 bp, Heterodera glycines
  Genomic contig location: Contig_ID=SeqID_4686; Location=104..2856; Strand=+
  SCN-specific regions: Sequence locations=1-1687,1709-2045,2071 -2351,2373-2753
atgcagatggacagtctacgagattcatccaatgcttggatcgaacttctcggtcgtctgatcggagacgacaaagacaacggcgaaaaagaatacgttaaattcgacaagaatgaaaaaatcgccgaccgatacgacgcagcaacaaccaaacttcgggatttgcgagatctcgaagcaacgctcagtgccgcagccaaactgcacagaggcagagccgacagagaagcaaaggcggatcaattggccaatccgcagcaacaagcgcccatgctaccagcgatggcagcaccaatgacagtgccaacattcacagcaccgctctaccaattccagccaattcaactggataaatttttcggccaaaagcgaaaatggcccgaattctacgaatccttcaaatcggcaatcggcagtcaatcaatcagtaaagcgcagaagctgaacttactccgcaatctgctgggtggagaagcgcgagaactcatagcgggcttccggctggaagacgcaaactacgagacggtccttcagctgttaaaggacacgtacggagctccggaggaacacatcagaagtcttcacttcgaactggccaatctcaagccgtgccgaagcctccgtgagaccaaagactttctgcttcaacttgagcggcttacaagggagctgaacaatgccggagaggacatcgaaggtcctcaagtgttcctcatgctggagaagaagctgactccaccattcctacgaagcatcctcacaaagaaaggagaggatccggcaaactggacgacaaccaaattccgagatgtgctaaccgaagcagtccggaaagaagtccaaatccaagaagtgatgggagaatatggccatcactacgtccaaccaaaagcagaagtcgtctcagcagcacctgtacaagcaccgagaacaccaaaccaaaggtcacgaaggcctaaccaaccaatggcactgcgtgatatgacatttatcgcctcatcactggacgagggtcacaaacatcaagggtatgtaagccaacagcacacacaacaagcaaagaaacactgccaacaaatgcgaaaccaagtacaaagcctcaaaaagggtccgccatacccctgtattttctgcaacagcaatcattggcatgacgaatgccaaaacgtcgacacactcaaccaacggatcagcatcgtcagagaaaagaagctgtgcttcaagtgcatgaagccaaaccaccgcgcatcaaattgcgctcgaccatctaagtgctatcactgcaaacgtcggcatcccacggcactctgccgagatcagtacaaagccaagaatggcatcaacacgcctagcacctcttgcagtgaagagaagccaaatgccaacgatggcaagcgatcaacagtgatcgaacaacaacaaatgtgtaatgccatccaaagcaaggaaaccagagcgttgctaatgacgacaaaggcaacgatcttcaatccgtcacggccatccctcagcatgatgggaaccatcttcattgacccgggaagccaccgatcattcatctcgagcagtgcagctgaacaattggatctgaacgtcctcagcacggaagaatgctacttgtccagcttcggtgaacgagaaccgaagcgatacataagcgaccgcgtcgcaatcggcattttatgccccgaccaggacaggttcattttcaacctgaacgctttgaagttcctgctgaatgatttgccggtactacaactaaacgcattggataatgacgaacttcaacaaaagaagctttccctgccgaatgagtcacggcaaccggacattctcctcggaatggacgtttggcaccagctgaatgttcaaccaattgaacaactgccaagtggatttacgatttgccaatcgaaaatcggcaatatcatcagtggaacagggcgaatcgagctcaagcaaccgtccaacatctctttcgtgctaatggtcaacaacgatgaatcgccacaaagcagtaaagcggctcagaggcagaaaaacattcaacaaaaagaaaaggacgaactgagacggcatcaacgcaacaaactcttgtccagcattgcaacattgcgatcaagacggaagagagaatcggctcccatcagctcaaaatcaatcgtgattgatctttcatcagacagcgacgcatccggcattgagatcatacaaaatccagtcagggatagacaagccaaatcaccaaatgagcattcaacggcaccaattcctatggcagtgcaacggctaacaccaacaaggaagagttcatcagttgccaagcgaccagcattttcttccagcaaacaaccaaaaggaaaagtagcgaatcccgcacaaacaagccaaacaaatgaactcaacagaaaaatgaaagccttgtcgccaaccgcaagtggatcaggcgccaaccatcattgcgtcgctacattggccagaagctcggactcaacaacagtaattgataagggcagtcaacagaattgcccaaacatgagctcggcaacaatcagtaagacaccatgccaacagcactcgtccgagaagacgttaaactaagctaatcaccaacaatcgtccgcaatgacgttaaactagtctaagccatcaacaactgtccgaaacgctaatcacccggctgccacgagtccggaatgacgttaaactagcaaagcatcggccaacccacacaacaattgtccgcaatgaca

SEQ ID NO: 55379 - DNA, 1800 bp, Heterodera glycines
  Genomic contig location: Contig_ID=SeqID_4686; Location=3758..5557; Strand=+
  SCN-specific regions: Sequence locations=1-941,964-1120,1142 -1151,1174-1765,1789-1800
atgacgaatcacgaagcacaattgtggtcaacgaacgacgaattggaagtcaacttccctggaccaatcgccggacttttcaaaggcgaacaaatcagcacggcgacaaactgctttgctcaaccagcaacacttttcgtaaaacggcacaatctgcagatgttttcgccagtccaccaagttcagaactgtcaatacgccaccgaattctgccaactgcccgacaactcaactctgatttggaaatcaacctgcaatggcaacgaatgccaaacatgcgactacgagaaggcggaagtcatcaacggaaaattcactgcggcctacggagaatcaatggccacttggatctccgaagatcaccaaaaggcattaactttcgccaaaaatgcgccagaactcatcgcctgcgatggcacacgcatcgtcatgtccgaacagaacttcggaattgccaaggagcaatacgacgacattgtcaccaccacgacaagatggaaaagaggcatccgaccagaacagctcgcatcacagctctcggcatcccaagtggcaaatagaaggattcaccatgcgctggctaaaaagcctgatcgacgaagcaatcacgtggtggattcgagtcgcctgcgtttattcaaccttcctcatgctgcgcgacattgttctcccatgcactctggcgtatttactcaatcccatccgagtgactcttctcagcctcgttggagtacgcccgcagtcgacattccgacccaccgttagcaaaccactcgggatcgaagagggaatgccgctgcgtgaactgccacgaacccccaaaccaccagcgcgcagggcagagcaccgatccatgtcaccaatcaaattggacatgattgccagaacggctcggtaccaacaaccacgaacacagtgccatctcgacctcacagaagactcgccctttgggaggccgagacgaaaagaattctgacgggccccatcctttttcgcgccggaatgtcggaattttttattcctatcgccgatcaatgatcggcggaattaagagggaggaggcccttcaccaatcccccgcccgccgcgcgacatgttttcgccgttccatccctctgtccccctttccttcaaattgtcaattgtttttgtgtgttcctcccccgccccgcgcacaaattaatgaccaatttgtcaaaccgcaacttttcgccgccgtccccaattcggcgaatgagactccaaagaacgatgaacccccaatttcccgttttcctcccaatttgttcattcgttcatttttgtgccctctttttcaattcatgcccaattttcggcccattttcgttctgctcaatttcgccactttttgttcaattttgctcgtatttaatgcgacaaatccccaccaattcctacaatcagaagcaccagcaaaggcaagcaatgcctcttccgtccctctctcagtccccctcatttcattgtcctttcccccggcccaattgtccgttccatttctgtcattcacccggtcccttcattcaatgatcagtgattggcccttcactcctgtcccatttcgctgtgattttccccaattgtgataatttccagacccccggttttggtctttgttctgtggccccggtgcccttcaattctttcccatcccggtccccaattcatttgtgattaatcccccggagatggccttttttcctgtgatcaatttgtgataattttgttcaccatttcaaatattggtttaattacccaagtttgaggctttttcccgga

SEQ ID NO: 55380 - DNA, 393 bp, Heterodera glycines
  Genomic contig location: Contig_ID=SeqID_24646; Location=60..452; Strand=+
  SCN-specific regions: Sequence locations=1-366,390-393
atgttctccgtccgtttcttcgctttccttctgctgctggccgtcctttgcttttccctcgtcgagtgcggtctcatcggtatttcgaccgtttttacgcattaataatatccaaaattcgtccaaatccgtttaggcattggtgccactcccattgaagccgcttggtgcggcgtcgtcggccaagagtccacccattgcccgggaggtgcccttcacggcggatttcccgccgtcggcggaacatacggatttggccgatagaaagcggcgcatttggatacggtaaatcatttagtaaatcgtttaaatgcattgaaatataaatttaaggattcttttggactactgacaaatcgctgagagtgaaataaaataagttgaaataattga

SEQ ID NO: 55381 - DNA, 740 bp, Heterodera glycines
  Genomic contig location: Contig_ID=SeqID_24646; Location=388..1127; Strand=-
  SCN-specific regions: Sequence locations=1-372,402-549,574-593,615 -629,652-679,703-740
atggcaccaccgtcgaccaatgaacagtctcttcggcaactgatgcattcgctgcaattgcttctgcgcggaaaaggcgcgcgaaaggttacaattcagccttggctagcagtagcaggagaacaacccgaacagcacgaggaggacgaaaagaagcaaaacggggcaaagagagcggggaaaagcgacggacaaacgaaacggggggaggaagacgaattcgcaatgtgtgtcagtgaaaagtgcacgagggaggccaaggcgtgctgcagcaaagtggcggaaatgtgcgcgggggcgtaaaacgcggccaaatgccaaccatggcattgtcaaaaatgcacaaacggcacctttcggttaatggacccgaaatttaaataaaattttgtataaattttcgtcaaacgatgcaaaattaaacagacgccttatttgttaggggaaaatttgaattttaaaccaaaataaggaaaactaaaataatgacaggaacagaaaacaaatgggccgaaaaaattgaattgcggaccgatcacctcatacaaaatctctttttctttttcaaactttcacttgggaatttactgacaaattataatatttttaagtaattgaaaccacaaataaatgaacaattttgagtgaaaagcttgatattctatccaaatttattcaattatttcaacttattttatttcactctcagcgatttgtcagtagtccaaaagaatccttaa

SEQ ID NO: 55382 - DNA, 1058 bp, Heterodera glycines
  misc_feature (9)..(9): n is a, c, g, or t
  Genomic contig location: Contig_ID=SeqID_24647; Location=92..1149; Strand=-
  SCN-specific regions: Sequence locations=1-342,366-796,818-1058
  Gene Ontology: Mol. function=cytoskeletal protein binding; Cellular component=cytosol; Biological process=signal transduction
atgtgcacngaatccaccgggggctggaccaattggacgaactttcccgggtttatcaaggagagaatgaccattgaaaataagtagaaagctcaatggaacggcagttttacccagttttttttttagctacgctaagcaattggagcgatggaacgacgaatggaaccattattcggaaaagcatttgccggatgggtcgatgaagcgttccttcacgctgattttggacgagagtaaggaattgacaaaagtgcactcgtcggtcaaagagcgattcaacgacgaggtaggaaaaggcaaacatggaatgccaaatgaattcggaactcacgatttcacaggtgctgaagaccatcgaactgttcaaacgcgacaattaccatcggtcgacatttcgcggttttaaagaggcaaaggaaatggaagacgaatttgaaaaggcgcaaaaacaatggaagaaactgttcgatcgggtggaggtgacgaaacgcacttaccattcagcggcccggaccgaaaaatctatgtacattcaatacatgaacacgaagacggacaacgcacaaacggacggaacggaggcgaaggcacgggaacgctttgaaaaatgccacaaagaggtggaaaaaatggaggcaatgaataaagacggaatttgcaggtgacgcgggcgaggacggcgtacgagcaaattctgaaggaaataacggcgtacaatggcatttacatggaaaatgtgcacttgtgatgattttctccctttttctaacattgttttttcagatggccttcgtttttgagaaatgccaacaaatggaaatgaaacgacttcgcttcattttggaaatgctttcgggaatgcagaaaatcctcgtggatttggtcaacccgccaaagtcggtagaatcattggctttgctttgggtgtttctgtctcaaattacacttcagactcgtccaattgcactccaaacttcgtcaacactttctcagcacgaccgatgcgactattggcggagatttgaagcggtggtctctcctccatggcgtggact

SEQ ID NO: 55383 - DNA, 833 bp, Heterodera glycines
  Genomic contig location: Contig_ID=SeqID_24648; Location=227..1059; Strand=+
  SCN-specific regions: Sequence locations=1-160,182-278,300-503,525-833
acctataataaaaaccgaagggccaagaatccaaagttgaacacgatagtgatttcggtcgcacgtatcaacaaaaatggttcttcaaaaataattcggatttccataatcatggacggcaaaacgatcaaattcattgccgacagtgatcagacatcaatattattgatgaaatcgcatacaaatgcatcggatccccgccgctaggaagaaagcgacgaagagggcatttttttcgatggacgccgctgccaattcatcggcaaaggattcgctaccttcaaattcaaaggaatcgaagtcaagcaaccattttatgttgccaaagcgggagcacttaatttgcttggggcagcaacaatggataagtttggattccttgaaggaatcaaaaatgcaatccgcggaaattccaatcaatcagatcacttccaaaaataatgagacaaaaattcgggaagcgatcaaagaattgccatcaaaatttgagcaagtcttctcagaaggccttggtctttgcaccaaaatgtaagcctctctgatgctcaagtcggacattaaaccggtgttccgacgagcccgtccagtgccgtattcagcgcttccaatcgttaacaacgaattggagagattggagaaaatcaatgtcatcaaaccagtggaacacaccgagtgggccgccccaattttggtggtgaaaaaggccaacggatcaacgaggttgtgtgccgatttctcaactggtctaaacgactgtctccagctgaacaagcatccattgccacttccgtccgacattttttcaactttaaatggctgaaaattcttttcaa

SEQ ID NO: 55384 - DNA, 543 bp, Heterodera glycines
  Genomic contig location: Contig_ID=SeqID_24649; Location=110..652; Strand=+
  SCN-specific regions: Sequence locations=1-26,55-543
atggtagacacgtttaagcgggcattttcaaaaataaaaggggaggggtgtcaggagacactctcgaaattattcctcttaacttttcgcaccactccatcggaaaatctgaatggaaagtgccccgcggaactatttcttggaagaaggcctagaatcgctcttgaccttctccgtccgccgatccgaccaacagaaaaagacctcaaaatggaggcacaatttaatcggagacatggcgcccgatttcgatcatataatgtcggagaccaagtctttgcccgtcataagaaaggcgaagattggagagcgggcaaaatcagtgaacgaaacggtgtaatttacgctgttaatttcactgacaattcaactggacgtttccatgcaaatcaattgcatgcgagagcgatcggggacgaggacatcccgcatccgttggatgcaattgccgcagatcaacgatgtgccgcagccgccagacgagcctgtccgacgctatcccgcacgccaacggaagcaagctgtgcgtttggatattgctga

SEQ ID NO: 55385 - DNA, 298 bp, Heterodera glycines
  Genomic contig location: Contig_ID=SeqID_24649; Location=1124..1421; Strand=+
  SCN-specific regions: Sequence locations=1-1,25-93,115-124,186-298
atgacaaatgaaatctttatttttcctggttttacagcaccaatagctctcacactttacaaaattgtttccagaagaattcaacatatgtgagcaatattttttcttacaattctcatttttgaaaaattatttttatttttgaatctttttattatttaattgcttattttttaattaaaatagagaattgtcttattatttccaatatatttatttagttttcaaactgcataatttttgtttaattctcaataaaaataattattataggtatatcaaactaagaagtctataa

SEQ ID NO: 55386 - DNA, 384 bp, Heterodera glycines
  Genomic contig location: Contig_ID=SeqID_24650; Location=410..793; Strand=-
  SCN-specific regions: Sequence locations=1-384
atgacattccaatcactgaaactcaacccaccagcatttcaatactgggactcaattctccggcattccaatctctgggactcaaatctccggcattccaaacactgggactcaacccaccaactttcaatgacattccaatctctgggactcaagccaccagcatttcaatactgggactcaacccaccagcatttcaatctcggtgactcaacagaatctccggcattccagacactgggactcaacccaccagcatttcaatctctgggactcaattctcaggctttccaatcactggaactcaaatctctggcattccaaacactgggactcaaatctccggcattccaaacactgggactcaaatctgcggcattctaa

SEQ ID NO: 55387 - DNA, 477 bp, Heterodera glycines
  Genomic contig location: Contig_ID=SeqID_24651; Location=103..579; Strand=-
  SCN-specific regions: Sequence locations=1-75,111-237,278-404,443-477
atgccggagaatagaaagtgcgctaattgtttccaattagcacactaattaagactgatgggcattaataatccctaattaaaaaatgataaaaatactaattaatttttgttccccaattaagagttgaagttgcgctccgtcaagtggacccaactgttgcaattccttattgggattcaacgctagaagcggcactgccaacaccggccgattcacatttgttcacaccggaggtaaaaaaagatttaaatttaattataaaaaataaatttttgtcatagtttatgggaagtacggacagtgctggcaatttggtcactggcatttttgccggctggagaacattggacgtaagggcaactcaaattagtttggatcattagttaattagatattcaagcaaatatttgatttttgtattaattaattattatttttacaattacgatttccagttctttgtaaagaattaaa

SEQ ID NO: 55388 - DNA, 737 bp, Heterodera glycines
  Genomic contig location: Contig_ID=SeqID_24651; Location=832..1568; Strand=+
  SCN-specific regions: Sequence locations=1-105,182-234,256-272,311 -315,337-519,606-737
atgagcatgaatgttgcgagacgtggtcattaaagggggaatgtcaacgaaatccggtgtatatgaacgcgtggtgccaggccagctgcaggcaggtggcatttgataaaaagaaaatttattattaaaattgcaaatttttattaaaaaaagtatttttacaaatatgtattataataaacagattcatgtttttgttttttaaataaccaaatgcaattaaattatctcttatttttcattaaatttttagcttattaagaaaagttacctaaaaaattaaaattttaattaatttttaaaaattttacctcattaaaatttgcatacattaagaaaaagttggacctggcctgaattccgtattggacttagatctgggttttctggtcaaaatccaagaaaatccaggtctaggaaaagtctgggttaccgaaaaatgacctggacatggtccgaaatcacgaaaatccaggtccaggccgatctcgatcatatattattcaacaaaattctatcttttttattcattaattataaaaaaaatttcaatgcatttaatttagataattaaaagaatattaatttatgttttaacatttttagtgccaagttgactacgacatgttcacgggtaacaaattcaaaaattgttctgatcatttcccgctgatcagaatgcaatgatcgccacgtgaactgtgcacaatgggcaatacgaggcgaatgcacacgaa

SEQ ID NO: 55389 - DNA, 1620 bp, Heterodera glycines
  misc_feature (1217)..(1217): n is a, c, g, or t
  Genomic contig location: Contig_ID=SeqID_24652; Location=914..2533; Strand=+
  SCN-specific regions: Sequence locations=1-487,520-586,619-630,691 -702,724-1072,1094-1234,1278-1307,1330-1354,1424-1556,1578-1620
ttataaacatttggaacaagtcgtgccgtgcccttcattatttaatggaagcaacagcaccaatggccacttcaacggatgagggcggaagtccgagggcaaatatggaggagggattgttgtcattgccccgggactcggtgactttgtcagtgccaagcagcagactgaaaatgccaagacggtccaaaggtaagtaagtacaacttaattggcccatgagcttgatgggcatggcatattcctgcctctcgaaatgaatagtaaaaattttaaattttcgataaattatcaaattttttgtaaatttttgggccaattttttctcagtaaaatttaataaaagttggttttccccagcttttcccatatttgctgtacctttgcactctatccctcaagaattaaatgaaatgaatgtgaaaagagcggaagagagaaaatgaaaattatagatgcagagcggaagtgggaaagagaacggggcgagagagagaagagagggagagagagagagagcgatagaaattgaaaatagagaaagcatagagacaaaagtggcagaaattggagatacaataggcataaagaattgtgaaaataaatagctaattcatagaataaggtagcgagagagagagagatagacgagagaaagaacaaggagagagaaacatagggagagagagattaatatatataaagagagaaataaagagagagtctgagtgcaaagagatgtgtgccaatttatttgctaattgctttgtttgccgccgccactttatgccaatggccatgtaatgaaaagccatctttattattacagaggacaggttgttgtcggcattaggaccattcatttatttgttcctgccaaagtcatcccatcccattaaatcccctaatttatttaaaaaaatgttttttgttcgccaattagaaagcttggcgttccatcgcgacccgttcaatcggccggaattggtgcacaccttgcgcgggcgtgagcttgtactgtttgtgttactgtacgcaatcggtgtgattgccattgtgttcatatttggtgagtgcttttttgtgtggcattttgccgaaattggcattccaaattttttgtttgtagcacttttatattttggtttttgagttgcaacaaaattttttgtcctattttttattttcaatatttcaaaaaattgccaaaaaaacgnaaaaatgttcccttgagaattaatctatttaaaaaattgaattataatttctattttaaaccaatttttcccgtctaaaagtttttagtgattttaatgaattttaagaaattatttttgtctctgtgaaaaaagggtaaaaatttaaatgaaaaatatcaatttttcatttttatgtcaattttaaaatttttaaaatttaatttcaatcaaaaacaaaaaaaatggcaaagtttttcgataacaattacaaaaaacagagtgtacaatgcccgtgttttggatcaatgatcaaagtcgcgcagagcagcgccgtcgtgccgcaattgtggtccgatcggcacagaaagtgatgctggacagagaaatgccatcgtcaattggcccactcagaaagacatga

SEQ ID NO: 55390 - DNA, 1812 bp, Heterodera glycines; identical to SEQ ID NO: 24653
  Genomic contig location: Contig_ID=SeqID_24653; Location=1..1812; Strand=+
  SCN-specific regions: Sequence locations=1-570,602-712,764-1029,1051 -1362,1388-1634,1659-1812
  Gene Ontology: Mol. function=electron transporter activity; Cellular component=extracellular space; Biological process=thyroid hormone generation

SEQ ID NO: 55391 - DNA, 1581 bp, Heterodera glycines
  Genomic contig location: Contig_ID=SeqID_24654; Location=1..1581; Strand=-
  SCN-specific regions: Sequence locations=1-267,306-827,890-893,918 -1207,1249-1581
  Gene Ontology: Mol. function=beta-mannosidase activity; Biological process=glycoprotein catabolism
caccattttcaaatgccattccaattaattatgttaatgttcgccttaattagcccctttcactttgtctcctcccgtttctttgatctcgatggaatttggcacttttcttctcaaaattggtctaaattttcgggaaatgcgaaaggttccgggggggggggagtggcggcataagtgccgtttttaaataatcatcgtttttaagtgcccggcgatatttacgccgatttattcaccaacggatttattgaagtagattgattcatttaaattaattttttattttaattttttctaattttggaggaccctttgtttgggaacggcgacggcttttgccgatgggtgccacggcaccgatggatttacgaaaagaaattcgaacttccggacgaagcgcacaaggcgagaagagagttttactggtcaaaggcaatgcgcagtaaattgctcatttcgtgcgcagaaatttcactttggatatttcgaaattgaccaatttatgtgaattaataattgccattttaaattccattttaatttaattaatttccccaatttttggctaattttttgcttctccatttgtccggcatcgattcgcccgcctctgttctgctgaacaatcggacaattgcccaattggacaaccaatttgtgtccaattccgttgacgtttggtccgatgttttgccccgtgaaaatattcttcgaattgaattcgaatcgcccgttgaggaggccaatttcagggcggaaaaatacgaagtgagagagaaaaagcacagattgaaaagaggatttcatttatgctcacattaaacaataattaaatcaaaattttataaattcattaaattttatttttaatttattttttattttaggcttttcatggccacaaattgccccccgtaaaatttgtttaaataactaaaaatgctttcgagtgttttgcagcagtgcaccccgcccatttacaacggggagtgccatgtgcaatttttgcgcaaaatgcaggccaattttggctgggattggggcccgaggtctgtccatttggcatccaattaaatggcactaattagttgctcgattgccttttgagttttcccaccgttggcatttggcgtccaattcgcttagaatttttcgatttgctttccattcgacgcttttccccggtgatcagtctgggcaacggttaaaaaattcccaaaaaattttattgtgattttacaattagtttagatgaatgttttgtgatttccgtccgcctttctttgatttgtgccgtcgaccatcaaatttccatcaaattgagcttaatcgaactcggaatggacaaagtccctaattatttgtccttcaattcattagctaattaacaccgctttaaggaatttattgtttcaacgggaaagggaccaaatttggagttggacagtttgaaaatggaaattccggcaaaatcggtccaattgtggcacccaatcggatacggaaatcagtcgatgtacactttggaagtcaagataacggaaatgggtaaaatttgggcataaagtagagataagt

SEQ ID NO: 55392 - DNA, 425 bp, Heterodera glycines
  Genomic contig location: Contig_ID=SeqID_4688; Location=22..446; Strand=+
  SCN-specific regions: Sequence locations=1-425
atggactcttcgtctccacacgccaatgccgtcacaaaaatttcagcggatgtcctcaaaatgaacgtgtgttccattaaaatctcccaaacaaaaaaaatttgggtttcttaacggaaaaacattttagtttatgaagaagacgatcactcgcattgagcgtcaaaaaaaacagaatgaaagggaacggacgaaggagcaaatttcggcagggaaattggaagtgttgccgcctcggcattatccgacagtcgaacacatcgacgacgacccgaacatgtgagcgattttcattccctccaatgtcttaaattctgaatttcagcacattgggcggagtgatgaccgaatggcgttactccgttctcatggacaacctccgctttggccgcttctcatttaaaggacaaaaccccgaagttgag

SEQ ID NO: 55393 - DNA, 481 bp, Heterodera glycines
  Genomic contig location: Contig_ID=SeqID_4689; Location=686..1166; Strand=-
  SCN-specific regions: Sequence locations=1-182,204-481
atggccaattttttatacatttattcgtctctccgaattcttcctcagtccgtctcatccgcattttcaatgtaataattcgtaaatttttattaaaattccaatatttctttattttcagcgttcattgtcagcgtaatattagcattgataataaatgtcatcagcagaatcaggcaacaaaaggacgttaaaaacagctcacaattcggttatttttaggcattcgctaaagggaacaatttccaattgccaaagcagcaaaaagacgcgcgtgaaagggaagcgttggagcgccaattgcgcgccgcaccgcgcggacgcttttcgttgccaaatgtggacagagtgtacaattcggacgaagtgtacgaggaactttgtaaaccggccaaggacagggcaaaagcactctttttgttatcgattgtggtcataactgtttgttttataaccgatttggaacacagtcggaaataaa

SEQ ID NO: 55394 - DNA, 1990 bp, Heterodera glycines
  Genomic contig location: Contig_ID=SeqID_4689; Location=170..2159; Strand=+
  SCN-specific regions: Sequence locations=1-32,82-502,525-794,816 -1194,1217-1225,1247-1287,1319-1474,1496-1723,1815-1990
atgcaatttcacgaacgaagacgcaatggaatagaggacgaagaggaggaggaggaagaagaacgggaagaggaaggagaaaagcgaaggttggcaaaactgaaaaatgggggaaaggggaccaattaattggcaataacaaacggacgatgttttgctccaggagtcgagaagaaggcgaactcagtgacgaggaaggggacggaagcatagtcaaattggtggaggaagtgagaaataaaggccgaaaaagaagggacggacgcaaaaggcaaacgcaaaagatgggaaaacgaacggacattaaaaggagaaggaggggcaattgagaggctaatgcaattgttattatgctgtttatggtattttattataaataaaagtgaattgttattcctttcggtgtcagcagcagaaaacgccaattgtttcttttttcatgcccaaataaaaaggaaaatgaaattctaaacggcgatgggacgataaaatttgcaatttcagtaaacagctaaatttatttccgactgtgttccaaatcggttataaaacaaacagttatgaccacaatcgataacaaaaagagtgcttttgccctgtccttggccggtttacaaagttcctcgtacacttcgtccgaattgtacactctgtccacatttggcaacgaaaagcgtccgcgcggtgcggcgcgcaattggcgctccaacgcttccctttcacgcgcgtctttttgctgctttggcaattggaaattgttccctttagcgaatgcctaaaaataaccgaattgtgagctgtttttaacgtccttttgttgcctgattctgctgatgacatttattatcaatgctaatattacgctgacaatgaacgctgaaaataaagaaatattggaattttaataaaaatttacgaattattacattgaaaatgcggatgagacggactgaggaagaattcggagagacgaataaatgtataaaaaattggccatccactgcaatgaaaaataaagcttatagaaacatgcgctaattaatttaaaaagtgctcccattagtagggccgggacttttagtgactaaaaatctcaaaatagttaactaaaatagtgagtaaaaatgccaaaatagtgagaaaatagtgccaaaaagtccaaaatagtgacgaatagtgacataattttcagccaaaaattgagcaaaaataatttttattcactatttgcagttgcaaatgagtaggactgggatttttaagggcaaaaaatccaaaataggtacctaaaaaataatttttagaattaaaaatttttgcaaagaaagtgaattttgtgaaaaatttttcatttcttaggagtgatttttgaaaatttttatgtcgattcttaggggtgtattttttgaaaaaaaattttaggtcgattcttaggggtgtattttttgaaaaaaaattttaggtcgattcttaggggtgtattttttggttttattgcgtttttgttaaggaattttccaaaaaataaaaatagtgacaaaacgccaaaatagtgatttctagtgactgataatgacatcagaatcgaaaaattttaacgcagaaatgcgttttttgagctcctttcttcaaaacaattaagcaaaaaaaaagttttttcactagaaatcccggccctagttattagtgccattttttgtttttattttttagaactggggtaaacccaactcatccaaacccaactcatccatacccaactcatccatacccaactcatccatatacccaactcatccatacccaactcatccatagcacgatacgagtcgtcgccgtggcatttaatgccacgactaagaccgtacaaccaaaaaatactacgactaagaccgtacaaccaaaaaatactacgactaagaccgtacaaccaaaaaatactacgactaagaccgtacaaccaaaaaatgccacgactgagaccgcataa

SEQ ID NO: 55395 - DNA, 845 bp, Heterodera glycines
  Genomic contig location: Contig_ID=SeqID_4690; Location=57..901; Strand=+
  SCN-specific regions: Sequence locations=1-87,109-200,223-227,251 -466,488-845
atgcaggaactgactgacgtggaaattctgcacgaaagtgaggatggtgcgaagctgttggtggacgaactgatcaaaggccatgttgtggaaacactggtgcagcagccgctggtgaaactgaacgagcaaatccaagacgaagcggacgccgtttacaacgcgatgaatgtggtggaaaatgcgagtgattcgtttttggcatttaaacggggaaaacaattttcaaaaaggacatggactaatatttccccaatttgaaatttccccctctttttatttgccttttgtttcagttgctcgacttccatccccaggccaatgatttgtgcgtctcccagggcctcttcgattggctgatggtccgcgcgacaaagcgaaaagtgttcgacgccaacaaattgttcgccagccaattgttcgctatgctccttcagtcgtgcgagtcggcacggaaaaggctgacggagaaaagggatggcattgacatgacattgcgagtgggtaataccaacggaatgccatagtttaatttgtataggcacttgccgtgtacaaacgacacaacccgggcagtccggacgaacacgagcacatggaaaatttgttcgacgctctctgtgccgcgcttatgtacgtgccgaaccggcaggtgttcctcgacggggaaggacttcaactgatgattcttatgctaaagtgaggcggggagaacaatttgaattgaatttggcattgtttaagggagaagaaaatgtcgcgggagggcgccctgaaagtgttgagtcatgcgactgccatccccgacggtggccccaactgcgacaaattcgtcgaaatttacg

SEQ ID NO: 55396 - DNA, 1421 bp, Heterodera glycines
  Genomic contig location: Contig_ID=SeqID_24658; Location=259..1679; Strand=-
  SCN-specific regions: Sequence locations=1-107,146-320,365-780,806 -820,842-1343,1365-1374,1401-1421
atgacaattcaatttgaccaaaattgccctccaatgttgaagagaatgtgctttaatggagttgaacaggttcgcgcacttctcgctcgaccaatttgcgcaaatggaaataaaaaaataattaattagtgaaattaattaattactgactcaaaaattaaaccaaatatttcattcgaagcgagcgagagaaattaaataaaaaaaacaatttgaccaatgattaatcgttcgcccgaatttagcgaattcttctaaccgaagttgattttgtgtattacaaatatttatttagacaaacgaataattgtttttctgtgttttaattaaatgaatttaactaaatgattttaattttttaaatgtaaagttcttcacaggctctattagcctactaaaaattacagaaaattttgaactataaaaaaagatagaaataaaaaactttgaaaattctgccttttttgcggttttaaactgacaacttttttgagagctgattaatcactgagaaatagcttataaatatcttctaaacatctagggctttcgaatgataccatgattgtgaagtttggccaacaaagaaaaaagttatagctttttgaacattgctgagacggagttggccagacggagttgacccctaccgtaaattagtggtgagcaacaattaccagtcattaagacacagttagttaaacggggaaaagaacacagtgaaaagagaaataggacaaaggaaaagaaagagacaaacggaaaaaacgcgtgcatttctttgtttctctttccctctttttaacccatacaaaaaatgtgcccagttttcttttcttttatataaatggtgccgtttttgtgtccgtcgcgggcccagtgaatcggcgttcggtgcgattcgtgcggagagcgaagtgcgaccgtttgcggagggatggaggcggcgaggcgacatcaaaaagacaaaaaaaattatggtggcggcagcctgtgcctggaggataattatcgttgataattgcggagggacgcgggcaagaaacgcgtcggtgagcggactggaggattttatccgtcccgatgatgcagacaataaagtgtcgtctcctttgcttcgatgaagcggctgggctcccacttttttgattttgttttgtacacacacgataccgtattccctctgagtattgtacacgttaccatattcactctgttaattccccggggctctatctatttgtcaacctcctccaaacagtgaaattttggacggggccactaatagatggtgacaaaagggagataataattatattaatatgtttattcgggtgggcatatgtaattaaaaaattttttcctggaaagaacttatttttaatttaattataaaattacaaaacacaatgccaaataaa

SEQ ID NO: 55397 - DNA, 70 bp, Heterodera glycines
  Genomic contig location: Contig_ID=SeqID_24658; Location=1..70; Strand=-
  SCN-specific regions: Sequence locations=1-70
aaattctttcttttcaatggtcaaactgaatatcgtttcctccacttcttcaccggcggtcgcaacgccg

SEQ ID NO: 55398 - DNA, 291 bp, Heterodera glycines
  Genomic contig location: Contig_ID=SeqID_24658; Location=1025..1315; Strand=+
  SCN-specific regions: Sequence locations=1-291
ttacggtaggggtcaactccgtctggccaactccgtctcagcaatgttcaaaaagctataacttttttctttgttggccaaacttcacaatcatggtatcattcgaaagccctagatgtttagaagatatttataagctatttctcagtgattaatcagctctcaaaaaagttgtcagtttaaaaccgcaaaaaaggcagaattttcaaagttttttatttctatctttttttatagttcaaaattttctgtaatttttagtaggctaatagagcctgtgaagaactttac

SEQ ID NO: 55399 - DNA, 485 bp, Heterodera glycines
  Genomic contig location: Contig_ID=SeqID_24661; Location=318..802; Strand=-
  SCN-specific regions: Sequence locations=1-168,207-485
atgccatcaatggaaccagcaaaatttggcatcggtatagttcaaaggaaaatgccaaagatggaggacaacacagacctgaacaaaatcatgacaacgaacaggcatggcggcattggtggtgatgccaatgccaatacgacagatggtggacgaataaagcagtggaagaggatggcgaaagcaaacgaaaacggtgcctaatttttacaacccattccggtggactatgaccatggcctaattagcaccataaagatatttttgtataaaatatttgaaaattgactcattttggttcaaaatacgaaaattttcaaaaattcgaaaaatcaaatctcaaaattttgggcaacaatgaaatattattggcaattaagctagcaattcaaatttgtcactgtgaaaaactggttatcctaaaaattagtgatgagttctgccgattttaatgatccaattacgtataatctactgccaataaa

SEQ ID NO: 55400 - DNA, 1743 bp, Heterodera glycines; identical to SEQ ID NO: 24662
  Genomic contig location: Contig_ID=SeqID_24662; Location=1..1743; Strand=+
  SCN-specific regions: Sequence locations=1-54,77-494,571-1138,1180 -1203,1234-1743
  Gene Ontology: Mol. function=cell adhesion molecule activity; Cellular component=cell-cell adherens junction; Biological process =embryonic morphogenesis

SEQ ID NO: 55401 - DNA, 721 bp, Heterodera glycines
  Genomic contig location: Contig_ID=SeqID_24663; Location=101..821; Strand=-
  SCN-specific regions: Sequence locations=1-254,276-452,476-687,709-721
atgtttctcatttcgattgctttggcattttctattcaattcctttcttctgttgccgaccccgaaaatcaacttggctttaaatgcacaaatgtttcaaattcgcaaaattatggctgttctgtggagggaaatgttttgcgcttttttgtcatcggtgacatcggtggggaggagtatacggtagagggcaaacagcagcagtgtacggtggaaggacacggtaagttgaagagggagaacaaaataacattttaaaatgagagaaaataaaataggaatatacaataatcacttaaacgcatatgtgaccactgtgagttaaggaacggtggctgattgtgagaaaaatcctacggtagtaaagtattatcgtccaactgtggcacaaaaagcagtggcaaaggcgatggattcgcttgctacgagtaatggagtgacacctcgaaaagtaattaataattaattaattaatcctaacaacaaaaaactaaagttttgatataaaaattctttaatttctcctatcaatttttatttgtaaaaattaaacaaattgtttttataggattttacaaaagtgtttgcttctaaaaagtcgaaaaaagaattgtataaaattgcttctggagaaatggcaccccattttttgttgaacgttggcgacaatttttacgacgaaggcgtaacaaaagaggatgttgcagagcgttttgaacag

SEQ ID NO: 55402 - DNA, 801 bp, Heterodera glycines
  Genomic contig location: Contig_ID=SeqID_24664; Location=261..1061; Strand=-
  SCN-specific regions: Sequence locations=1-284,310-648,670-681,727 -734,756-801
atgttatttccacaattgatcagtgatcacaaattttggccaattaaggaattgatgaacccgaaaaatgacttttacgagaaaaatgttgacaaagtgacattggccattgatgtcacgttgaatgatgaaaaaacgcaggagaaattcatttctgatcccaacaaatccagcggaacactttcaatggaaattgaaaatttgtccgaatttgagcgagaagttattgggagtgaacggagaagtgaaacttggcacatcaaaggattttcgtggaaaatattggcaaaaatagaaaagaaaaatgagaacactgatgaaaagtggttgagtttctttattttgtgcaatgctccaaaagaaggtgctagctaattatcattaatatgtatttactaggttgtaccataaaaacttgtcgttttttgatcaaatttttttatttactaatgatgaaaagattataatgaataatgagggctacaatttcaggtttttgcctatttttttctgagctcctaatggcctgaaaagcacgaaaataagttgtttttttggtgttgttaaactacttttcgagtttattagtgccaatttactaggttttatttatagagcaaccaaaaatacaccccctaagaaacgacccgaaaattttcaaaaatacaccactaagaaatgaaaaatttttataaaattcatctcaaattattttaaatttattttcttgacaagttttgcttttttgaaattgtttatctcaagactgatatggcttaattttattacttttttaataaa

SEQ ID NO: 55403 - DNA, 691 bp, Heterodera glycines
  Genomic contig location: Contig_ID=SeqID_4691; Location=129..819; Strand=+
  SCN-specific regions: Sequence locations=1-76,98-229,258-624,646-691
atgaggcgcgaacttgagcaacaagagctggaattgtttatgttgtgttcccgtttagttcgacaattttgtgaggttggttttacagtgtattttatctatgatatatcaaataggagggggggggcgggggttgggaaaatgagtggttcggcggtgttataggcgccgcggttacttttttataatgtttaattcaatttgcaagattttgtccaaaatgactaggttttgggccaattttttaaaaaatatttagaactaaggacacttgggaactctgtcaaaatatgatgattttcagattgaccacaaaatcagcgccgaggacagaaaaaattttttcggaagatactgtgaggttacgacatggatggagcataatgcaggtgcaccagctgtggaagtgactcaacaaaaagaggcgttcgaacatctgtaccaatcaatcattgacggagcgtcgggcaacgactatgtcgcgacaacgggttgtgtggctgggacgtcatccgccaacgaagtggcggtcaccggatgtttgcctggaaattcgaagaaggatgaaaaaggcaatgtcgaaacaaagaaaaggaagagagaaagcgacgaaaatgaagaatgaatggtgtttatgcttttttaaaattggtaaaaagtgtttaattttttaatgtttaattcacttcaa

SEQ ID NO: 55404 - DNA, 856 bp, Heterodera glycines
  Genomic contig location: Contig_ID=SeqID_4691; Location=2532..3387; Strand=+
  SCN-specific regions: Sequence locations=1-111,133-535,557-856
caaaaagtccgattgtggtcgcaggtggtggattggttggtctgtcagtggcctacggcttggccaagcgtggtaagactcttgcatcaccaaagtacaaaaatgtacagattgaaatggatgtttattttcaaggtgcgaaggaagtctttctttttgaacgccattggtacttttgcatttttaaaataattgttttcttggcaaatgcagcatcggtgctcacaattcgacacgcatcagcacgggaatgatcagtgagtgattgttggattggtaacactggggaatattggctccacaaaacaaacgttttttgaaaatagtaacccggggttttcgaggcttattttcacgaatataatattatttgcaaaaagatatgatattcgtgattataagtcacgaaaatcgccgggttggtctttaacaaaaagaaaatgattttttttgtggggtccatattttccattataaccgttggatttggtttcatttattgggggagtgtcggtcgaatttaacttgtgagctttccaacattaaaccctttagacaatccatgcttttacacggatcgctctctccaatccgtcgtacgcaaatcgcacgaattatacgcagaattggacaaccgcgggacattaggtaatccgtcaacaatgatataagagtctcaaaacgatgagactttgaaaaacttgacgacccctttaattccgacttcttcccctgttgttagggttcactcgctgcggtcgcgtctatttggcgtccagcgacgacactgccatccaagcgcggcgtatgttcagccgactcagcgccgacccggccaattcggcagccgaactgg

SEQ ID NO: 55405 - DNA, 868 bp, Heterodera glycines; identical to SEQ ID NO: 4692
  Genomic contig location: Contig_ID=SeqID_4692; Location=1..868; Strand=+
  SCN-specific regions: Sequence locations=1-224,246-345,391-595,618-868

SEQ ID NO: 55406 - DNA, 927 bp, Heterodera glycines
  Genomic contig location: Contig_ID=SeqID_24667; Location=161..1087; Strand=-
  SCN-specific regions: Sequence locations=1-302,325-539,561-927
atggccggcaaggccgctgaggagctattggtgggacatagctacggacatggtggagatctggtggccgctcggccagtggcaaaagaggtcggtacatttttaactcgtcagctgaagtttttaacgccaaaaatgctttatttgcgaccgaattactttggactttattgcagtttacacgaccataaaaagcatatttaaggattaattaattctggtatcattcggcagctcaaaaacttctttactattactcgcaaatttcagcgaaattaaacggtacttcggtcggtgatctatttaattttccccaattttttctgctcttcgccgttctttcccattcaattaaattggtaattaatccatcctcttttgtgtgcctcgggtggtggtggtccaatttcatgagaaaattgggtgtgagaaatttgcataaatgaaatgtgacgaacgatggatgagtgcgtttccattccgttctcgaggagagtctttaaacttttaaactcgagaacgtctcaaaaattgaaaaagtactttataaaatttaattatcgaaccatttgctcttccatatttgacatccaattttatttgacaaattaaatattagcggctgtaaaattcctacattcttggtatcaaaaaaagcttaaattctctggtaaacgctgacttaagaaagaaattgcaatgagaaatccgaaattagaattttcgagtatatttaagaaaattttttgtgctcatccattggacgcttaaattggaatagagcaaaaagtcacatccgtttatttttagcaatttccgcctttgggaattgtttatgaatgaatggcaaaaccaatggataaaagtttcttcaagcgaaagtcctcattttgatgagtgacagcgtttgatgaatatggaaataaa

SEQ ID NO: 55407 - DNA, 464 bp, Heterodera glycines
  Genomic contig location: Contig_ID=SeqID_24669; Location=377..840; Strand=-
  SCN-specific regions: Sequence locations=1-314,336-349,371-464
atgccatccctgacatacatctacgaaattttcgacccattggacgcttcttggcccgttcaagtctcgaaatgccaatcgctttgctcggccgtcggcgctcggcgtgtgcaaccaaatgaaaagcgcttggccggcagttgcgctttcccaattatttggcccgatcagattggggaacagttgaccggaatcaatggtgttgggattcagatcagtgagaatagttggcgaaatgagacggcgcaatttgtccaggcatttgccccaccgaaaggccaagtggcgaatgccaggctcaaagatgggccaaacttcacgtgccaccacctcccaaattgtgccttcatcaatcagagacaagaacaaattggtgcctttgtcgaagatttgcttgttgcgacggagaaaagcgatcacagagtggtcgatgtaactgaaaaatggactctttttatgtcgat

SEQ ID NO: 55408 - DNA, 1079 bp, Heterodera glycines
  Genomic contig location: Contig_ID=SeqID_24670; Location=438..1516; Strand=-
  SCN-specific regions: Sequence locations=1-1011,1043-1079
ggactgaacaaaacagtcccaccctcgaatatagccccatttttgaagggactgaacaaaacagtcccaccctcgaatatagccccatttttgaagggactgaacaaaacagtcccaccctcgaatatagccccatttttgaagggactgaacaaaacagtcccaccctcgaatatagccccatttttgaagggactgaacaaaacagtcccaccctcgaatatagccccatttttgaagggactgaacaaaacagtcccaccctcgaatatagtcccatttttgaagggactgaacaaaacagtcccaccctcgaatatagccccatttttgaagggactgaacaaaacagtcccaccctcgaatatagccccatttttgaagggactgaacaaaacagtcccaccctcgaatatagtcccatttttgaagggactgaacaaaacagtcccaccctcgaatatagccccatttttgaagggactgaacaaaacagtcccaccctcgaatatagtcccatttttgaagggactgaacaaaacagtcccaccctcgaatatagccccatttttgaagggactgaacaaaacagtcccaccctcgaatatagccccatttttgaagggactgaacaaaacagtcccaccctcgaatatagtcccatttttgaagggactgaacaaaacagtcccaccctcgaatatagccccatttttgaagggactgaacaaaacagtcccaccctcgaatatagccccatttttgaagcggttgaacaatagagcccctggggctttattcgaagaagtacggtatatgaaatgcaaaattatattttggatattattaaataaagaaaatggtggagattaaaggcattaaatgctcatttttcaattttagaggggaaattattaatagaatttagaaaaatgaccaaattgtaagaattatttgctttttctgcccgaaaaattatttaattgtattcaaacaaaaacacattcgaattgatttattgaattttctatgatgtgtaaatgaaaatttatatagaaatagcaaccatagataataaa

SEQ ID NO: 55409 - DNA, 165 bp, Heterodera glycines
  Genomic contig location: Contig_ID=SeqID_24671; Location=268..432; Strand=-
  SCN-specific regions: Sequence locations=1-127,149-165
ctatacccaaaacggtctgctgaacatgttggacaggaatcgacggataaagtgagaaaactttttagttttccattgcgttcatttgtcctcttcagaaaatgtccacaaaaattccaaaattacaaggagaaattttgtgtcatcatttgtctggaggaacgg

SEQ ID NO: 55410 - DNA, 819 bp, Heterodera glycines
  Genomic contig location: Contig_ID=SeqID_24673; Location=158..976; Strand=-
  SCN-specific regions: Sequence locations=1-193,217-359,381-819
aaattaaatccattttttcggggtgaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaatttttttaaaaattttttctccatcttcctttttgatactaaagcatcagagtgctaaattaagttgtaaataaaatttggtgcgctttagagcactttctgaaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaa

SEQ ID NO: 55411 - DNA, 504 bp, Heterodera glycines
  Genomic contig location: Contig_ID=SeqID_24674; Location=48..551; Strand=-
  SCN-specific regions: Sequence locations=1-41,65-322,418-504
atggaaacttcttatgtaattgtgaatggaaaagtgagtacatttaaaaaatattaaataaaaagaatgatgcaaatattttgcagactgtgactgaggacagtgcgaaaagtgaaaacagcttgccatggatcacgtccaacggatggtcaggcatcaattttgttgaaaataaatttgaggtgaacatcaaaaacataccgaatataataaaaatttaagagtgttaacaagactttgtctgcaaaaaaggtctttgtctcgaaagcctgggtgtaagaaaaaaattggcagtgttatatcaacgaaaagtcaattatggtaaaaaaaaattaaataatttctcaaaaaaaaatatacacataaaaaattttaaaataaaaaatataataaagttcaaaaatatatacttattttctgtagaaaactacaaacacgcaaaacgtggcatctagcattgaaacttatgctacggttctttcacgaaaaccggttagcaaataa

SEQ ID NO: 55412 - DNA, 226 bp, Heterodera glycines
  Genomic contig location: Contig_ID=SeqID_24675; Location=610..835; Strand=-
  SCN-specific regions: Sequence locations=1-226
aaatcagctcacaaagccaaaatacgagtcaaggaaaagccttgcaaaaatcaccacccgggctcacattcgttgacccgaaagaattgtaaagaattaaaacgttaaacataatttatataataattacaggaccatgtcgcaatacaagcgcgctgattttccacccgtagagcgtccaaaaggatactctcaattctcaacacaacccactgaaaaagtctaa

SEQ ID NO: 55413 - DNA, 607 bp, Heterodera glycines
  Genomic contig location: Contig_ID=SeqID_24676; Location=172..778; Strand=-
  SCN-specific regions: Sequence locations=1-120,142-231,298-483,509-607
atgaactcaaacttcggacgagccctttttattcaacattcgccagcagaagtgtcgaagcaaacacgtgagaattggaaaatgtagcatttctaaattcgtatttaaattcaatttttccttaattatttgttttaaatttttgaagacaattattccaaaaaaatctattgagtagagatgcaagggatcgaattttaggaaaaaccgggacaataaaccagggccatcaaaaaaagtatttattaattatttttcaaattaataaaatcattagtctttaatttaaaaaaataagaaaacaattggaacatcgtaatttggacgtttcgggattgaattttttcaaattccctaagattttctcggtgcataaaaagtgagaaatttagtttactgttaactttaatgtttttaaaatttgtaacttcagtgaaatctgctaaaaaaattcaaaaaggctttcttcttgcgcttgcgcactttgtttttgtttccaaaaaatctgatggatggagggcgacaattgccgaaaggcacctccggagataattttgaatttaacatatttcacaaaggtaatttttttggtcaaatttgaaataaa

SEQ ID NO: 55414 - DNA, 421 bp, Heterodera glycines
  Genomic contig location: Contig_ID=SeqID_24676; Location=887..1307; Strand=-
  SCN-specific regions: Sequence locations=1-343,365-382,409-421
atgacgcgggtcagttattatgatgttttgttttttgcattgtctcacaattaccactttttttatttaaaaattactttttcagattgtatcaaatgtaaaagactccaaattgggcaaagatgcgattcagcagctaaaggtggcaacagaaactgccgaaagagttgctcaacaagttggcgaaatgcaggcgtataagcaagtgtcttatatggccaaggaaatcgaccgattggccgatgttcgaatgtataaaaggccaggtttgttaatatttaaatgtcaacggtacacttgaaagtagcccgtcgtggtgttcaatttggatcctttttttttaatttgaaataacaaaaatttttaggaagtgccgaactgaatttaatgggagaaaaaataaaacacaattgaaaataaa

SEQ ID NO: 55415 - DNA, 2390 bp, Heterodera glycines
  Genomic contig location: Contig_ID=SeqID_527; Location=10..2399; Strand=+
  SCN-specific regions: Sequence locations=1-108,147-2390
atgaaggagtctgtcagcgctgctcttttgacccacaccgtcgatgagccttgctacatccagcccattgacgacggctcagttcgacaacgtgcatcgattgctgtggacaacgacgactctgacgacgacgaggacgatgatgatttgccgcttcgtctctgcttcttcgatgccgagacgtcccaggacacgccattgcagctgaacaaccgcaccgtccagaagcacgtgccgctgcttatcgtagccgaagtcatctgcgaacgttgtctgcaggctggcatcagcgtcaacgatggtcttggaagacgggctcctggctgcgtctgcatgacaggaatggtgaggggtcaactgtttcgccagtggtcttcgccaccctttgccaatgcaccgggagacaacagcgcttcgccagttggagcacccgccttcaatcagcgccgcttcttcttccattcgttcgacaacgacggcaacgacccagtggaccaatttttggattttttgctgcaccatggtccaaagaaggcacacaccgtgtgcatcgctcacaacggtggaaagtacgatttccatctcgtacttgaggcactacaccgccgaaatcgtccacccaagcatctgtgcaccacgggattgaagatctactcaatgcgtctgtccgggcgtcaccaacggcgagtcacattcaaagactcaatcaattacttcttttgtgccttggacgcgttggtgaagagcttcgatgtgcctgaccatctggccacattgaagccattcttcccttatctctacattcgacgacaacatctgtcgcagcgcctcatcaatcttccggctcaagagttttacgcaccggatacgatgaaggccgagaaacgggcccaatttctccgttggcacgccgaaaacaacggcaatggattccaactacgcgagcagctcatcatgtactgcgtcaacgacgtggccattttgagggagtcggtcatccgattccgccaactcattgccgacaacacgcaaggcctcgacccattcctccatgcgtcgacagcagctggccttgcgcttgccacttttcgccgctgtttcctgcccgccaatcgtctagtccactcacccgagggcggctacttgcgcgggcgacgtgcttcggcagaatcgcagcgctacatccgcttcttcgagctggagcacccggaggcgcaagtgcagtgcgccagctggtccgttggtgaagcgcacatcgaagacagtggctaccgagtggacgggctttggcgacgggatgcgcctctccgtcccctggccattgaatggctcgggtgctattatcacggtaattaattttttcgtttccaaaatatcttaaaattgaggctgtcgtgtgtgctttcccgaccggcagcaacaattggcggcggggcgaacagcggaagatttgtacgaacggacggagcggcgcctctttgagctggagcacgaccacggctgcgatttgcacgtggtgtgggcctgtcagtgggcggagcggctccgccacgatccgaacctgaagcgccgttacgatgctgtgttcgtcccttgcccgctggacccgcgcaacgacgcgttgaggggagggcgcactgaaccgttcaagctgcaccacgtgtgcagtgacgacgaggagataatgtgcatcgacattgtcagcctctacccatacgtcatggtaggtttttcttttaaacattcgcatattcatgatgaataccagaaagccaatcgcttccctgtgggcaacccacgggtcctgacgcgcgaggtgctgctgcgtccgccaacggtaccgctcccgtggaatgcaccggaaaacaacatcttccgggggctgctgctcgcccgggtgctcgctccacgcaacatccgggtgccgttgctcggctaccgcacaaaggacgggcgattcaccttccctttgtgcgcgtggtgtgccgaccgtcggcagcagcggccgtgccgacatgacgacgacaagcgctcgtgggtgaccgcctacacgcacgtcgagctcaacaaagcgctccagcttggctatgtggtcaccgatctgtttgaggtaaagtcactcattaaaaaattttgtgtacgaaaacacaaattaggtctgggactacgaagagtgggacggtacgctgttcagcagctacgtcaacaccttcgtcgggctcaaagtgcaggcgacgggctggccagaaggatgtgtgacggatgagcagcaaaaagcatttgtagacgattttgagcggacggaaggcatccgcctggactcgaccaaaatggagttcaaccccggcctgcgcctcatcgccaaaacattggccaactcgttgtggtaa

SEQ ID NO: 55416 - DNA, 662 bp, Heterodera glycines
  Genomic contig location: Contig_ID=SeqID_527; Location=2808..3469; Strand=+
  SCN-specific regions: Sequence locations=1-273,307-372,394-629,652-662
atgggtggtccgtgtgtagcagagggcgaggctctggggcagatgaagcgcgaacacaccgaccgacggatcgtcgagttcgttgcgggtggccccaagaactacggcatccgccacactgcgcgggacggcaccgacgagcgcgccaacctcaaaatccgcagcttccgcctgtcctatactgcgcagcagctgctcacttttgaggcaatgaagaacctgacgctggccacgtacaacattgacggaccaatgtgagttttgcaattaagcattaattttgtaaataaattttaaaaaaatttagcgatgatgccttggacaatgacgacctttacgtgtacgggggcggcgaacatcgtgccatccgcgtcaacttcccgcaaattgaccgcaatgtgtacgccgacctctacacgcaggaagcccacaaagactacaggcccttctacgccaaggggcgcgttcggcctgggatgcagacgcgcccctttggctatctggaggatgatggacagccgaacgaaggacaacggacgcatcgaagaaagagaaatttagtagagcaagatcccacacagcccggccactctgggtggttctgatgttgtgatttttttgttagtttactattttgtttatttaaatttgtacaaatgaaa

SEQ ID NO: 55417 - DNA, 1174 bp, Heterodera glycines
  Genomic contig location: Contig_ID=SeqID_527; Location=3983..5156; Strand=-
  SCN-specific regions: Sequence locations=1-322,346-387,444-664,686 -1094,1118-1174
atgacactgacgccccaattgtgtgagccacgggtgaagagtgcgtccaaatattgttgactcatacccaccaccaaatcatccagcaccagcaaggttttttcttttttggcacactcccgcacttgttccgcgcgtgggacgccgctgtgtacagtgactggcacattgccaactttgccggcgcgctgcagattcatcacatttgtgttcaactcaccatagctataaataacgcgttcaacaggggtagagatcattttgtccacatttcgcaacagacgcattatccactctgacttcccacttcctgtgctcccagacacaatcattgtgaatggatgacgaaattgcacatcctcccttttaaattgttggaaggcgtccattttactttttttatgtaattttctttttatttatagtttttttttttattttatagattttaatggatttaattcttgctaccgattggataaacaacgcttatcccgaaatggatttagaggacgccaacaaagagaacaaagagccaacgaaaaagcaagaggaggaggcggatgatcccagttggatcagcctgattgacgaggagatgaagcgcgagccgctcgctccaattggtgaggagacgccagcaacaagttacttttgttttaaacgtatatttaaattttaaattaggcactccaaaaaaatgtgcttgcgctgaacgccgtcgccccgtcccgctcgtggaccatctctgcaagcggttcaaatgcagtgcccacgagctgcatgtgcttttcaaaagcctagagaaacgccgggacattgtggagcatttgcgctccgtccaactgcgcactgcccacctgcgcccgtccgtgcgcaattttccagtgcgttgtaatgacctgtccatcctggacacccactccgccccagcttaccgaggctacctcggcataacggttgtttaaaatttgttttgtttgtcggtaccaagcaatttaaaggtcaggatgcactactacataaaacacggcatccgcttgcgccaccctaatttgccgtgcgttgttgaatttggaggcggagatcacaaaacttttttccctcttgaaattttgtccattgttttgtagatgtattcaatttccaattgtactgttgtttttaaaataaa

SEQ ID NO: 55418 - DNA, 3925 bp, Heterodera glycines
  Genomic contig location: Contig_ID=SeqID_527; Location=4768..8692; Strand=+
  SCN-specific regions: Sequence locations=1-44,68-676,701-1391,1419 -2843,2890-3072,3094-3925
atggacgccttccaacaatttaaaagggaggatgtgcaatttcgtcatccattcacaatgattgtgtctgggagcacaggaagtgggaagtcagagtggataatgcgtctgttgcgaaatgtggacaaaatgatctctacccctgttgaacgcgttatttatagctatggtgagttgaacacaaatgtgatgaatctgcagcgcgccggcaaagttggcaatgtgccagtcactgtacacagcggcgtcccacgcgcggaacaagtgcgggagtgtgccaaaaaagaaaaaaccttgctggtgctggatgatttggtggtgggtatgagtcaacaatatttggacgcactcttcacccgtggctcacacaattggggcgtcagtgtcattttggtaactcagcacctgttcaacaaagagctgcgtgtggcgcgcactaattcacactatttagtattaatgcgtaatcctgcgggggcgttgcagatacgcaccatcgccacccacctcttcccgtcaaggactgcccattttattgaggcctaccgggacgcatgcgcaaaaaattttggataccttctcgtggacatgcacccagagagtccggaagagatccgccttagaacaaatatatatgaacaaaaacaaattgtttacctaccaaaatgaaagggtcacaaataataacaataaataaatactttttggagacattgtgtaatgccaaaaaggcgaatgcccttattcgagatgcatccgatgagcaacttttgtgccttgtcgaaatctgcctaaacattctaaagggccgagtccctttgcgtccccggcatttgaataagctgaaagctcatgcacaggtgcttcgtcgtctcgcccgcacacgctgctcgcgctctgccaaaaaggttttgctacaacacggagatggcctcccagctattgtggggctcattgcgtcaattgctctcccgcttattgctgatgtcatagaaaaatataaatagtttccaaaaaaattaaaaacaagaaaaaatgcagcatacaaagcgctatttgctcgtccccgaagagatttatcagagtttggcagcaccgccaccgtcagacggtacaccaattgggctggtccgtacccgaattaaacaaataaaaaatgatgacgccataaatgaggcggaaagggcagtcaaatatgagcaggaagttaagcgtctcaacaagctcacaaaggacgaagatgaacgtcccgtgggtgttaaattagaaaatttgagtgatgtggttgacgccatgccaaaaccagtcaacgttacaaggccaattgttgtttctacgcgacgccatctcaaggttggacgtgcgcgaaaagaaaatgttgaacaattagaagatactgatgatgatgatgattatcaaaacccacggtcgtcaagttcaaataaacgacaacccacacaaacggaaatcttaaaattaatttataaaaacgcccaatctctaggggtgtcggaggaagggcaagttttgagagccggtgggcgtccatttataaccagcagtgttgatgacattgttagtcacctgtttaacaaggacaagcgtggccaaaataaagagccaacggcattcaaagaatttgttgaaagggcaaggcagaatccgctcttgagtaggcatttatttcccgaaggccaatccggtaaaggaaattataaaaacaccccaattaagtttaagccatcattatggatttgaaaaagcttcgtttgctcgagtttttgtacaaggacctaagttcacctgtcgcattcacgagcgttgaaccgctgctgagagaggcgcggaaaagccaaccaaaaattaatcggactgatgtccaaaattatttaaccagccaacgtacatacacactgcatcgtcaggccaagcggcgctaccgccgattgccaacattggcacccggcttgcatactgaatggcaggccgatttggctatatttgaccgatttgctaaacaaaatcatggcttcaagtacttgttagtctgtattgatacccttagtcgacaggtgtttgccgagcccgtaaagaccaagacgagcgctaacatgatcattgcctttgatcgtatattcaaaagatcaaaatatatcccgtggaaggtgttaacagatcagggaaaggaattcactgcccgcgcagtacagcagttcttccgcacaaaagacgttgaacacttttgtatgctcacttctccccaatttcatgccggaatggcagaacgtgcgaatcgtagcatcaaagagcgcctttaccgctactttacggagcgtaacacgtacaagtggattgatgttgtgcaagacattgttcgtgcaattaaccactcgccaaattcgagcattggaatgcgcccagcagacgtgaactttaaaaacgcagaagcgttgagacaaaaattacataatgcagctgaaaatgttgtacgacgccagccaagataccgtgtgggagatcgcgtgcgcattgaaaagtacaagcacgtgttccaaaagggctacctcccacgcttcaccaatgaactattcacggtggtagaagtacacacagagcgttcgccagttgtttatcggttgcgtgatgaccataatgaaataattagtggttggttttacgcaaatgatttatgcaaatcactagaagacaagcagcaaaatatgtatgaaattgaaaagattttgaagaaaaagaaacagaacggggtggattatgcatttgtgaaatggaaagggtacagcgctcgctccaatagttggattcccgcaaattcaattagcgagaaaaatatataaaaagcattatttaataaaatttataaaaaaaaatgccttcaaattctttttatgttgttcttccgtcaaacaccaatattgaaggaaataggacaaattctttccgagtgcgtttaccgcgcaaattgcaattcaattcggaatgggaggtgggtcttgccgttattgtatacccccactcttggccttccataggcaccgtggagcaacaatttgttcagattgagtggcagacggggaatacggtacgtatcgaagttccaccatcaaatgtcacaaacccccatgagcttagcaaaaatttatataggctcctgggtgagggaagtgatccgttggcaaaaaaggtgcgatcaacacagaattctttcatgcttttgataaacaaggctcgacgatgggccagagaagaatacattaagcgaaagactaaagaaaaacggagcgtccgtgacgaagagctgctcctacaggccatgttgacagatactggaacattggttgatctcaacagcgtagcccaaggctttctgacacgcgaaaagagtgctgcaacgagtaatgtaccgttgagaatgccagctgatgataccaattcgtaccaagaaaaattggatgagtacttttcgaaattaagtgacaaaaatttgaacattcttgatgaattgggcatgacaaaattgaacgccgaaatcaaaaatttaacagaagaggaacgcgtgatccttgaagccacaaaggaaatgggaacggaagcatggattcaggcgtaccgtgagatacgtcttgtttgccaatttaactatgacgtccatagaaatcgttttgtcctgaacaccgacccacggtacgttaaaaaggtcaaagtctcgcctcaactcgcttacattctcggtttcaacaacacggagtttattcaatctgaaaacgaggcaagattcatgccggacatgagcggtggtgtgtcatcattccacgtttacacgccggatcttattgaaccaatgatgattggagatgtcacggccccagtgttgcgcatagtgaccatacgcggaaaccccgaccaa

SEQ ID NO: 55419 - DNA, 483 bp, Heterodera glycines
  Genomic contig location: Contig_ID=SeqID_4693; Location=110..592; Strand=-
  SCN-specific regions: Sequence locations=1-61,244-274,296-357,384-483
tccaatacaaataacaaagttacttcaacgaaagcacccgcaccaccaccgccgccatctgcaacaacatcagcaacacttaaagtaacacagtcgcaacatgcaatagcagcaataaatcccaaagtaacacagtcgcaacaagcagcagcaacttcagcaactgtaacagtaaaaaaagcaacagcaactgcaaaaccgacaccttcaccatcgccaccggttgcaccagcaacagcaacaactaaagctgctaaagcctccccagttgtgcataaagaatttaatgaaaatgcagcaggagtcgatgtccttgacattatgcttggaggatcaaaacagtctgttgtgagtggagaggagaagaagcagcagcagccaccaaaaactaatgtttccgttggtcgtccattgatgtctccaccggccacggagtcgaaagatgtccttgacattatacttggagaaccaaaacagtctgtt

SEQ ID NO: 55420 - DNA, 2900 bp, Heterodera glycines
  Genomic contig location: Contig_ID=SeqID_4694; Location=1533..4432; Strand=-
  SCN-specific regions: Sequence locations=1-396,420-502,528-570,597 -756,780-939,963-998,1035-1036,1058-1070,1093-1186,1247-1254,1278 -1883,1905-2150,2172-2706,2728-2900
atggcgaataaatttttaataattcccgaggttctataccgggggctcacttcagcttccagtactggggacatcactctcgatgctgtacgacaggaactcgaccgaacaaagatgaagaaggtgaatgcgaatgctaaaaatgttcagtataaccagcaactaagacgctacttacacatgaggaaggaacattcagacagaccaacaaaggtgtaactgtcaaaagggttaagtgtactatttaagcgggacgatggtgatgaagatatgggtgttgcagacgctccacaatacccgccgggcccccctccacccgatcagcaccctcgcccttcactacgcccaccctcaccgccggatggtgggcattctccgcctaataatagacctcctcgcccaccccggccaccaaaaacaaggaaaacgcggagacacatgcctgtacaccaatggaggctaagacagcgaaatttgcaggaacaacatctgcagcatccccaaccagagcagcaacagcaacaagcacaactaggacggaatcttcttgttgaagcagctgcagcaccgttatatgataatgatgatgatgattacatgcttgaagacgggtacacgctacctgctccttcacaatattatggcgaaccgatgctgccggactatgaggatgaaattgatgaaatggacactgcccgatttagttttgcgagcagaagaaaaatgacagaagaaaatggtgatggtgaaaaaaccaaaaaaaaaaataaaatatattactctccaccttcatctcccaaatgggaacaaaccagaaggcgacaacccctattaacatatgaacgtactggtcctccgcctccgcctcgccctacaccgaaacgagaatcaaagcaggaattgaaccagcagcagcagacaccgacattaagacagatcattcctcctgctcctcctccacaaggtaaaagagagccaaaatatgaacaagtacatgattcaccaccaccaccacctcctcctgctccggctcagatcaaaagggaacccaaatatgaacaagtgcatgagtttccgccgtatcctccgccgcctcagataatcaaaagggaaccaaaacaagagctatcgcaacaagcttcgacctcaagtaagttatctatcccggaaagagaaccaaaaaaagaaccacaacaacagcagcagcagcaacagcaactacaacaacaagaacaatcaacatcaaatcagccatttgagggagaagaggaggaagcagatgaagctcccactcttccacgaacaaaaagaaatggaattaaacaccaaggtaagaaaagtggcaaacgccgtgtgagacctgaaagacgcaaggggcgagcaagagtagagtattcaccaacaccaaagttctacaatgtcccatcaacatcggcacaaaaggatgacagtaaaaaatatggaaagctgttttctattccaccaaataaactaaccatgaaacagcgcgtagaacgaatattaataaaatgcaaccattacggtgaacgaatgggtgttagtggaaattctcttattaatgaagaaactggaaaaccatacccgcgtagcaatgtgtccatgatcataaagtatataatagacaaacgagcaggtaatgctaccaaaattccaccaagatcaaagcagttggaggagaagcttaaattggatccaattttgtactcatggacagctccattaaagaaaccgcagccacaaacaaaaccgaagccgccgacctacaagaagccattccgtccagaaaggtggagctgatcaataaaacacttgatcagttatacaatgacccttcttcacctgcagcatttgctggtgtcagtagattactagaagaggcaaagaaaagaataagtgatatacaccggtcagatgttgtgaattatttggaagggcaccgcacatatacactgctgcgccctagacgagttcatttcccgaggtcaaaaactgtggccgcaggttttatgactgatgttcaagttgatttggccgatttacaatcactttcacgtcacaacaaaggctatcgctatctgcttgtagctgttgatgtgctctccaagcgattatttgtggtgccgttgcgcagcaagcgtgcagatgagatgctgctagcattcaaacaactggttgagcaaatgccaatgacgcctcatcgtgtgttcacagataagggcacagagtttcgtaaccgaatgctcaaggagttctttgaagaacatgatattgcaaaacacgaacccgtccattctgctgtgaaggcatcggtagctgaaagagccataagaaacgtgaaacaacgtttgtacaggtactttgcacagaaagaaacactaaattggattgatgtggtgcaacgtattgttgatgggatcaacagagcgccgagccgtgtgcacggaatgcgccctattgacgtgaattttagcaatgctcagaaagtttggcacacaatatacggtgatatgtattcgccgatgagaaagctcgagaaaaggacgagattcaaagagaatgattacgtgcgcatgagtcgagagaaggggcagtttgagaaaggttatttaccaaattatggagatgaaattctcgaaattgacgatgtgctgcaccatgttaaccctgtgcgttataaacttcgtgatgaaaaaggagaacagttcaagggtagcttttatgaccaagagttggcacgtgttcgaaaggacgccgaaacgagctatcgaattgagaaggtggttcggaaacgaaaacgtgctgatgggtcaacagagatgctcgtcaaattcataggttacccggagagggagtggattcatgagtcacaaattgtataa

SEQ ID NO: 55421 - DNA, 600 bp, Heterodera glycines
  Genomic contig location: Contig_ID=SeqID_4694; Location=6726..7325; Strand=-
  SCN-specific regions: Sequence locations=1-236,258-398,421-600
atgcagtggatcgctgcagatatctgtacttgtccccaaaatctctactgtcttcgcacacttaactatctcaaaccacttttatgtatacataaaagtgtcctcaatttcacccaatttcttgctgaaggagtacagcagccaaagcaacaaacgtccgaattgcaatcagttctgcttctgttcgtcattggtgtgttggtcctacaggtcggatttttttgtagttttttaacaaataattttgttgtgtacagctgatgcaattgtgtctgctcatgaaccatcgtccgagaaccatgtcgagaagacggatccgtagccgagcaccttttcaaaatggtgcagagaatataggagctcatcgcctggcacggttccctcctctgcagcaacagtgcaggccgcagccactgatcattgatgttcgtcctcctgcacaaccgaatgctgaacagcagcagcagcagcaccatgaccgagtggtcagtttagttctcataaattttaagacttaacgtattaatttttaaggacagtgagcgctcgagcgtgtccgacaacgagagtttccactcaattgttgagaatgaatgctga

SEQ ID NO: 55422 - DNA, 120 bp, Heterodera glycines
  Genomic contig location: Contig_ID=SeqID_24678; Location=375..494; Strand=+
  SCN-specific regions: Sequence locations=1-120
ctcccggcgatcattgacgccgctaggagcaaagatcgtcttctcggcattcttcgttcttcgtccgttcttcgggcaaagatcgtacgttggaaagtgaaatatatgatcaaagcctga

SEQ ID NO: 55423 - DNA, 644 bp, Heterodera glycines
  Genomic contig location: Contig_ID=SeqID_24679; Location=207..850; Strand=+
  SCN-specific regions: Sequence locations=1-397,427-517,541-644
atgccgctttttggggggaagttccggcggggaatggtcaccagaaatgccccgtacaattcccacacttcctcacgactcattttggccaatgcgctgacactttcgacaattgcgtaagtctccgagtcggggtaatgctgatttacgatgttctccttgccactttcgaagcccgccttttgccttcatttgcaacactgtttacttttaattatctttatttttaaattgacaatgcttcgcgccaaaaatcgtcgccgaacattcggatcatcagaagacggatggattcgtggataaagccgaactgaacagaaagaagcgaaatatggaagaaggacaaacggacggaagggatcaattaccatttggaacagagaggagagaaatgaggaaataaattcaaaaattaattaattaattggacaaaattattgttttattcagtcagcccaaagcaaagcaattaattaagggatgggaaaaatatgagagattttgcaaattcccgccacttcttggctttctctgcttttatttcgtaaatatgacatactgttgaatggcaaaacattttgccataaaatattccacgaaaatttccgtgccaaaagggaaaatcgctgacaaatgaagccata

SEQ ID NO: 55424 - DNA, 519 bp, Heterodera glycines
  Genomic contig location: Contig_ID=SeqID_24679; Location=1..519; Strand=-
  SCN-specific regions: Sequence locations=1-519
cagttcggctttatccacgaatccatccgtcttctgatgatccgaatgttcggcgacgatttttggcgcgaagcattgtcaatttaaaaataaagataattaaaagtaaacagtgttgcaaatgaaggcaaaaggcgggcttcgaaagtggcaaggagaacatcgtaaatcagcattaccccgactcggagacttacgcaattgtcgaaagtgtcagcgcattggccaaaatgagtcgtgaggaagtgtgggaattgtacggggcatttctggtgaccattccccgccggaacttccccccaaaaagcggcattttgaggtggaatacacaatggaaattggctgggatcagctgctccgcacgatgagccccgatttgaaggtctttggcgattgcgttaattggtgtccaattaggagggcattcgttcccttaaggctttttggacaatttggactcgctccattacttcatcgaccacgtcgtgtacaaaggcaacctccgcgggccgttctttt

SEQ ID NO: 55425 - DNA, 516 bp, Heterodera glycines
  Genomic contig location: Contig_ID=SeqID_24679; Location=940..1455; Strand=-
  SCN-specific regions: Sequence locations=1-516
aaaggcaatacggtaattgtccgatcatttatcagctaattatcccgcgtcaaagatgacacttcgccgttcgtcaaaaagattctgaaggcgcacgtccgcgtgcttttgtattacggtgacacggacatggcgtgcaactttttgcttggtcaacagttcactgcgcaacttggtcttaaagttcggcgcgtttgcaatgaaaaaagcaaattaattagccaatttagcgttccatcaacaaacagccgtggaaagtcgcgagacaaatcgccggcttcaaaacaatttatgcccgaggctttttgaccttcctcacgggtttggccaagtgattggccacccattcactcattttacaatttaagttcgaggcgcgggtcatatggtgggcgaattttgtaaatgaatctttgcttaattagcagtcaattaattaaaatgccttaggcgccccaatggcgagcacagcaaatggactacgcgttcagtcagttccttctcaaccacccaatt

SEQ ID NO: 55426 - DNA, 878 bp, Heterodera glycines
  Genomic contig location: Contig_ID=SeqID_24680; Location=514..1391; Strand=-
  SCN-specific regions: Sequence locations=1-247,286-601,651-878
atgttggatgcttttacgacggattcagatgttgacaccatttgtgtgtcgccagaacatattcaagctgatcaattcttcggcacagtgccgtgccatcaaaaatttgccgaggaatgccgaaatgatgactcactgttttgttgactgtgctttgtaagaagttattgtcttaattataaattatgattccacagtttgggaaaacagggaccacaaaaaaacaacgattaggaaatgctgcaaatttaaattttcttacaaaatttaaaattttccactttttcagcacccggaagttcactcgctgcaacggatccaatccaattgggtcccactgatcagactaaaagcgttttggcgacaaagattgtcttactgtatcccgagacatttgaatatttttcggtgattcgtcaaaatgaatttgaatttggcgacgaagaattggcgcgaaatttgaaaattgaatttaacgaaatggtggaaaaggtcaaagacctacgggaaaggacacttccatcggaacagagaccaaaacacccgatgatttggctaaaagatgtgctgtttatgagcccagagcaaatcaaagtttgtcattaaccacttaattacccatttaattacccaattaaataattaattaaatttacaattaaatgaaattcaagataatcgttgcacaacaacgggcaaagacttggtgtggttcgtcggtttgctgctctaccgaatgttgtttaacaacaaacatcccatggacaattggggagccaaagcgccgttttggacatggaattcataacggattggcatggaacaggtggccaattaaaatgtcaaaacgttgtgatttattaatgaataatatttag

SEQ ID NO: 55427 - DNA, 567 bp, Heterodera glycines
  Genomic contig location: Contig_ID=SeqID_24681; Location=245..811; Strand=-
  SCN-specific regions: Sequence locations=1-12,34-74,96-195,217 -240,262-287,318-366,395-424,446-480,502-567
atgattaaatttttctttgccatttcatttttattggtcatcggaactcatttgaacaatgggacaaccgatgtgaagaacattggtaaaatttatttaagaaaaacattcttatttcaacaataagaacataatcaaagcttttggattgacttaaattcgtctatgaaattccaatacataatttagaaaatcctgaatgaaataatgattttttggatctacttaaagtctctgaaatttaaaatttaatgaaatatggcccgaaaattacgatatttggttcgatttaaattaatctaaatatataatttaaagaaagccggcccgagaattacgatttttgggtctacttaaatttgtctcttaaatttaaaattataaataaaaatatggcccaaaaattatgactttgttaaatgccaaaaacaaatttatgaatcaatgtttttagtggaaacatttgtacaagatgatactgatctaaatgaattggtggatgatgccatcatttgggcccattacattggcatggtaacgcgagcagacaaaacgaaaactcggtaa

SEQ ID NO: 55428 - DNA, 181 bp, Heterodera glycines
  Genomic contig location: Contig_ID=SeqID_24682; Location=1403..1583; Strand=+
  SCN-specific regions: Sequence locations=1-68,106-181
atgagcatgtttttttccacaaaaggacaacaccaatttttgagcgcggtaatgctttataaaatagcttattttaatgttttaaaatttattttatattttttagacaaaaatcaatgtgcagaatgcgctcaatgccaacctgtttattctgtttgcgaatcgaaaagttggagatgag

SEQ ID NO: 55429 - DNA, 682 bp, Heterodera glycines
  Genomic contig location: Contig_ID=SeqID_24684; Location=614..1295; Strand=-
  SCN-specific regions: Sequence locations=1-49,161-221,284-326,367 -512,534-682
atcaatacaccaaattatgatggttggcttagttatctgatcttttaacaaattattaatagaaaattcaaatatataattatcatagttctttatatgtatgtttttatgttttattatatatttaaaaaaatttattggtaaaaaaaaattaaaaattcatagatatttttccatcaatacaccaaattatgattggcctagtttttagcacttatctgttattattaattttttaaaattatttataaaaaaattaaaaatttttataaaacattatttagtatgctaataactttaggataatgaatataatcagaaaaccgaaaaaaaaattttttttttgaatattcaaattttaaatttcagtccttcgatgaaaattccattccttgaaccaataattgaaaaatatgttgatgaatacaaaaaaagtcgtcaattattcgctgaatgcatgcaaaaaattttgcgaaaatcgaaaaatcctaatcaaacggtgaagatcatcgaatttaaaaagacaattgaaaaagaaatgaatgatttgttgaaacatacggatttgccaccagatcaattgattgatctgttgaacactcgtgaatggctattgtcgatgaaaaaagacattggtaagtgcaaaaatagcccaacatcgtccttgaatgccaaagggcgc

SEQ ID NO: 55430 - DNA, 895 bp, Heterodera glycines
  Genomic contig location: Contig_ID=SeqID_24685; Location=1..895; Strand=-
  SCN-specific regions: Sequence locations=1-277,299-895
  Gene Ontology: Mol. function=receptor activity; Cellular component =endoplasmic reticulum membrane; Biological process=signal transduction
cgatgcgtcgtggaggagggaaagggcacaatccaatcgccaccgaaaacattccgaggtgaaaattgtggacaaatgaaaataattcgcaataaatcactgaattttccaaacgaatgccaatgaaaaatgccaaatttgaccctcaaaagactgtctgtttcgcatttgttctgtgaatcgctacgcagcacaaaagcaatattgggcagagcagaaaaaggcacggatgggcgaaacggtggacgaggaaatgttggagaagctcaaagtggcggcggagaaggagcgggagcagaacgaattggagtacagcaaaatgctgggcagtgtggtccaagtaaatcgaaggggggggcacaagggaatggatactgatttgatcagcaggggatagagagagaaaccaatcggcagggaataaagggggacaattggcaggttgctgtcgtaaaccccttctcattagtcccctgttttcctaattgctgcttctactttttgtctaattgcccttcttcccatttcagtatggctcctccattcaggttattccattttgtatttggttcgctttttcaactaattctctcccccaattgatcagttattgcatgtgaaatccaacaaatttttgacgatgcaaaagaattcgccggcccgacaggagagaaatgcgatgcgcgtttatttggacagaataggcaatgagggctcgtggttttgtgtggacattgtgtacaaacacgtgtctcttggggacaatgtaagaaaacggagggaaatgtgaagggtaatggaagattaggggagcgggatgggctgatcagactaataattagggggagaggtgggggaagtgattaagcattggattggagaggggggatgcttc

SEQ ID NO: 55431 - DNA, 397 bp, Heterodera glycines
  Genomic contig location: Contig_ID=SeqID_24687; Location=126..522; Strand=+
  SCN-specific regions: Sequence locations=1-74,96-249,327-397
atgggatggttcacttatatttatgatggatggcgagcacataaaataataattcacggcaaaacggtgacccaaaaaagaaacaaatttgaattggattttgcttatccccccatattcccattgatttttatttcagcaaaatgatgacccacaaatgtggggagagattttctcaaaagaaatactattacaatgtgcaacagatagagaattttgtacataatcaaatgtcgagggttcaagatgaaaaattgaaaaatatttaaagaaatttagagaatactttaatttaaaaattttttgattaaaattaaattttaaaagaaaagattcataaaactttgaaaaatatttcataacattaaaatatcaaaagaaaaattatcaaaaaaga

SEQ ID NO: 55432 - DNA, 322 bp, Heterodera glycines
  Genomic contig location: Contig_ID=SeqID_4695; Location=45..366; Strand=-
  SCN-specific regions: Sequence locations=1-322
atgtctcatagtcagtccgagaaatcgctcgaccagcagttcgattgttgtgagtgcgtcgtcgatgatttgctgaagggccgtcttggcgattcgcaatttgcgcaaaggaatgtgagttggcattttcatccttacatttccgttcgtattgtttcagaacgtcttgagagattgtatccaatctctccaatccgtggccaaaacaatcgatggcctttcgttgttcagtgccaatgattccgtcgaagaacttccgacgaactctctccgttttttgctcgtcccagcttatttggccaccgcactgcaagaaatcggc

SEQ ID NO: 55433 - DNA, 1755 bp, Heterodera glycines
  Genomic contig location: Contig_ID=SeqID_4695; Location=891..2645; Strand=-
  SCN-specific regions: Sequence locations=1-34,56-94,117-714,736 -941,963-999,1021-1231,1253-1321,1343-1383,1407-1424,1446-1755
  Gene Ontology: Mol. function=ATP binding; Cellular component=nucleus; Biological process=base-excision repair
atggattatgggactgatatagaagagtgcaccgatgagtttaaaaggtaaggagaacaaaacatttacaatcctatgctatttactcaaatgctttaaggctttttgaggagaaatcactgaacacgtgggagtcgtacatcgctggcaattttaagaaaaatccgagcggaatggacattgtggaagtggattttgccgataaaaaggtacaatggtgcaatgagaaatgaaacatttttcgacccgctttttggcaggagaaccaaacccaaaagttggacattgatgcctccaagtcacgtttgtctcgtccggtgaaagaacttctttcgatgatattcgatgtcaacgcattcacgaatactttgcgggagttagatgtgtgacagtatcttttctattgggttttatttgctttttttcagattgaccttactaaaatgccacttggtcgcctcagccgttcccacgttctcaaggcgtacaaagttttgaccgaattgcaacaaattctggagaggaaagaggatggcaaagcgcagcccacttctcggggagtctttgtggacttcaccaaccgattttacacgctcattcctcacgccactgggctgaagtccccgccaattctcgataatttgaacgtcttgaaggagaagtgtggcatgttggacaatttgcttgagattgaaattgcctacaatttgctcaagtcagaggaaaaggaaccaaaggacaaagacgcatttgatttacactatgaaaagctcaactgcaaaatggaagtacgtactccgttaaaaaaatcacagaacaacaacattctcttaagattcttgagcaaaattcgcgagagttttcgctgataaagaaatacgtcgaagttggtcatgcgcccactcacggggtccaattggaaatcatcaatgttgttgttccttttctgtgataatttaaaacccattttatctttaggttcttaaaattgaacgcgaattggaaatgaaacgcttcaaaagggacattgggaatttgcatttgctttggcatgggagtgagttattaattacttccaaattcagaaaaataacatttttgccaatttaggccgtctctcaaattacgtgggcattctcagccaggggcttcgcattgcgccctccgaagcgccagtggtcagtccttgcattaatttttctcaccatttttttgtggctttagactggatatatgtttggaaaaggaatttacctggcggacatggtttgaatagaaattcgattgtgaataataacaaaaaggaaggcgtttaggtgtcaaaatcagccaattattgttatgtgattaatggcgagggactgctgcttttgtgtgaagtcgcattgggcgaaattcaggaagaaaaagatgccaaggaattgagaaaaccgaaaagagggaaacacagcgtgaaaggtaattaaatttcattaatattattctgatgtaagtctatgtcattgtttttaaggagttggtggaacagtgccaaatccatccgaattcgagcaattggacggagcaacagttccatgtggaaaagcaatcaaatcaggcgcggagggtcattctttgctatacaatgagtgagataattaggtagtttgataaatctaatcttcaactttttgtaggttcattgtctacgatgaatcgcaaattcgtctgaaatatttggtccgcgtgaaaatcaaaaacacaccgcttctttga

SEQ ID NO: 55434 - DNA, 1414 bp, Heterodera glycines
  Genomic contig location: Contig_ID=SeqID_4696; Location=106..1519; Strand=-
  SCN-specific regions: Sequence locations=1-88,110-708,731-856,878 -970,1004-1414
atgacaattgagcacgcgaaattcagggtcatcgaagtgttacaaatgcaaaaacagcattgcaaaaggggaccttcgtgtttcaagcaaagcatccttctaccacctcgaatgttttcattcacttggaatttttcaaaaaagtgcggaagagtgagtcatttctagctaaaatcatattatcgtttattaatcccagttttttatagcttaaatggatacaatgacttaaacgcggatgagcaaaagcggttggatgagttatttccaaaagcaacacaaacgcccgctgaggaagggtatacgctttttatgtcttccctaaaataacaatttgtattagaattaaacgaaagaatgaaatcagtgagacggagacaccgacgagcaaaaggatgaaaagtgatggagaaaataaggaacaaacagaggcactaaaggtggacggacacacattaataaattgttaattcttttagttaaatcaacccgacaagtctaaatttgcctttcagaaacaatccgaactgttatggaatactcgaattgcattacgagaaaatttggacagcagcgaaatggttcgttctaatacatttctattttttaagaataactcaaaaagggggcatgggaaacctaaagaatttcaaatatcataatgtttaaatttttatctcacaattaactttaattcaaaaataaaagtgttttaggaggaattactgcaagcgaacggaaatttcaaaccgaagaagggcggtgcggaagcgatgttggataagttggtcgactttgtggtgttcggtgtccctcagccatgtccacagtgcaacggaccattgaattacaggtgttgtcacatttatatttattttccatgtcaattaatttttagcacgaccacccattcttacaaatgctatggaactttgtcggaatataccagatgcctttacaccacaaggactcccgaaagaaggccttttttcattccaaaacaaatgaaatctggcaataagttcttgaaaacattgaagacagcggtgcgtttatcggcaatcatggaaaagggggcataggggcccctaagcaattgaacgcccataaaaagtttcggcctctgatgagaaaggcatagatttgataaaaacctgacggtagatattcgtgctcagtgtcacgagaccccctcccccccagataatgattttcctgaaataaaaactgcaaaatcaggggttcctttctccatgatttcttctagttcatcgtcacccgaattcatattcctgaaatgaacattttcagctgcttcctgccagactttaccctgctgcagcactgaccgaagaaatcattgtgaaaccgaaggcatttaaaagtttgaacgcggcagagcgagcaacaaacc

SEQ ID NO: 55435 - DNA, 57 bp, Heterodera glycines
  Genomic contig location: Contig_ID=SeqID_4697; Location=7..63; Strand=-
  SCN-specific regions: Sequence locations=1-57
atggagaatgaagatgaaacgccaaaagagccgccctatggagcagaatatcaaaaa

SEQ ID NO: 55436 - DNA, 764 bp, Heterodera glycines
  Genomic contig location: Contig_ID=SeqID_4697; Location=805..1568; Strand=-
  SCN-specific regions: Sequence locations=1-150,172-621,647-764
atggtatttgttttgacatctgctgatacctggtcatagactggacaaaatatctgtgattttttaaatttttgggggggggggggggtagcaaaacaaggaagaccttattaccttaaggagcatgcatccgtaagaaatatgtgaaacaaaaatttataaaaaataatacaaaaagcagtcacttggaatttatgtaattactaattaaaagcacacacacattaaatatgtaacttcgtgtttgtttactcatctgttcacttttacacaatttgattatgtcctttgtgttttacataacatcataaaaccccctcaaataatcatcctttctctctctcttttttttatcaaaattcattctcgtctttgccattgttatgcggacattctttttcatttaactcttaacaatttacttttaattcgtcaaaatcaatgcattccgatatttcaatttgattttcttttttataggccattttgaagaatttatttgcgtatttggagaactatctaattgtggttgtgagtttggaaactctgtcctcccaaaatgcctctttgtcccaaatgtcagcggcctgtttattttggtccgttcatataaatgtctacaattaattaatttttgtttgtttttacagctgagcgcgtcacttccattggaaaagattggcaccgtccttgtctccgtacgttgcttctgtgttatttgtgctgttactacaacagaaaatcttctttttagagtgtcataa

SEQ ID NO: 55437 - DNA, 694 bp, Heterodera glycines
  Genomic contig location: Contig_ID=SeqID_4698; Location=980..1673; Strand=+
  SCN-specific regions: Sequence locations=1-4,26-186,299-324,347 -366,389-508,530-566,590-633,670-694
atgtgtgaaagtgtgcaaaaggataaaataaaacggaaaaggaatttaacgtcgacaggtcagaaggggatcgtttctttttgtatttcattttggcacgaaacacgaaattttattcacttgtaagtatggggggtgtgtgttctgatgagagaaaaattgttatttggagattgggagaaaatcaaaaattttattgaaaaaataattaagcattaacttttaatttatgtataaatatttggaaaattcaaaatttaattatttttaattttactacttaaaaatagtaaaatttgggttttctttgcttttaaaacccgggctaaaaattcaccattgttctttttaggtgaaaaaactgatcaattttggacaaatctgttaacaaattgtactcaaattttcaaaatttttcctcggcggcgactttcggcaccgccggtcctcctccacaaaagatttttaggaaaataatgcgtcaagaaagctgaaaaactcgttcgtagattatattttaattaaggaattttggagaacttacaaatttcaaagtaattaattgatttttaaaaagagtgaaaataattaatttgagtttttttttgattgattaaattttgagaatgcctcaaaaattttttaaatttttcagtaaaatttttttttcgtagttcatgtgtggttaaattca

SEQ ID NO: 55438 - DNA, 2327 bp, Heterodera glycines
  Genomic contig location: Contig_ID=SeqID_4699; Location=421..2747; Strand=+
  SCN-specific regions: Sequence locations=1-120,153-315,337-428,450 -911,933-1253,1292-1376,1408-1601,1743-1861,1883-1897,1940-2158,2317 -2327
  Gene Ontology: Mol. function=protein carrier activity; Cellular component=cytoplasm; Biological process=regulation of cholesterol biosynthesis
atgccacaactcaattgcacagcttcggcaacgatcacttcctcagcacattcccgccatcacatcgatgtccccccagagccgaaggctaaacacgacaagcggaaaacatcaaacgggtaaatatatttaaataattttaaatttaaaaacaatttgacgctaaaggaaaaaaaggaattacccaacgggggaagggctctttcttatcacttaccaatttatcattgaatttcctccgttttttctccccccctttctttgaactttatttacaaaattggcttaatgagagcagaaatgtaataaaatgcatttttaaatggtttttaatttccattgtttttaagtgtgtgctatcaacagacgccgaccgacgaaacttttggcgcctcgcaattggaaaaattggcggaattacgcaaagaattgggtgatgagctgctccaagagaccacattgctaaatgacaatttgtcactaattcgttggctaacgggatggaacaacaaaattggtggctaattaatattaccaacgataagtcctactaattagtcaatgttatgatgccactttcaattacttttccaattaaaatggttcgcttttcgtttcgcagatgaaatcgtcccgcgtttccgtcgtgccgcttctgtgttccgctgtttgaacctcaaccaatttgtgattgaggacatcgacgatttgaacgacttctcgcggggtgtctcagccggctccgaatattaccccgggggcgtattgggctacgaccgcgagggaaacgtcgtgtcgctgcaatgcatgggactgtcccatccgaaacagttggccaaatgcgggcgcgtcagcgacgtgtatcggttgagcatttacgagaccacactgatttatcaggcaaagaattgacaaatgccaaaagaaagaatttggggggggggacgaaatggaaatggacgagaaaaacaaagaatgaaaatgatggcatggggtcaagtcgagaatttcagcttatcaaaatacaagagcggaaactcggtcgcaaactcggcctgaaagtgatcatcgacttggacggcttcaacaccgaccatttgagtacaatcgcattgaaagtgtacggaaatgtgctggtcacaatgcaggtaatgctcaccgaatttctttctcaaaacaggatttaaataaattaattgtgccctctttaaaggaattgtttcccgatttgttgcggcaaggtgaaaattcacaaaaaaactaattaattaagtaattattttatatttaagtgttcgtgatcaatgcacattatttggtgaaaacggcgtacaacagtaattaattaacaaattgaccaattagtcccctaattgccctcccccctcttctttttcagtcattaaacccgttctgtcggagcaaagtcgtgagaaggttgtcttcttgggcagtgatttccacggtgtgttggcacgcgacattgggcccgagaatttgttcatccgttggggagggacgcgaacgccgacgcgcgggcacaccgaaggagggacacttcggatgggaggagtgccaccggaaagtttaaggtggaaatggaaaagtgaagcgaagaaagagggggggggggagaaagagagaacgatgatcagagaaacaaaagagcgatcagtgaaaaaacgaaaaaaggggaagagaaaatgaaaacggaaattaaagaaaaaaagagaaggaagagagtggataagcctgtgacaagggaatcctgttcagatattgtgccaaaaacaatcccgatcacattgacgacgaagagctaatcaaattgaatgtgcccgccagacagagacgcgaagtggaggtggaagtgccggaaccgggcccacactccatccattggcttttccacacaaatggcgatttggccttcggcatccatcgaagtgacgaccaaatggaggtgggattggcaaaaacaacttttttcaaatggattatttattcattcaaaggtgtggccaactttccatttgctgacggattacgtgccggagtacggtaaagtgcgggtggagggcggagtacggtacaagctggtgttcgacaactccggtggcactttcttcagtcgagaagtgaaatacgggcttagagtgaagaaggttgaggagagtgaggaggaggagagagagcacggagcaaaagaagcagagaaaacgaacggagtgacagcacggggagaagagagacaaagcgtggccagagacaccgaggaagagaaagagaacacgatcagagatggagagggaaaagcgaaaaattaa

SEQ ID NO: 55439 - DNA, 715 bp, Heterodera glycines
  Genomic contig location: Contig_ID=SeqID_24690; Location=584..1298; Strand=+
  SCN-specific regions: Sequence locations=1-61,83-198,220-715
  Gene Ontology: Cellular component=mitochondrion; Biological process =rRNA processing
atggaggcgattgaaattgtgcggaacgaacgaatgtcgcgcgaagccgaggacgaccacaaaaggcatccgctgctgatgggctattcggcaggtgccgaacatcgcttcattgcggacggtatgcaaaaaatccgacacaggtgcaatttagggattttcgggtaaatgggcgcattttacaacatttacagtcacttggagaagagtttgatgacgcttcccttcacttttgtgccggaccttttgaaggaaatgggcaaatgcgtgcgttccaattacaaatccgacctcgctgagcgtgtcattcttttccttaccaggttatctcggcgtccgccttggttttacttctgaaaagaattcctattgtttttttttcagaatccatcacaatcagatcatccattctcttgagctgctttcactgatcgacgacctcagaacagttttgccaaaacatatcgctgacactttggttggtgttgcgatgttttagagtgatcaaagggtcattaaactttgtgcttgcctttttcagaattgcgttggcctcaatatagctgcgttaaaatttcttcaaatgcgattggaaagccgacaaaatgcaaaaatgtttgtcgctccgcgagcagaaaataacgaaaaggcttcaaagaaaaagaagcagcgacggaaagtgaaagaaattgcctttgtttcatcagttatatga

SEQ ID NO: 55440 - DNA, 673 bp, Heterodera glycines
  Genomic contig location: Contig_ID=SeqID_24694; Location=545..1217; Strand=+
  SCN-specific regions: Sequence locations=1-22,44-281,303-346,398-673
atggacgaaatgttgaaaagatatttaaaatttgccataaaatttatggcaaaacgccagcgaatttccgaacaaaaactgaagctgcagggaataggcaaattgcaagcattaaaagctctaataaaattttatgttcatgaaaaatgcgagaaagaacaggcaaatgatggtcagcaaccgagcaagtccaagtgggagcgattgttgccacttttgacgacggtggtggaggacgaagaggacggcacaaatgccaattttgcattggaatgtaagagaattaatttataaaaataaatgacaaaaaaagctaaaaattaaaatatgaaatttagttgacacaaaaaagaagaaaaagaaaaccggaggaggaagaagaaggaggagaaagaagcgcgaattagcagcctttgccctgattttgtgcgtcgcgttggcagtggcaattctgttgttggcgctaaattgcaaaagcgttggcctctgtttggcaaatcgttctggagcacaaacgcaacgccaatactcaaacgaaaacgaagcagcagttggtgtggaggcaaccgaagaagcgcgcgtcacaacactttttgaacttttacaaagcaacggttagcgcatttctcggatttttttttgtttgtttttagcgttaaaaattaataaccta

SEQ ID NO: 55441 - DNA, 387 bp, Heterodera glycines
  Genomic contig location: Contig_ID=SeqID_24695; Location=93..479; Strand=-
  SCN-specific regions: Sequence locations=1-20,42-275,297-387
atgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggccaaattttaggcccccagccacagccccttgcttctcccagttttaagtcttggatttgtcaaataaa

SEQ ID NO: 55442 - DNA, 1020 bp, Heterodera glycines
  Genomic contig location: Contig_ID=SeqID_4700; Location=1445..2464; Strand=+
  SCN-specific regions: Sequence locations=1-244,267-975,997-1020
atgcgaattttcatttgcttttccgcactttttctgtcaatctgcgcattttttggtgtgttcttttcattatttctgcttttgtagtaattaattaaacaaaattttagactttaagccaatctttgcgtatgatccgttggaattttttgattatctcatcgaatgcgatccaaaggccaaaatattgaccaaagtgcgaaatgatttttcagaaggggtcgaagtcagtcaaaacgatgcgaaagaattggcaaaatatttgagcagtgaaaagggaaataaaacatttggcgaagtgattttaagtgaggcgagtaaatacgacaagaaaagggagcaaatggacagcgaaagtgcacaaaatgccaaaacacccggaaaagcaactgaaaatgccaaaaaagaccaaaaggcacaagcaaagatgaagacggcacaaaaatcatcgcgtagaacaaacagattagaaacatccctgatgggatcaccgaaaagaattggaaatgccataaaggagcacgtgaaaaaatttttatcacaaggagacgacatttgggctttaatggtcaaagtgagtaaaatgtatgaacaatatgaagagatgtgcaaagaaatagcagaagaaacgattaagaatttaattaaacagcaaaaagttagggagaaatgctttagacaacacccactaattatgctaattgacctattcaaaccgcacttggaaattgcacatgatttgagcagcaaaattatgagaaaacgaacccaagtaataaataattaaaccatttaagagcaattagctaaaaattggtgagctgtttaattaagatgagaaagtcactgcaaattattgccaaaatattttcggaatattatgaagaagaatgggaaaagttgaagaatgaaattgccaacatcagattggaagaactgaaaatgctttcggaaaagatggacgaattcggaaagaaattttgggaagaaattcaaaaagccgaaaagagaaaggaatga

SEQ ID NO: 55443 - DNA, 3727 bp, Heterodera glycines; identical to SEQ ID NO: 4701
  Genomic contig location: Contig_ID=SeqID_4701; Location=1..3727; Strand=+
  SCN-specific regions: Sequence locations=1-438,460-616,639-639,661 -781,804-821,848-963,985-987,1009-1064,1087-1383,1405-2463,2485 -3234,3256-3288,3310-3642,3665-3727
  Gene Ontology: Mol. function=protein tyrosine kinase activity; Cellular component=mitochondrial inner membrane; Biological process =transport

SEQ ID NO: 55444 - DNA, 1373 bp, Heterodera glycines
  Genomic contig location: Contig_ID=SeqID_4702; Location=874..2246; Strand=-
  SCN-specific regions: Sequence locations=1-7,38-91,114-376,398 -605,627-787,809-859,881-954,976-1128,1190-1373
atgtccgtgaaaaataaaaatgaaattgagcaaacattgggcaatctcatcgaatttataaagaaaaatgaaacattttgtgaggtgaaatatttggaaatggcaacaaaagaattggaagccgtgaaaaagggaaaagacggggataaggggataaggatcaagcagattttgcaaaatcgcataatggacacaaaattaagcattttggccaaagaattgcccaccaaaagggaaatgtttgaaaatgccaaaattggagacatcgaattggccatatttatgcccgatttccatgccgaattaagccaggcggggcaaacaaattcatattgggcaaatgaatcggaccaaattatggtaaagcataataagcacaattaggaaataaatccacgtaatatattacagaaggactatctgcaaaaagcggaagaattgtttcggttagcaaatgaattgataaaaccgttgaagaaaatcgcaggcgaacaaatggaagaactgattaaacggttggaacccgaaattagcaaactcattagcctaattgacgacaaagaaaactcagaggaattgagtgaaaaattggagaaaagagtggacaaaatcaaagaaattggaagcaaagcgatggaaattgtgctgacaatggacacgccaaaaaaagagaaaatttgtaaaacggcggaagaaatggaaaaagcaatcaaagaattggagaaaaacacgggaaaaagcgacaaagtgaaggccaaaatgagaaaactgaagaaattgttggaaaacgacaaaaaacaatttgtggagcgaccgtacaaaatggaggtgagtactgtaagagcgcatattgtgaaaagagatttttgttgaaaatttttcagttgttaattaaaatgggaaggcattttaaaaaatgattcggaagttcaatttttaaataaatttcagcggaagaggaaaggcttttaattggaatcggagagataaaccaatcggtggaagaaagacgccttaattagcgttgatctctctctatctctctctgtgttaattaattacttcatttgttaattaattggttcctttcgatttttttttatccgacattttaatttttacaaatgacaaatcattcattcattcattcttttggtttttctgctccttttgtgttcaatttctttccaatttgtttttgttcattccatcgtcgcattattaccgtccgaactgtgcaacattcgcatcaccgccgggtcgccttcgaggccaagcaaccaaaaggtttcgagaacgccctttccctaaagcggggggggggggacaatttacggtagtgtactataaagagtaataacccaaacaataaa

SEQ ID NO: 55445 - DNA, 1041 bp, Heterodera glycines
  Genomic contig location: Contig_ID=SeqID_4702; Location=1..1041; Strand=+
  SCN-specific regions: Sequence locations=1-47,69-680,704-1041
  Gene Ontology: Mol. function=transmembrane receptor activity; Cellular component=plasma membrane; Biological process=receptor guanylyl cyclase signaling pathway
ttaccgtattcttctcggtcggtttaattaaatactgtcattcattctttttaattattttattttaaggacgtcgtctcattcacaacaatcgcttcaaaatgctcacctttgcaggctaaaatttgaattcacataaacaaattaaaacggtttaaaggtggtcaatttgctgaacaatctgtacactctgttggactcaatcatcgccgaatttgacgtgtacaaagttgagacaattggtatactgtagggctcttttctgtatttgtattattcttgaatggtgtaaaaatcatctatttgcatgaattaattacaataattaaccatcccaaattggccaccattttccaggcgatggttatttgtgcgtgtcgggccttccccaccgcaatgggcatgaacacgcgcaacacatcgccaaaatgtcgttggcattcatgcgcaacttgggcagcttcaccattccccacttgcccactgaacggcttcgtctccgcattggcattcacaccggctccaccgtggcgggcgttgtcggtcagttcaatccattgaaattgaccttttctcgtttaaatgcttaatgataattggataggtctttccatgccccgttattgtctgttcggcgacacaattaacacagcggcacggctggaaagcagctcaaagcgtaattgggcattttgtttttaagcacctttttcatgctttaagcgatgcgaattcacatttccacgacgacgaatcactttttggtcaatgttctcggaggttttgtcacccaagcgcgtggagaaattttagtgaaggcaatgcttttcccttgccttttataattttcagggatccatctcccctcgaatatttattgtttgggttattactctttatagtacactaccgtaaattgtccccccccccccgctttagggaaagggcgttctcgaaaccttttggttgcttggcctcgaaggcgacccggcggtgatgcgaatgttgcacagttcggacggtaataatgcgacgatggaa

SEQ ID NO: 55446 - DNA, 132 bp, Heterodera glycines
  Genomic contig location: Contig_ID=SeqID_4702; Location=2259..2390; Strand=+
  SCN-specific regions: Sequence locations=1-132
atgcgcctcaacttcaaccaccaaagtgccaaattgccttccaaactcattaatgattgcccgcatggacgacagcaattcggcattactaaagacgggaaaaggtcaaatttggcatcgctttccgccggc

SEQ ID NO: 55447 - DNA, 871 bp, Heterodera glycines
  Genomic contig location: Contig_ID=SeqID_24698; Location=70..940; Strand=+
  SCN-specific regions: Sequence locations=1-53,75-232,254-273,300 -462,494-718,751-799,852-871
atggtcgattctatcacctaccgtttgagcgaagtgtatttgttgtggcgtgatgcaaaacaggaactgattgacaccatattggagggtgttacggttgggttgaacaaaaatattatccgattcttttgtgaaattgaactggcatacaccgcattagggaacacttggcaaatcatcgaaaaaacaggtggggctcattaagaagaaattaattgacttggctaaatggcctttggccggctccatcctcctgcatttatttacgatttgtttttaattttaaaatttaataattagacgacccatggaaacaagaagctgcgccgggtcgtttcataaaagtgccaattttaaataatttttgagaaaactcataataacttttttccaacatactaattaaaaacaatttcttggtctaatataatagctcttggattgctgtattagcatgataaatttcaaaaaattttattcaattttctttgaatatacttgaacacaactgttttaaaactagagaaattttcttatatttctcctgctaatagagcagcaacctaagagctattttaagaaacaaaaattatttaatttagttgggtttacgaaaactatgacgagtttttcttgaaaatctgtaaaattggcacttttacgggacgcacatcgtggcacttttttgcgaaacgacctagcaccgaaacaagaattcatttatttattaaaaaaaataaaatttattttcgagaaaatttgagaaaggcaccgaagcaccgaaaaaagaacatttattcaaattaatgaattgaaattgggaaaatttataagtgaaacatgttaaataatatttcgtataaatatttta

SEQ ID NO: 55448 - DNA, 820 bp, Heterodera glycines
  Genomic contig location: Contig_ID=SeqID_24699; Location=79..898; Strand=-
  SCN-specific regions: Sequence locations=1-357,406-409,431-460,482 -766,788-820
atgatcattgaaaatgagttcgtctacgccgggcacagctccgtctgtgtgctgatgaagctgatcattttgctgagcactgtttgtctggttggccttgtcgtcaaattccatgtccatgaaattcaggcaattaattttaatgattaaatcaatttatgtagaatttaaatttgtttcccctcagatttttatgaacgcgaacagtgccgaggattggcaaattgcgctgacctttcgcaaaagcatgcaaattgtggtggaaataatcgcttgtgccatctgtccgttgccaatgcaaattgatgtgttcgtttccacagtaaactccgacggacatacggtaaaatttttcaaattttaaattaaattaatttattttattttttcattttaatttatttttgcctacaattttttgtttaattaatttaggtgccaatgcgaatgccgttggacgttctcttctcaatttgtaaatttccatccaattcgtttttcattcaaatgattgttttccaattccattacagtaatgttcttccgactgtattggctgtgtcgggtgatgcttctccactgtaaaatttacctaattaatactaattgtctcattagtattgtaattgccttttctcagctcgtctgttcactgacgccgcttcgcgttccatcgccggtctcaaccgcgtgaagacggacgcaaaattcatcctaaaaacgctgatgaccatctgtccaggtattacatattgatagcaattttaaaaatacccaaaaatttgttttaggttttaatttaattaatcggattaataaa

SEQ ID NO: 55449 - DNA, 448 bp, Heterodera glycines
  Genomic contig location: Contig_ID=SeqID_24700; Location=344..791; Strand=+
  SCN-specific regions: Sequence locations=1-393,415-448
atgttgagcatggaaatggtcgcgacaaaggacgacgaagacggagaaggacaacaactacagcagatcgaggaggaggacaacgacaatgccgacattctgacccactacatcaagccggagcgcaatttgtggttgttgaagcgtcgtccgaccgttgggggaggaaaatggcaaaaacagtgggcccaatgggaggcggaggcaatcggatggaattggaccaatgcatggaatgtgatcgaagttgccaatgaagaggacgtggacgtgatcgaagatggcaatgaacacttggacatggacgaagtgacttatgagggagaggcgatggacgagatagatgagatggatggcacggacggatgaacgctttaaacagacattggacgacatttaaatgatgtgtaaaatgacaaaatttctacaatttattcatttttttaaa

SEQ ID NO: 55450 - DNA, 405 bp, Heterodera glycines
  Genomic contig location: Contig_ID=SeqID_24700; Location=929..1333; Strand=+
  SCN-specific regions: Sequence locations=1-326,349-349,372-405
atggagaggaacaagagaaaatttgccaaaattgtttcctcactcaaaaaggacggaatcgaaatttcagagagtgccaccgatgtgagtgccgatgttcagtcccttggataatgaaatttccgtatcgtttcctttaatttcagactttgttcgtgagtaacagcagtcatttggtgggcgtccccttcgagagtctcgagttgcttttccgtcgttttgacctgcactgtgccttcaccgtttacccgaccaacaaatcctactcattggtccacttttccgaagtgaatttggcgatcgctgcgcgcaatgctctcaacggcaccaaacccaaagactttcccagtgaaaatgctgcacaaattcatttgttcttcgtcaggcaaagtggggtctgaaaaa

SEQ ID NO: 55451 - DNA, 482 bp, Heterodera glycines
  Genomic contig location: Contig_ID=SeqID_24701; Location=248..729; Strand=-
  SCN-specific regions: Sequence locations=1-143,165-421,450-482
cattgacatttcggcggagaaatggttgatgcactacgaggccgactcgttggccaaactcgagaacccaccgtcactggcggacggaatcaatcgcgaattggagagggtaaaacggggaagaattggggggccaaaaaaacggggaatagggatttagcttcgtagacattttcgaagaattttatcagttttcattggtaaacttccattaccctgtgtttaagacattctctatttgtgctgagaactgatacaatccggtgccattctgttacggttgagtcaaacatcagcggccaccgcacaaattctcttccaacgttattactacctcaaatcatttgtgcgctacaatttcgaggttttttttgttgttgttgcaatttcagacaaattcggtgtattttgcatttttttagcacatggtccaagcttgtctgctgttggcaagtaaaattgaagaagaacctcgaaaaccg

SEQ ID NO: 55452 - DNA, 412 bp, Heterodera glycines
  Genomic contig location: Contig_ID=SeqID_24701; Location=980..1391; Strand=+
  SCN-specific regions: Sequence locations=1-192,216-412
taattaaatccattcctttgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggagagcaaaaatccaacgcagaattaaagtacaggctataggg

SEQ ID NO: 55453 - DNA, 461 bp, Heterodera glycines
  Genomic contig location: Contig_ID=SeqID_24704; Location=28..488; Strand=+
  SCN-specific regions: Sequence locations=1-433,455-461
atggcggaatccaaggttctttattatacaaatatttgtacagacggtaattgttagctttttctttttaaatatcctcttccgatatcaaacacactaaaactgatatttaaggacaatcagaatcgaatcctatgccatttggtggaggattttcatttacgactactgttcctccagcagctaacggtcctttccaatttggtgctgcacctccagtggccaacggaaatgtgttccagtttgctgagacgactgattgtaaggcaattattactttctgttagcattatgaaataatttagctgctgtttctacgaatgttcgacacggtgttacgggaaggaaattgctgcacgctcgaaggaagaagcgttgattgcattcaatgttagaaaaatcaccggttttgtttttgttcgttagaatatgttattttcatggaatattatgtccaggaa

SEQ ID NO: 55454 - DNA, 357 bp, Heterodera glycines
  Genomic contig location: Contig_ID=SeqID_24706; Location=851..1207; Strand=+
  SCN-specific regions: Sequence locations=1-201,353-357
atgcgcaacggaagcgaagtcatcgacggcaatgaacgaatttggtggcaaaaggtgttgggccaaggaacggcggagaatgaccggcacggagagagtgccgaggcctaccaaaagcaacgggacggactaattgtaaggcaaaacggaaggaaaagagcacaaggatggacggcacggaaaatgggcaaaaaaggcaccaaaggacaaaaggaaaaggaaaaagcgaaaaggaaaaagcgaaaaggacaaaaggaaaaagcaaaaaggaaaagcctaaaaggacaaaagcaaaaggaaaaagcgaaaaggaaaagcctaaaaggacaaaaggaaaagcgaaaaggaaaagcctaa

SEQ ID NO: 55455 - DNA, 1462 bp, Heterodera glycines
  Genomic contig location: Contig_ID=SeqID_4703; Location=435..1896; Strand=+
  SCN-specific regions: Sequence locations=1-90,112-482,504-560,582 -728,750-1462
cttccatctgtgccacatcagaatggggtctcatccgacggttttggccctggtcaaatggctattttagccaccgaacgtcttgacaacactttggctgagcgtgagtccgagcaatggccgttggaggggttggacccccaattggtgggccatcggccgtggagagtgttgcgccagcgcattttggacacattttcaagtgcaacggacagactttcattggagagcagttttttgaggggaaacgaaccgacggaaacgccaaattcggaggagaggcgaaagttacgaaagacaaccagcggagaagcggaaaagatgagacaaaggtgaaaatcatcggcaaaaaagcaaaattataatttaaaattcagaaaaaactttgccattgaaaaacacgtgcaaacggtcgcaaaattccacgaacttacgcaggacgaatggacgcgcaaattgaaggaattgaggcgcattttgctaattaaatgggaagaggaaaagcgattggaatgcataaaggtaattgagaaagaattccatttattcaatggggtttaaacaaattcctaacattttctcattatatcagctgacttctgaagtggcaatgctaatttccaccaatatttcgtctgcccaattttatccctcccaatttgtccatgtcaccgactttttggatctttttggccatttggtgtacaaaaggtgataatataatgatggaaaattattattttagcaaataaacttcatttcgttccgattttcttcagacttttgctccgagcggcggaggaacgccgcggggttggacttggcgcattgccttctcatttcgacactaacgacgttttggaggagacgcggatcaaagcgcgcaattggtttggcaaagtgaacgaaaccgtcgctttgctggcgccacgcatttatcgtaagcggaaaacagcggcaaaaaatgtgatttatttcccgaaaagttttgaccgctttgctgccgtgccaacgtttcatggaccctttggctgccattcaggaaaatgttttggaactgtgccaatccgtcaaacaggcaaatggcacatgtccaagcaatcaaaattaacaatttgaggtgcaacatccgctcatctcctcctatctccgctgttacatttgtcgcattgcgatgcgactgaatgccgccgatagggcgccccattggaaatgtctgaacgattggctccaaacctacgctcaacaaccggtaaacccggtgacccatcaaagactcaatgcgttttcttccgacctttttgcttggccccgccatggaatgggtcgtccaatgcgtcgcgttcaacgccgtcttctactcggatttgcacccgttgtgggagtattgccgtttgcccgaacggcgtgccgttgtgctgctgccaatgctcaacgcattgccccgcctttatttgggtga

SEQ ID NO: 55456 - DNA, 1329 bp, Heterodera glycines
  Genomic contig location: Contig_ID=SeqID_4704; Location=11..1339; Strand=+
  SCN-specific regions: Sequence locations=1-184,206-685,707-941,971 -1126,1169-1329
tgaatttgctggggttgccctaattctcttaggtttttcatttcgggtcgattccttcgtcgccttctttttggacactttcgacggactttccctctcaaccactcttttcactcacattttgcaactcggcactgatttcttggccactttggtgcatattccgctcgaacaacaacatcaaagtgaggaggaggacgaagagaccgacgaaagtcggcgattgccattgaaacacttccgccgctttttgcacttcgtcctcagcttttggcacagtgtctcgccgtcgttcgccccctcccctccactctctcatcactctctcaatcttcccctttcgactcaatttgactttgtccgtctgcttgtccgttgtctccaatatttgtgcatcatttggccaactgtccatcgcactttccttccctctgccgccgatcagtcgccgctgattgaagacgaagagattgtgcagcaattgatggagcagcaacagaaccaactgcaacttgacgaagacaaggccgagcaaagccaattcaatgtcacacttttacggaacgtttgcactcaatgcgcggaaaaaattgcggacgctctgaagccctttttggtgaacgaaaacgcatcgggtgaatttaaaaaataggaaatgtgcggaaacttcttggaatttgtgaaattgcagatgagatgggtttggctggtgttgaactgcttgaactcctcgcccaattcggtccagccgatgtcgaggaaggaaacggagacgcttctgctgttgtccttccgggcgttctcctcacattggccaaaacaatttacaaacagtgcaaacggaagccggaattgagaaggcgaatccaacgaatggccaaacgataaaacgatgctaatcactgaactttcgcttattttcatctcatcggcgcttggattgtttcgatttttctcctcccaaaatttttgcggtgtttaatttcttaaattcctttcggatttacttcaaactttccatttgatatgggtttgcctttgtttcattgcgttttcttggccatacatatccttaattattgcgcttttcaaaatttgttaaattattcgcttgttttcctctgtgattttatgtattttcaaatttaaatgttaaataaaattatttcactttgaatgattttttgatggaagggttagccaaaaagagagtgaatgaactgataatgtttttctttttttcaatttgttcattccgaaggcttcaatcaaatggccattctcagtttcgatgccctccgggcgattgacagtttctcccatttttga

SEQ ID NO: 55457 - DNA, 620 bp, Heterodera glycines
  Genomic contig location: Contig_ID=SeqID_4706; Location=446..1065; Strand=+
  SCN-specific regions: Sequence locations=40-40,68-620
atgactttcgttggcacagagaatgttcaaaatgctcgtcctcagcagcggtcagcttttcttcatttcggcgagcagtgcaaagccgtgcagaatcagcagctgctctccatggccatggcattcgacaaacactccgacacggaacagtccctcctccaactccctttccatgtcagaggcattctgcacagaccgcgacgaatggacaaactgaaggaatgggtcaaggtggaacttgcattttgggaggttatcattggccagttaatcgttaaaaatttgcatgccaatgtttaaatgtgaggggacggcacttttgaaaggcttcccattaattagcccattactctcccgtaatgacattgttaagttaagattgtttaggtgcttctctcgacagaaaatcacttccaactgtctctcgtgtcaacatcaagcctttccccgcacgaaatcgctttttccatcggctgggatttgtcccgcccccaaccgaccattagcgaggctttatcccatatcggattcaaagaatggccaaaggcattcacttctaccgcttcggacattgagcggaaagacaatgaaaacgaagagactgaagaggacgacggaca

SEQ ID NO: 55458 - DNA, 807 bp, Heterodera glycines
  Genomic contig location: Contig_ID=SeqID_4707; Location=466..1272; Strand=+
  SCN-specific regions: Sequence locations=1-450,474-642,690-807
atggtgaaaataaagtcaaaagggaattggggagcatttgaaagaagccgacttttagaaactcaaaatgataagccacgaaattggcattttggtggtcgaaccgcacgcgcaacagcccgactcaaaactccaagtgcaaatcagcgggaaagaccaacagaaaaggacagttttgtcggatacggtagtgtgtaacatatacaagtacaatcaaccatttttctgacccttttagcctttgtcggacattccgaatggcatacaatttgatcggtcattacccaccaaaaaggaggctttaatcgtcgaatggaccacgtcaaatgctaactctgagggttctgtcggtgccaccggcgcaatttcagtgcattttgacggccaaaaagtacaaattttactcgacggtcagcagaatcgtcatcattcgtgtggtagtaactttgtttaattaattaattaattaattattattattattaatccaaccaattactttaaggactgtgcggagattggaatggaaatgccggggacgaatttcgaatgccaaacggaggacagacggaaaatgccaaagagtttcaccaagcctattcgctggtggacggagagggggaggaggacggagaatgcgaagacagcgcaattttggacaaattccattcagaaaagacggaggaaaacgaaacgaatgagccgaaacagcagaaggacagcgaggaaaagccgaaaatggagcaaatcggtgaggaaaagcaacgaaaaacaaagcgaaagaccgaaaaaagccgcattttatag

SEQ ID NO: 55459 - DNA, 1149 bp, Heterodera glycines
  misc_feature (290)..(290): n is a, c, g, or t
  misc_feature (304)..(304): n is a, c, g, or t
  Genomic contig location: Contig_ID=SeqID_24709; Location=91..1239; Strand=-
  SCN-specific regions: Sequence locations=1-89,132-352,374-951,974-1149
atggcgcgtactacaatgagttttttatttaatcctcttaatgaagatcaacgggaagaaatgtgcgaaacttggctttacacctttagtaattttaaaatagaaaatcagttaaaaaataaattaaatatcttaggcacagaaaatataatttatgcaaatgaatttgaattttcatctcatgaatatggacctggagaaataaaagaaataattggtgatggaaacttgggtggcgtagcatctctctggctttaaccggaagtgaatggaatcacacagaaattcgngagagatgttattngagtttttggaagaagctatatatcagaacacgcacatttaaatgtaaatgaaaatgaatggtggtgtaagtattacgaattttataaatttatcaaaaacataacttttatttcagtactttttgatagtatagaaagcattcaagagcatatcgaaaaagcaattgcacccgctgctggtgctcatgaaatcgaagaatggatgagcaatttagatttagcagcagtcagcaaaatgtttcgaataaatgttattgtatgtgagctcgttaagaaagaagtttatcgttggcaaatgtattcaccagcagatttggaaacttcggttagactttgtaaaatatttgttttattatgaattttaagctttcgaacgtgagtcagaagaagtcttcaccatcaatatttctttattttcatggccaacattttgaactcatcaaacaaccacaaaagataaattaattttttctttcacatttaggtgtcagtattaatatcaggcaaaagccaactaactaaattaagccaactcgtactactccaaaacattaagatttagagtgaacacggatagtagcgcgtttgacttttcaaatcttattacacatgaaaagtacgagttggtataatccttaatattataaatgcttttcctttataaattccaaaaaaatattgttgtacatattgtggaacttcattattcgattcttgtttgatagcacccgtgatatggttttgcaattttaaacaaggttataaaggagaaaattgtttagcttaatatttaaatatagttgaccgttgttgctataaccatgatgtatgttacataaataaa

SEQ ID NO: 55460 - DNA, 55 bp, Heterodera glycines
  Genomic contig location: Contig_ID=SeqID_24714; Location=292..346; Strand=+
  SCN-specific regions: Sequence locations=1-55
gctatagggaagctattcccgaaggattcggtctccccataaatctggcgcatcg

SEQ ID NO: 55461 - DNA, 296 bp, Heterodera glycines
  Genomic contig location: Contig_ID=SeqID_24715; Location=937..1232; Strand=-
  SCN-specific regions: Sequence locations=1-296
atgctgtgagtggatttagcaaatccaaaatccatttttctaaaattgttcgactttcagaccattgcccaccgccccgcaccgcccccggctactgagtgtgatcagtcgaccatcgagaattggagaagaacccccactgatgatccacgaggctgctgtcctttcgtctctcaccattttcccgatcattttggcatttccaaaacgctgatcggacaattctcaatgttatttttgtatttgtgcaaaatttcgttggattgttctgtcgcacaaaaaaatcaaagaataaa

SEQ ID NO: 55462 - DNA, 585 bp, Heterodera glycines
  Genomic contig location: Contig_ID=SeqID_24717; Location=304..888; Strand=+
  SCN-specific regions: Sequence locations=1-175,303-311,400-585
atgtcattggacacatgggttggtcgctatccggaaacatacggctatttcgatggtggcaaaatttatggacacaacaccggcttcttcgatggatttcccgagttttcaagcggtgacgtcgtcggatgtggtgtcgattgtgcgacccatgagatcatttacacaaagaacggagaacgattgagtgagtgtgggaaacgaagagaaagagaaaaagggggagagaaagtgaggtggtaaagagagtaggacgagatagagagagaaaagacgaagaaaagggagaaaagaaagagagaatgattttgtttaaatattaaaaaaaaaattaatgataatttttttttaaatttttaaacaattttctataaattttcaattaacaaaatatttttagttagcgaaaaagccatatttaacgtgttgtgtaaacaatagtagtgattcgatgttcgaaaccaaaaattcaacaaaaccgagactcgacccacccgagactcaagagatagagaccgaaaaaatacgagacccgagactttttaacaaattttttgttcacttcaaaatcgattaaaactttca

SEQ ID NO: 55463 - DNA, 1914 bp, Heterodera glycines
  Genomic contig location: Contig_ID=SeqID_24718; Location=140..2053; Strand=+
  SCN-specific regions: Sequence locations=1-94,116-131,153-257,280 -426,456-903,1061-1068,1213-1238,1261-1280,1339-1402,1425-1588,1610 -1612,1657-1914
  Gene Ontology: Biological process=N-linked glycosylation
atgttgatttgtgtggggagacatttaaaaagtgccaatcgaagggacgaaataatggccaaattacacttggaaaaaatgatggccattttggaggaggaaaatgatgaaaccgatgggccattcaaaggcattctgatcaatcacagtgagtgatcggtttattatcgctgttttgggaccaaagtttcctttcttagtgaagtgaaaaaataatcgttttaatatatttttttctgattcttataaatattcggaaaaagtaaattcagaaaaaatgaaggggaaaagtaccataaaagcgaatgttttccccaaaattattggacaataaatgacaaattaaaaacatttagaagaatcattcggcacaattctcaacaaggacggtattcaaaagatcaatgaatggctaaaccttgaagtaaataaaatacaaaacaaatacattaaaacaaagtaattataaaagagctaggatttttaagcgcaatcacccaaagaatagaccacaaaactcgaaaaataggaaaaataaacaccagcgtaaactttacagttttaatatgtttcaaaataaatttaaaaatccggcccgtctttaattattttattattacaaatttagacaaaatatttttcgttgaatgaaaagttttcatcggctgcttcttcttccgatgacgaacaaagattcaaagatgcgaattatgatgaacaaattgatgaagataatgagagtaataatccaaatgatagtgataaattagagaggaacaaacaaaaagaaatggaaaattcgagggaaaatttaaaaaatgaaaattttgaaatgaattattttatgggtggacaaaatcaggaagaaaataaatgcaaaaaagaaaagtgcaaatggagcaaaaaagaaagtgaaaaaatggaaaaagaaaagagaaacgggaaaaaagagacggaaagggaggaaaatagtgaagaaaaagaagaaaaagaaaacaaagggatggaaaggaaagaaaatagcgaacaaataggagagaaacaaaatgaaaagaaaagatggcgagaaaaggaagaaataaaaaggaaaaaattgctggaaaaaaaggaaagagaaaaagaagaaagaagtaaaaaatggatggaaaaagaaaaagaggaaagagtgatcaaacggaagaaaaacttaagaaaatcagaaaaaggagaaaattatcgctttttgtcaaaagaaagtgttaaagcaatgaagcaaataaaaattgaaaattattcaggtgaatattaaataaattatgtaaaatataattgttaagatttattaaatgaaaaatatttggccaaattttacgacaaatttttattaaatgaattggaagaagagaattgtgtgatatatttgcatgttgcagcatttgttagagcgattcattcaaaatcaaaattcatcaaaattcgaacaaaaaatcacgaaacgaaaatttcgaaaagttttgaggaaaaatggcgcacttttgcaaaaaatgcaatgccaaccgaaggcgaacaaatggaaattgaattgcaaaagttattttcattggacatcgcacttaatgagataatatatgggtaattaatgtataataattaactaattaatgataattattaattgtattaagaccaattgaacaaaaacaaatggaaaaagcaattgaaatgcttgaggaaaagcgaaagggcaaaagcaaaaacaaattgggaacatataaaaggggggaaattgaaaacattttagagcaattgcacctccaaatttttgggattttatgtgctaaaaaattgacaaattttgtggaaaatgaaaaaataataatcggagaaagaattaaactaattatgagaaaagaaaatggagaaaaagaattttaa

SEQ ID NO: 55464 - DNA, 719 bp, Heterodera glycines
  Genomic contig location: Contig_ID=SeqID_4708; Location=558..1276; Strand=-
  SCN-specific regions: Sequence locations=1-131,153-287,309-328,350-719
atggaacaaatggcattttacaattcaggcagtagtacgtcttcgcacagttccgactatgcagatggcttgggcccgctgggcggtggtgtgccggttggtgtccgaactcgactggccagccaagatacggccaacaaaatgatggttttcgatccggccaacgtgtactcggtgagaaaaagcttaaaacctttgaagttttaaaaaaaaattttttgtagagaccggcgcaggccgaagtcccacgctgtattttcagtgggatcccagtccgcattcccgcatttgttttttattttattgttccaaaagtcattgcacacagatatttactcataactttattcacaacagacatagagaaataaaacaaaaaaaaaatctaaaagagaacatattagcgaatgataaaaatcgaatgtttttaatgtgcccgcctttagctttgattcagagacgcaaacgcttggaaaaattttcggcattttgccgcagctttttttgggtattttttatattatatggctaagatcttatcggaagggtccactttttttctaagaattagtgcaaccccttatcttcaaaatagcattaaaagaataattttacatatcaaactcaaagaatatgatcattcgcgcaaaggtgccaaatctcaaatttcggttccagcagaactgttttcgggcataacttttcttagaactaataaa

SEQ ID NO: 55465 - DNA, 1297 bp, Heterodera glycines
  Genomic contig location: Contig_ID=SeqID_4708; Location=1592..2888; Strand=-
  SCN-specific regions: Sequence locations=1-93,115-346,641-655,706 -723,745-928,995-1121,1146-1243,1275-1297
atgggtaaattaagggactggaccagtggttcttatgtgcaaaatgttctgttcggcgtttccgagcagtgcccgggatcggccaaactgcttggcgctgagggcggtgcggcgtatataattgacgaggactcggcatcggactcatttggcggatgggacgcggcaaacggtggcggcgtcgcggttcagccaattggtgtgtgattattgttaagagcatccgaatccactgatgggatacgaaagtgccgtgcaaaaatggcaaatttaaatattttaattgcaaaattttcaaatttgtgtaaaaatgcatataaaaaattggtaataaaaatagaatgcgaaaaaaatacaaaatcttaaaatatttacaaaaataaatttgaaaaatttaaaaatattttattttaaaagatccaactatttttatatagaaagaattattttttatatatatatgtttttaattttgtttgaaaaataaaataaaattcaaatatttacaatagaaaatttgaaattttaaatattttttttaccaaattccaaaaatttttatggaaagaattaattttttctaacgttttaaaatatatttgcaatttttttaaatatataaaataaaaatttttataaagttgttgataacttcaaaaaaacaaatatttttttgttcaatttatgaaaaaaattaattttattgaaacaaatatttggcgtatttgaaacaatgaataaaaagtttggcttatttgttttttttttatttttaaggctattcaaatgcaattaatgatgacccaagcggcggtgctgctgatcatcccttgtacagcggaattgattccgtttattcaacagccggtggattgtcggtgttggcacttgtcgttttggttggcacgctattcggctttttggtaacaaatttaaaaaatatatttctttttttcttaaaaacgaataattaaaataatcatttttttttataggttggctggcgaatttcgagatggcgaatgctcagcgagctggcacgtcatacatcatcaggcatgtgtaaaataatattcaggggtcaagctaatagtcccaaaaaatacttcagatggagaaagcaccttttgtttttattttctgttacttaaaaaaatttcgacaaaaattataataactttttttttcagaagcaaactaaacttatattttttggtattttgatagacctatttttttttattagacagaaaaattttaaaaatttggcaaccgtattaaggcctgaaaaattaaa

SEQ ID NO: 55466 - DNA, 1613 bp, Heterodera glycines
  Genomic contig location: Contig_ID=SeqID_4709; Location=2655..4267; Strand=+
  SCN-specific regions: Sequence locations=1-97,232-437,680-912,968 -975,1003-1082,1105-1341,1367-1423,1445-1533,1555-1613
atggcatttttacttccgatttgcctttcatatggcattcctcaatggtctgtcccggtgctttccagtgaatactctacaaaaatgataattgcccattgattaattaaagtaatcaagaaaattaattaatgaaaatgattactgtaagttgagaattaaaaataattaactaattataatgactgtcaattgataacttaaaagtaattaactaattaataataattacatttctggattccaaattggagtagctcaaattgaataatgcatctcttagaagtaaaaaacaattattatttaaatgttcattacaattatttcttctaccttgctccgatcagaatgaaatttttggttgcatcgatcaacaaaaattggtcttgacttttgcttgggctgtgaaagcgtggagtgctcccaactgaatattcaaaaaataaataattattattggaataatttaaataaattaattatttttaaattactattttagaaaattaagataattatttcaagcaaatttaatttattttttaattatttagaaaattaagaaaattattacttaacagaattattacaaactttattaatgcaaaagtttaatgatttaaaagtaatttttatttattattatataaattaatttaattaataaaaataaataaatctcattttttggagttaatataaacttttgatcaccttcattgacaatttgtcgaggtctcggatttaaattatcaacagcaaccaattgggcatggaaagatgagatcataaacagcaaaaacatttgttggaagaggtggttggcaaaaagcattggcattctatctctgattttgttatgagcttggctttgcgttgtcaatccttttaaaaggcaaacaattagctcactaattaattaattataccattcaaaaaaaagtttttaatttatttttatttttttggcaaaatcaaagtaatttttaaaaatttgatttaatgatttttatcattttctgtccccatattagtcactgctccataaaacaggtgaaattttacaatttttaaagaatttactgggttaaaatattaaaatttcagattttgtggcactttttggtgccgtaaaccctgataaacctctaactgacgaaaaagtaaaaatatattttttctgttatctctatttttcaccttcattgttaatgtcaatgttatggtggtgtcatgatcttatgagaaatccggattttctttgtacaaagatgagtgaggggcattatccattttcatataaatcaatagagaagggtcaaatttccaattttttgcatgtttttatattattttttttattaaaggagttgttcctaattggtaattaaaataaattacgattgaagaaaatgaactcgaaaaaactttgaaaaattttgggtatgaaattaaatcacgaggcatgaaaattatgctcaaatttttttaaattttggaatgaaattaatcccatgtaagaaaattaattcacaaaaaattttggtaaattggtatatgaaatccaaatcccaatgcaagaaattaatgcacaaattttttttaatttggca

SEQ ID NO: 55467 - DNA, 256 bp, Heterodera glycines
  Genomic contig location: Contig_ID=SeqID_24720; Location=743..998; Strand=-
  SCN-specific regions: Sequence locations=1-8,30-256
atggtatgttttaattaattaacttattttgggctttcccgcacccatttaagtggtgcaaccctttgatgttgccacccagggatatgttccagcacgtgccaggtgatttcgacaatgatagatctcgacagggattgatttcgacattgtggactcgacaaagagtgatttcgacagcaccgataaatttttaaaaaacacgagtgtattaaaaatgtgagccaaaaatgaagtcatacaatgatggaataaa

SEQ ID NO: 55468 - DNA, 219 bp, Heterodera glycines
  Genomic contig location: Contig_ID=SeqID_24720; Location=1256..1474; Strand=-
  SCN-specific regions: Sequence locations=1-219
gtgcttagcagtccatggcgtcgccactccatctttttgggcagtcacgcaattgcagcgagcgaagaatttgaaaaatgctgtgtaaatgggatgaatttggcggaatatttaagcaggattgacggagaatgaatgaattaatgagctgctgatgaaccatatgaaacaaatttttggggtttttaactttttttttcatttttaaatgcaaataaa

SEQ ID NO: 55469 - DNA, 110 bp, Heterodera glycines
  Genomic contig location: Contig_ID=SeqID_24721; Location=10..119; Strand=+
  SCN-specific regions: Sequence locations=1-110
gttggactcctttgatgtacgccgcctatttgggccatcgcgaactgtgccaactgttggttctgaggggggccgacgtggaggcagccaacgagcgcaatcaaacgggg

SEQ ID NO: 55470 - DNA, 1258 bp, Heterodera glycines
  Genomic contig location: Contig_ID=SeqID_24722; Location=190..1447; Strand=+
  SCN-specific regions: Sequence locations=1-66,88-261,284-666,689 -743,765-798,831-1179,1203-1258
atggacatagtgcatgtggtcacttcgcagcaacggcagacgcaacattatgcgactccaccgatggtacaaagatacaacatgtggcattttgcgatatttactaatgctttttcatttcccgtaaagccgctctacacgccctatttgtacgccgccatggcaccgccccatccccaatacaatccatacgcgtattactacgcccccgttgccgctccttccgccgcttcgtcatcgtcctccgctgtgccgccgttcctccaccatccgccaccgccccatgtccatttgatgccggcaccgccaccgcctccggcaatgtttgcgccattgtcggcaaattccgcagccggcacttctgctgccaacaacacagcgtcgaccagcaattacaacaacgccacgggcacttccaattttgggtttgactgtccgcccgtcgactccaatccgtcccgttggtccgccgaaacgctgtgccggtggctgactgcggccggactcgccgactgtgcccagcgtttgctcaatgaggtgggaaggcggagggcacggaaacattattgggttgctgttttggcaaggacaatccaagctttggaccgaagaatttcacaaccttttcaggaagtggacggcgcctgccttttgctctttacgcccatcaactaccaaaatttgggactgaaattgggtccaatggtgagtacggttgtttttttgaactgaataccaaacattttttgtaaattaaggtaaaacttcagcaaatagcggaggtaaatgaatgaaaaaattttgattaattttcatttgtttttgtttacagtatctgcgacagttcacatttgccgacaaccgctaaaaagattaaaaattggagaaaaacagttttttggacgcttttttttgttaattcaaaattttctgaatttagcactttcattttatttatttaccgataaagaatttgccatcggaaggtcggtgaccattttttgcttatttgttagactgattttatgtgttattctaatatagaaaaatttggctccaataagatttatacgtcctacatatcaatcgaaaatgataacaaacaaagaacaactggtattgtggttcttaatttaaaagttcgaactccgtgaaagaattttaacaaaaagttgaaattttttataatatccattgaaatcaatcaaattttgccaagttgagaatttttatcgaattagcattgttttgcatcaaa

SEQ ID NO: 55471 - DNA, 828 bp, Heterodera glycines
  Genomic contig location: Contig_ID=SeqID_24724; Location=109..936; Strand=-
  SCN-specific regions: Sequence locations=1-828
atgaagggtgtcggtgcggaaagatgccgaaaatttaaaaatgcaatggacactcaaatgaaaaggtttagcgaaaatttgtgggccactgaaaaacccgagaaaattgaatatgcatgggcaggtgaacgttgtgaaaccacagttaatgattatttggagaaaggacaagggggaattttggacttttcattaataacttcgtttgggtacaaactcaacccatataatggttgggaagaaatgcaaagacaaacatttttatgggaaataccggaaccaagcgaaaattattgggctactcattttccagtgggcgattttttttcagaaattacggatgatgcaattgtggttgagagtgagcagagcgtttttttctttgaaaaagaaaccgcagaggagcgtgaagggattattggggtaccggaagaagcgtacaaaatgtcaaacgatgtttttatattaattcattctttgtcaaagaagcaaaaaagggaaataatggaaaaagtggaagtctcaaaaaagggaagaccgtttaaacaaaaagcacaattaaaacagaaaaatgtacaaaaacaacaaaatgagtctattttggtcaactcaaattccacctcatctcaaaatgtgctaaatgttacaacaataatggtaaatactatacccaaaccgactgtagctatattaactgtgccacctctgaagacccaacagaaaataataaaagcaactgccaatattataactactaccatggctccaaacattaaaattacagtagcaaaaaaagaaaaattaacaaaaaacataccggagaataaa

SEQ ID NO: 55472 - DNA, 552 bp, Heterodera glycines
  Genomic contig location: Contig_ID=SeqID_24725; Location=317..868; Strand=-
  SCN-specific regions: Sequence locations=1-75,534-552
atgggtagcacgcgggtctctaataacccgaagtttgggttcaattcccaacggtgcgcccataatttaaatgtcacatttcattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacattacagactcagatatgtttataa

SEQ ID NO: 55473 - DNA, 307 bp, Heterodera glycines
  Genomic contig location: Contig_ID=SeqID_24725; Location=1079..1385; Strand=+
  SCN-specific regions: Sequence locations=1-256,281-307
atgttggcgaggaagttccgtggcattcaaggatcccaaagtaaatccaatctggcacacaacgcatctttcatcattttggagcatttgttggttcacttccaggttgggcaaaatactatcgcattgttgagcgagttagaccccctccaatctcaaaagtaggagtgggttcccttcttcttcgacgtagttgggtccgaattggttgggttctaattgcaacggactggtttcgtctcacggttggcggtgccccctaatattaaacacacacgtacacgtgtcgctcaaaatttattgaaaa

SEQ ID NO: 55474 - DNA, 1503 bp, Heterodera glycines
  Genomic contig location: Contig_ID=SeqID_4710; Location=368..1870; Strand=-
  SCN-specific regions: Sequence locations=1-1503
atgttcgacgccaagccaacggaaaagcttcaagatttggtgacgcaagccaagacaatcttcgaagcagcgggcatgaaactccgagaattctacggaagcaacatcgaagagctaaaaaagctgcaaccagacgacttgacaaaggacctcgaagataacaaagtgctcggcattcgatggaaaccaaaacacaatcggctcatcttcaaattaccaatcttcgaaggaaaaatcacaaaacggacaattctgtcgcaaattgccaaagtctacgacccgctcggactcatgtcacccgtactactgccagccaagctcattcttcaagaagtgcaaaacttgaacccaaaatgggacgacgaattgccagcaaacatcaacaaggactggttcaaattgatggcacagtggctcgacagaggcgaagcaatcacaatcgaatttccacggcacatccaagccatcgactcagtggaattccactgcttctgcgacgccagcaaatacggcatgggaattgccgtgtaccaaaaggccaaaacaataatcagaaaggatgaatgcaacctcatctacgcaaaaagccttgtcaaaccaatcaaagtggcagcgcacgacgacacaattccaaagttggaacttcaagcactgactctcggagtaaaagcagtcaaattcatccaagctcaaatcaaattcgccgatcatcaagtcatcatgtggacagacagtcaatgctcagtcgaacgacttcgagaaaacaagcgccaagatcgatttgtggcaaatcgattacaaaaaatccgagaagcgaattttcaagtcagacacgtcagaaccgactcaaacccggcggatatggcatccagaggcgcagatccccaatgccttcgaacatcactgctttggcgctttggcccgatttggctttcaaaagcagacaaatggccagaatccaacgtcatctaccgacccagagatgaattcaaagaagtggaaaagccaccaatcgttgatattccagagcaaccaattcaagcagtgcacagcttcatcgcatctgtcatggaagactcagtttctcttgccggcagcgacgacgaaagtcaacaaccacgtccaaagaagaagttcaaaattccgaaacgacgctcagcactgttacgacccatcggtcagcagcaaagtccattacaaggacaacacaaacgccgcaagcaactacaagactcaggcttacgcaagttatttcaagccatctcggaccaacaaggaagcagcaaggccaccacaaaggccatcgaggaaagccgagaagtgcagaaggcaccacgacatgaacagatcgagcatgaacaacgaatggtgaagaaaagtcaacaagaagcaaatcgacatcttcaacccgaaaagcggcagcaaaaagaaattcaagaagtgccacattcaacaacagaagagcaacaacgagaaaccaaacgccaatttatcaaagtttag

SEQ ID NO: 55475 - DNA, 669 bp, Heterodera glycines
  Genomic contig location: Contig_ID=SeqID_4710; Location=1232..1900; Strand=+
  SCN-specific regions: Sequence locations=1-669
caactttggaattgtgtcgtcgtgcgctgccactttgattggtttgacaaggctttttgcgtagatgaggttgcattcatcctttctgattattgttttggccttttggtacacggcaattcccatgccgtatttgctggcgtcgcagaagcagtggaattccactgagtcgatggcttggatgtgccgtggaaattcgattgtgattgcttcgcctctgtcgagccactgtgccatcaatttgaaccagtccttgttgatgtttgctggcaattcgtcgtcccattttgggttcaagttttgcacttcttgaagaatgagcttggctggcagtagtacgggtgacatgagtccgagcgggtcgtagactttggcaatttgcgacagaattgtccgttttgtgatttttccttcgaagattggtaatttgaagatgagccgattgtgttttggtttccatcgaatgccgagcactttgttatcttcgaggtcctttgtcaagtcgtctggttgcagcttttttagctcttcgatgttgcttccgtagaattctcggagtttcatgcccgctgcttcgaagattgtcttggcttgcgtcaccaaatcttgaagcttttccgttggcttggcgtcgaacatgatgttgtcgacgtacagattctcttcgat

SEQ ID NO: 55476 - DNA, 3151 bp, Heterodera glycines
  Genomic contig location: Contig_ID=SeqID_4711; Location=21..3171; Strand=-
  SCN-specific regions: Sequence locations=1-2145,2167-2730,2752-3151
atggccgcaccaattcaacagaaactcggcgctgcactcaaagttctctcccgcagccgaactgcggcggagctgaacatccaagccgaccaagcggcatcaaatctcgaaaatgccctcaacttcgaaattcaattggagaaagttcaaaaagatgccaaaacgatggacatcttcctcgacgatgtgcgcgaagcactcactgcatgggcagatttactgcgcaaactgcctgcactggaacgcgatccggcagaagcagatttcaacaaattcgagaaaaaagagcgaatcaacgacaaagtcgacgaagcagcactgaaactgcgcgacttgcgcgacttaatcggcacactcacgtttcaagcccgactcttccgcagcaaggcggacaaagaagaacgggacgctcaagcagcctatgcacaagcaacacaacataccgcacagcaacaaacaacaaagacgccgtccttcactcctccgttctaccaattccaacccattcagctggacaagttcttcggcaacaaacgcaaatggccggagttctacgaatcgttcaaatcagcaatcggcacacacgcactcagcaaagcgaagaaattcaatctactgcgcaacctgctcggaggagaggcccgtgaactcgtggccggctttcgactcgaggacaacaattacgacacggccctccaattgctgaaggacacatatggcgcaccggacgaacacatcagggcacttcacttcgaattggcaaacctcaagccctgcaaaaacctgcgcgacaccaaagaattcctcctgcaactcgatcgactcacacgcgaactcaacaatacaggagaagacattgaaggtccgccaaccttcctcatgcttgaaaagaagctcactcccggatttctgcgcacaatcctcaccaaaaagggagaagacccggcacgctggaacacgacaaagttccgagacgtactcaacgaagctgttcgaaaagaaacccaaattcaagaagtcatgggcgagtacggacactcgcagcagcatccgcaacaacggccacaacctcaaaggcccaatttctcggcatcgaaattccgagaccgtgcaccaatcccacagcaacgggaacgcacattcatcacctcagcggtggatgacaatcacaaaaggctgatcaacagacagcctcaatataagacacagcaacaaaggcctcgcgcaccacaaccgcaacaaagaaacttgcgcactttcaacaatcaaaggcaatttccaactcaacgtgcaaatgcgaccaacaatcaacgacaatttccaactcaacgtgccaatgcgatcaacaatcaaaggcaatttccaactcaacgtgcaaatgcgaccaacaatcaacgacaatttccaactcaacgtgccaatgcgatcaacaatcaaaggcaatttccaactcaacatgccaatgcgacatttaatcaacgcaagcctccaagtccatgcatcttctgtgacaacgatcactggaataaagaatgccggaaatacagtacaattcaacagcgaagagaagtactacgcacaaaggcattatgcttcaaatgcctcaaaagcaatcatcaagcaagcaactgcccgcaaccgaagaaatgcttcaaatgcaaacaacctcatccaacggcattatgttatgcagacgaaaaaccaccgaaccaaatcacatcagcaatgttggggcaaacacaacaaaatgtgtcaatcacaactcaagacggaagcaacgaacaaacggcatcgacatcgcaaatgtgcaatgccgtaaacggaagcgacacccgcgcactcctcatgaccgcaacttcaacggtcttcaatccagcacaaccgcatctcagcatgactgcggcaattttcatcgatccaggcagccacagatcattcatttcgtcaaaggcagcacagctactggatcttccggtggtccacaccgaagaatgccacttgaccagtttcggagaacgcgaaccaaaaagatacatcagcgacctggtcaagctcggatttctctgcacgagcggggaaaaactcatcttcaacctcaacgtcatgaaatttttggtcaacgacatgccaatgattcaactgtcagagctggacaagacagttttgaggcaacaaaagctcaatcctccgcatgaacaacgacaacctgacatcatgctcggaattgatgtctggcacgaactgcaggttcaaccaatcgaaaagttgccaagcggtttcacactgtgccgatccaaaatcggcaaaatcctcagtggatcaagacgcatcgaaatgcatcaaacgccaaacgtgacatttgtcatgtcagtccacggcactgagcaagaagaagccaatcaatcagtcacgttcgaatcaaccaaagaagagacggaagttttcacaatcgaagatgatttcaaaaaggacgaacaactcaacaacttcttcggattaaatctgattggcatggatgacacatcaacaccaatcgatcaggatcatgtgatgatccacttcaaaaagaacctcacgttcgtcaacaaccgataccaagtcgctttgccctggaacgaccgagttgatgctcttccaagcaacatccatcaagccaaagccaggctcgtctcattgatcaaaagactgcgcagcctcaacctgattgacaaatatcaggcaattttggatgaacaagttcaaaactcagtcatcgaatacatcggtccacccgagtctccatcaagtgcatggcctgtgcattttctgccacacagagcagtcatcagagcggataaagcaacaaccaaaatccgaatcgtcatggatgcgtcagcaaagccaaagaattgtccatcagcaccatccttgaacgactgcttgtacacaggaccacaactgctgaagaatctcaccggcatcctcctgcgcttcagacgcatggaacatgtgatcctcgccgacatcgaaaaggcatttctgcaacttagcattcgacacacggacagagatgcctgcagattcatttggcttaacaatcccgagacagcagagctcaatccaatcagccactccgaattgcgcctctaccgattctgccgtgtcagtttcg

SEQ ID NO: 55477 - DNA, 681 bp, Heterodera glycines
  Genomic contig location: Contig_ID=SeqID_4711; Location=2172..2852; Strand=+
  SCN-specific regions: Sequence locations=1-681
cttttcgaacagcttcgttgagtacgtctcggaactttgtcgtgttccagcgtgccgggtcttctccctttttggtgaggattgtgcgcagaaatccgggagtgagcttcttttcaagcatgaggaaggttggcggaccttcaatgtcttctcctgtattgttgagttcgcgtgtgagtcgatcgagttgcaggaggaattctttggtgtcgcgcaggtttttgcagggcttgaggtttgccaattcgaagtgaagtgccctgatgtgttcgtccggtgcgccatatgtgtccttcagcaattggagggccgtgtcgtaattgttgtcctcgagtcgaaagccggccacgagttcacgggcctctcctccgagcaggttgcgcagtagattgaatttcttcgctttgctgagtgcgtgtgtgccgattgctgatttgaacgattcgtagaactccggccatttgcgtttgttgccgaagaacttgtccagctgaatgggttggaattggtagaacggaggagtgaaggacggcgtctttgttgtttgttgctgtgcggtatgttgtgttgcttgtgcataggctgcttgagcgtcccgttcttctttgtccgccttgctgcggaagagtcgggcttgaaacgtgagtgtgccgattaagtcgcgcaagtcgcgcagtttca

SEQ ID NO: 55478 - DNA, 1026 bp, Heterodera glycines
  Genomic contig location: Contig_ID=SeqID_4711; Location=4743..5768; Strand=-
  SCN-specific regions: Sequence locations=1-1026
atggcactctcacagctctacttgaaggaatgtcaacgcaatgtgcgagtcagcaatccaacgcttcaggcacggaaactcctaaagcgcgagaatctgcaagctcgatggatcagcgaaacaacaatcgaagtgtttccctgtgttccaatctccctctccaacatcagctaccgaacaacaaaggactgctacaagttcattccggtcacaatacatttgccaaacgcaacaagagacgcattcctcgacccggagatgcgcattctctcactcatctcaaaaatcgcaagttgctcaccatttcgctaccatcaccttcaagtgcaacaaaaccccaacttgtgggtgcgaatcgactcaagaaatggaaacgtccaacgactggcacaaacagtcatccatgagctttacgacacgatcctcaacaaaacggacaacgatttggatctccacccactgatcttccatcagtggcagctcgacaacgacaccgacttcgccagccttccgcacatcgacgaattcgaagattcggaagaattcaaaaacaagctggaagagcaaacgacgcaacgagcggaagcactcggcgccttacccggcggaatcgaaggatggaccatcaaatggctccaagaacggctacaggaagccatccaatggtggataagtctcgcctcggcatactccacattcttgctttgccgagatgtcatcctaccatgcttaatcgcatacttcctaaacccaatccgcatcacactcatgaccctgattggatttcggccaaaaaatcagccaacgcctcaaatccaaccacaatacgaggacatgccattgcgggagatgccaagcactccgatccggcggaaacgacgacaattgccagagcaatcgactccaccaatccgactggacacgacgacaggaacggcatcattccgaacacgagcgagagcgcatagcgcgacagaagacacgctcttcggacgcttacgaccgatgaaactggcggacgactga

SEQ ID NO: 55479 - DNA, 54 bp, Heterodera glycines
  Genomic contig location: Contig_ID=SeqID_24730; Location=689..742; Strand=-
  SCN-specific regions: Sequence locations=1-54
agcccgtgaacagctgcatcggatgcaagtgccgccgttgctgtacgcctaaca

SEQ ID NO: 55480 - DNA, 105 bp, Heterodera glycines
  Genomic contig location: Contig_ID=SeqID_24738; Location=759..863; Strand=-
  SCN-specific regions: Sequence locations=1-105
atgccaatgtcaaaggcaaaattgtgcaattcggtgctaaacacgtcgcgcaacgagtgtttgagcacattcttcgcgcctggaaatacggtgtcgcggattaac

SEQ ID NO: 55481 - DNA, 690 bp, Heterodera glycines
  Genomic contig location: Contig_ID=SeqID_4712; Location=129..818; Strand=-
  SCN-specific regions: Sequence locations=1-190,235-252,274-283,305 -345,367-425,484-580,622-690
atgcccgcaatgtcagctgctgctagtgaagctgatttgcgcaatgatttgatgcgattaatcattggtgaagagcacttgttgaaaattaaagcacaatatttggacgagcggacagcgcttaacctgcgaagaccagtgaactacatagaggtggagcagtactttcaggtttttcatgggacccccggacagaagaagaaatgaaaatgttagcacattttgttgaaaaaattgaccaccaaaaatggtcattttttgtaattaattggttaaaaccaacaatggcaatttataaaaaataggtagtggcaataggaagagctaaaaattagtgctgctaactgaaattgtcaaaaaacataatttgactgaaaaaagtctaattgtcgtcaaaaacaacaatttttaaatattccaaaggcaaattttttaaaattttaattttttaaaaagttttatccaaaatatttttaattattagtgttcgacattttgaaaaaagacctgggcatggatgtactgccaggaaaattttcctaatttttatgcgatttgttaaatgatttagacaaaaaagacaaattattgaagattttttccataaaaccaaaaacctcagaaaacttagaaatcagtaaaaagactttctaaaaattgagccttatcggcctcccaaaaaacaataaa

SEQ ID NO: 55482 - DNA, 61 bp, Heterodera glycines
  Genomic contig location: Contig_ID=SeqID_4715; Location=2675..2735; Strand=-
  SCN-specific regions: Sequence locations=1-61
cagcagcacgtcgcttgagtccagttacaaggcgctgacattccacatgcgcagcgttcat

SEQ ID NO: 55483 - DNA, 2476 bp, Heterodera glycines
  Genomic contig location: Contig_ID=SeqID_4715; Location=1..2476; Strand=-
  SCN-specific regions: Sequence locations=1-19,42-138,175-288,347 -550,572-589,617-718,740-877,904-923,945-1157,1202-1889,1924 -2411,2433-2476
atcatactccaacttctcattgtttcgttttgttttaattacttgctgttggttcattttagtaattataaaaacctaatttggtcaaaacattaataaacattagtaatatgtataatttaaatgcatttgggtttctttaatttattaattattaataattttgtttaatttcgattaaaatgagtttacgaaatctgcaacaaaaattcacctaaaaaatttttacaatctacaaacgcaataaaagttttgtacgtccgaaccccgccacacccatgatcaatgtaatttacttaaaaattttcatttacttttaaatcatttttaatttcaataaattttagcgtcttagtgtgcaggtgcagcaactgcaacaaatgtttgcacagctggagagcgagaagcgatattggaaagaatggtgctaatgaaggtgtagccgatggacgactccacggccgaactgcccagaatccaaggaggaagaggaggccagcattggccctttgacttcgatgtcgctttttaattggagagaatgtgccttgatcaaattcagttgatgcaacagtcaaaggcacaaattgaaaatgaagaggaagaggaggaacagataaaggaacgtaggccacgttcggataatgtcaaacgtgaaaggagaaaaaggaaattgagcaaatggaagcgaagtccgaagccagacgaaaagacgcggaagggaatgccaaagagaaggccaaagccgaaaaggaagaatggaaacgtgccctcctacgtccgccagttaaatattatgaccactttatgtacatatttttgacaaacctagtgatgacaaaaaattttatttaagctaatttgttatcctaccgtaatatattttttatttaatctgaaaaattcttaaataaacgttgcttatttatttatcccagggcttcgatatctgaggaattttcctcattttgtggtcttttagagggtcaaagagtttgcggatttttgtggtcttttgagaagtttaagtatttttgtggtcttttaataaaaagtgacaaaaacgcatgattttttgaaaaattaggtatatttggcaaaatgtttgaactttttcttcaaatcttaaacattttttcgaaaaatcctcattttgcaataaattttaattaatttccttttataattttatacaaaaaaacaaacagggcttcggtagagggggtcaaaatcattttttttgaaaaaatctgttgacaaatcgcactcaaaatctcaaattttttccggcagcgcctatcggcactgccggaccccctccccccaatgttcccaaaaagtttttttgaaaaaccgcggcacgaataaagcaatttaaaatcaaaaaattatgagattgtcaatttttttaaagaatagaaattgaatttaaaaatttttggaggttagttatagatagatttttaccaaaaattaccaattttgcgatttttgaccaattaaaaaaaaataagaattattggggtccggcgccgctgattggtgccgtgattgtttgaaacgaaaaatatgaaagttaactgattttgttcgcaattttatggacgttttaaaaaatgaggattttttgaggtattttagtggcaaatgaggattttttatgactgaaatgaggattttcaaaattttgaaatcgaagcctgatatatgcccctctccgctcttctgctgcctttttttggtccctcccttccctttccgttcaaccgaggagttaaatcgattcgccaattttccttcccacccccccccccctccgcgtttctgcgcaatgagttcacaaacagattaatgatgaatgaatcatttattcaaggtactcaaatttaatggttgctataaaaccttttttgttctcctaaaaaacaataaaatttcggaataccaatttggttttgttagaaataggtctacgacaagtcaactaataacagttgtggaagattggtacgaggcaattataaatggaaaaaatgttgactgtatttatattgattttcaaaaagcatttgactcagtgccccataatttacttttatacaaattggaaaaaattggtataaagggcaaacttttaatgtggataaagggctttttgagtaataggacttttcgagttaaaattggggattctttatcctcaagtaaaaaagttacctctggcgtcccccagggctctgtcctgggccctttattatttttgatttatattaacgatcttcctgatgccttgccatcaggagtgaaaataaaattatatgctgactgatgttaaattatatatttgttataaagcaagagccgacacggaaattatgcataaagcattgcataatttattcgaatgggcaaataaatggcaaataaaagtttcaattcaaaaatctttcgtattatatttgggttcaaataaccc

SEQ ID NO: 55484 - DNA, 288 bp, Heterodera glycines
  Genomic contig location: Contig_ID=SeqID_4715; Location=2420..2707; Strand=+
  SCN-specific regions: Sequence locations=1-16,39-288
atgaaccaacagcaagtaattaaaacaaaacgaaacaatgagaagttggagtatgatggtgcactatacgtgctccataaattcagtgacgaccgactaaagaagttttggcgctgtgagtttcacggaccatcagacaaatgcaagggtatgttaatatatcactttgaattttgagaatcttaaaattcaggacggttgcacactgatttaaacaacgttgtgcagaaggtggtcggcgtccattcgtgcgacatgaacgctgcgcatgtggaatgtcagcgcctt

SEQ ID NO: 55485 - DNA, 67 bp, Heterodera glycines
  Genomic contig location: Contig_ID=SeqID_24739; Location=960..1026; Strand=+
  SCN-specific regions: Sequence locations=1-67
atgcgcaagctgcaatttgttgggcccgagctgctgctgattcgaatggagcagccgaagggcgaca

SEQ ID NO: 55486 - DNA, 942 bp, Heterodera glycines
  Genomic contig location: Contig_ID=SeqID_24740; Location=113..1054; Strand=-
  SCN-specific regions: Sequence locations=1-82,105-240,262-326,361-942
atggaagacaagacattgcttatgtgggacaccaacactactcgtgcatgtgaattttcgaaaattggcacatggaaaggactacaacttgacaatatttggatttcggatgaggtcagttttcgtttgacatttttgaacaacacaaagaaagtcaactcatgtggtctgaatttgataaaatcggaggaaggatttgctgtacaagacttgccttccgacgatagcaacaaatcctcaaagagaagcagaaagacgagatcacttgaaagttgggtcaccgaatcggaaatgaactccaaattgggctatttggatgaacaagtaagagaaatgctgactctttccttttctcagacaattaaatcgatttgtgattatatgttggagacgagaagatgggcagcgacggcacttctctcagatccaacaacttttgccagaaaattattccaatctggtaaactggtggcaaaagtggccgggcccgaattgattaaagtgtggccatgcatcgaattgcaagcacatgactacaaatttgccaaaattgggaactcagcggactccgaattcgaatgctttgacaaaattccaattaaattccgagtgaaggacaacaaaagaatggcatttattgacccaaggacaatgattttgagctccgacgcgagactggcaccatgctcagaataccgcaaacagctcatttttgtgcgtggttctctttatgaagttgatcaaatcgatgctcaggtcaaacaggtgaatgccaatcgcattgacggtttcagccttaatctgtcattggcaccgacttatgctcgccattcctttcttcaccttgccctagtgaatgtgtctgactttattggccagttttacgacgccaatttcgcaagagaaagtgaactcacattccaacttaaaagtgaggacacg

SEQ ID NO: 55487 - DNA, 371 bp, Heterodera glycines
  Genomic contig location: Contig_ID=SeqID_24740; Location=717..1087; Strand=+
  SCN-specific regions: Sequence locations=1-77,99-234,257-371
agcatttctcttacttgttcatccaaatagcccaatttggagttcatttccgattcggtgacccaactttcaagtgatctcgtctttctgcttctctttgaggatttgttgctatcgtcggaaggcaagtcttgtacagcaaatccttcctccgattttatcaaattcagaccacatgagttgactttctttgtgttgttcaaaaatgtcaaacgaaaactgacctcatccgaaatccaaatattgtcaagttgtagtcctttccatgtgccaattttcgaaaattcacatgcacgagtagtgttggtgtcccacataagcaatgtcttgtcttccatctcacattggcctgccttgaattggcaattgtt

SEQ ID NO: 55488 - DNA, 786 bp, Heterodera glycines
  Genomic contig location: Contig_ID=SeqID_24741; Location=97..882; Strand=-
  SCN-specific regions: Sequence locations=1-382,404-468,491-664,686-786
caccgagttggctgaactgaaaacgaagagtgacaagctcacttccgaattgtcggctgtcaaaacgtttgcacgcaaattccgcgatgagcgcaacaaattggagttggagaagaaggagttggaggtggacaattttttagaaattaaaagttttttttctttttaaattccatttttaggccgatttgaagagcaaaaacgaggaattggtgcgtctccgtgaacagtccgccgcttcagcgctggaaaccaccgccgccgctttgtctgcagacacttcagctgctggggagccgcgttctcctgtcccgccaactttgtccggcactgtacctggggcaattgctgctggcgcactttctgcaatccgtgcagcggttggtgccggagagggcggcggtgccggggcggacaacagtttgcgtcgccgaatggaccaattgatgaaggagaagcaggtggggaacaacacaaacacaaactgaacttgattaagtggtcgaacgtgctaccataggaataatttggacttatactgatattacaaattggttttgatcaaataacctggaaaattgagttcattaactctgatcaacgtgatcactgatcaaaaaacatgcaaattgatcattgataatccaatccttccctttgtgcattttaatcctccattttctttcacaggaactgttggacaaggtgaagaagttggaggaacacaacaaagtgttgcagcgtgagctggatgaatccaacgagaaggtcacacggatggacatg

SEQ ID NO: 55489 - DNA, 819 bp, Heterodera glycines
  Genomic contig location: Contig_ID=SeqID_24742; Location=150..968; Strand=+
  SCN-specific regions: Sequence locations=1-509,531-662,689-819
aaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaactccaacgcagaattaaagtacagactatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgataagtttctgaaaaaaaagttaagcctaaactttttggcctgtttaaaaaggaattaaaaatttttaaaaattttattcatctccctttttgatagaaaaagcatcagagtgcctaaactaacatgtaaataaaatctggtgcgtttcagaaccctttctgaaaaatatttaagaattaattttgcaaaaaataataaaacgaaagact

SEQ ID NO: 55490 - DNA, 810 bp, Heterodera glycines
  Genomic contig location: Contig_ID=SeqID_24744; Location=41..850; Strand=+
  SCN-specific regions: Sequence locations=1-583,608-642,687-712,758-810
atggaggaatttgtcggaatttatcagttccattgccatccaaacttttccggcgtttccgggctttatccgcttcaattttcaagccgtgggcgcatttctgaccggaagaaagggcgacttatgttggacattgaaaaattttctgaatttgcgcaattatctgctgggagttgcaagcgattcctcgaggactatgtgtacattgggggactcccgtggataataatggcaaaaataaatacgcaaattgaaagcactgaaaaatggatggactttttcctatggtgcattggtccaaaacaaggtcggattgaaatgtgaaattatgaacagggaacggatttatatgtttttacatatttttttgcgcatatgctatcgcatgaaaagctcaaaaatagcatttttacctgttttcctttcaaacagagcgtgttttagcattgtgctagcgaaattgataaaaaacgagacttttttgagaaattaacttattttttgaccagtttttcttcatgttttggcacatattttggcctttttggggtttttaggacatattttgagggtttttttggcacatatatatatgtacatatttggcgttttttagcacatataaatcgttccctgattatgaaatatttaattaaattaaaattttaaattatgaattatttattcacactatgacaataattagggtttcaaaaaattttcattttattataaactttttatttattgataaatagggcttccttttttaggcacaaaaaatcgcgaaataggcattaaaataggcaa

SEQ ID NO: 55491 - DNA, 2692 bp, Heterodera glycines
  Genomic contig location: Contig_ID=SeqID_4717; Location=141..2832; Strand=+
  SCN-specific regions: Sequence locations=1-440,462-936,958-976,999 -1092,1115-1576,1599-1988,2023-2090,2114-2692
atgaccatcgccagcgcctgcgtcaagaactttgcactcaaccatctgaaacccaactcgctcgccatcgtcccggaaaaaggctatacaccacaacagaatcaaagtgcactggccatcaaatatctcgattggtactcacacattaacaacgtcaacattcaaacagcacactcccgctatggtgaatatgtctttaaacgtgagggtcaggtgtatcaagtggatggttatataaaaggggaaaatgggaagagggataaaataatcgaggtaaatggttgtctgtggcacgggtgcgaggaatgttttgaggacttggacgacgaaacgaaaatgccgaacggaaagacgctaggacaattaagagagagggaggtaaggaagcacgagattcttagccggtacgtagacttggatgtgatctgggaacacgaaatcaatgagcagctgaagaaggacaagcaaatgagggagtttttcgacaactggaaggaccactcaccaataaaaatcagagacgcatttcatggaggacggactgggccaatgaagctactccacacagctaagccgggacaaaaaatcagctacaaggacttcaccagcctctacccatggaccaatttctctacagactatcccctcggtcacccaaaaattatcagctttagattaaatgagcaaactgtcaactggcgagctccatccgacaatccatacaagggacttttaaaagttttacttttacccccaaacaggaatatcaatgtgaccgtaatgcccataaaatttgatgagcgactcctctttccactctgcgaaaaatgtgccaaacacatcaccaatgaacacccgaatggcctcaaagacaacgactattcgtgtccccacttcaatcctaatgaccgtgcctttgtctctacctgcactcaccttgaattgaatgctgccttggaggtcggctacaccgtcagaaaactcttccatgtcctgcaatacgaccaatggagcgacaacatcttcaaatcttacgttagcgaaatgatggccctgaagatccacgcaaccggcttcccttcatggtgcagcagcgaagaggagaagaaggaatacattgaggagaaccgtcatcgatttggaattttgttagacaacgaaaagatgaaggctgaaccagggaagcggtacatcgccaagctctgcctcaactcactttggggccgcttctccatgaggaacctcctctccaaagcaataatcaacaacgacgaaagcctgattcgccaatataccgacgacaagaaaattgaattagtggacttggaaatgatcgacgacgacaacgacgtattcatgctcacctacaagccgaaagaggagtttgtcgacgaaaataaatactccaatgttgtcatctccctcttcacgacatctgcagctcgcctctacctctacgatgccctcaaaaaagtagccgacacccccgactgtgaaattctctacttcgacaccgacagcgtaatctacgtgcaccccgaggacaacgacccactaccaacaggaaagggacaccttggagaactcactgacgaaaagccggaccacaacattttggaattcatcagtgctggctgcaagaattatgggatgaagctgcaacgcaaggacaccggtgaaatagaacatgatttgaaaataagagggttcacccttgatgcacaaactgttcaaaaaattcattacgatactgttaaggaccaaatcttacgctatggctccgaagacccccctgaccctatcattgtaacttacccccattttattcgccctaatctaatccaaggcaaagtgtatacccattccctcacaaaacattatcaacccatattcacaaaaggtattattaatgattcattccaagtcctcgaatttggttatcgcaaatgataagtatgcattctcaattaaattttctgtatattagttttcttatggttcccttcttttctttctctctgtttatatcactcatgtgggacggaatgacccctggttgatcctctccaacactccaggccatccatctgagatgaaggtggacgagctgttcattattgtaatgcgcagcctggtgcgtgagtgtttggattggggaccgaagggtgaagccgttccctgggtgtgtttactcacttttaagggaactctaagaattctgatatgccttcaaatctatcaaaagagttgcatactttctttttataatttcctttattctctattttacacttgtatttttcatttgaatgtttattcagaaataaaattgaaaaatgtgtcattactaatattaaaaggtataaattaaaaaggtatttaacgagaaaaatagtcagggttttgtaacacaatttgtaaattattaaggaatagaagatacaattttaaaaaatacacgaacttgtcgtttttaggtagaaaagtgcataattaaacacattaacatgtatgcagaattaagcaatggaagataaatttgaaaattattaagcaattgggaatgtcgtttttaggtagaaatatgcaaaattaagagaaataagttacaatttgtaaattattaaggaatagaagatacaattttgattatgtgcacgaacttgtcgtttttaggtagaaaaatgcataa

SEQ ID NO: 55492 - DNA, 753 bp, Heterodera glycines
  Genomic contig location: Contig_ID=SeqID_24749; Location=139..891; Strand=+
  SCN-specific regions: Sequence locations=1-753
atgtgcaaactgatgttcgaaatggaagtccgtgcccacatggattcggtggcggtccgtgcctcccccacggctgtcagttttctgaccgaattcaatgccaaactcgcggaacaacagcagggaaaggtcggtccgtacaattcatacatattcaattttgcataaatcaagcagaaccaaccaaacgaggaaaacgaccgtacggcattgcgcgaataccccaactattgggatcagaaacggattgaccggtccgtctattggtggttcagaccgatgaagagcaccagcggaacggacgcgataaacatgacgaaattgtcgaacaatttgcgcaaagcggcggaattgaagcggaaattttcggaaatggtttgtctgtccatttggtcgcccattgaggaaagctttcggttttctgccactttttaggccgaattttcaatccgtcactgtctgatcactgtggaagccggggttcgtgatgttacgcggccaatgattttgattgaaagttctgtcaccggtactgctcggaattggtccagcacattgactgcggtacgaactcacgcaaaatcatttctgataattccgttgaattttcagaaatgtgagactcatctgattgtctcctatttcaatgaattattcaacgtttgggagccggtcattgaacccgttttgcacaaggacaaaggctggcaaaactggaaattggcattgaaagtgctttctttcttccattag

SEQ ID NO: 55493 - DNA, 761 bp, Heterodera glycines
  Genomic contig location: Contig_ID=SeqID_24751; Location=1..761; Strand=+
  SCN-specific regions: Sequence locations=1-42,65-761
  Gene Ontology: Cellular component=integral to membrane; Biological process=membrane organization and biogenesis
aaaaagtttagcaatgattcatcgcattttttaagcctagaaaaaacaccttcaaaacttttaacatttttttcgccggacgccaattcttgaccattgccgttaattttttagccttggtcgtcctttacatgctttaccttctgttcggtcgttgggctcagctggcgtgtaacatcaccggctttctctacccagcgtaatttaattttttcaattcggtattatataattaaaactgaaacacgcaaacaatttagttacatctcaataaaagcgattgaaagtcaccagaaggaggacgacacccaatggcttacctactgggtaacttcttttttcgtctcaattgcctcgagaattgatgcattccttcagattttggtgtttttttattcaaatcattatttaggtggtttttgcgctgcttaatgttgtggaattcttctccaacaccattctgtactacttccctttctattggttgatgaaggttctattaaatttttaattgtttttaccctaatataatttttttttcatcctcattactcttgcagtgtgctctgctgttgtggctgtacttgcccagcactttgggtgctcagctgttgtacacgcgcatcattcgtccgttccatcttcaacagcacaagaacattgacagcatgtacaacaaattggctgggggtgagccttttagcaaatgaaactacctaaatctccaaatttccttaatggttaatggtaccatgtgtcag

SEQ ID NO: 55494 - DNA, 723 bp, Heterodera glycines
  Genomic contig location: Contig_ID=SeqID_24758; Location=1166..1888; Strand=+
  SCN-specific regions: Sequence locations=1-189,214-221,251-262,284 -541,574-723
  Gene Ontology: Mol. function=calcium ion binding; Cellular component =membrane; Biological process=signal transduction
atgactgtccaatttttttcacaggaacaacagtacaagaggcagctgaaagccaagaatgagacggccaaatttttgcaagattcgctggaagaaattgcgctggctcgccaggagcaagggcatgcccacggggcgcaagcaatcgaatttgctcaattccttaaaaaggttttttttgcacaaagtgccaaaaattttaaaaaataagcaatcctttgaatatttttttttacaaattttaaaaattgccaagtttttcaaaaaaaaatttttttttattcgtactattttccccctatttattgtcaggttcgtacgggtgagggcggctatgtgaacaaccaggagctgttcaagttcagcaagttgttcgaggacgaactgacgctggacaatctgagcatggtccatctgcgagcgttgtgccgtctgttgggcattgctcagtttggaacgccggaaattttgcgatttcgtctgcgcatgaaactgcgcgagttgaaggcggatgaccaagtaattgtgtctgtctattaccaattttatctaatttatttttttttaatttttcgttttttgaccccctaaaaatctgcaactttttagctcattgaacgggagggcggtgttgaagtgctttctgcccaagagttgcaggcggcgtgccgcgcacgcggaatgcgagcgcttgggctcagcgaagaacgacttcggcaacag

SEQ ID NO: 55495 - DNA, 369 bp, Heterodera glycines
  Genomic contig location: Contig_ID=SeqID_4719; Location=135..503; Strand=-
  SCN-specific regions: Sequence locations=1-369
atggtaatggagagggaaatttgggcgcttcttcacaatttggtactcgccgaagacccgtccaatgcggcaacttatctgattgacgagtggagccagaaattcgggaaaatgcacaagctgttggccaactgcggctcatatgacaacactgacccatatgatgaagcgatgcgagggctgctgatggtggtcatggacaaggagaaaattccaatcaaaaagctggatgaatgccgtgccatcgtgccaacacttatggccaatgccgcgcatagacatgttggacaatttgctaacggatctgagagagccgataagtccttatttcggcaagacttttttggcagaagagtgcaaatgaagtag

SEQ ID NO: 55496 - DNA, 6352 bp, Heterodera glycines
  Genomic contig location: Contig_ID=SeqID_4719; Location=1257..7608; Strand=+
  SCN-specific regions: Sequence locations=1-397,419-834,856-1063,1085 -1336,1390-1573,1596-2454,2476-2629,2651-3358,3394-3556,3580 -3617,3639-3801,3823-4254,4276-4594,4616-4820,4842-5056,5078 -5225,5247-5252,5281-5348,...
  SCN-specific regions: Sequence locations=...5382-5417,5441-5572,5594 -5685,5710-5841,5863-5899,5922-6352
atggggaattttcgactgggcattttgacccaaacagagcatacgacccaaattcacttgcagaaccgtgccacaattcctccaccctccgccaaatgcgccggtaatcttgagtctcgttttcggttgcttttttaaattcccgaatgcttttttcaggccgttcgtgtccaaccagttcaacaactgataccactgatagacgtgccgctatttgtcaacccaccaccaaatgtgccggtaattttggctcgctttttttactttttttttcaagatcccgaatgcattttttcaggtaattcgtgtccaaccgatgcctcaaccgttgccgctgagagacatgccgcaaattcaccatccaccgcgaaatgtgacttcaatttggatcaaattgtggttgctttttctcagtctctgggtgtttcttcagggaattcatgttcgacaaattcaacgggaatacgccgtaccgcaatttgcccatccgccgccaaacttgccgtatcatccaccagaaaacgttccggtagttgggtcttgtttttcgtgcgttttctcatattttcggatgcttattcaggcaatccaaccacggcaacgaccgcgccagctgagagacgtgccactattcgaccacccactgccaaacggacaggtaatttcagaccctgtcttctacctaacaccgaaacatcttttctaagcaaatacatcccaaccccccgagagtgctggaagtgatccgacggctgggcgagtggagaggaagaccaagggacccaagatgtccgcctcaatgaatgaatggaatttggattttgataaaatttgttgttttaattttttgaattgataagggttaaatcccgttacctaaattgtttgaaaattattaaaattttaagaatttagatgctaaacctaacctttgacaaagattatgaaaaaatgaaaagaaatgacgaaatttttggaatgttccttctttttattatctatggattttttttcatgtgcattattttggtgctagtaagatattgccgaatgaattaattggttttttctcttcattttaaaacatttcacgtccccatgccctgcccacttcccgcggaattgatcaaggaaataattgacgctcttccccctccaaaaacacatcggcttttgcgcttaaattttgttttggcatactttgttaaatgtcggtttcattccatgatgagaagattgtttcgcccagatcatatttcaataccaatggcccgaagaaccggaatttatttctttttcgatgttcgtactccccctatttattttccactctaccaataataacatttaaataaaattataattttttatttcttatttgattaatttcgatcaatattttttgataattaaacaaattgtatttttcaaaaaagacctttctcgcagtagcaactcatcggcttttttttactcccttcataaaatgtctcgcttttgcccgctcgcccaaatcaatgaatcgggtcggcttaacacaccaaaggggaaatttagtgagttccaaacctatcaaattaaaaaagaattttgatattcgttttaggtcttttttacgctttggaaattgctcgaagctaccagctcatagggaaaagtataacggaaaacaaattccgttatctgatgaagacggagaagaaacaaagggaaatggccattgaattgatggaaaaggcagggataagcacggatgacaaagcttttggtacccaacaccttgaggctgtacaaaaatactgggacagggaattcccggatatgtttcgcattgtggcttttgaaatggtaacaaaattcgcttgaaaaatataaagttacatatttttagaagaccgggcttaggccaattttcaagggagagggtgttcgtaagcacgaagtttgcgtgataagagaaggcaatcactgggaagggatcaaatcggtgtcctggttttttggtgttcgcaacttttgcgtgggttgtgaagtgacgtacgatcgacctgaaagacacagaatggagtgtaaggaaagatgcaagaagtgctgtagaatggggttcgggtttccatgtgcaaatgtgtgcgaggaaatgcactgcggtgaatgtaatcttaagttctacaacccggaatgttttgaagcgcataagaaggcggcttgtaatgagtacaaaaagtgtgaaaaatgcggagaagtctaccaaacacgttcgaaacacgtgtgcggggaaaaattttgcaaactgtgcaaagtttgccacccagggcggcaatgtttcatcaaaaaaattcaagtgcgaccgcagaaagcctacagaattgtggcctacgatctggagacgactgtagatgggggagaacaccggcctaatcttgttagtgctgcacgtacttgtaacatttgtgcgggagaagagcgggaatgtgagatttgtgaaggccccagtaaaatcacatggtcagtagcggatggttttgacccaatgagcgagtttgtcgtttggataatgggttttcaacgatttgaaacgattgcttacgcgcattatgctgggagattcgattcccactttgtcttgtccgagctaacaaagaaggaaatcgcgacggaactgatgatggcagatttgaaaatttatcaaataaaggcgggaagagtgtactttcgggacttttggatgctcagtcagaataaattggcggaccttccaaaaaccttgggcttaaaaactgcagctaaattgtattttccacacaaatacaataagaatgagaattttgggaagagattatccaacctgccacctttggaagactattgccccgacagcatgaaagaggaggaagcggcaaaattggaatcgtggcacaatgagaattttcaaaaggaatttgaactaggtagggaaaatagcattttttctttgaaaataaaatttaaggggaacaactcaagacgtattgcgaaaatgatgttgaaattttgatggaatcaattttgaagttccggcggttatttttggggataacaggagatttggatgtaataaaggacagcgtcaccattgccggggtcgttatgaagatcttcagggcaaaatttttgaaggacaggcatattccaatcatgccagagggagggtatgagagagcagagaaccagagcaaaatcgcagtgaaatattttgagtggttagcccaaaaaaagggagtaaaagtgcggcatgcgtgtaacggaggagaagtggaatttggtgggctgaaggtggactgtgtgattggggcagagaaaaaaataattgagtttcaggtaaaagaaaaaatattttctttttaaacaatacttaaggggtgtgcatttcacgggtgtccgagatgttttttaccttggaccatagcaccaaacggacggacaatggaagagaatcaaagtagaaccgaaattcgcatggaaattttgagggaaaagtgcaaaaatttttcaatcggagaagtttgggtagaataaaacatttagaaatatttattaattgttagttttaggagtgtgacgtcagagaggaattgaagaaaaataaggagatgaaaaagttctttgaaagtgtgccggacaagggaccgatcaatccgagggatgcttatgccgggggaagaacgatgccattttgtttgtacgcaaaggctaccgaagaaattgagatatcaatgttcgacatcattagtttgtacccctttgttaattatggtaaaaatctgcttaatttttgttagtttcctttcgcttaagacaccccataccccgttggagtcccgaaaattgtagtgagcaggaattttaatgtgaattggacagcacctgacgacgtaccctatgatggacttttgaaagtaaaagtgatcccgccgaaaaatcttttgtatcctctcctccccgtgcacatcgatgaaatgctcctcttccctaattgttggtcttgtgcgagaagggccaagaatgaatttatgatgacaaaagatgtgaaaaaatgtaaccatcgtcccacgcagagagcatttttggggacattcacatcaattgagttgcggaaggctttagagctaggatatagaattgtgggattctatcgagcgtatcattttgaacagtttgacagtcaactgttcaaaggatatgtgcggatgtttttgaagataaaggtggaagcgtcggggtggccggcggaggtgaaaagtgaagatgaaaaaagagcattcatcgaaatgtacaaggcaaagtatgacatcagtttggattatgataagattgggtttaatcccggactaagaatgatcgcaaaattggtgagaaattataaaaaatcttgaaaaattgttcaatttaagggtttaaacagtttatggggcaaattttcgatgcgcaatactctttcaaatacggaaattgtgggcagcatggaacgttggatggaattgggaagagataatacaattgatttgggcgcccggtaaaaataagcgaagagatagcacggtggtgtaccggaaaaaggaggcgttcataaaggagcataaagtgtcaaatattgtttttcattgtggaccacgagtgctgcgataataaaactgtatgagaaccttgaacaggtctataggaaggaggggtgtaaaccgctgtattgtgacacaggtgtttcattagaaaaaataacgcataaaagttagattctctggcgcttgatcatccgaagggtcggtgtacattgaaggaggggaaatttttggggtaaaacataatttttgaaacacatttaaattgtagttttaagggagatgacgcgagaatatgcggacaacgaaattttggagtatgtgtacgcgcgtccaaaacagcatgccttaaaactcagaagaaagaaggatggggtgatttggcacaaaacaaagatcagagggatgacattagacagacgaaacgcttttaaatacgaattgttcaaagagatggtgctggactgcaagaaaggggtcaaaaaagtttttcactaccctgagaaaatcggttcaacaaacgacttccgggttctctcaaaagatgtgcgaaaagaatatacgccggtgcagaaaaaaggaattattgacgatcactttaatgttttgccctttggatattattaataatttttgttttgataattttgtctcatgtttataacatttaatattttaaattaatcaaatttgtttcattttttagaatgtcaaagaaaaatttccaagaaacttcaaaagaaatccgccgctcgaaaaatacaaaaaattatttcaaaaacagtcctaatttggaaaaatgtttcgaagaagtggagagtcacataaaggaaaataaaaaatttgggataaaagagcacgtgacaactttctattttaaatgccccgaaaatgaagatcccgaaaaaatgtttaaaaaaatcctgaaaaaattaatgggggatgcaatgagccgagaagctgagccgggctggaaaattgagaaaatttcagtggacctttattgcagtgctctgtcagacccagtgatcatccctgcccgccccttccaacaatcgaatccagacattgttttcaaggagttcatgcacaggcagcaatcatttggggaagtgaatttgttagaccagagaatttcaataattattgccacttattctttccctgttaaataaaatttttttcatttttccatttcattattttttgttcattccattattatttattcgagtttttttctttattaatttttcagttaaaatgtactcgtttcaaaaatattttgaggaggctctcgaaaaagaagattttttctggcagaaaaacagagcagaagtggaggcattgttaattgaggcttcaaattataaaattataatacacagggacaacgaaagccgctattctgattatattgccacctatcgccgcaccccactcttctgtttctgcatgattgagagaaatttaagatttttttacgacacaggaaccgggacgcccataggaagggttacaaccgtgctacatgttaccgttgaggcgagctatacaggagagggattcatttcgcctatgttttccttttggttttattgggagggcaggagtcaaacaacaaacgaatctttcacgagccgtctttatttgtacactgtttcgatgctaagagcaatgggcaaagcctggggcagagaactacttttgaaccctgttgaagttttaattgatatgttctaccaacgaatagatag

SEQ ID NO: 55497 - DNA, 766 bp, Heterodera glycines
  Genomic contig location: Contig_ID=SeqID_24759; Location=34..799; Strand=+
  SCN-specific regions: Sequence locations=1-165,198-529,556-575,601-766
atggctccactgacgatggaccaaatgcaactgctggccaagctttggtcaaatggcttcacactccgagcaaaaatggccaaccgaagcgattgtatcgcaataattattttggtccacagaatctcgaatgggtcaacaacttcaaagaggtgtgtctagccatattttctataaattgtttttgtttttccaaatttgtttagccatttatcagtgccaccacttctgtcagttacaatattcaactttattttcatgtgaacacaattccaactgaaccatttgaattggtgaacaaacggacgaatgaaaagctgacactgaaacaggagatcgacgaattcgacgtaaatgtgtataattggctgttgcaacggtgcccaattggggagacggcgagggtgccagcaattaaatggggagacagcttaaatccgagtgccaatttgaacagtatcagatttgatctgtggagtttcgataaatccattgagtgagcagcagcaatagcatttgaattttatcgaaaaataaaatatttaattaattttaggccattgtcgccaccaacggaagaagaaaaagaagaagaagaagcggataaaagcaacggaaatgtcgtctgctgattaagtgtacggaaatgaatgattgaataattctatttgagaaatgaattttcgattgaaacgattatctagagaatttggaaatccattaagtagttaagggttcactcatccccccgcttagaaaaaaataa

SEQ ID NO: 55498 - DNA, 1194 bp, Heterodera glycines; identical to SEQ ID NO: 24760
  Genomic contig location: Contig_ID=SeqID_24760; Location=1..1194; Strand=+
  SCN-specific regions: Sequence locations=1-169,191-419,441-1016,1038 -1138,1173-1194
  Gene Ontology: Mol. function=plus-end-directed kinesin ATPase activity; Cellular component=plus-end kinesin complex; Biological process=anterograde axon cargo transport

SEQ ID NO: 55499 - DNA, 65 bp, Heterodera glycines; identical to SEQ ID NO: 54797
  Genomic contig location: Contig_ID=SeqID_24762; Location=143..207; Strand=+
  SCN-specific regions: Sequence locations=1-65

SEQ ID NO: 55500 - DNA, 339 bp, Heterodera glycines
  Genomic contig location: Contig_ID=SeqID_24762; Location=710..1048; Strand=-
  SCN-specific regions: Sequence locations=1-339
ctcaaacaattatgggggagcaaaaatccaacgcagaattaatgtacaggctatagggaagctattccggaaagattaggtctccccataaaatctgggcgcatcggttcggggggacatgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaaca

SEQ ID NO: 55501 - DNA, 744 bp, Heterodera glycines
  Genomic contig location: Contig_ID=SeqID_24765; Location=176..919; Strand=-
  SCN-specific regions: Sequence locations=1-59,87-249,271-379,416 -542,568-744
atgcagcccggtgcgaagaagcgcacaaaaaggaagaatgccgaaaacacccacggcgaggctatggaatgcgaagaagaagaagaggatgccgtagatgaggacgccgagaacaactggatgctggggtacgaagaagccggggagaagccggagtcggtgacaacatacgcgtacgcccacgccggtaattttggaattatttaaaaaaaacttggaagaaataaaatttaaaggttcccgctacgatcatgtgctgatttatggtgaaatgctgcgcatgggtgtccgccctgaactcatccgccagggaaaccatctcctggaaatgaagacccgcaaaacaggagtctacacaaccaccgttttccgggacaggtaaatattttgaatattaaatatttttaaaatttttgatcactttagttacaagttgatcccaataaaacttgccaattttgtcaagacgtttggcctagaaattgagggcgtggaaaacaagaaatattttccacacaaattcaataaggtaagaggaatttataaaaaaaaaataaaaataaaaattaatacaatcttaggcggaaaattatggcactgtgctggacaccctgccaccaattgagaactattacccaggtggactcttcccggcagagcgtgcaaagtttgagcagtggtacgacgagaaccgggaaactggttttgagctcagtgaagtcatcgcggactactgcaagacag

SEQ ID NO: 55502 - DNA, 453 bp, Heterodera glycines
  Genomic contig location: Contig_ID=SeqID_4720; Location=402..854; Strand=+
  SCN-specific regions: Sequence locations=1-395,417-453
atggccgaagcagcaattcgccaactgtccgacgtgttccagcagttcttgactgctcagcaagcaaatgcggcagcaccagcacaaccgattccaatgccaaatttggcaaatttcgactgttttggtcttggtgaccatggcgaaagcgacatcgagggttggctggaacgcttcgcccttgcgcttgactgctcaacaccgaaccttcaggacgatttgaaggttaagctcttgctgacaaagctgagtgagacggcctacgccgagtatagcaaacactgtttgccgaaaaagccaacagagtttgactttgctaagacttcggaaatgctgttaagcttattcgcgaagcaaaatcagtgtggatcggcagatatgagtgcttacgggctgaaaagcaagacgaggaggaatttcgcggcttcatcaaccgccacaaaaggctgttaa

SEQ ID NO: 55503 - DNA, 2943 bp, Heterodera glycines
  Genomic contig location: Contig_ID=SeqID_4720; Location=1361..4303; Strand=+
  SCN-specific regions: Sequence locations=1-730,752-800,822-1032,1054 -1284,1307-1697,1719-2943
atggaagtcacgatttgggtgaatgacattccgatcaaatttgtgcttgactgggtgccgatttgactgtgctggacgaagtcgcacacaaggctattggaaagcctcggctgacccactgcaatgagcaagccgtgtaccacgacggtacaagctgtaagcttttgggaaaaggcacagcacgtttttcatttggaggaaaaacaattaatgggcaatattatgtgacgaagaaaggatcactcaatcttttgggaattgatatgttggatgcctttggcctattggacgctttcagaagggaagttgaaaaggcatgaatggcaatttggtgaagaaggaagcgaaaaagtcgccgattcttcaacaggagaccactttggctgcgcttcaaacaaaatttccgcttgtttttgcggagggacttggacactgcacgaaagcaaaggctcatttggaattgaggcctgaggctgtgcccgtctattgtcgtccccggccagtgccttacaacacacgtttggttgtagaggaagaactggaccgattgttggagcagaaggtgatcaaatctgttgatcacactcattgggccgccccaattgttgtggtgaagaaggccaatgggtcagcgcgtatttgtgccgatttttctaccggtttgaacaatgcgttgctgcttcatcagcatccacttccattgcccgatgatatttttgcgaagctgaacggtggaggattttctctcaaatcgacttaaaggatgcttatttgcaagtcgaattggatgagaaatccaaggaagtgtgcacgattgccacccaccgaggaaattaccagtttcagcgactgccgtttggagttaagtccgcgccaggcatatttcagtcaattatggactcaatgctggcagactgtccatttgctacggcatatttggatgatgtgatcgtcgtaagccgatcatccgaagatcatcagaagcaccttgaagaggtcttcaaacgttttgaaaagtttgggttccgtgtcaagccagagaagtgcttcttctgtcaggaccagatcaaatatcttggatttattattgatcaggacgggagacgaccggaccaaacaaaaattcaggcgatttctgaaatgcctgttccgacaaacgtgtccgaggttcgatcatttttgggaatgatcaaccattaccaacaattcgtgaagaacatgaggttcatccgacagccgttggacgaattgttgaaacaggacaaagtgtggcaatggtcggaagattgtcaaaatgcctttgagaaggtaatcaaaattttgaaatctgatcaattgctgacacactacgatccggcacaagagatcattgtatcggctgatgcttctgagcatggaataggagccgtgatctctcatcgcttttcggatggaagtctaaaagccatagcacatgcatcatcgtccctgtcagcagcagaaaagaattattctcaaattgagaaggaaggcttagcgattgtctttgccgttcaaaaattccacaagtatctcttcgggagacacttcgttctgcagacggaccacaagccgttgttgtccatttttggcaacaaaaagggaattaaggcttgcacagcgaatcgattgcagagatgggcaatcactttgctcggctatgacttcgaaatcgaataccaaaatactgctgattttggtcaagcggatgttttgtctcgcctaattgcgaagacaccagtgccggacaacgaagtgatcattgcaaacattcgtgagagcaatgaaacgggagtgttgaattttgttacgaaaactcttcctctcgatcaccgtgatttggctaatgccgcgaaaagtgatcaggtgatcaaaaatgtgaagaaatttgtctgctcacattggccaacaaagaacaaaatggccgcagacattgttccgttccatcgacgacgacacgctttgaccatcgaggatgaatgtctgctttatgcggacagagttgtgattccggcatcgcttcaaaaagatgtcctacaactcctgcacagaggccatccagggatgaaacgaatgaaagctctcgccaggcagtacgtttactggcctgggatggacgaacaaattgagaattttgtcaaaatgtgcaacgaatgcacaatggaagcaaagatgccggtgaagagtgagcttcactcgtggccgaaagctgacggaccgtggaaacgcgttcatttggactacgccggaccgtttatgggaaaaatgtttctcataattgttgacgcgtactagaagtggcccgaggtcttcgaaatgcgttcatcgaattccgcggctacaatcgacaaattgcgatcactctgtgccagttatggccttcccgaaattttagtcacggacaacggcacacaattcgcttcaaaagaatttaaggaatttgtgaccgaaaatggcatcaaccatctgttctccgctccgtacaatcccatgtcgaacggacaagccgagcgttttgtcgatacgttcaagaggacatgtaggaagatcaagggagaaggagcatcggaaatgttgaccacatttttggcaacataccggaccacgccttgtgaggctttgccggagtgcaaatgtccggccgaaatgtttctaagaaggaaaccgcgcacgactttggacttgttgaggccaaagccaaaggcacagataattcgagacgagaccatggagaagcaattcaataggcgccatggagccaaaccgagatcttttgccgtgggcgataaggttctcgctcggcatcgtctttctcagccttggcgccccggaaaaatcaccaaatgtaaaggtgtcatttacgacgtcgaattttttgacggaaaattcggacggttccatgccaatcagttgcttgtgagaagc

SEQ ID NO: 55504 - DNA, 746 bp, Heterodera glycines
  Genomic contig location: Contig_ID=SeqID_4720; Location=5027..5772; Strand=+
  SCN-specific regions: Sequence locations=1-125,148-746
atgccaattcacaaatttaattttttaatatgtcacggaaacattagcagcaaatttaattgcgacaatttgccatttataacaattgagagcgtgagaaataattaatttttttaaagtaactgaattatgaaaaaagttgtttagatattaaagataaatttcaaaaaaaatttaattactaatgctatatatttcaaaataattcataggattgctaaattaagacacagaaaatattgagaaataaaaataatgaagaaaaaaacaataaaagcatatatatttttacaatgaaaaggatcagaaaattttaaaagtaagaacttcctttgtcagaatttatttctcaactcatcatgaatgttgtattcattcccatgtaaaagtacaacatcaaaaatgtggagcaatttcaaagtccaaaagcccagtgcattctgtcgggaagaggaaattaatccaaatttggcgcgggaaaagttctattttgttgtcgacttatcggggcggaggatggcacgaaaaatcggatgatggcaccaattgcctcgaggccattctgccgattttttgttcaaagctttagagtattttacaaaaaaaataaaaaacatttggactaaaaataaccaatttgttggcaaaaattgaaaaaattcagagatccaactgaattttcctgcattgtccatagtcgtagctgagaatgaattattaaattgttcattaaaaaattagtaaaa

SEQ ID NO: 55505 - DNA, 871 bp, Heterodera glycines
  Genomic contig location: Contig_ID=SeqID_24769; Location=488..1358; Strand=-
  SCN-specific regions: Sequence locations=1-207,230-242,265-294,317 -322,348-466,488-595,617-767,790-871
aacgattgtacatttgctcagtattcgtgaatggcttgtttcgccggttagcctaattatagatggcttctttagcattgtcgaccggtaggtttcgagttagtggtgtaataaatcaatattttcagtgaaatgcaagaagcgtggaaacttctcaacatacgtgtcccttcactaaaagatatatgcaccaaaagcatttctgagaatgagaaagctttggaagaatttcgaacgttcccatatgtttttaaaaaattatttacacgtttttaataaaaaaattgattatgttttaaacttctaataaaatgtttgatcgttttttttattttaattttaatttactggctatatgtatggaaaggtttttagaatgggtccgttcactaaatatttccgagaggagctagaaaaggtatttttgttttgcgtcaccaatcatataacgacttttaggagtccttttattggaataaaaatcgtaaagacctcaaaaaacgaatggcaaatgctagtccgtatagtgttgccgttcataaggataacaaccaccctttttcgagcattcctaaaagcagacgatttcgaaaaaatcttttctcttttctgatccgtgatggtgattatcgtctttcgtgggatttttttaaacatatctcaagacgaattcactgcccggttaccaagttttaccgctacattaacggactggtacaaattgtatctacggataagaaaaaaccgcgtattttcatctatttctatcaggaaggggaaggaaaatatcgagccccttcttcttatcaagggtggcttatgaggacggaaatagactttgacgagattattacgacttatttggtcaaag

SEQ ID NO: 55506 - DNA, 592 bp, Heterodera glycines
  Genomic contig location: Contig_ID=SeqID_24775; Location=436..1027; Strand=+
  SCN-specific regions: Sequence locations=1-44,66-148,170-592
atggcaaaaatgccgacggtggtcagtaaaatcacaaaatattacctcaaattttgtatttttaaggcgactattgagccgaaaaatacgaaaagggacggaagagcggcagaaaatgagaagacttggatttgtgagaagtgagtgccgaaaggggggcgggagagtgatgaccgaataatgccgactctctcccccccccccccatggaaggtgtcgcaagcgcaactcaatcctccgttatgagtgccaaagctgcgaaaagggacacccaacggaagcccagcgcgaggcaatcggtcgagcattgacgggagtttggctgtgtttcaagtgagtggtccaagacaaacgaatggggcggggttaagggatggaataactccgagaaaaaatattggtgtgaaaaagggtcctcaccaggcagcggtacccctccaagccaaaatcctaggattttctctgctgctggagattttagaaatctattaaaaatgaaatcatctgccgatttacagttgtaaaaagatcaatggtcgacttaacaaagtgtgcttcgaatgtgccacaaaaaggcctttgaaaatggcag

SEQ ID NO: 55507 - DNA, 73 bp, Heterodera glycines
  Genomic contig location: Contig_ID=SeqID_24776; Location=2113..2185; Strand=-
  SCN-specific regions: Sequence locations=1-73
tccaagtggggaattgaacccaggcgaaaaattatgaaaggtagaaagtttaaccactacaccacatgtgcat

SEQ ID NO: 55508 - DNA, 1290 bp, Heterodera glycines
  Genomic contig location: Contig_ID=SeqID_40; Location=2619..3908; Strand=-
  SCN-specific regions: Sequence locations=1-432,455-1290
atgtcagaccgccgaaaagaagccgaggaaaaaatggaaaaagcaatgtaaattaaaattaaaatgccattttaaatttcaattttcaattttgtttctttttcttcagcttcatctccgctgattgttggctttgtgtcttcgatttgttgccgcctcgtcaacttggccttggaattgcgatgatcagccaccgatttgactattacgtggacgaacatttcaagacgcgaaaatgggcactgaaaattattgaaattcgaagcaaaattggagaaaatggcaccaaagaaatggcaattgtcaattctaattgtgaatcattgccaattccgcaaattcaattgccaaagaaaatcatcggattcaaaagcatcagcatctagtaatttcgattatgaaaaatttagacaacacttcccatcattttcagtttcatcgaccaaaatgtcatcgcttttctccaccgttttcgtcaacttttcgccgcctgtcaaattaatttggacatttatgcgcacaatgatcgcatttcggagttcattttgcacaacatttggccaatgatcgtgaaacatatttgtgccatccaattgtccgacgaagttttctaccgtttgcgcaaattcgtgccgtcaattctcgacgactgtccatcgcttcgcgttatcagtgcctattatactggtttcttcgccgaatttccatgcaatgacagtgtcgcggcatcggatggacaagcggtggtcaaatggcttttcactccacttcaaagcaatgtgccaaaggtgttcaaatgctggttgtacatggatgcttggacttggccgtcaaatattgaaccattcaaaacggtgctttcttttattatttcgttaatcaattttcccatattttaggctttttccaatgcttcttcccccgtcaattttattgtcgtcatgtgttttattcctacgtcttttcctgacttcgttgtgccctttgatctgatcaatgaattgactcgggaacaattggcattgaaaagaactgatgactacagcaatcgttttctgttggtccgttgtccaattgcgcgtgatgaaagcaaatggacaaaatgggaaaaggaagcgattgactggcaattttatgagcaatggaacataattgacattcggattaatgatgagggcgaaatcggagatgggtaagcgaatgcttttttcaaaaattcatatttattgcgtttctatttttaggcttctcaacgcaaatcccggcccaagtgatcatcagcagaagtga

SEQ ID NO: 55509 - DNA, 1189 bp, Heterodera glycines
  Genomic contig location: Contig_ID=SeqID_40; Location=5228..6416; Strand=+
  SCN-specific regions: Sequence locations=1-603,625-842,865-1045,1067 -1084,1106-1189
atgtcactgtggatgacgctgcctggcaagatgtgttcagtaatgagtggaagtaacgtggcagcgtcgcgtcgcataaccggtagtgatgctcgagagtctcggtctcgagtctcgactcgagaaaagtctcgggtttttttggtctcggggttttgggtctcggtctcgagtctcggggtcgagtctcggtctcggggtcgagtctcggtctcgagtctcgggaaatttttggtctcgagcatcactaataaccggcaccataaaacaacgctgcggatttcctcgttcaattccaccgaatatccaaacgtcattaacgacgagccttccacgctcgtattttcttcgaaccgcaagtgtttcatcgatttcgacgaggattcctacgagatgacaaactacaacctgtgtacgatggcgacaaaaaaccttggccgcctatgcgggcagggtggcgaatgaaaaattcgatacaaaccagggatgtgccgagccagacaaaatccgattccgattatggccaaaaatccgatacggttttaaaaccgattacgataatggcccaaaatccgattaattgcgattccgattacgattccgatttttttaaaataattttttcccaaaaattttattcataatcaaaatcataaattttaagattgtgatgcaaaaataaaagtttgtccacattctcaggcaataaacgttttctcagatctgtcacaatcaacccagcggtggagaaaagccgttcgctttcagtcgatgtagctggggctgagaaatatttttttgatagcttagattcggaaacgaaatgtcttctgcacacagaagcccaacaactgttttgttttgcaaaaaacgatcaagcatttggaaggtggatgaccaacgcagctgataggaaaattgcaacttagtaataattcattcatggttcttttctgctttaatgtcccaacaaatttttttcttcaaaatttcgacttttggttcgaattcgggtccgggattcaaaaataggtgaattggctgccatgttcttaaactgataccattaacaacccttcaaagactgacatttttgctaaataacaaaaaactggattatatcggggagaattaatccggcactgctttgtgagaaaaatttaatttcagtcattatgttaaaataaga

SEQ ID NO: 55510 - DNA, 1303 bp, Heterodera glycines
  Genomic contig location: Contig_ID=SeqID_41; Location=448..1750; Strand=-
  SCN-specific regions: Sequence locations=1-55,77-257,284-547,569 -618,641-713,735-971,993-1048,1071-1160,1256-1303
atgaaccaattgcacaattttaccgccaaaaagctttatgaaaaattggcattggctgatgatcagtttgatgagtggcttgtggaattaggcctattacatggtagacgtacatgtcctcaatgtggaaatgaaatgggacgctgccaacctcgcccaaatcagcattatggaaaatggaggtgcaaaaacgcacagtgcaatcgtccggaaatgggctaccttgttggcacttttttcgccggctctcaccttgctattaagcaggtgttttctttgtcttatttctgggcgcaggaattgggtactcaggatcaaatgatgcgcgaaatcgatatcggaggttttgtaaattgtttagtggaagttactcaaattactatgatagggcctcaaacagtcgtagattggcgtaattttttcgcgacatttgtaccagggatgtgccgaatcggaatcgtaattaactttaatcggattttgggccataatcggaatcggataatcgtaatcggattttgccttgaaatccgattattacacccctaagaattgacctttgaaggaatttttttagcgagaataccaatgaattttgaaaaaaatgttttctgaaacgaatgttttaatcttattttaacataatgactgaaattaaatttttctcacaaagcagtgccggattaattctccccgatataatcaagttttttgttatttagcaaaaatgtcagtctttgaagggttgttaatggtgtcagtttaagaacatggcagccaattcacctatttttgaatcccggacccgaattcgaaccaaaagtcgaaattttgaagaaaaaaatttgttgggacattaaagcagaaaagaaccatgaatgaatacaaaaaaaaaaagaaggggagggggcgaaaggtgccccgggaaatttccaaatgaaatttggtgtgtggaaaaatcacccctagtttctattgtgaaattttaaccatttttgccaaatgagcatgagtgccgagatatgacgtgccaaagtttttacgcttttttaattagaaaagatataattctttttggccaagaaagaagccattggtgtagaggtaggtagtaggttagtcaaatcttttttatctcacaggttcgaatcccatgcatgtatatattattttataatttttatttttgattttcatgcaaagttaactatctaaaaatttttagtaaaaacatatttttattttaaatttttttccattagaaatcaaaaaattactacattaaacataaaggtgcaataaa

SEQ ID NO: 55511 - DNA, 870 bp, Heterodera glycines
  Genomic contig location: Contig_ID=SeqID_42; Location=1733..2602; Strand=+
  SCN-specific regions: Sequence locations=1-573,612-700,739-870
atgcaagttaatccccaaaatattatttctttacttcaaaaacatttttcgaataattttaatgattcaactatttcgcctgtcgagattgaaatggctaataattttatttcaatcattgaacgatgccttaaaaatgaagaagaaattgaaatcgttgaagatctcgcatttgatgaaaatgcagataaaaagtttaaatttagtatgtggaaagaatttacaaggaaagtcactcaatttgttattgtttgtgaaattgatttaaatttgcacactcgggacaatatcattaaattgcaatcactgatacacaaccagctccaagcaagccggtttaatgcttggataaatttcgcgtggcgaaaagctggattttatgggaatgactccttcccaatttttacgcacccagttaaatattgttttgatgcaaaaaagcagccacatcaatgccaaaagaatgaatgtgccaatgttgttttaatccggtgcgctcattgcgaaattttcctatgttttgaacatttttttgtcaattacctgtactgattagatgattttgatttagagaaaattaaaataaaatttattaaaaacaataaaaaaatgtttgcgtaggggggactcgaactttccattacaaaaattaaatcgtgacacacaaccaccctgccaaccggtcgcttgttgcttctccttttaaatttaatataatataattattaaatatttaaagcctcatatctcggcacagaagcttattccgcagctagaaaaaaaatttggcaatacaacccaggggtggtctacccacctacaaagtttcatttggaagttccaccatcacccgaacactctcctttgtga

SEQ ID NO: 55512 - DNA, 6884 bp, Heterodera glycines
  Genomic contig location: Contig_ID=SeqID_42; Location=3737..10620; Strand=-
  SCN-specific regions: Sequence locations=1-117,139-178,215-227,250 -400,422-627,685-813,836-928,957-1100,1122-1384,1445-1822,1886 -1892,1915-2102,2124-2163,2185-2220,2244-2417,2542-2545,2799 -2810,3146-3290,3312-3341,...
  SCN-specific regions: Sequence locations=...3366-3493,3515-3643,3672 -3682,3844-4017,4041-4076,4098-4137,4159-4433,4469-4514,4536 -4696,4760-5007,5041-5156,5194-5246,5291-5309,5331-5346,5376 -5526,5549-5728,5760-5777,...
  SCN-specific regions: Sequence locations=...5799-5908,5966-5981,6005 -6044,6066-6205,6227-6462,6484-6661,6683-6884
  Gene Ontology: Mol. function=pre-mRNA splicing factor activity; Cellular component=spliceosome complex; Biological process=lariat formation, 5'-splice site cleavage
attctttggtccgatctgacttcaatggtccttaaaatgaagtccattcccagtatttctgagcaccttggcgacctccgcttccgcgatcagccaccgaaagcggctattggaagcgcattaaaaaatctttattttctgggagcaatcgatggtaatattttttttttttttggcgaaaatttattttaattttttataaaattaaaaatttcagtccggtcatttccacaaaaaattttcaaaagggcaccgaatggcacaaatttgtgaaaaggcataaaagagtagtgatgcttgtagtctcggtcccggattttcggtctcgattttagtcttcgagactcgtgaagtgggttgtgctctgtttttttcctggattctccatgctttgaatagtaggaaaaacactttcttttttgtgtttgcgaacaaaagttgggacttttttttacatattttcgggtttttttcatattacatacgtacatatttgcatgcatattccacactttttcgtacatattttcatatatttttttacatattttgaggatttttgagaatttatagaaattttttgtgaaaattaaaaaaaatttttgaaaatgtatccctaaaaaatcgatttttttcaaaaaatgatatcaaaaattaatttaaaatactaaaaaatgattttaagcctatttttatggcattttgtgcatatttcaccctttacgaggaattttctccaaaaaaattaccattaaaaatttttatttacatattttagtacatatcttgggttttttgcacatatattttagcattttttataaatttttatttacatatttcacgatttttcttacataaaatagacagccctagtaagtcagaaaaaaggcaaaaaatgcctcaaagcgggtccctaattataccgtaatttaattttttaaaacttaatatatggacataaaacaaaactattttaaattataagcaatcaaaataatttaaaatggataaattaaaaacggaattcttcgttttttatcctaattaccaggatggcattccgaagccccaaaaattttcggctataacaccagatatatttatttttagaaataatagcgaaattacaaattatgaattagatttatcagaattccgaggcccaaaaatttttcgtaagtcgaaaatcggaattccaaacccaaaaatgtcggaaatcagaattccatgccatccctgctaaataccaccaaaatattcaaatttgaccaaaaattgccagttttggtgaaattctgttaaaaaaagaataaattttaaaacgaaaaaatttagttatacggggaattgaacttactctttgtatatggacacaaacttctaaaataaaattaattcaattttttgattgttcttaaaaaagaaaaaatatatattaatagtgcccatttcctcatttatagaacgcgtatcacttactcaaattggcaatcacatggcaaatctccctgtggatccgcaaatggcaagggccctgatagcttcgaaagattacgattgcattgaagagatgctatccattgcggccatcatgtcgacccaacaaccgtgcattattcgccctaaaaaaatagatcgcagccgattcatgaaagcgatggagcagttcgccaactaccatggcgatcacatcacaatgatgaacgtctacaacaagtttatgagttgtaagaagggtggggatatagaagggtagttgcgaattaaaaaataaaatagaaatacgaaaataggaaactaaaaatataaaattcctatatctactctttctttcctttctcctcctttttctcttcctctatctcttactctttctgtttttgggaatgaaattagcaaattaatattaatcaaattttaacaattttttgcggcgcatttaacgaaaaacttttgggaaatgggcgaggggataggatccggaaaaatttggtaatttctttcggatttgttaacagattttcatcaaaaagaccaatttttgcaattaagtgccaatcgatgattttttgcgcttcgaaacgctttttttgctgcgcgtttttcaaaaattttgggggatgggcagggggtcgccgggaaagattttataatttttaatgcgatttgtttgtcaaaaaatgaccaaattttgcgcaaaccttagacattctgccataaagtttcaaaatatgaatttatttagtgaaataagaacaatttttggtcactacatacctccaaatcaggacaaatctgacaaagggatttaaaagcgtaaaatcaagcaaccggttgtcaagtgattagtgtgcctaccttaggtggtgtgttgtcatgggttcgagtcccattagtgttgtctattttcaatcaattaattaatcaaaataattcaattcttttttaaaaattaattaagtttattaaataaaataataattattgtaaattaataaataataataatttatttttaataaaatttaaaaaaaaattgcgatctctttctatctttctttcatttctactctctctttctctctcacttttccattttctctctttctttatctctctaaccctctcttctctcttactttctcttattttctattttttctccctcgctttactctctctccctcttctctttctttccctctctttttctctctctctcgctctttctgtcgctccctcgaattttctctgtctctcctctctctttctccctcatctctctctccctctctttttttctttaactctcttttttctttgctctcttctccttctttcctctcctcttttatcttctctccctctctttcctttactctcttcgttcatttctatcttctctcctcgcctcactatctctcatccctctctcgcttcctctctttgtctctcctcgctttatctctatcctttcctctctccttaacttattctatttctttcttctttcctctctctcctcattttctctatcctttcctttcttctccttctcacctcactttctttctttgtttctcgcttctattcttttctctcctcattttgtctcatttccctcttttctggtcatttttttgtcaagttttgttaacaaatcaactaaaattacaaattttcccggcggcgcctatcggcggaccccttgttccccaatgttccccaaaagtcttggaaaaagcgccgcgaaaaaaccggtttgagagcaaaaaaaggtacatcgatttacatggccggaccccttcgcaatttgtaaaattggccgctgacccctcgctttgcaaaaaattttaattttaggtataaatctgaattttactgttcttcatcctgaatttgaaaaaaaaacttaatcaccctcaagatacatatacttctgaacaattctaatgctaaaaaacaggaactcgcacgaaaacggaataaaaattttgtatttgaaaatgttgtctaagaatttttaacgttggaaaattaccggtttttaccggtatcggtaccggttttgcagtaccggtcattaccgataccggtttttttacaattaccgattaccgcttaactctattataaactcaataaatcatttttttataaattatttagatttgcattattattattgttttttttatttcatatttattttattcgaatttgttttttttaattttattaaaaataaattattatttattaatttacaataattattattttatttaataaacttaattaatttttaaaaaagaattgaattattttgattaattaattgattgaaaatagacaacactaatgggactcgaacccatgacaacacaccacctaaggtaggcacactaatcacttgacaaccggttgcttgattttacgcttttaaatccctttgtcagatttgtcctgatttggaggtatgtagtgaccaaaaattgttcttatttcactaaataaattcatattttgaaactttatggcagaatgtctaaggtttgcgcaaaatttggtcattttttgacaaacaaatcgcattaaaaattataaaatctttcccggcgaccccctgcccatcccccaaaatttttgaaaaacgcgcagcaaaaaaagcgtttcgaagcgcaaaaaatcatcgattggcacttaattgcaaaaattggtctttttgatgaaaatctgttaacaaatccgaaagaaattaccaaatttttccggatcctatcccctcgcccatttcccaaaagtttttcgttaaatgcgccgcaaaaaattgttaaaatttgattttttttatcccgaatgcattaaaattcaatttgctaatttcattcccaaaattgctaaagatgatcggaggcgaaaaatcttcgaataaatttaaaaataattgaaatatttttattttcgacaccaaaatctgattttttgagcccgatgttctgattttgaaaaattttcgataaagcccttaaatatgttaaagtttcagtgaatacgagcgaagaagaacgcaaaaagtggtgcaatcaaaattttgtacgcttcgatgcattgaatgaagctactttaatacgaaagcagctgtcagacaaaatcaaggagccgacgagaagaaatatggtagtagccatttaaaaaaaatgaaaaaagtacaacaaagtaaagagaaaaaaaacaaaacacaaaatcaaacaaacgcctaaaatgctaatgttagggtgtccatgtatttgcatttttttcatagactgcaaatggaatgaaacgaacgaaaaacgagttttagctagagttgagcgggacagggaattttgacaaaaaccgggaccgggacgagaaaagccgggattgggaccaagtttttcgaccgggacccaaaaaaacgggaacagaaccaaccgtttatttcggggggagcggtgaatcttggaattttctgagtccaaaaattctggattttttaaataaattaacaatctcttaatttttttgcttttaaatctctcttttgtggcgctgttttttcaaaaaactttttaggaacattggggggggggggggaggggggtccggcggtgccgataggcgctgccggtaaaaattttgaaattttgcgtgagatttgttaacagaatttaccaaaaaagtgataaaatatttggttatttgtgggttttaggctgtttaaaaataaaagaatattttttattaattaaaattttaattacagtaaaataatggtaaagaaaatatgaaaaatattatatcccgtgaggaattatgattaaatgaaataaataattaatttttttctcaaaaatttttccttctccaccaatttccttctcttttctcaccagaccgccattcttactagtgcttatttagtcccgccgggaccgggactggcaaaaccgggaccgggatttctttttttcaaaaaccgggaccgggacctggccaaaattttgcaaattgactaggtatttttataaattattcattgcaaaaaagccagattataaatgttaacaaatagtttcaactaagggccgatttatagctgaaaaattgttttagatgcagttcgcgaacccaaattctccagaatacttcaagaacatcaagcaatcactgctgcacgggtatttcatgcaggtaattgaaaaatttaaaattgaaatttaaataaaaatgataccaaataagtttttaaaatttacaaactatttcaataatttatcaaatgctatacattaattgtaaattggatttgaattttaatttaaatcgtaaaaaaattaaaaatacaagttcttttgtaaactttgttatttcaagccagtaaataataatatgatgattaatttatttaattatctattttaaattaaatttttttgtgggaaaatgggaattattttaaaaaattaatgaaaattgtggacaaattactattttttcggcgatgccgatagtctctgcggggaaaaattttgggaagaaagaagtttatttacagatcttcattaaaaacgtttttgaccattttaaaagaagaaataggaattttggggtccggagctgccgataggcgcagcggaggaaaaaattcgagattttgactattttttaatagattttcaccgagaaatttaaatatttttctatctgatttccagaggcattcttgcaaataagaactccttcaattttccaagacgtagagcccaaatccaaggacgtccttggcacccaaggacgaatccctatggttttacgccgtttttgtttaatggttttcggaaaaaattttttaaaatagaataaaaacgaaaatatgccccctaagaattgaaaaatgatctctaaagtcgatccccaaattaatttttatttcgcaataaattgatttaaaattttccttattcgattctttataattgaaatataatcaagaaagttttttttcctaataatttttctggattttttaccttaaaatctttcagaaaacttttgtttgactatttttaatgcataatcgagggtttttatacctcttttttgtttgtttttgttttttgctttttgttgtaatccacgtatttatcaaattatttatattgaaaaataaagatcgcccagcgtgatggtgagcgcggaaggcttttcaagccaattgtcgaccgtgacatgtcgatcactttcgacaaattcacctttgtccatccggaatccactttggtcatctaccatcagctggtcgaaaccaaaaatgcggtcacaatgagaactgtgacatggatcgacaaaaaatg

SEQ ID NO: 55513 - DNA, 630 bp, Heterodera glycines
  Genomic contig location: Contig_ID=SeqID_42; Location=2913..3542; Strand=+
  SCN-specific regions: Sequence locations=1-178,200-324,349-386,436 -568,595-630
atggtggatcgaagtcttttacaaaagggcaaaaaatgctttccgcaaaaagtgcaatttgaacataaaagacctggcctcatcagtactagggttggttttccgatttccgaaatttttgataaaacgtcggaaattctaaaaaaatttgaaagtttttttttaaaattagcaatttttgtacattatatattacaataaaattttcaggaattttcccagcggcgcctatcggaaccgacggatgaaccgtaaaagtcattaattttcaaggaaaaaatactaaaaccgcaaaatttggtcatctttatgatgaagaattttatcaaacaaaaaattttttgaaatcatctattacttggttaagaattttaaaatttagcttgttaaaatattttaaaattttttaatttattttatgtttttcaaaaatttccgatttccgccttctgatccgacgtttttggggtcagaattccgatttcgaaaaaatattggggcttggaattccaatttcctaaaaaattttgagcctcggaatgccatccaatacgatgtctttttgttgttaaaataattttaattatttaaaatctgttttaggcattattatagacaaaccactacaaa

SEQ ID NO: 55514 - DNA, 1940 bp, Heterodera glycines
  Genomic contig location: Contig_ID=SeqID_43; Location=1314..3253; Strand=-
  SCN-specific regions: Sequence locations=1-216,242-254,293-335,364 -411,518-559,584-595,621-623,645-691,713-744,766-792,814-949,971 -1088,1132-1301,1364-1415,1474-1494,1522-1696,1718-1756,1788-1940
  Gene Ontology: Mol. function=pre-mRNA splicing factor activity; Cellular component=nucleus; Biological process=mRNA splicing
tacctttctgcgccggttgaggacgcattggaagctgctgcaacggcaataatccaaattcatgttgagaaacaatacggagacatccttgttttcgttgaaggggaggaagtaagtatgaataataaatggaaaatatttttgctcgagacgaaatttttggtctccagctgacccgagaatcgagactgagtcccaaaaagactttttgtactgattttaattaaaaaatgataaaatatgtgtcaattgaaatatatatatatatatatatatatatatatatatatatggattaaattttgtcgataggaaaccaatgaatatacaaaaagaaaattaaaatattagaataataatttacgaactcatagatatttagaaattgctagtactataaaaattcttgacatttttatcaaataatttttttcatttttgaaacaaaaattaaaaattaaacggttcttttaaagttaactttttaatgaatataaattagaatataaaaaaaattctctatttcgttatattgttaatttaaaatgttttcaagtaccattttttctcaagaaaaatgacattttggcattgattcttaaagtttttgaatgatttccgtttatgtttgtttttatgattaagaattcttgaaaagaaaatctctttttttctctaaaaataaagtcaacagcagtgctttatttatttcatactcaaaatgagtcgccaagaagacgaaaaaattaaaggaacaaaacaaatgtaatttttttaattgaaaacgatccgtgcaaaattttaataaaagttagaaattaatatatgtatgtattctacaggaaattgagaaagtgtgcgacaaggtgaaggaacgattacgcgaattgaagagatctgatttggtaatttcaaaaaaaaacttttgaatagagggcacagaattccaatttttctataaaataggagacatttgtgtacatttgcttattatatttgttagcaaattatggtaaacataaaaaaatttatgctatttgttaacagattttgcaccaaattgcaattttatgattattaggttaaaaatactgatttttgttatttttaatccaaattaaaataaggataataatgaaatggaaaataaagacaattcttggaaataaggacaagaaagatctctctacaataaaaaggaaaaaattttatagcaatttttattaggtgtgccggccgttgtatggggcattgacaactgaccagcaagcaaaagcgttcgaaagatatccgagtaataaaaattaaattaaattaaattgtaacaattaatattaatttaaattaaaaaaattaatttaaaaattttgaattctttaatttggtttgttttttgttttttgatttcttttttcttttattttttattttagcaaaaatattattgaatatttaaatggttttattaaaaatggaaggaaagttgttaaaatttagcacacatatacacatatatgtttaatattccctaaaattgaaaaactttggtacgtgaaattaagaattttttaatcgggtttaataatgtccttatttttcaacataattcaattttggttgccaatttcgatggcatctctggtaatttttttcttgccaaatcgggtcaaaaataaattgttacaaccaaatttaataaatcaaatttataaaacttttccttcggcacttctcattattgcctgatcccaaattcattaaataaaaaaatatttatatttaaaattccgtattctaaatcaaatttttaaatagaccagagaaaatgtgtgatcgccacgaacatcgccgaatcatcgatcactatcgacggcatcgtctatgttgttgatagtggcttggcgaagcacctcaaatatgataccaaaaagggcatcaca

SEQ ID NO: 55515 - DNA, 228 bp, Heterodera glycines
  Genomic contig location: Contig_ID=SeqID_43; Location=1..228; Strand= -
  SCN-specific regions: Sequence locations=1-228
cggtaggggtcaactccgtctggccaactccgtctcagcaatgttcaaaaagctataacttttttctttgttggccaaacttcacaatcatggtatcatttgaaagccctatatgtttaaaagatatttataagctatttctcagggattagtcaagtctcaaaaaagttgtcagatgaaaaccgcaaaaaaggcagaattttcaaagatttttatttctatcttttt

SEQ ID NO: 55516 - DNA, 385 bp, Heterodera glycines
  Genomic contig location: Contig_ID=SeqID_43; Location=872..1256; Strand=+
  SCN-specific regions: Sequence locations=1-146,168-385
cggagtaggacaaaacgtcgtcagccgaaacgtcgtcgaacgaatttttcgaccataacttttttctttctcaaccaaattaaacatttttggtattattcgaaagcattcgaaaaatgctattagcctgcaaattttcaaaaatttttatttatgcacaataaaatcagagcaaaaaaagttcgaattactgggcttttgagttccttctggccataacttttttgaaacttaacgaaaatttttgagattttgcaaattaataataaacacatagagctatcgaacaacaccaacaattcttaatttgattgacagtgaacaaagttatggttcaaaaagtcttccgacgacgtttcggccgccgacgttttggggtgcaccg

SEQ ID NO: 55517 - DNA, 236 bp, Heterodera glycines
  Genomic contig location: Contig_ID=SeqID_529; Location=609..844; Strand=+
  SCN-specific regions: Sequence locations=1-194,216-236
atggctgatccaatcgactcgaaatattttgggtttgtgccagccactgaagagcagcagggtaatggggaaaatcacaataaaaagtaaatgcaattaaaataaatgattgaattcaagaacatacattaaaaaggggtaatatgccaaagggtacaaaatgagttttatgcaaaaaattctaaaagaaaggcagtttattgctattttcaaaatttacgggttaaagatctgta

SEQ ID NO: 55518 - DNA, 1642 bp, Heterodera glycines
  Genomic contig location: Contig_ID=SeqID_530; Location=46..1687; Strand=+
  SCN-specific regions: Sequence locations=1-21,43-119,146-197,315 -673,703-819,875-914,936-959,1000-1260,1282-1642
atgggaatttgccaaacaggcaattctgctgatgtgttctgtttgggccaatttgtgcccagtgccgccgtgctgtcatcatcatcaatcggtgctgctgctggtgatcgtcagcagaaaggacggcagcagcagcagaacacggcgatggtgggccaatttataaaagaaacaaaaaatggttgccaagaaaattgaaatatttaaaaaaatgaaaaatatatttttgcataagaaatatttcttaaaataaaaaaaaataaaaaattttaatcattgaaattattatgtttaaaatgaatattttatttttagagcccggaattttgaaggtttcaggctcgtccgtgggcttagacaattgaccaggctcgggctgccctgtcaaaaaagccaatttaaacgggcgtcccgggtccggtcccaattttagccgggcccccgccggacttgggattttttcaagttaacatgcggggaccaaagaccaacaaaaaaaacttcattaatccgaattttcttttaatagtaatttttcaaattttttctgataggtggaaggttcgacaccgcaaagtttttcaatttttgcaggccaatgttgtcaagacggaacagcagcagcagcataatgaagaggatgggcaagtcgaatatggtaagagaaaaaaagtacattcatttattgtcatttcaaatatacgaattatgttggttttttaaatttttaattttgaaaaaacttaaatgcgcttaaatctaaagtttttgaatttttcataaaatttctccgactctattcatcttgtaaaatttaggaaaaaatattagattctaaaataaaataaattaatttgattttttttgattataagcaaaaattataatggtttttttggaagaaaaagtgttcaatatgacgggtttaaaaccttccaaaatactgaatgaaaacctacaataaaaatttaaataaattaaaaaaatatatattttttagaccaattgactccaacaattccatcactttttggagaagatactaaccgattggatgtgcgacaacagcagcaaatgtgccatgttgatcagctgatgaaaacatgcgaatccattggtgggcacagatttatgcacaactaattaatgatgctaaaaagacaacaaacaattattctgtttttaactccgatgtaataggattttcgagatttctgtcccagggatgtacttttttttgaatttagtttaaattcaaaaagaggaatttatgatttttagaatttcttcaaatcattgaagacaggcacaaaaatgccgaaaggcaataatttaatgctttgcccggttcagttggccaattaactcagtttcaaaatgatcagaatgctattttgggacgaatttcccaattggagacgcagcaacagcaaatgcgtgaagcatttatttttatattcgaaaattttaaatgaatctttctgagaaattttaaatgttccttaaaaattcctcgattatttaatgattgtcttttttaaatttgacagttggcacagcaaacaacgaaagagcccaccaaagtaggcaatgccaaacaacagaaaaaagcgcaggtattaaattttgaaaatttatttga

SEQ ID NO: 55519 - DNA, 1645 bp, Heterodera glycines
  Genomic contig location: Contig_ID=SeqID_530; Location=1963..3607; Strand=+
  SCN-specific regions: Sequence locations=1-112,134-164,189-231,253 -303,325-543,565-584,621-904,938-1087,1113-1645
atgaaacattttaactgctgggattacgaggcccgttcttttgattatccctactacggtagttatgacctcgaacttattgacgctaaaaatctgacgatctgttataccagaagaaaatataacaatggtatatcgaatgattatatcattaaactgattaattaaaaatattttttcctataaaagattggcgaactgtctttgcggaacattccattcaaagctccgctaattccaatggccttttctacttcgaaattgctttcgaaaaattacaatcgtagggaaaatttatatgtaaaaacaatttagttattgaatcaatttattttatattgtttattaacagggctgggatttatatttttataagtatatgcttttttgcaaaatttacgagtgaatcacgaaaacatattccatagttcaagttgccaaatttttttgtgttaagaacaatgaattaaaacataaaaaaagaaggattctctcaaagcagaattttttcatttttttataaagttatgaaatccaagaaaattaacttttttacaaaataattatttgacgaagcttttcggaaatttattataaaattttttgtatgaataataaatggcagaaaggttgatgctcaattgaaacccttgattaaaattttcatatcatttgtcttaagtggtgccgtcgtcggatttgccgtcaaactaaagccatttttatcggttgtgaaccgctggggcacattggcgtgccaaagcaatggcactttttttgtgaatggtttccagcaacaacatataaatgcgacacattcattttcccgtggcgatataatcggtctcggcgtttatttagaaactcgtgaagtttttctcacaaaaaatggacaccgtttgggtatatttaaatttaaataaataataataaaattgaaaaatgtacaactgtttttgaaatgattaatcaaaattactatacatttaaaaagagatgaagcgttcggaccattgattgaatttttgaattatttctgattttctcaattttttgaccaattgatcaaatcacttttcggctctctaataaaaaactaaataaataaaacataattgtttaatttacagttaccgccaatatgttcatttcatttccaactgatcaccggcagcagttgttcccattcgtttctttgctttcgcctggtgatcaaattgatgcaaattttggaccaaactttctctttgcgaacacataaataaggaagagacgaagaacgattggacaaatttattatactttttttatgattttcaaatattatttcatttttctgctttttttgtttcatggatacaaaggaattccgcccttcgatacaaaaattacaaatttatattcgcgataaaatgacgccgaattcctcattgtttgatcagttgggcgctcacatttgggcgctcaggtttgggcgcatgcatgtttttccactataaattttttctttgtgaccaaatccatcaatcttggtattacccgaatgcttaacctgttgaaaaagttatttctaagctattgattcgcagtatgaaaacccgaaattgtagaaagaaatgctggtgcccaaacgtgagtgagaaaa

SEQ ID NO: 55520 - DNA, 1509 bp, Heterodera glycines
  Genomic contig location: Contig_ID=SeqID_532; Location=2001..3509; Strand=-
  SCN-specific regions: Sequence locations=1-46,68-1429,1452-1509
atggcacttggcgctggtcaacgcccgcttcgccgccctggtgaacatgcagctgcagcagaggcggtggtgtttggaggagtttcacatcagtgagcggaagccgaaacggactggcgccgaagtgttgagcttggcaaacaacggctcctacttctcgttgccattggccacctcaccgttgccggacagtgtcatcggattcaacggcacattcaacatttggtcgccattcaatttttgaatttccaattgcattttgttcttccccattttgcaggtatttggacgcagaagtgatcaatttcctgcaacgatttcggcgcctcttcaacacgtacatctcgctgaagttcaccattccgataacagaatttcgcgcttggcaagccgtggcacgtcacatttggcccttgctgaagaacgggctcggcacgttggtcaacgtgaagcggaagcaactggccttgatgcgcaaacacatttcgccgaccttcctcttcgactgcccaaaccttgtcgaaatcgtcagcccagttttgcctgaacgtcctaccgttgacaattctgctgctcctgaaacatcgagccgtgacttgtacatgtggctgcacacgacgcgcgtcgaccgtcgtccgttggtgtacaaattgctcaaatggaacaaccgatgggaccaattcgtcaacgaattgatgatggtgggtgtgtgggatgatcgatcgattgatcgacggacggacggatttcgttttttctctgtgcccttttaatcattgttctgctgatcacattcatttccgcttttcagtctttcaatacggcgtcagtcccggtcaactacatggtgttcacttcgttcgaattcatctacaccagaagggaacaaatggtgaacatgctgacggaggagaggctgacgatgttgaccaatgtgcacccgaaacgaggtggtggcgtggtgtccttcgtgaagattgtgcgctgtccagcggagttcagtgaagctgacgtggtgtcctggtttcgtatgacgcgcttgaacaacgaacctcatccgaatttggtgaccattggctttgcagatgacgaaattgggtatggacgagttgtcaaccaatttttatattcgggggtactcttacaatttctgtccctttgttttcagaccgttgccttcggattgtgctgcgtccatgtcgagaaacagaccgggctgagaacagaagcaatgcgcaaacagtggatcaacagcagatgagccctaaacacaatcaatggccactcggatggaattatctgatcattatcttttcataaaatgtaaatttcccatcaaatgactgatttttgtcacagatttcgtgtgcatattttgtattataaatgaagtaaagcgttgcttaatgcgatatttgtgcatcaatcaattaggcttttttaaaaatgaaaagctagaagtcccgatttaatgataccaacaaaatgctgatttggttgacaaataaa

SEQ ID NO: 55521 - DNA, 748 bp, Heterodera glycines
  Genomic contig location: Contig_ID=SeqID_533; Location=1108..1855; Strand=+
  SCN-specific regions: Sequence locations=1-164,186-194,216-328,350-748
atgtccagcctttccataaaatttgtcaactttttcctttttccattgaccattctgttggcacagtgttcgaattcgcctgacggtaaaaatttaagccctctcgagagggaacgggttggaattgtctttttttctaaacgaaattttaatttcaagtcttcaaaaaacagtcaaattttattccatgtgagatttctgaataaacattttacccctaaccagctataagctgctggaaggctttggtgccaagcttgaggctaaaattcataagcttccttcatctgctgatgttccaatgaatgcttctttgctggagctgcttgatcaattcgaaaccatcgaatttgatgggacagtgaaaggaaaagttcgctgtggttttgggctgaaccaatgcatgaagatggaatgcactctggatgcatacagtatcaacaacatggagtttaatgaaggttttgtggttggagactttttgacgcttacacaaaatccgcaaggttgtcgtttcacactggctttatttggtgccaagtcccatcacatatattaattatacagttaactcatgtttttaaaatagaaaatatatttacggaaactttaccagttgtcattaccatactaaaaaatgcaccaaagcaaattttgtgcaactaataattagttagttatcagtcaagccttttcaattagtttaattgctgctggcccataattaatttaacactaaaattctcta

SEQ ID NO: 55522 - DNA, 253 bp, Heterodera glycines
  Genomic contig location: Contig_ID=SeqID_533; Location=2022..2274; Strand=-
  SCN-specific regions: Sequence locations=1-20,53-139,161-253
atttaaaatgtaaaaaactgatttaaaatcaattatatttttaaaattttatggatgtaatttcgacggtcctaaaatttaagtctggagtcggaattgctctcggaaagtgcaaataaagggaaaacattgaaagtagttttaatttttaatttaaaatgttgtcttttaccatgcaaaatgccaacagccaaaatcagggcaaaggtgccaaagtgattgccaaccgtccacccaaccatcgcaccgttgc

SEQ ID NO: 55523 - DNA, 1291 bp, Heterodera glycines
  Genomic contig location: Contig_ID=SeqID_4721; Location=67..1357; Strand=-
  SCN-specific regions: Sequence locations=1-82,303-457,481-538,1263 -1266
  Gene Ontology: Mol. function=DNA binding; Cellular component=nucleus; Biological process=regulation of transcription, DNA-dependent
atgcatggtggcaagcggcccagtggtcaagtggttagtgtgcctgccttttatagtgggttcgggtcctactgcttcagagtaatttaaaaaaatattatatataattctactttttgttttgtttttttatttaattaactttatggaaataaaatattagttattttaaattaatgaaataagatttatttaaaaccaaatttaaaaatgaatttaatattaatcaataaaataggtaaataataatttaaaaaataatataataaataaatctaaataatatttaagataaataagtatttacgagtacaagacaagcaatccggtgaacaagtggttagtatgcctttctttgttggtgtagtgtatagggttcgattcccattaattctgattatcaaactttttaattttttttttgataattacgtttaggaaataaaaataaaaaatttacataaagagtgaaataatatgttttaaaaaaagtttctgatccaatctaacagaataaattttgattcatggcttacggaaaattaaaaatagataaaaatttaaataaaacaaacaaaatttaaaactaaaaaatatgaaagagggacagaagaggaacagaaagaggaagaggaatagaaaggggaagaggaagtggaagagaaacaaaaagaggaacagaaaaagaaatagaagaggaacagaaagtggaaaaggatcagaaagagaaagcggaagaggaacagaaaggggaacagaaattggaagaggaagagaaagtggaagaggaacagaaaggggaacaggaagagggacagaagaggaacagaaagaggaagagaaagtggaagaggaacagaaagtggaagagaaagtggaagaggaacagaaagaggaagaggaacagaaaaagaaatagaacaggaacagaaagtggaagaggatcagaaagagaaagcggaagaggaacagaaaggggaacagaaattggaagaggaagagaaagtggaagaggaacagaaaggggaacaggaagagggacagaagaggaacagaaagaggaaagtggaagaggaacagaaagtggaagagaaagtggaagaggaacagaaagaggaagaggaacagaaaaagaaatagaacaggaacagaaagtggaagaggatcagaaagagaaagcggaagaggaacagaaaggggaacagaaattggaagaggaagagaaagtggaagaggaacagaaaggggaacaggaagagggacagaagaggaacagaaagaggaagagaaa

SEQ ID NO: 55524 - DNA, 589 bp, Heterodera glycines
  Genomic contig location: Contig_ID=SeqID_4722; Location=916..1504; Strand=-
  SCN-specific regions: Sequence locations=1-131,153-355,384-407,431-589
atgatatacccgggtataacgaactcctccaactctttaaacaagaatccctcttaaaacgcagaataaaaatagatttaaaactcttccatgatataattttgggaaagatccatattcagcataatgattctttttcaaaaatatattcaggactgaaaaacgattatattataaaaaccgcttattgttcaaccaatgttcggtttcattcgttttttattcgtacctctcgcctctataggagtttgcctaaagaggcgaggttacttaattctactgagtttgctaaacttcttgacacctatgatattgatgttttacttttgaaaccgccccatctcattcagtgaccaattttattttatttattttgttttaatgtcggtgtcacgcttttgcgtataaattgaattgaattgaattgaatcagtttttcggtcgttttttcgataaaagaacagaaaagtcggaattgaaaaagaccaataatttttcatggattttatttatgtattgtattattaagttaataagaaaggaccgggagcacagcaattctcaacaatgactgagaatttttaataaa

SEQ ID NO: 55525 - DNA, 1436 bp, Heterodera glycines
  Genomic contig location: Contig_ID=SeqID_4723; Location=808..2243; Strand=-
  SCN-specific regions: Sequence locations=1-80,145-302,334-627,649 -840,867-887,909-1126,1148-1436
atggacaaagtgactccgaattttaaagaggagaaacgaacaaatgccatcgttgttcccccaaaggatgcaattggtacaaattaataattaaacaaaaaatgattgaaataattattaaataataattgaaattataaatttcagtgaaacgaaataataaaactgctgttattgcccatttgcacgtcttttaccaaaaatgggctctttttgtggtgaaacatcgcactttaataatggcaatttgctcaattctttcgactttgggcgcagtgaaaatattcaaaacgccgtaaatgaaaattaattaaataataaaaagttaaaaatgagtgctcatttgtcagctttgtgaatgatctcaacggatggaccccttacggcgcgcgttctttggccgaatcggacgcatggaacgaatttttcaacgacaccggcacaggcagcaatttcgccattttcgtgctgatcaaaccgaaagtgatcggcacaaatatgctgcagagcaaaatgctggaggaagtgatcagagtgaggagaaaagcagccaaataaatcaataggaaaataaaaaataaaagggggaggaaagataattagggcgagcgggggtaattaatgggcaaattaatatccaaaatggcacaaggcacaaaacattggtttgtcttcaggtcgatgacctgataaattggaacatcactctccaaaaccatgccacgaataagtcggaagcatttgccgagttttgctacaacttttgcgacattaacgaacccttgcgacttttttgggcaagtaaaaagtcaaaaattaattgatttgcatcaattagatcttaaaattactttttaaaaatttcagaaaggattcgtcacccaaacggaagaaggaggaaaagcagcggagataagtctgaactatccgaacatcaatgtgtgggggcgaaaagctaatattcaggcaaacaaaggccatcggcgggtttaaattttaaatcaccttttaatttcagccccatttccacggcgttaactttgccaaaaacaatttgaccacaaaaatcaccaacatcgcttctgtggagatggtcgcccttcaataccgagccgaacggacactgttggggctgagcagcgacgagatgaagcagtatctgatcagagtgtccaagttcttcgagaagttcgttcaatcaattactataattgttttgatcatttttaactttcagcgaatttcgcagtgatttgatccatgtgatgagcataagccaaagttatgtcgaggcggagttcgtccgtgccagcttgtccatgctgccgtaccttggcttcggattcgccgtcatggctttctgtacggccattagcattcctttgtccgccgcgtattttcaacaggcgaccgtccacaaggcattcactcattag

SEQ ID NO: 55526 - DNA, 1074 bp, Heterodera glycines
  Genomic contig location: Contig_ID=SeqID_24781; Location=57..1130; Strand=+
  SCN-specific regions: Sequence locations=1-146,190-614,657-726,751 -884,907-965,1037-1040
ctacaattcatattggcaaaacgcgtcgaccccgcaaccggcgcatcattactacactggcgggaccggatcacttgtttactcaacaatcagtggtgacgcacattccatttgcaggtaggtgatcgctgatcatttggatcagcaaataaattatattttttgtgttcattatataattatttttaactgatttattagagctcgacctgattagcctctgctggttccagaggcctgggtttttcattaacctaggtccaggcacttttcgggccttctaggttttttggggtctaggttttcctgctatgctttttccagaaaaattagaccaatgtaaagtataactcataacttggcatgaattttattgagccttggtttttctcagaaatccaggctcaagtcctgcgttaaacaatacccaggccccggcatttaattcaattgccgaatacttagttaattagggttacacaaggttacggaatcgttaatcctctgggctgatcaccggattacagcagtaacgcggacgtgtccgcccgtctctccacccgtacccatcagttatcctcctcactgatccttgtgccaactccgccggccactcattatcagcatcatcatcattatccgaatcatcatcatcagcaacagatcaccgttgatccatcctacaataacaacattgtgtcaatgtcttcaccgtccggcacgggtgccattggtggtggtggcggtggtcacattggcatctatcatcaagcaaattccagtaaaaaagagcaattttcaatttgtgacagatagatgatgtccacttaggacttctaaatttactaaatttgcgttttcaaaattctagagttttaaaatcaaattttgaaatattttttagtgccaaagaatatgaaaaagtttctagatttcttccaaaaacaaaaaagaaatagtttaactttttaaatttattttttgtaataattcaaaacttttatcttgaaaaaaatcattttctttaaattttattgcgccttaattttaatactcttgataataataataata

SEQ ID NO: 55527 - DNA, 56 bp, Heterodera glycines
  Genomic contig location: Contig_ID=SeqID_24783; Location=1324..1379; Strand=+
  SCN-specific regions: Sequence locations=1-56
atggaagaaatgccagttgtgccgataaacgcctcatggaaaattttgaagacata

SEQ ID NO: 55528 - DNA, 86 bp, Heterodera glycines
  Genomic contig location: Contig_ID=SeqID_24785; Location=1026..1111; Strand=+
  SCN-specific regions: Sequence locations=1-12,36-86
atttcgtcctcctcccccttttttcttccctttgtctctttgccgatcgtttgtcgtcctttgaagacgaatgagtaagcgttgat

SEQ ID NO: 55529 - DNA, 291 bp, Heterodera glycines
  Genomic contig location: Contig_ID=SeqID_24788; Location=785..1075; Strand=+
  SCN-specific regions: Sequence locations=1-291
atgagtatcaacctccacgacaaaaagtcgctcatggacaacattttgccggtggttgagataaatcaaaccaccaatggcattacggttagcagtgaacgaattgcgataccacgaacgattcagttcgacattcttggcaaatgtcgagaatgtaagtcaaccgaatgtgagacggaatggtgcgtttccaaggaaggcgttaccatttggtgcacacgcttcaaaataagcccccgttttgtgccatttgatgtgatctacgatttgtctggttacacatttttcaag

SEQ ID NO: 55530 - DNA, 612 bp, Heterodera glycines
  Genomic contig location: Contig_ID=SeqID_24789; Location=663..1274; Strand=+
  SCN-specific regions: Sequence locations=1-612
atgaggaccatcatattgaagaaatgctgttggcttacaattggttgtgatttcatctctgaagtgttgaacctgtcggtcggccactcaactttttgctcactttcgagaaattcactacttcaactttggcggccccttttgtaagtgggttgggaagagttgtggtaaatttgccaaatagccaaatatctgataaaacatttgtgttcgttaatttgagtttagtgtgacacaattatgtgtgtcatgtttttgataaacattagtgtttgttatttgagtttagtgtgacacaattatgtgtgtcatgtttttgataaacattagtgttcgttatttgagtttagtgtgacacaattatgtgtgtcatgtctttgataaaacattagtgttcgttatttgagtttagtgtgacacaattatgtgtgtcatgtttttgataaaacattagtgtttgttctgtgacttaagtatgagacactaaagtctggcatgacattgataaaacattagtgtttgttttgtgacttaatgtgcttctcaaatttcagaaacccaaacaagcgtgaagcaatgaaacatgcacggtctcatcattggactttttaa

SEQ ID NO: 55531 - DNA, 259 bp, Heterodera glycines
  Genomic contig location: Contig_ID=SeqID_24789; Location=866..1124; Strand=-
  SCN-specific regions: Sequence locations=1-259
aacaaacactaatgttttatcaaaaacatgacacacataattgtgtcacactaaactcaaataacgaacactaatgttttatcaaagacatgacacacataattgtgtcacactaaactcaaataacgaacactaatgtttatcaaaaacatgacacacataattgtgtcacactaaactcaaataacaaacactaatgtttatcaaaaacatgacacacataattgtgtcacactaaactcaaattaacgaacacaaa

SEQ ID NO: 55532 - DNA, 55 bp, Heterodera glycines
  Genomic contig location: Contig_ID=SeqID_4724; Location=110..164; Strand=-
  SCN-specific regions: Sequence locations=24-55
aaatttatttatttttatgttggattcgaacccgagctccaaaaatgcgaattta

SEQ ID NO: 55533 - DNA, 82 bp, Heterodera glycines
  Genomic contig location: Contig_ID=SeqID_4724; Location=1221..1302; Strand=+
  SCN-specific regions: Sequence locations=1-8,37-82
cagagaagaacattcacattttcatatttaatttcatctttaaatctgccattaataaagcatctcaaataatccgccactg

SEQ ID NO: 55534 - DNA, 1958 bp, Heterodera glycines
  Genomic contig location: Contig_ID=SeqID_4725; Location=361..2318; Strand=+
  SCN-specific regions: Sequence locations=1-127,149-198,251-277,304 -580,610-620,671-745,774-1569,1591-1642,1664-1744,1766-1958
atggcgggaattttgtccattttctcgagttttctcgaagcaaatggacttggcggacccgacttttggggacgatcgattctcgtgatgcaggtggacttaaaaatttcgtgccaaccaaaactgttttatattatctttaaaaatcttattctgaaattaaatttttgacaaaagaatcatcactagggcggggacaaatattttattataaatcccaaaatatttaaataaatattttcaaaaaaatgctgaaatgttgaccaaaatattgagcaaatatttaagaaaaatgaaaaactttgtggaaaaaaataattaactgctcataacactacaaaaatttattcattgattacagctgcaaataatatatttttcgagtttgaatgcattttctaaaataagtaaaattataaaaatcaaaaattttggtcaataaagaaaaaaacaaaaatttggttaagaaaaaaaaaaaacaggattttcttggaaaaatttttgaaaatttttgttatcgcgttaaaaaatcttttagcatttttgttaaataatttcttagttttacattaaaagtttgaaaaatatcaaaatatttataaaaatattgacaaaatccctaatattaaaataaatttttattttataaaaattcaaaatatttttttatgactaaaactgacgttcaaatgcaaaaatttaagcgcagaaatgcgttttttatctcctattcattgcaataagcaaaaaaaaaaaaaaaaattcaaataaatgtttgccccagccctaatgatcatctctgattttaaaacatattttaaagaacaattaattaaagtttgaaaaattattttcggagtttctcatcgaccaactgagtccccccccccaggcgttccatctgctgatcaactcttatctcgagctgcgctttttcctcccgcttctcctctccgtcttcgcttcgccccccggcgctttgcttttgtcgcgccttctcaccatttgccagtccctttactttgtactgctccaatttgtcgcctttgttctgctgctctgccgtttggtgctcaattcgatgattctcccattggtccggatttttttcctttttttaatgaaatgatttgaagatcactgtccatttggtgctgatcgcctcaattctgctccaacttgtccaaatgcttttcgtcggccaagcgggcaccgaattcttcatttggtgttggtatttgagtgcgtgtgtcacttttacgctgtaccaggcaatgtcagtgttcagtgttatttgtctgttcacatcggagccaatgttttggacgacattcaacttgtttttggccaattcatttttgaatcgactcgttttttaattgttccaactctttttcttgattgaaacggtgctgattgtgagccgttataaaaaaaagccaacaaaaagggcgttataaaaaaaaccatcaaatgaaaaatttcaacaaaaaactacccataactttgctcaaacccaatgaaaattttaaatctttaaacaattctattttagcctccaaaatttcaaaaaatttggttatgtttcaaaaaagctatggccaaaagtacatcaggaaccaggttttctgacatttttggcaataacttttttgaaattttgcaggctagtagagaattgttaaggctatcgaatgatattaagaattaaatttagttaagtttgagcaaaagttataatttaaaaatttctgctctatttaaactcaggaatgctttttaagctagttttcacagtttttcactatttttggtcaattttcaaaatttaaataacgaacaataataattagagctagaaatttaggtaagaaaaatcgcgaaataggtattaaaaaaagctcaaaatagttattaaatagatacaaaaatcccgaaatagctagaaaaataggtaa

SEQ ID NO: 55535 - DNA, 54 bp, Heterodera glycines
  Genomic contig location: Contig_ID=SeqID_4726; Location=2708..2761; Strand=-
  SCN-specific regions: Sequence locations=1-54
aaacacttagggctatcgaaatattaagattttgaaatctggttcattttgtgc

SEQ ID NO: 55536 - DNA, 542 bp, Heterodera glycines
  Genomic contig location: Contig_ID=SeqID_4727; Location=1024..1565; Strand=+
  SCN-specific regions: Sequence locations=1-9,33-177,214-293,316 -464,487-542
atggcacaaattcatttcaaaattttccttatcttttctctcattactttttcacaatgccgaatcaattcagaaccgagtgaaaaaggtgagaaaaagaaattaaaaagtttaatttgcttggtcattatgagggcactttattggacaataaaataagcgcaaaatattcatatcagtagaaatctctgatattggaataacaacattttttgctcttatttctgaatttcgcacaattgtcttaattttcattaatttcattaaaattcccttcttcaaaattttcgagaatatttttaaacaaaattaattaacgataatccattaaatttacctaactgatgacatgaaatcatttccaataatttgctcattagtaaattgatgagttttcaagatgtaactctgttttagaaggcccttcttcaattggtggaattcaaaatgcaacaagcgatcatcggtctgctgctgctgcttctgatcaccatgcttcttcatgcgatggttttggttggacactgaacaagggaaaataa

SEQ ID NO: 55537 - DNA, 83 bp, Heterodera glycines
  Genomic contig location: Contig_ID=SeqID_24790; Location=733..815; Strand=+
  SCN-specific regions: Sequence locations=1-83
atgcacagatcccatcaaagccacggcattattatgggaatccgggaaaatgatatgtctggggacgcaaagtctgatagact

SEQ ID NO: 55538 - DNA, 800 bp, Heterodera glycines
  Genomic contig location: Contig_ID=SeqID_24791; Location=47..846; Strand=-
  SCN-specific regions: Sequence locations=1-51,99-107,141-283,305 -313,337-358,380-380,435-455,506-800
atggacacagacactggatggatcaacgatttcaagcaggtccgcaagaccaattttttttttcatttaaaactttattgtaatttattatttttaaaccaaaacatttcgtatttctgattttattataacaaataaaaaactttcaaattttttcattcttttttttgagcaaactaaaaagccgcaaaattaaccaaagtcatcattttttggataaaatctgttaactaatcgcattaaaattccctggcagcgcctaccggcaccaccggacgcccatttaccttagtttttgaaattttagctcaagaattgcaaaaatttcaggaaaaacatcttattatattttaccagaaaatttcaagtaaaaacttttgaaaatttttaaacaattttttaaaaatttaatgtgaattattaagttttttaaaggattttccaagaaatcactgaaaatttcttaattttttagtaaattttcttacaaaaaaaatttatatttgcattttcccattgtttagacatttgttcgtgccaccacttctgcccgttacacaattcaatttgaagtgcccacatctgtgccaattgggccatttgaattggtgaatgaacggacccaagaaaaactgacactgtgtaaaacaagcgaagatttatgggctatccaatgggtgatgaagcgatgtccaattggggagacggcgatgattcagtgggaggccccccaaaattcggcaaccaatttgaacaatgtcaacatttatttgtgttgtgtcagttgcactaagtggtga

SEQ ID NO: 55539 - DNA, 435 bp, Heterodera glycines
  Genomic contig location: Contig_ID=SeqID_24792; Location=140..574; Strand=+
  SCN-specific regions: Sequence locations=1-55,77-435
atgcaattttcaagtgtagaacatttacggctcaccctgaacagcctcatacgtgaggtgtatcagcagcagcaattttcttctggccatgatagagctagccggacgaaacggcaggtcacagacctattttttcatgaaaatccagtggattattgggaaaagattggcgaattacgcaccaaacaagagcagtttgaaaaggaggtaaaacaggaggagagtgaactttcggcagacactacggatgtggagaggaaaaaactgctacaaagcgagcttccactaaaacggattcgtatgcagaggaaaaagtatgagctggaagagttggaacgtgctgctgaacgtcgtgatcaggaaagtccggagaatgagcaaagaaagattagcgatttttccaacatcatcccgaagattataacaaaaaattga

SEQ ID NO: 55540 - DNA, 889 bp, Heterodera glycines
  Genomic contig location: Contig_ID=SeqID_24792; Location=625..1513; Strand=+
  SCN-specific regions: Sequence locations=1-782,805-889
atgagcaagtacattggtgaaaaagatataaataaaattcgtcagcttaacaccgaggttggcaaaatacgcacaaaaataaaacacatgcagcacaatttgaccatctttgaaaatgctgcgcttcagcgtgaccaccaaaaatctttgtcggaatatgaggagctcagccaccagcagaatagtgcatttgttgaggaattttttcaaaaacatcccacaaattattggcaaattattcacaacaattataggggtcttacagaacattttcagaagatagaacaactgcaagcaaaggcagtagggttaaaggataatgcgtctttcgaaaagcaaatagagcgagcaaaacagctgattgagtacagacgaaagagattcgctgcgctggaatttgaggcaaaaaagcgtgatgagcaacaacagtttgttgcagcagcagcaaatacaattactgcaccaactgcgtcggcattgatcggaagggaggcgttaaaaaaacgtacaggcatctctgccagtacggatggtgaagtaggtgataaagcagatgtcggtccacaaacagctaccacaacaacacatggggaggtattaaaagagaaaatactggagcagcaaaaacacacggacaaggatgataaagcagatgtcggtccacaaacagctaccacaacaacacatggggaggtattaaaagagaaaatactggagcagcaaaaacacacggacaacgatgataaagcagatgccggtccacaagcagctaccacaacgcatggggaggcagtacgtgagaaaatattggagcaacaaaagagcacggacgatgatgataaagcagctgtcggtcagcaaacaatcccaacagcaacaaaaacacatg

SEQ ID NO: 55541 - DNA, 1650 bp, Heterodera glycines
  Genomic contig location: Contig_ID=SeqID_24794; Location=1..1650; Strand=-
  SCN-specific regions: Sequence locations=1-6,28-211,234-689,720 -723,786-884,925-1067,1090-1502,1524-1650
  Gene Ontology: Mol. function=protein tyrosine kinase activity; Cellular component=mitochondrial inner membrane; Biological process =transport
tgcggcaaatgaatgcaggcagaagcatcaatctaatggaccatgtgttcggcatgttggagcagtacgccaacaaattggaggagaatgtgcatgaacggacgcgcgagttggaggaagaaaagcgcaaatcggaaatactcctctaccgcatgatgccacggtaattaaagcaaaagtgattaaaaaaattgcctttttttctctcacgcggccctctccctctctattacacccccctcttttattgcccttactgtaaagccgattcaaaaaccaaaacgcaattaagccaagttgcggaccgacttaagcttggccagtcggttgagcccgagcacttcgagtgcgttacggtgttcttttcggacattgtcaaattcgcggaactgtccaaccaaatgcgaccgctgcaggtggtcaatcttatgaacgaactgtacaccatttttgacgcgatcatcgacgaacacgacatgtacaaagtggaatcaattggcgaggaatttttttaattaaaagcagacaaatgacatttttgaattttggggctaggctggtagttgaaaattttaaaattgttcccaaaacatatagaaggaaataatgcatgtggataaatggtggatatatgcttcagctaatttacgattaaaaaattgtcataattttaataaagaatcgattcacttttattatttgagtttttaaatgtcttttaggatttaaaaatatattttttttaacattttttttattattcactaattatgtatttaattttactaaatgcctttaggcgatggctatttgtgcgtgtccggccttcccaatcgaaatggcaatttacatgccaaacagtgtgctgacatgtaagaaatggcataaataaattcaaaaattttatttttattttttaaattagggcattgaaatttttgaaagcgttggaaaccttccgaatttcggaccattcctttgagcgcattcgtctccgcatcggactgcacagtggcccatgtgtcgcgggcgttgtcggtaaaaatttctttaaacacattttgtgtaattaaattaaaatgggtaattttagaatttgattcattttcctatcaaaaattttattggttgtaatttagggttggccatgccccgctactgtctgtttggcgacacggtaaacaccgcctcgcgcatggaaagctcttcaagccgttcgtttaaaaaccattaatgaatcttttttacatattcagctaactaaattcacatctccaaagaaacgtatatgctgctgcacaataattttgatggttacgcagtggaaagtcgaggcgaagtgataattaaggtaaggggaggggcgataaatgcatcattaatcagcacgaataattgactaaatgccgtgatctaataagctaaggcaccaccacaggattattaacaaaatatacgaatgatatgagaatgctggggaaaaaaagcaccacttattaaccacaaatcaaattaaaatgaaacaattagaaagcccgaaaaaagacaattaaaaattaattagtgtgtacaatcttactctttttatagggcaaaggcgtaatggagactttttggctgttgagcaatgccgagataagaagcaacaac

SEQ ID NO: 55542 - DNA, 305 bp, Heterodera glycines
  Genomic contig location: Contig_ID=SeqID_24795; Location=302..606; Strand=-
  SCN-specific regions: Sequence locations=1-121,145-261,284-305
atgtcaaacaatgcgagcgatgaacaaaaggagcagaaaaagggcgatgatattgaccaaaatgatggtcatttgacagctgatgatcggagcggactaaaaaaaatcaaagaaattaatcgaaaaagagagaaagaaaaggacttgaagaacattggagacggaagtggagaaaaggataagcaaaaggaggaaaaggcagcagtcgacggaagccaaaaaacagcgcaacggatagggcaatctgagcaaaaatggggcgaaatcggaggagagcgaaaaagacagaaacaaactgctgatca

SEQ ID NO: 55543 - DNA, 486 bp, Heterodera glycines
  Genomic contig location: Contig_ID=SeqID_24796; Location=501..986; Strand=+
  SCN-specific regions: Sequence locations=1-88,110-226,259-415,437-486
atgcaggtatttcttttttatatctcatatttattcttcttattgagtccaatatttcggatatcaacggttttttaacatgcttcaaaaatatacgaaaatgttttatatatgcttgaaaatttccttaagaccaatagactaggatttagaaaagaattgtttagacaatcatcgagaaattgtcggagtcaaggaaacagtgtcaataattattttagtccggataataaattataaatattttagtataattttcatgcaggtatttcttttttatatctcatatttattcttcttattagtccaatatttcggatatcagcggttttttaacgcacttcaaaaagatgcgaaaagtttcgctgatattaaagcattcaattaatcgcattttcatagtcataaaaaacaattttttatataaagcgtcttgggttttttggagttctcaatatggacattattaaaagtagggcatgtgca

SEQ ID NO: 55544 - DNA, 705 bp, Heterodera glycines
  Genomic contig location: Contig_ID=SeqID_24797; Location=1346..2050; Strand=-
  SCN-specific regions: Sequence locations=1-185,207-565,587-705
atgattgatgagtatatgacaaaaacaattgttacaaatgtgaaaagcccattccgattaagaagtaagtttataaaattcctcctcgaccaagctacggttgagcatgttcgacgtttgatctccgaacgcggcattcacagtgagagacaaagaattgcacgggtggttgtgctggaacaactccgactcgaactcgaagaccggaacgttagaagccgttgagaactgaggagtgttcggcagattcgaagggaccgaacgcagttccttcatgttatgggcaaacaagcagtcggaaccgaatctaaaagaaaacaaaaaatggctctgaccggcattttcttcaattttaatatttaaacaaacttgcaaaagcccagcgtttgaatattatggcacatttgcgttttgtacagcgacatcttactctgacgcgcattattacagtgcgaacgctgcttgtaagccgcaagcatctgaaggcattcgcggaaaccattcgtcgcactaaattaggcatgagttactgtatatgtataatattttagttatataccgctccattttcatgcgagtattataagcaagcaaaaaggcattgttaagtgatgtacgcgaatcttcttgcattattttagggtgtttgttaggatgtagttaatgaaaaatcggtatgcctttacaaagaattatctaaataaa

SEQ ID NO: 55545 - DNA, 222 bp, Heterodera glycines
  Genomic contig location: Contig_ID=SeqID_24798; Location=1034..1255; Strand=-
  SCN-specific regions: Sequence locations=1-222
atgccaatctataggttttcgtggtcgctgatcgcgaatccggtattcatttcgtccaattccaaatcccggacccgaattcgaacaaaaagtcgaaaattaaaatttttggttttcatattattggtcagcattgtttaaatacacggaaacgaactgaaagtcatcagtgcttcaattaaaaatcatttaaactatttttagactaaaaatgaaaaataa

SEQ ID NO: 55546 - DNA, 295 bp, Heterodera glycines
  Genomic contig location: Contig_ID=SeqID_24798; Location=1324..1618; Strand=-
  SCN-specific regions: Sequence locations=1-31,56-75,97-295
atgcatttcgtgctgattgaggggcaaaaggcaagtcaccccagccaaatgctttgtgatgtaaagcccgggtcgataacaaaattattggttcttccattttcagttggaatttgacatcattgatggtgagaaggggagggaggcggccgttgtgtccgggcctggtgggattcgcgtcggtacagccatccgatacaatccacaacagcaactggccgctggcaaggacttcaaacgtatcaatgcttctgctggtggcagcagactcccgccgcgtcctcctgtggcgaag

SEQ ID NO: 55547 - DNA, 61 bp, Heterodera glycines
  Genomic contig location: Contig_ID=SeqID_4729; Location=1219..1279; Strand=-
  SCN-specific regions: Sequence locations=1-61
tgtcgcctctcaccggcaaatgcttgactcctatttgtgcgagtttctttggcgcgaggct

SEQ ID NO: 55548 - DNA, 546 bp, Heterodera glycines
  Genomic contig location: Contig_ID=SeqID_4729; Location=475..1020; Strand=+
  SCN-specific regions: Sequence locations=1-128,169-546
atgcgaatgcaatctccaattattaatcgtggcagaagaaaaacgaaattggcttttaaatcacttgtgccatcatccttcgttacttatcgcacatttatatcgttttgcatttttaggtcattcccaaaaaaatattaatttaatagcctatttttatttatttttcttgttacttagcacgattgtccctttcggcgatcggcgttttcttatctttttgtgtattactacaggatttccactgtcggactgtccactgtcaaattgtccagtcagggattatcgaccaaagcttatgcaattgtctgtatgaaagtggtgattgttttttaacaaagtctgtatttactcgtgtttttaagagttaattatgtttaggatttgtaatttcgacattttatggcacttttataaaatttctaagtgggcaattttacaaaaggaccgaactcgcttttttcaaaaaaaaattgaaatttttgaatctttttatacaatattgcttttaatacaatcatataaataacaattttttatcttaca

SEQ ID NO: 55549 - DNA, 1184 bp, Heterodera glycines
  Genomic contig location: Contig_ID=SeqID_4729; Location=1896..3079; Strand=-
  SCN-specific regions: Sequence locations=1-52,85-216,286-310,426 -511,533-675,708-847,879-902,925-1184
atgcgtcaaagaatggtttgtgtttagttatcttgctctaaggcatcaaaactataataaaaaaaatatttttttaattttaaaggtttgaaaaaaagaaggaaattcgttgtccattctgtaacgttgagtcaaaaccatttttggtaaaatatgaaaattgttttttgatataaaaactaaaacccgattaaaaattaataaaagattatctccaaaaaatcttatttattaattattttatttatcacatttaattgattaaattgcattaaaaattaattagctgaacaaaaaggtaaaattcgagaaaatttgataatatttattttggaaaaaaataataaaaataattttatatattattttttgccacatttaatttaataaattataattatgataattaaaaaaaacaaaattaaggattttcattttcaaccaattttctccgagtcagaaaaaatgtacgcgcatttttacatggacccattgaaggaattgtacagaattaaaaatgccaaaattggtgggtcagctcagcgcgggctactagcccaacaaatcatcaaccaaatcagtaccaaagtgaaggaaatggaccaacgtttaaagattttattgccaatatttggttttgaaaatttggaaatgccattgttcagcattgaacaagagggaaaatttgctgaggaccctttctttaatatatccagacatacatcaaacttttggacgatgaccgaggctttagtactgatattgaaacggaggcgttggcgctgatcgaaacggcaccgaaagtgccattgttggaagccaacaatgccattgaacaaatgcaaattgttgtggaggaagaggaggaaaagccgccgcaccagccccaccaccaacagaagaaacagcatgaacaccaccaccacaagaaggaacaccacgaacataatttggttaagatgttgtttaaaaacatgttttacaaagaacattgaccaaagatcaaagagtaacgattatcttgatttattgattggttggtttggttgtaccgttattttatgctatttttagttatgttttcgtgggagaagaagagaaagtatttagcaaatttatttaggtatgtatgtggaaagaaagaattgcgaaatttaattggataaaattgaggcacaaataaa

SEQ ID NO: 55550 - DNA, 1865 bp, Heterodera glycines
  Genomic contig location: Contig_ID=SeqID_4730; Location=113..1977; Strand=-
  SCN-specific regions: Sequence locations=1-327,350-574,598-768,791 -1067,1089-1138,1160-1213,1235-1390,1416-1449,1471-1522,1546 -1610,1633-1652,1674-1865
atgccattcagcatcaagcccagtggtctgttttggcaccgacgcgtgttagtcgagacgacaaatgagggcaccggtggtaattatcacgcccttctgtacgcaattgtgcgagaaaataggagggcaccacaacaaaacggtggcggtggcggtaatggtcaaagcggtggtaatggtggagaccagcagaacaacgctaatgctaatgaccgtaatgatttggctgccgctgagaagcgcgaattgttgggctattccccgctgatcaaagataaagaagatatggcagaagcggtgccgaatgttggtgatgatggcactggaacaacatccgggcagcagaaaaaggcaccatttaaaccatatttataatagctgagttcattggattaaatccataatttttattaatcacttctgagctgatcgatcaaactcgggaaagggattttaagttggagtaaaattagaaaaaaaattttaaatgaattaagcattgtaaccaaacgccaaattcatagttggcttgtcgaaactaattcgggaaccttgaggattttcattaaaaaccaaataaaattaattttattttatgtgttcaatgaatacgaactaaatattcctgtgaatttgacgcatttatatcgccacaaaattgaacggcttgaactgtccatttttcattatgatggcgaggtaagatcaatgtttatttcagtaaattaacaccagggctggagggatttgcgattttaccaggtgctatgtcagacaaaaagtgcaaaatttgcgaaattttggactaaatcaactcataacttttctcagacgcaaccaaattgcacaatcttggtatcattcgatggcccttgaattgcattattagtttgctaaatttaaaaaaatcttattaagtttttcaaaacttcaagcaaaaaagtggaaaaattgtcataactttaaaagaacataataagatttttttttaatttagcaaactaataacccaattcaagggctatcgtatgataccaaggttgtgcaatttgattgcgtctgagaaaagttatgaattgatttaatcaaaaatttagcaaattttgcactttttgtccatcgcctatgattgtaaatctaattaaaattttgaatgtttcgcatacatttgcggtgtacttaagaaatttttcaaaaaatttgactcaaaaacaggaaaatttggttatttttgattaaattgttgttttacaaatcgaactattttttgaaattttttacttgaaaagtaaaggcggtacctaataaacaccgctaatgcgtcttgttttttttctacaaattattatctttataatttgctcctttgttcccataattgcttaattgccccaattaagtaatttttaggaaaacatcctaaattgaaaaaaattctgttttctctggaattttcacaacataaaaacagagcagcagtccgtctccacacaccctccggcccagaaaatgcttttgcctcattaattttaattatatttttttctcattttaagtgcaaattcactgtcaaaaaagttgttaaaacggcagtttatgcgaataaagaaaaggacaaggacaaagacaagaacgatgataaagatgaggataaagataaggacaaggatgaggatgattgtccaatttgcttcaatgaaatgaaagttaatgaggaacaaattcaagttcatgaacacgaggtaaaatcaaagacacgcgcgggcatttacgctggaggggacattaatttgccagcagggctatcaaacgaaagataccagggatggcacggaattccgatttccaacgtttttggggtatga

SEQ ID NO: 55551 - DNA, 1339 bp, Heterodera glycines
  misc_feature (98)..(98): n is a, c, g, or t
  Genomic contig location: Contig_ID=SeqID_24800; Location=24..1362; Strand=-
  SCN-specific regions: Sequence locations=1-261,285-380,414-993,1015 -1339
atggaattggctgaaggtatactcattaacgatatccaagtgcaacgtttggcgcttgaagttttgacgaactgtttgtgcggtccaaccaaccaggntgatgctgattgtgaattttgtcttatgtatgtttctttttgtttaggccaatggctgtttgggtcttcattatcgttttacatccaatttcgaacgtgatcttcttcccagcgaactctcaatgaaatttccatcatccaatttgcccacttgcgatggtgcgcatcttccagcttcttcgcttccgaacttacaacaaaatttgcgattatttgtcacccctatacagttgcttaaaattatttggaaatgttcacagcaaaataatgcaattatggtaagatgtgagaattttgatttttataatattttttaggttctcactaccttgttgcataagcaacaacccgcaactgaagcagactcgatccgggaattggcctgccgcgcgctgaacggaatcgctcggtttgagccgatccgccaaattttgagcaaattgccaataattgcaaataatgaactgataagtgagtttctcattttgtatgattattcactttaatttctagcattaatccaatctcctattctgcttgagaaacgtattgaacatagtcgtttttgtgagcaagcgcgtcagttaattgagtgtgtcagtcagaccaaattacaggactttgccattggaatgactcaggttttttttgttaacattgcatagaagacacttatttattaaggagcatctttggcgggctgccgttgtcgcgaagacacacatcaaattcaatgaaaaggaactgttgcaactgatttaccagcatttgagtgacattggctttaaacggactgccaaacagctgcaaatggagggggaacttccgaatgttcccgcaagtcgaattccttcaacgcccgcttctctgcccggatttgtgaattgcatttgcttgtcaaatgtttcagaaattcatttgattaagcctcgtcaaaatgaagctgcgttcgccaatgttcttgcgcgacggatttcaaaggcagacgccccaatttcacacccccagccgtttactcctcggccacagtccgtttcctcctcaaagcaaatcacttctggcagcagacttcctctgaaactgctctcatcggctcataacactttgtcaacgggctcctctaatttctctgttgcgtccaatttgtctcagcaaacaccaatcgccaatgtgaacaatgcattttcgttgaaaatgcgacctcccaaatcactcagtgaaattgttattaattactttag

SEQ ID NO: 55552 - DNA, 49 bp, Heterodera glycines; identical to SEQ ID NO: 51181
  Genomic contig location: Contig_ID=SeqID_24804; Location=597..645; Strand=-
  SCN-specific regions: Sequence locations=1-49

SEQ ID NO: 55553 - DNA, 270 bp, Heterodera glycines
  Genomic contig location: Contig_ID=SeqID_24806; Location=633..902; Strand=-
  SCN-specific regions: Sequence locations=1-270
atggattcggttagagatgatgaaaaagctggggctgctgaagatggcggatccgataatgccgagtgcaggtgttgtaagtaatgatggcgttgcaattgtcgttggtccaaagtaactaccatcgggcattgtgtttctttgtcatgccaaaccactctgttatgtagttgttatttgttaataaatttaggcttaatctatgtgtacgctcatgcttttctattggcttttcacttgtgtcatcactgcctaatccattacaattag

SEQ ID NO: 55554 - DNA, 1303 bp, Heterodera glycines
  Genomic contig location: Contig_ID=SeqID_24807; Location=1..1303; Strand=+
  SCN-specific regions: Sequence locations=1-217,239-258,307-408,459 -861,883-886,908-915,937-1146,1168-1218,1240-1303
  Gene Ontology: Mol. function=calcium ion binding; Cellular component =endoplasmic reticulum; Biological process=protein folding
tttttctcatcccatgggatatgatttacatttttgacccagtactcgttcacgctcggcatgcaccaggtcatcgaaggcatggacaggtggtgccaattgaaaattgatgacttttccctgggaggctaataaaatgcatattttgggataattaatcgttaacattgatccgaaggtgccattgttttgacccggaaatgccattgttttgatcaaactagacattataaattaatacgaatttcaatattttggaaaaatattttgaaataaaaatttaaatattacatttattttaaatttcgtatttacagagcaatgaccggcatgtgcattggagaaaaacgccgtgtgaccattcctggaaagttgggcttcggcgacggtgggcgaaagaggtaaaacaaattttaaaaaattaattaaaaattaaatttgaaaatatttttttttttcaaaaagggatggcatcaagtcggaccaggtgctgcattacattgtacaacttgtcgacctgtttcgtccgacgcccggcccacgatggcgcgaggaggacggcctcgaaattgaggtggttgggttggcacatttgaaggagcctcggaatggcaaaaacttttgagatttcaaatctttattttatcagtgttggaaaaattggaaatcaaccattgggtcgaaattttctcaacaatgaaaaggaaaagtcaaataacttagaggtcagctctaaaaactaagtaacatccaatacggattttaattaggattggtggaaaattccataaatttagtcctaaaaaacaatagtttttctaacaataagacaagaagtttgggtccaaaaaattttcggaatgactttcaaagaaaaacaaacccctatgtttttgtgtttattttccaaaaaaacaaacaaacaaataaccaaatttctaaaggccctaaacaaattgtgataaagccacacattcaatagtctctgttaaattaaataaagctgctggcgaaatcaaatgtccgtaaagttataattaccgagcgaaaattcaaaaaccgtaaccacatacataattacagtagctctccctagtttgctttaattatgcgcttgacagccgcgtagacgtaatcaatcaattcattaataaaataatataatttcatccgtcgacaggtgacccacaaaattgaggaaagcgcttgccgtcgttcggcacccggcgacaccattcaccagcactacacactgaacttggcggacggcacattcatcgactcgtccttctcacgcagcaaa

SEQ ID NO: 55555 - DNA, 1408 bp, Heterodera glycines
  Genomic contig location: Contig_ID=SeqID_24808; Location=22..1429; Strand=-
  SCN-specific regions: Sequence locations=1-488,510-963,985-1408
atgacatttgggtacgaccctaatgttccggcagaagttatacttttgccagtacatttccctggacattggactctcattatccatgatgtgcaatttggcactcattttgccgattctttgcctaccacatatggcaggttggatccgcaactgacggataaaattaaaaatatcatttcggatattttgccgtcagcagtgttgacagggattgttgatgtcgaaaatctgacggtccaacacgatggtaatagttgtgggtacttcgtgtgcctgtatgctgagtcatggcttatgaacaatcgcacatttgttctgcctgatttatccatcaattatgaaaaaaagcgcattttatggcacattaacgagctgtatggctctgataatgtgccatatcatccaagggaaggggtgccaactccttgcccaattgtctatcggcatacggatgaagcgcagtcgacatccaaggccgctgagctaatggaagttgatgaatatgatgatataatgatcatcgaaccacatacaagtggacaggcagttgatgccattctcacccaggcccaagtggccggtgaaaaccaagctgacacgcttggtttggtgtcggagtcttgcatcccgcaagagccaattgcgcaggctgatgatgtaattttcatcagacctaagacgccaccaaggcgatcaatgcgcgttcaaaaaaggctttcagcttctgttagccgttcgccttcaccggcgccgaaacgccccccgccagcaaattcgctgggagtggcaacgccgatcacacggcgttgctctgcatttcacaaggggtggcaatgcgctgcagcagcagccaaacatttcccggaatattgtgactccgggaaactcggtgacaaaaaatgcgccgattgcggtgcacatctcttctcacatgaagacagtagcatttgctgccggaagggaagagttgtgctgccaatgcttaacccgcatcctgatgagctcaaacagctgattgtggggaataagcaatcccgtgaagggaaagaatttgtgcgacacatgtcgcgttataacaacctgttccaatttgcgagcgtttccgctggcaacaaaccaagccctgctggcggtccgatggccgttattcttaacggagaattccatcgccgcataagcagcatgcaggctggtacaactcagattcctggctttggccagttgtacattctggacccagtcgaggctatggaacagcgtcgaaacaaccccaggtttactggggagaaaatcacaaacgaagatgagtttgtgcagggtcaccagctaaatgagcagactcttgagatcttagaacaaatgatccaagtgcatcatcctgctgcgcaggcatataagcaggcgc

SEQ ID NO: 55556 - DNA, 849 bp, Heterodera glycines
  Genomic contig location: Contig_ID=SeqID_24809; Location=242..1090; Strand=+
  SCN-specific regions: Sequence locations=1-86,115-155,181-661,683-849
ggcgccgctgttgtcaaagtcagtaagcgtcaagcagttgatgagggccttaggaaatacagaaaacgcgtaaaagaacagcaagcaaaagagaaaaagcagaaggagaagaagccaccgccaaattccaccgtatgccgttaccgtactttctcattttaataataaaaaaaaatttaactttaatgaagaatgatgctgccggtggtaattcaacgggaaacaaccaccatgggtcccgtccagctccagcaggtggcccagacgacccatctccagacgaaccgggtaggacggacttgcatttggttaaggaacagattggccgcaattttgctgtcaaaaaacattcgacatgcatgactgaagttattgcgttcagctattttatggccaatttcctttattgaaaaagccaaatttcatggctatacctacaactgactacatttacaaaggcagttcatagaatggagggatttcttaaaattctaaattaagcaatgttatatcaggcctatctagataatatcttttggactaattgccagcatacgacattaaaaattttcaatgtggacataaggattaaaaataggtacaaaaaattgtaaaattccaagcttcggctcaaaaatatgtgtatttttctgctttcttatgattctgtccaggaaaagaggccaaagctcggaggattataaaaaagtcgtgtgctgggtgccgccgtcgttttttattgacttaattggttccgaattcagtatcaaatgcttctgatggtgctgctccagctggagatgatgtttcgatccctcgtgaagagataaatgaaatgaaacatgcggg

SEQ ID NO: 55557 - DNA, 451 bp, Heterodera glycines
  Genomic contig location: Contig_ID=SeqID_4733; Location=1160..1610; Strand=-
  SCN-specific regions: Sequence locations=1-215,237-420,445-451
atgcagtttttacccaacagcggcaaaggtgaatagcaaaaaaagtcttcaatttaagtgcaaaaaaaaggtcttcggttcggtccccccccccccgaaaatgagagagtgacatcacaaaatggtacggctaaaggaaaatcaaaaaatgaattaattagcaaaatgtatgccccaaaacttttgacgcgctcagtaaattcaaattttcttaatttttaagtcaaatttcttgtggaaaaagctggcgccgacttggaaattcgcgacgcctcggggaggacggcgttaatgggcgccgcctttgaaggacaagcggacattgtgcaatatttggtgtcgaaaaaagcacgcaccgattggaaggatgaaaatggtagtggtcgaataattcgttgatcgcaagaggagaggggcagaaaattttaaaattttggccaattctaataaa

SEQ ID NO: 55558 - DNA, 322 bp, Heterodera glycines
  Genomic contig location: Contig_ID=SeqID_4733; Location=26..347; Strand=+
  SCN-specific regions: Sequence locations=1-25,80-138,160-322
tttttgggccccggggtcgtttgggccccaacccaaaaatacaaaaatgtgctgtttttaaaaattaagattctaaaaactaagcctgagggatccctcgccacttggcataagttaggtttaattaacattcgctcattttttacaattttacttattccaaatcctattattttttaatagttaaccaatttgatttacattctgatttggacatttttcagaaatggctaacccaattgcaaccaaaaaacaaaaagtaaaattgtcttacgaaagccacctttacaccttcgctaaaatgagatctgatgggatgaca

SEQ ID NO: 55559 - DNA, 166 bp, Heterodera glycines
  Genomic contig location: Contig_ID=SeqID_4734; Location=272..437; Strand=-
  SCN-specific regions: Sequence locations=1-120
actagagtagagcgggaccgggaattttgggcaaaaccgggaccgggacttgccgggacctgagaagccgggaccgggacctcggtttttgtccgggaccgggaaccgggaccaaccgggaaattttaaaaattcaaaaaaattttaaaaatttaaaaaaaaattc

SEQ ID NO: 55560 - DNA, 2041 bp, Heterodera glycines
  Genomic contig location: Contig_ID=SeqID_4735; Location=250..2290; Strand=-
  SCN-specific regions: Sequence locations=1-1825,1847-2041
atggcaaaaccaaacgattgtggtcccgcggcattccatttcggcaagcaaagccgcctgcaactccacgtgttttgcgacgcgtcggaacacacattcgccgccgccgtctacattcgaagcgagactgccgatggctctgaagcgaacctaatcttcgccaaaaaccgcctccggccacgaaccgcgaaccagcgcttcaccatccctcgactcgaactcctcgccattctcgtcggaattcgcgccatgcgcttcgccgagaaagagctcctacgtccgatcgacgagcggcacttatggtccgactcccaaattgccctctcatgggtgaagtccgacgaacccaaagcccagttcgaacaacgaaggctcgtcgagatccgacaagggccgcccaccattttccatttcgtcagaaccgaccaaaatcccgccgacgtagccacgagaggctgcacacctgcggagctccgaactcgccacatttggtggaaaaggcctgagtggctcacgagtccggaaacggaatggcccgacgagttaacgttcgcaacgccagccgactccccttccgccgatcccccgtttgaagaatcggagaccaagaccctcatggccaaacaaagtccgctgccccctcccctcattgatccggctcgtttcagcactatgctgacccttctcggaacgaccattctcgtcctccaattcatcgggcgtcgtcgaccaaaatggctcagaagcggcacctcgtcaatcccacggagtggccctccgacgggcgattcgttcagagcagccaggactttcctcatccgacaagaccaacgaagctcgcccgacggctacgacaaacaccccactgttttcaatgaggatggccttttgtgcctcaaaacccggctcctgcacgcgaatggtccgcccactctcgcctctcccgtccttctcgaccgccattcatctctgactcggctaattgtccaagaaatccacgccgacctcagacacgccggcgttgactggactctgactgagttccttagccgttattggatgcctcaagcacgacgaaccattcgtggtatcctccgaggctgcccgtcctgccggcgaatcacggcacccccttttgcgaggccaacaatgcccccctttgccctctatgcgcgtcaaaccggctaatccctttgaattcgtcggtctcgactttgctgggcccacctcctctcgactaagcgacggatcgctcaccaagacctacttggtcatcgtcacctgttttgtcacccgggcagtatatctagaggcaaccaccgatctgtcagccccgagcttcatcaatgtcttacgacgattcatcagtcgtcgcggccgaccaaagcgaattctgagtgacaacgccccgacattcgttcaaacgagcaaggctctcgacattctgaccggccctccgtccgaaaccgacgccgtcacctttgccgcgcgccgaggcattcagtgggacttcattcccgcctatagtccatggatgggggcttgctacgagcgactaatcggcctcgtcaaatcctgcatcaaaaggacgatcggtcgacgaattctcgactacgacgatttgagcgcattccttgccgaaattgaggccagcgtcaacagccgcccgatcacatgggtgtcagatcaaccggactcatcgaagcccctcactccgaaagaccttatccagcccggcctccccaacgacttggaaatcgtcgactctgatctcgactacgacgattgcctctccggtcccgcgcgtctcgcagcactttggaaagcttaccgggaggccgccgaccatttctggctcaaatggagtcatgagtacctcctcgccatcagagagcgcgccggatggactcataaaggtccccgccttcgaactcccaccgccccccacatcggccaagtggtcatcgtcgaagaggacctccgcccccggaatttatggccgatgggcatcgtcgttgcactaaacggctcactccctaac

SEQ ID NO: 55561 - DNA, 515 bp, Heterodera glycines
  Genomic contig location: Contig_ID=SeqID_4735; Location=1254..1768; Strand=+
  SCN-specific regions: Sequence locations=1-515
gtcagagtccagtcaacgccggcgtgtctgaggtcggcgtggatttcttggacaattagccgagtcagagatgaatggcggtcgagaaggacgggagaggcgagagtgggcggaccattcgcgtgcaggagccgggttttgaggcacaaaaggccatcctcattgaaaacagtggggtgtttgtcgtagccgtcgggcgagcttcgttggtcttgtcggatgaggaaagtcctggctgctctgaacgaatcgcccgtcggagggccactccgtgggattgacgaggtgccgcttctgagccattttggtcgacgacgcccgatgaattggaggacgagaatggtcgttccgagaagggtcagcatagtgctgaaacgagccggatcaatgaggggagggggcagcggactttgtttggccatgagggtcttggtctccgattcttcaaacgggggatcggcggaaggggagtcggctggcgttgcgaacgttaactcgtcgggccattccgtttc

SEQ ID NO: 55562 - DNA, 894 bp, Heterodera glycines
  Genomic contig location: Contig_ID=SeqID_24810; Location=624..1517; Strand=-
  SCN-specific regions: Sequence locations=1-180,268-324,346-348,422 -425,517-521,546-586,609-621,643-838,861-894
acaatatcactgcccgttgggacggattgccaatgccaaaacagcccacacttttggaaggggacgatgttggcacactgttgaccagccaactgaatgaggaggacgaggccaagacgggcttgaattgcccacaaaaagtgctcaaggtgttcgttcagcaatggcatttgtaatgccaaaattataaaaaatttaatacaatttattaaaaataaattaatttttaaataaaatactttttttattttttacatatataattttgggttttcagcttatcaaaattatggtaccacatgttgtgcttgttgctgtactaattggttatttgtgtttaggtatatgaatttttatatttttaaattaaaaatatttcaatatttttataaaaaacaaaataaaaactaaaaataaatatgaattttttacgattatcattataattaccttttttcaatttaatttattttataaatttataattatctttattattattgttgtaatttttataagcataaataaaataatatttttctttcaggagctggaattttacaagcattggagacccgaactgagcttgtaattaatttgttatattatcaaaaaaccattttgtatatttttgttttaaatgctttttttcacagatggcacgctctcgaaaactgataaggcttgatcagctcattgagaacttcactgagtccagctggcatatgttggttgaccgatttggcgccgatgcccaaatgcatcgggaacaatgggccgacatatttaggcaaaaataattaaatcaaattaaaatgatgattaatcccccataaaatttatttaaaaattcagagattatatgatcagcgttgcggcagaagttgatgacag

SEQ ID NO: 55563 - DNA, 109 bp, Heterodera glycines
  Genomic contig location: Contig_ID=SeqID_24812; Location=255..363; Strand=-
  SCN-specific regions: Sequence locations=1-109
atggaagaatcgcccgaattgttaaacaaatcagtcggaggattagctgaatttgacttctctttgtgcgaacgtaatcatgcactgaagcgacaaatggacggcgaag

SEQ ID NO: 55564 - DNA, 829 bp, Heterodera glycines
  Genomic contig location: Contig_ID=SeqID_24815; Location=19..847; Strand=-
  SCN-specific regions: Sequence locations=1-334,356-829
atgacactttacgcgtcccatgacattttacgcgtcccatcacattttacgcgtcccaacaacactttacgcgtcccatcacactttacgcgtcccatcacactttacgcgtcccatcatattttacgcgtcaaaaaatgtttttcgaaccgtcaatcggaaactttataccttccgaatagtctaattgttcttgcttgtatactttgatcatcgaaatgtgcaaaagcaactctaagcacacttaatgatgtcaacagaaattcaactaatataagaaaaaaatttacaaaagcctaagcttaggcctagtctaacaataagccattgttcgagttgcctgtgtataagttgtcatgataaccttaggcttaacaacgaaatttatagttaaaaactttactgaatacctgacaaaaaaaatagtttttctcttagttattaggacaactataataccatgagaccagggatggcacggaattccgaaaatttttggggcctcggaatgccatccctgccatggacacaaaatgtcatgggacgcgtaaagtgttgttgggactcgtaaaatgtgatgggacgcgtaaagtgttgttgggactcgtaaaatgtgatgggacgcgtaaaatgttatgggacgcgtaaaatgtcatgggacgcgtaaaatgccatgggacgcgtaaaaccgattagaaccattgcttttaccaaatacgaaacgaaactgaaaaaatgtcattttttgcgttgattttttccaaaaaaatttcacggggattccaatgttgtgcaattgtatagaattgtggtcccgacgaaaaataaa

SEQ ID NO: 55565 - DNA, 345 bp, Heterodera glycines
  Genomic contig location: Contig_ID=SeqID_24815; Location=1038..1382; Strand=+
  SCN-specific regions: Sequence locations=1-345
attatgagccacccaatttggcaaatcggtctttttaaacgcattaaagaagattcagtcgattgcttggagtgtaagcaaaaaaacgttatttatttttcatcttcatcattttttggtttaaaaatatattgaatacttttttatactttgaaagacttttattaatacagaatttttttaaatttcctaaaatccgcaatcctgcgcaggatcctgcagattttaaatgcaggatttgcaggattaatcctgccggatcctgtcctgtaaaaaattttgaattccaatcctgcaacaggatccgcaaatttgaaatttccggtctctatattcactatgggt

SEQ ID NO: 55566 - DNA, 228 bp, Heterodera glycines
  Genomic contig location: Contig_ID=SeqID_24817; Location=1059..1286; Strand=+
  SCN-specific regions: Sequence locations=1-228
ctttttaaaatgactggcttgtccgaaaatgtggccttttcccgcttcgtctctgagtttggtggccgctgcaaagaactcaaaatcgctaatgaattcgccagggatccgagccgtgccaacaaatacacgcgaacgctcaaagacggaaagggcagctggcaattgtgcgtggacttctccaaaaacctcatcgacgacgacatttttcaccaactcatctcagtg

SEQ ID NO: 55567 - DNA, 438 bp, Heterodera glycines
  Genomic contig location: Contig_ID=SeqID_24818; Location=1064..1501; Strand=+
  SCN-specific regions: Sequence locations=1-438
atgattcacgtgttaattcacggtcatgatttacgtgttaatttacggtcatgtaagtttaacttacagtcattattcacgtgtcaatttaggggttaattcacgtgaaaattcacagtcatgatttacgtgttaattcccgggcatgatttacgtgttaatacacggtcatgattcacgtgttaattcacggtcatgtgcgtttaacttacagtcattattcagtgtcaatttaggggttaattcacgtgacaattcacagtcatgatttacgtgttaattcaaaatcatgatttatgtgttaatttacggtaatgattcacatgttaattcccgggcatgtacgtttaatttacagtcattattcacgtgtcaatttacggcttaaagcacgtgtcaattcacggtcatgatttacttgtaaattcacgatcatga

SEQ ID NO: 55568 - DNA, 1024 bp, Heterodera glycines
  Genomic contig location: Contig_ID=SeqID_24819; Location=197..1220; Strand=-
  SCN-specific regions: Sequence locations=1-389,411-1024
atgcagtacaatgcttttaagccccgccgtgaggcgggacagttccaaaattttgtaccacattttactgtggaaagtccaagtaccttattggacaactacgtgtcaatgagcacagtcgcctttggccagttgtggaacggaaaaatgggaatatcagatggggtgcgctcttttctaaaaattcctcttttcgtctaaccatccctcccttttgtgcactatttcgtttcaaaattgaatcattttttttggctttttgaaataaattgtgaaaaatatacgaaaattattttcggttttaattatgctgtacaatgcttttaagccccgccgtgcggcggctccccttttgtgcactattttagtttttaaaattggttccggactttttggctttttgaaataaattgtgaaaaatatacgaaaattattttagcttttaattatgcagtacaatgcttttaagccccgccgtgaggcgggacagttccaaaattttgtaccacattttactgtggaaagtccaagtaccttattggacaactacgtgtcaatgagcacagtcgcctttggccagttgtggaacggaaaaatgggaatatcagatggggtgcgctcttttctaaaaattcctcttttcgtctaaccatccctcccttttgtgcactatttcgtttcaaaattgaatcattttttttggctttttgaaataaattgtgaaaaatatacgaaaattattttagcttttaattatgcagtacaatgcttttaagccccgccgtgaggcgggacagttccaaaattttgtaccacattttactgtggaaagtccaagtaccttattggacaactacgtgtcaatgagcacagtcgcctttggccagttgtggaacggaaaaatgggaatatcagatggggtgcgctcttttctaaaaattcctcttttcgtctaaccatccctcccttttgtgcactatttcgtttcaaaattgaatcattttttttggctttttgaaataaa

SEQ ID NO: 55569 - DNA, 391 bp, Heterodera glycines
  Genomic contig location: Contig_ID=SeqID_24819; Location=892..1282; Strand=+
  SCN-specific regions: Sequence locations=1-391
gcttaaaagcattgtacagcataattaaaaccgaaaataattttcgtatatttttcacaatttatttcaaaaagccaaaaaaaatgattcaattttgaaacgaaatagtgcacaaaagggagggatggttagacgaaaagaggaatttttagaaaagagcgcaccccatctgatattcccatttttccgttccacaactggccaaaggcgactgtgctcattgacacgtagttgtccaataaggtacttggactttccacagtaaaatgtggtacaaaattttggaactgtcccgcctcacggcggggcttaaaagcattgtactgcataattaaaagctaaaataattttcgtatatttttcacaatttatttcaaaaagccaaaaaaaa

SEQ ID NO: 55570 - DNA, 965 bp, Heterodera glycines
  Genomic contig location: Contig_ID=SeqID_4737; Location=114..1078; Strand=+
  SCN-specific regions: Sequence locations=1-79,103-833,855-965
atgaaatttgagaataacgctacggcagtttttccaaattcgggcaccgcaagtgaagcgaaaaatgagcgtgcgtcggaattttcccaaaaaggaaaattttctgaaaccaaaaggagccattggacagattctgatcaaaagtcgatgactaaggaaaagtggaagaaagttgaaagggcaccaaggaacatcgcgcccaaagtggacttccgaattaaaagaaattgtgatgagaaaaatcacaactttggcccaaaagaacaagtgggaaagaattttgaagtaaaaaaaggcagtggtgaaaattcgggaaaaagtggaaggattttttcgtgcaaaaattctgaagttcaattagggacaattgaaattttggaaggtcggaaggagtttgagagaaaaagattgaagttgggcagaaactctcaacgagaaaagattggacgaaatgtctcacttgatggaaatggcccacgaacgaattatggcacaaatttgaattcgtttcgacaaaactgtgttttctggccaaggagagcgaatgcagaccagatgagccgtgaaactttgccatttgatcggggttgggtcgagttgaccgcctcgtgtccggattcaacttcgacttatgctgatcgacaaccaatgatgtgcggacttcggtgcaatggcagtgagctgatcccaaacggacctcacctttcgacagccggatgcgggatgtgcagctgatcggcagggacgcctctcgtcagcggccggggatgtgttattatttaaattagtgcgtaattgcttggcgttttgaccatttattgatgtttgttttattcattctcattttcatgcaattattctccccccttaaagtttttgtcatgttttgctgttctccgtcattttggatttgattgattgttttgttccccctcgtcttctgaatttgtttgtgtttgatttta

SEQ ID NO: 55571 - DNA, 3340 bp, Heterodera glycines
  Genomic contig location: Contig_ID=SeqID_4738; Location=23..3362; Strand=+
  SCN-specific regions: Sequence locations=1-356,378-754,779-891,915 -2834,2864-3194,3216-3275,3297-3340
atggcgaatttgagaacgccaccgctaacgcggcaacgcgcccttaactttggaattgcattggacaataccggaaaccaaatttcggcacaatttaacccgaatttaggacaaaaccgttcttttagccctgaattgggtcatgtagaaatggttggtaatgatggcgtttcagaatacggcgaagactttgacgacgagcagaatttgagaagcagacttttggcaatgacaatgaacatcagcaatccagcggtgaatgtaccggacgagaatgcacaaaaccagcgaatggccatgaatgcaccgcttgtgaattcgggtattttacgtgtcaacaacagaaatgtgggagtaaatggcttgggagaaacaagagaaagatttttgtcaaacaatttcgaattgggtgtaagcaatttgaacaatgcgggattagttcctacatatccccctgaccatgaatcaacgccagtgagtgccttgcgtggcgaaattcgagcttttggtaatttggttgaaaatcgccgacatgaaaatgaacttttggcggcgcgaaatgacgcacaatacactcagccgcgagtggacggagttcatccagtttttgtacgtcaaatggctgtccactcccaactgacagctttgcgcctttcggctaaccaccaagctcatgttgcaacgagttcaatcgaaccccttgctcgaaacgcgcaagtagacaacattggttgcaataacaatccgcagcgacaaatggaaaatttgcaacaaaatttacaccggcaaatggttcgtaatggtgaaaattttgaacccggaaatcacaactacggttgtgaggagcgaaacccaaacgcagaacagaatataaacccgcgcccaaatagccaacattttcatgttgcaaatcaaaatcatccgtatgttaacgacataccggacacccaaaggaatgaaatgcatgatatgattttagcgcaggcaataaaaagcctgaacaatttttcatactcaatggcattgaattcgttgcctgagctgaaagggagctccggagcagatggcgtccgatcattttttcgacattttgatgtcgcaaccgatgaatggcctgaagcgaagcgcttaagcgcactccgatcgaaatgtttggggcgtgccgaacgcgccttcaatgttgcggttgcaaacaacccgttcagctatgacagcgtaaagagggcgatgataaatctgcttgaagagacagatgccagacaaatgtcggcatttgaagagcttatgtccggtgtctatcgccgaaacaatgagagaattaacgatttggcagatcgagtttcttcgctagttagaaaagcctaccctgggcttctcgagcatctttatgatgattattcaatccgacacttcataagggcgctccaaaatcctgagttagcattgactcttgagttagcccgtcgtccttcaatgatttttgatgaatttgttgcattagcggcgagagccgaagcaacccaaaaggcatcaaagctcgcaatgcaaaggcccaactattttgctagatttaacagcaatttccaaacgcctcaatacaaccaacggccaatgcagcattttcgtcaagaaaattttccgcaaccctacaaccagcaacaaaaccggcctaattgttataattgtggaaaattcggacattttgccaggcaatgtactgaaccacaacgaaaccaaggcacgccgaataacaacagctcggcatcaaatttcgttggtcaaaattttcttgttgaacaacagaaaaaacctccacaacagaatcaaaatctttttgttggtggcatttcgatgagtcctgctgatgtggaaaaactgtttggaaaggatgggaccgaaaacgagacgaaaaatttgaataaggtttcgatcgggagaataatggccttaaaggtatcggtttgtggtttgacggcaaaagctatgttggacggaggtgcccaaatttcgatgttttcttccaaattctttgcaaaattattagctgagaaaagaatcggtaccgaacagcttcgcccatctcgtcacaacactcgcgtgatcgacataaatggaaatgcagttgagtgtattggaattgtgtctctcccaattgtcaggaaaggcaaatgtgtgtggattcgtttccacgtctcacacgcatcttttggctatgaatttgtttttgagacaaatgcattagctcgactaagttttaaacttttcgacgaggcaaatgacgaattggtcagtttttcggaagttaataatgtggaacgcaattctgtgcacgtcatttatcatacgaccataccatctcgtaacaaaaatttggttcactcggcccagcaaatgaaatttaagagtaacgctacggcaatttttacaaattcgggcaccaaaagtgaagtggaaaacaaacggacgtcggaattttgtgccaccaaaagcggccatcggccaagttttcgtcaaaagtggaagaaggttgaatggacaccaaagaacatcccgcccaaagtggaaaaccgaattatcagaaattgtgatgagaaagggcacaaaaagttcagcccaaaggaacaactgggaaagaattttgaagtgagaaagggtggtggtgaaaattcggaaaaatgtggacgaatttttcttggcaaaaaatcggaagttcaattagggacaattgaaattttggaaggcggggaggagtgaaagagaaaaaggatgaatttggacagaaagaatcagcaagaaaaagtcagactaaatgtctccagtggcggatctcaatcgaattttggggaaaatggcaaaaatttgaattcgtttcgacgaaaatgtgttttctggccaatgagagcggaagcggaccagatgagccgagaaactttgccatttgatcggggttgggtcaagctgaccgcctcgtgtccgggttcgacttcgccttctgctgatggacaacacatgatgcgcggacttcaacgcaatggcagtgagctgatcccaaacggacctcacctttcgacagccggatgcgggatgtgcagctgatcggcagggacgccactcgtcagcggccggggatgtgatattatttaaattagtgcgtaattgtttggcattttgaccttttattgatgtttgttttattcattctcattttcatgcaattattctccccccttaaaagttttgtcatgttttgctgtgctccgtcaattttggatttgattgattgtctgttttcccacctcgtcctccgacttggtttgatttgttgtgtgtttggatttta

SEQ ID NO: 55572 - DNA, 662 bp, Heterodera glycines
  Genomic contig location: Contig_ID=SeqID_24820; Location=1192..1853; Strand=-
  SCN-specific regions: Sequence locations=1-537,559-662
aaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacatttatggggagcaaaaatccaacgcagaattaaagtacagactatagggaagctattcccgaaggattcggtctccccataaatctgggcgcatcggttcagggggactgccccgaaaac

SEQ ID NO: 55573 - DNA, 911 bp, Heterodera glycines
  Genomic contig location: Contig_ID=SeqID_24823; Location=360..1270; Strand=-
  SCN-specific regions: Sequence locations=1-324,346-737,759-911
ggcaggacaagaaaagaatgaagttgatgcctcatgaaactcggaattggttatgttttgtcgaaaatatccttacataatactcataaaaaaatacaaataattcaacccacctattctatgaccacattctgaaaaaaatcccagaaatacgaggaaagatatgcttggtcacaataaaataaaaaatggctagtatgtaaaaatttgcggtcacaaataaaaaaaaatggctaatatgtaaaattggcgtccagaaatttttagactaatccgacgcaaagcacgaatgaattaaagaggcgaaagaattcacagtatcgtttctaatagggaaatattgacaggatattcggctaaaaacgggtttgatcatttttagcgcatttttaggtatacatttgagacaattgggcaggacaagaaaagaatgaagttgatgcctcatgaaactcggaattggttatgttttgtcgaaaatatccttacataatactcataaaaaaatacaaataattcaacccacctattctatgaccacattctgaaaaaaatcccagaaatacgaggaaagatatgcttggtcacaataaaataaaaaatggctagtatgtaaaaatttgcggtcacaaataaaaaaaaatggctaatatgtaaaattggcgtccagaaatttttagactaatccgacgcaaagcacgaatgaattaaagaggcgaaagaattcacagtatcgtttctaatagggaaatattgacaggatattcggctaaaaacgggtttgatcatttttagcgcatttttaggtatacatttgagacaattgggcaggacaagaaaagaatgaagttgatgcctcatgaaactcggaattggttatgttttgtcgaaaatatccttacataatactc

SEQ ID NO: 55574 - DNA, 445 bp, Heterodera glycines
  Genomic contig location: Contig_ID=SeqID_24824; Location=1534..1978; Strand=-
  SCN-specific regions: Sequence locations=1-260,282-387,420-445
atgcccatcaactttgttctgaacgactttttgtctgtacgttgtttcgtccattttttgcctattttctcctaaattcagcgcttactgaatactcaacaggacaaaatgccattatttctgaatttgcgaacaaaaaagaactcattcaagtggaaatctaatggttgagttgtcatttcaattctttttaggccattttgtgcagctgttttataccaattttttgtggttatacggtgcccgaatttcgcggcgtcagatacatcgacggcggcttctccgacaatcaaccggtgtacgaccagaacaccatcactatttccccattctcgggaggtcagaacgggtcgcttttcctgagcagttcgtttacccttttcccggaatttttttttttaaatttttctttttttttacaaatagggagtttttccagaataaa

SEQ ID NO: 55575 - DNA, 823 bp, Heterodera glycines
  Genomic contig location: Contig_ID=SeqID_24826; Location=674..1496; Strand=-
  SCN-specific regions: Sequence locations=1-509,531-662,689-771,815-823
aaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatctggtgcgtttcagaaccctttctgaaaaaatatttaagaattaattttgcaaaaaaaaaaataaaaacgaaagact

SEQ ID NO: 55576 - DNA, 93 bp, Heterodera glycines
  Genomic contig location: Contig_ID=SeqID_24827; Location=56..148; Strand=+
  SCN-specific regions: Sequence locations=1-31,54-93
atgggagcaaacatccaacgcagaattaaagtacaggctatagggaagctaattcccgaaggattcggtctccccataaatctgggcgcatcg

SEQ ID NO: 55577 - DNA, 369 bp, Heterodera glycines
  Genomic contig location: Contig_ID=SeqID_24828; Location=2139..2507; Strand=+
  SCN-specific regions: Sequence locations=1-282,315-369
atggccagatttttaattcaaaatccccaacatcaacaggtgtgtggtgcgcaacagttggtcagtttggtggtcggtggcactgtgtgcgagtcgcatcgccttcgtgttgggcgctgctcccgtgttgtagtcgatttcagcgacaacagcagtggcggctcattttgtgccgccaacgcgggcggccgtgccaaaatgaagaaaatgtttgtcaccggcggcgacggcacggagcagcagcaggacgacaccatcaccgatgaacaacagcagcaggaagacgaggatgacgacgatgatgatgaagacgaattccgcatactatctgcacaccgtaagcaaagaaaggaaaaactactcatttag

SEQ ID NO: 55578 - DNA, 491 bp, Heterodera glycines
  Genomic contig location: Contig_ID=SeqID_4739; Location=566..1056; Strand=+
  SCN-specific regions: Sequence locations=1-90,112-138,160-491
atgaagaaaggggttcaaaatagcatttatgcgttaaaattttttgatttggtgaaggtttttagtccatacatataaatccatattttcgggaataaatccatatttcgccatttttgccattttagtccaaatttcggccatttttggcaaattttcacaagaaaaatgcaaaaaaagcgaaaaacattggtgccttttttaggattttcggaaaaattcttaacaaaaatgcattaaaaacgaaaaatacacccctaagaatcgacccgaaaattttcagaaaatactagagcccggagcaggaccggatcctgtgcaggattttgcaggatcccagtccgcaatcctgcattttttggaaaatgcagaatttgcaggattaatccggccggatccggtcctgcaaaaatttttgaattccaatcctgcaacgatccgcaaatttgaaatttccgggctctaaaaaatacacccctaatttgtaagta

SEQ ID NO: 55579 - DNA, 2307 bp, Heterodera glycines
  Genomic contig location: Contig_ID=SeqID_4740; Location=1447..3753; Strand=+
  SCN-specific regions: Sequence locations=1-563,597-823,845-960,988 -1144,1166-1358,1469-2307
aaacgggtggaacagatcgaaatcatcgagagaacggtggaggaaagtcggaggtaatcttaggaaagtgcccaagatgatcatgcctttggcttcgtttttcgattatttattttaattttggcatttttctccctttttttgtccttttcccttttaatttttgcctttcccttttcaggcccctcacttcccaaggtcttttcgtctgtttaattcgtaattcgaatttcttacttctcttcagagttagtcaatttccagccccaaagttcggtgcgtacttccagcgaacggattcttttcccggacccggaaaagaggtttcagctgaccagcgaaagggacgccgggagggactcgtcgctgctgtacagcccctcaggcaatcgttttggaatttaaaattgcaattttcttttatttaaggccaaaactcattcattgtgcgtgaggcgccgttgcaacagtcgacgcctgaacggaatcaacagacgcacaaaaatggactcacaatcagtcggcacgggtacgacgctgacgaagtgttgactttaggtaggttaaatttaaatttaaatttacaatttaaaattcagaaacgagcgaaagagtgacggaaacgcatggacaaaagggacatccgacgaaggacagaagcgtgggggagacgagcggtgccatcgtacggcgaacgccgccccggcgggaggataccgcgacgaagtccattcttaagacagtgccgccgatggcatcccccgaggggaccgtaggggaaaattcgtggaggaaaagccccgcgtcggtggaagggtaagccgaggggagggagagaaaaggaacggattacaacaacagatcagtgcagcggaaggacagctatcggagaatgcaggtaaagcaggaggaagagagtgatgttcagcagccaacatcattttacggagtgagtgaacggacgaaaaaagggggaagggaaggagacggacggacggaggaggcgaattggcattttaatgggggacaaagttggcatttcatataaaaggggatggagttggctaaagaattagattttattttttgactattttttctaatgacttttcctccgatttcttcccaaaaaccatgatttccatttgtctcttttcagcagtctcccaatgcgacgattctgtcaaagagttcaaaacaactttggcctgaaatgtttagcgcggagaatcgcggaaagaattcattagcacggataaaagggtcaattgccgaaatgagccgacaaatgaggtggagagtcagttgagttagcaaaaaaactaatccgttttcccccgcagcgacggcgaatggaccccccgcctcgtctctctgctgtgcctcgtcctgcttctgctgctgctcgtcctgctcctcctttggctgcttgtctcttcgcttctcctccatcgctccaccttcgccttttggctttaccctccgccgtgcgaagagtgccaacgacggaacggcggtggaacttcggacactcagcagccgagtcggcttttcgtccatttgaacagcccggcacaggcgcacttcgaactgatcggaaaccccccgttcaagtcgaactcattcactgccgttgatttcgacaccgtttggcaaacaattgcaatgatcaaacaaagcgttgttccgtttttgtaagggatttgtggccatcgcggaccacgcgttgacagatgagcaaggaacacacaccacgtgctttgtgatggagttggacagaagcgcgatgccggacatggatgtgttgcaagacgcactgagcaacacttacagcgaggtgagaaggagggagggggaattagaaatatttggtttggcggagatttggccgattggtgaacgatttgccaatgtttggggaggggaattagcaatatttgggggtggaattggccactttgtgaagatttgccagtgtttggggaggggaattagcaatatttgggggtggaattggccactttgtgaagatttgccagtgtttggttggccaatcccattaatccttgtgccacccttgctcattctctctttcccccgttctctttgccaggtccattctcagttcggctggcaagaatattggtgcgtttcgcaacttcggtgtgcttagctttttccattgaaggcaatacgtagcggaagaggtcgactcatcatttgttcttcagaaatttcgcgatcgaatcgacgactgtcaaaaggcgaccaaatggtaccgcctcaaacacaccgtttacacccgcg

SEQ ID NO: 55580 - DNA, 414 bp, Heterodera glycines
  Genomic contig location: Contig_ID=SeqID_4741; Location=402..815; Strand=+
  SCN-specific regions: Sequence locations=1-121,143-143,176-212,341-414
atgggcaaaatacgaagtgcaaacggacccatcgggcggacattggcactacccaaagcatacggcacaaaagacgcaaagggacgcggagggaaattgggtgaattggcaaaagggcgggggaggaggacaaaggcagcggcggaagaggaggagaagcggaggaggggacggattgagaaaacgattggaaattcaatgagaatggttgtgaaagggagagagagagagagcgagggagagacagacagagagagcgagggagagacagacagagagagcgagggagagacagacagagagagcgagggagagacagacagagagagcgagggagagacacaccgatcacttgccaccaaccgatactttcattatgcaaaaagtaaattatataaaatgccaatgccataa

SEQ ID NO: 55581 - DNA, 482 bp, Heterodera glycines
  Genomic contig location: Contig_ID=SeqID_4741; Location=1005..1486; Strand=-
  SCN-specific regions: Sequence locations=1-286,308-482
atgccaacaacgagcactgccacactgcttgacacatcggcaacaacgagcagtaacacggcgatggaaagcgactcggacgaagaacaattcccaccgccaccgccgattgatgggacaattggcacggcgaatgaggtgggaagggaattgagcatgagcgacggacttgccaattaccgtcttttgtcctccctaatgggattaccgtacttgtcacccttcattaattccctcttctctttactaatcacttttgtcatcagagtcacccattccgcgcaatgcttccgcctccttccctcccttccatcgttttcccacggaatttggcgccgccgcccccgccaaagcgatcggaagagacgcggcttcaaatggcggaacaaaacccttttgagatgagagaggcacaaagcgaactgatggcggaattgcaacagagacaaaggatgaggacgaaagaatcggcggaaaagtga

SEQ ID NO: 55582 - DNA, 366 bp, Heterodera glycines
  Genomic contig location: Contig_ID=SeqID_24830; Location=111..476; Strand=+
  SCN-specific regions: Sequence locations=1-170,192-366
ctgaccgacattttagcaagtgcaaaaagtgcgataaaattgtggtcccaagcagccaatgaagccgaattgcagttgattattgagcgtaagttaacggaagaaacattttccgcttacacttgattggctaagattttggtgctatggcgttacccaaaaaccatcacaaaaaattttttgatatgactttgctcaaagcaaccgaatttttaattgttgatttctttcgatagccccaagtgttttttaaatcctgaaaaatttcattatgtttcaaagagatcaaattcaaaaaaaaatatctggtttttgaatttctcaggtcatactttatttaaactatgatttttttgaataagtata

SEQ ID NO: 55583 - DNA, 912 bp, Heterodera glycines
  Genomic contig location: Contig_ID=SeqID_24831; Location=1182..2093; Strand=-
  SCN-specific regions: Sequence locations=1-20,42-230,252-258,295 -611,648-670,732-782,842-876
atggtcgctggggttcagcagcaaaaaattgcagccaaaaccagcaacaacacaaggccaaaaacagcagcagtcatgctaattatgaggatcaaagctcacttaagtgagtataaatgagaggaacagcagaggaggaggatggaagttacatgagataaaaaaggaaaaataaaataagtcagataataatattctgattaaactaattacacataaaccatgcaaagaaaatgatttttaatttaaaatcgaatttattaattggcaaataaaatagaattatttaaatgggttttagtggaacacgtccgtcatattgtgctgatgagtctccgttcgttgcaaattgcttcgcccgactcttttctcgatggcacaattcaacaaattcgaaatggccacccgctggaaatggcattgggtcccccaaaaatggcattggcacaaaaattgagccaaatcgaatgccatggaagtggcaaaagggatcaaaatcgcatttgtttaacgatggagcgaccaaaaactacaaaatattcgccgaaatcattgaccaaaccatcggcaaattgtgtcgcggtgttcggccaaacggcgttgacgttggcatttattttaaaaacaaatattatataattttaataccactttggttgggacaacttcttataaaaattcagaagaaatatgtatataaaaatattattttataaaatcttaaaaaaattggttgtgactgtggatgtagtccccccccccaagtggactacatcccagtcaaaatatttttactttttaaaaagatttataaaataatatttttatatacatattttttctgaatttttataagaagttgtcccaaccaaagtgttattaaaattatataatatttgtttttaaaataaa

SEQ ID NO: 55584 - DNA, 650 bp, Heterodera glycines
  Genomic contig location: Contig_ID=SeqID_24833; Location=184..833; Strand=+
  SCN-specific regions: Sequence locations=1-650
tcgattttttcaagtgtccgtttgggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaac

SEQ ID NO: 55585 - DNA, 527 bp, Heterodera glycines
  Genomic contig location: Contig_ID=SeqID_24836; Location=799..1325; Strand=-
  SCN-specific regions: Sequence locations=1-475,501-527
cagaagtaatcggtctcccattcattgatcattcgttcttcgtttcgtcaatggcattctcttccgtcttttgccgttctccgtcccttttgtcccttttgcccattttgcttctgatcattgcccagtttgttaatggcatggactttgatgaattcgaattgccttccgatcgattggacgcattccaaaaacggagggcgcgcgaacttttcggaaagcgaagcgcaccacctccggcagcaggtgggaaaacgcggcacaaaaaagaattggcagaattatgccatcggcattctttgccatttgcagtcgcaaattacgaacgacactcccgaagaacacgagaattgttcgggaagagagcagctgctgttgaaccgttcacggaagcggaggaaggtgaaaacagtggggaaagccaaaaagccattcactggcaaaggcaaagggtggcgaaatttgcatactattcttcctcccccatgcttttcctcatgcttttcctccttggtcagttccactga

SEQ ID NO: 55586 - DNA, 168 bp, Heterodera glycines
  Genomic contig location: Contig_ID=SeqID_24837; Location=1..168; Strand=+
  SCN-specific regions: Sequence locations=1-168
agaaataaaatggaaaagataaattttaaagcatgatgcaatttcattaaaaatgggataaccttaatttaattggaaatgttccccctcttcgtcgttctattcaaaaaatatttgtttgtttacattcaattcttattcatttctcacacaaaaatgtattaatca

SEQ ID NO: 55587 - DNA, 104 bp, Heterodera glycines
  Genomic contig location: Contig_ID=SeqID_24837; Location=218..321; Strand=+
  SCN-specific regions: Sequence locations=1-104
gtcggaataaaacatcattcccctgcttgtctactgtttgtcccaatttctattttgccaaaatttttgccgggccgaatttgcctctgtttggtcccgacaag

SEQ ID NO: 55588 - DNA, 761 bp, Heterodera glycines
  Genomic contig location: Contig_ID=SeqID_24839; Location=348..1108; Strand=+
  SCN-specific regions: Sequence locations=1-52,74-271,425-494,516 -581,605-609,631-732,754-761
atggaggcggtgcacaacgaaactccatctggaatgccgactcacaaactgaccatcaaagtgaacaaaattttatttgattattgtttaaccaataaatccaggtgggtagtgttgaaagcggccccggcgctttcacagtgccccttggggccttggttaaataataataatgaaacaaacaaaatttagagtgaatctccgaaagcgaatcaaattcagcaagtcattgcgcgaatgaggaaacataataaaagcaaaaattaaaagcaaaaaataaatacaatttcattatataagaaataaatagttattttttaaaaaatttaatgggattaaaaaaccatattaatattatatagaatcatagaattaaattatttaatgaatctatacatattacttcttaattatattaatttaaggttaaaactcactcaattcattaaattttaggacgagattcaccatgagaataaatcacaaaaagaattcattttctcaattaatgaatataaatcaacaaataattttaaacatttgaaaaataactcaaattagggactaaataattaggtaacaaatattttaaaattaatttaatggtcgacaaatgctgaaattaaaaaattaaacgtatacaaattatttatattatactatcagaaatacaataatttaactaaattgctcatatatttttatttctcatataaagctattaatattcaacaattaaacaaatttattaaactaaaaaa

SEQ ID NO: 55589 - DNA, 1890 bp, Heterodera glycines
  Genomic contig location: Contig_ID=SeqID_4744; Location=2323..4212; Strand=-
  SCN-specific regions: Sequence locations=1-59,81-244,282-763,785 -789,811-1644,1666-1720,1750-1796,1821-1890
atgtcttcagaaattctgtacgtttattatttccttttttttctaacgtttcgcatttaaatttcaaaaccaattttgaaagattagctttttttggatgctataacttcacatttgtatttactagctaactttgatcctttaattacttttcccttctcttcaattattaattcattcatttcccaaattcatttttcagttggtgtgccgtgtttcttcttctgttggtcggctgtgccaccattcttttttggttctttttggacaatgccaaaaaacgacgacgccctcacaaaaaagaaatgtaaaataaataatcataatttgaaaatttcgaaaaaattctccccaatttttcagctttatctgcggagattgttggcttttggtgttcgattttcttgcgccttctcaactcggcctcgaaattgcactgatcaaccgccgctttaactgcatcgtcgacgaacacttcaagacacgcaaatggaaattgggcgaaatgcgaattttccacaaaattggagagaatggcacccagcaaatgcaaattgtcaattccgatggaaatccattgccaatcccgcaaaatccgttgcccaacaaagtcatcggattcaaacgcattacgatcctgtaaaaaatagattaaattggaatttttcgtctaaattttctgtttttcagttacatcgatcaaaatgtcatcgcttttctccgcctttttcaccgttttttcgccttttcttcaatattcttgttcatcactgaaaatgttcgcattttggattttgttttgctcaatgttttgccaatgctccgcgactccattcgtcttatgcttttgaataccatcgcttttcgccgtttgcgccaattggccccgtcactgctcaacgattgtccatcacttcacactgtgttgtttgaagactccattttccccgaatttccgcccgatgacagtgccaatgcgtcggatggccaagcggtgaccaaatggttgttcacgcctcgttcggatggtgtgccgaagttgcttcaatgctctgttaattcaacggatgagcaatggtcgtcaacgatggaacattttaaagcggtgattatccctatttcattggtttttctatgattttttgtcccatttttaggcattttccaatgcttcttctccggttacttttcgcattcattttctgatgtcttctccgcttgacttcattgtgccatttgatcggatcaacgaagtgactgaggagaaattgacacttaaacaatcatcagcaaatgattttctgctcatccgttctccaattggatgggataaccgaaattggaaaaatctgagggatgaaattattgctcgaacgaatccaattgacattcgggtcaaagatggcggatacgacgacgggtgaaaaaattaaaaatgcttaataattctcttttttgtttttgagtccaattgcttagactttgtgttttcaaatgcataatagagccgaattatggtacaaaaaatagttcgttgagttgactcataaaatgccattgaattataatttgcaatggaatgatcatcgttttttcagtcttctcgacgacgcttctcccgggccgagtgatcagcagaagaaatgaatgaattaatcaattaattgatgcgatttatgagcgaaatgatgttggtggcaatttgtcatttaaatattgcctaattgtttgtttgtctgtttgtatttgacctttgcttgctcgcaaatgcgtccatttccattgtattttatgtgtattaattaattcattcattcattgtgagtaatcgtagataaaattgctaatgatttaaccggatttcattacatagcagcacaattcaataaa

SEQ ID NO: 55590 - DNA, 311 bp, Heterodera glycines
  Genomic contig location: Contig_ID=SeqID_4744; Location=4852..5162; Strand=-
  SCN-specific regions: Sequence locations=1-76,100-311
atgggtaagtgtaaaagattaatttaattcattcaccaattcaaattgtgtttaattttaggccattgtcgccaccaacggacgaaaaagaaaaagaagcgggtcaaagcaacgatgaaatgttctcgacgactcccggaccaagtggatcagcggaatgagtgattttttgaaaatgtcgtctaattgcgtggaaatgaatgaattaattaaatttgagaaatgatcgatctcacggattgaaatttgatttgattctctcatttattctctcagaaatgcttttgttgattttctttcattcgaataaa

SEQ ID NO: 55591 - DNA, 369 bp, Heterodera glycines
  Genomic contig location: Contig_ID=SeqID_24841; Location=1259..1627; Strand=-
  SCN-specific regions: Sequence locations=1-90,186-293,344-369
tggatgaacagtttggcgagctgcgggcagagatcggcaaaatcaaagaacaacagtcgacaatgatgagcacaattatgcaggtgagtgttataaaaagaaatatttaatttttttacaaaaaaataaaataaaaaacaatttaaaatattgtatacacaaataaattttcaaaattattttaagttgcaaatgcttctgctgcagaagaaaaacgaaaatcggcaggaatttactgagtcagctgatcactcactgatcagtgccatcggagtacaataattttgaaatcaaaacaaataattatgatcatgttaatttactttttttttaatttttttttgtgcttttttatccatttaaaataaa

SEQ ID NO: 55592 - DNA, 571 bp, Heterodera glycines
  Genomic contig location: Contig_ID=SeqID_24842; Location=586..1156; Strand=+
  SCN-specific regions: Sequence locations=1-238,279-423,446-540
atgcctgtagactctgttgctgatcggatgcgtaacataaaaagcgctgatctgattgtgtggatgcaatggtttcaatcggcgcataagggaaaagcggggcattcgatcaaacgagaatttatttggctatatgcacgtgttttttacgaccggtatggaaatggatttgacaaatattttgaagccgaattctccagaattgaagtgctgatggaaagtaagcaattacagtcccattaattaattaattgggtaattaataaatgatttaactacagaaatcacccaaatgcacactgatgctactgctgctttcgctttgcagaaaggcatttgctgtgaattgccagaaaaatggcgtaccataatcaaccaaggtacgatgaatgagagcattttggaagtgatcgaatcggatgagggaaaggaaagaaaaatggggacaaatgaatttgtacaacagttgcattttgatgtgatcagagagttttgccaaaacattgatcaaaccgaagaactggttcagagaaaaattggaaatataataaaaagtaaattaaaattataa

SEQ ID NO: 55593 - DNA, 196 bp, Heterodera glycines
  Genomic contig location: Contig_ID=SeqID_24842; Location=1105..1300; Strand=-
  SCN-specific regions: Sequence locations=1-104,176-196
tttttcatcaaatggaatgccaatatgttggaaattttttttgatctgtcctttgttcattattccttcaaatttcgtcgataatctttgctctgttttaacacttaaaaatttaaaaaaattttccgttacttgccaaaaactttataattttaatttactttttattatatttccaatttttctctgaaccagt

SEQ ID NO: 55594 - DNA, 982 bp, Heterodera glycines
  Genomic contig location: Contig_ID=SeqID_24846; Location=15..996; Strand=+
  SCN-specific regions: Sequence locations=1-190,214-982
taattaaatccattccttcgggtcatgtgccgggtgccgcggggtaagcagtgctggttcgtctttcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaatttttttctccatcttcctttttgatactaaagcatcagagtgctaaaattaagttgtaaataaaatttggtgcgctttagagcactttctgaaaaaaatatttatgaaacaaaaaaatcgattttttcaagtgccctgtttggggtactcaaacatttatgggggagcaaaaatcccttgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaa

SEQ ID NO: 55595 - DNA, 2162 bp, Heterodera glycines
  Genomic contig location: Contig_ID=SeqID_24849; Location=116..2277; Strand=-
  SCN-specific regions: Sequence locations=1-87,127-165,187-610,640 -1188,1211-1381,1404-1453,1475-1844,1872-2162
atgttcggcttcaactacttgcccatcttcccgcaaatcacgtaagtttttcaacgtgtgccactttgggagggacatttttttggctgttcaaaatatttttcaaaaattacaattaattgttgaaaatttaaaaaaacaatatcgatcgactgactgatcactcattgatcaatacactttgttttctcaacgattaggaagggtaagctgaacatggacggtggcgatttgctggtggttggcattgacacgagtcgcccaccaaaagcgacggcgtacgaccggtacaaactgtgcagcaaggggctggccgagctcacctccgaggaaccgatgaccggtgggtgaacgaaacagtcaatgggcgcggcaatggcacagcgatcattggcattccgccgatcgggaatcgctcccggggattatctctaatccattgttaaatgcccaaaattcggctggttttaagtgattttttgtttcaatttcacagttggcatttgcgcaaattatctgaagaacccctacaagttctgtggcgattattacttccaaccgtgcacgtccgtttgcttttccttccaattaataataatgcatggaattgttttttaataatagaaataattattatttcccgttttatttcttcccatttaagtcaagatcagttgcaaaaacagatgctcgaatacaaattcggctggattttggacaaagtgcaaaagaaccgagggaagatgccgtcggtggtaagtcaacgaattggaccagggatggcattccgaggccccaaaaattttcggaaatggaaattccgaccccaaaatgtcgaaatccgaatttcgtgccaatccctgctgaattggaccttccaaattgaaatcactgatcatcacgaacaaaatgttatttctcaaaggttttcatcatccgcgacggcatcagcgagggaatggtgccgaaggtcggtttgaatttgcaccgcaattccaccggttggcattggcactctgtcctccgtctttcagaacgcgcacagcgagttccaagcgtacgtcgacgcgtgcaaaaaggcggttccgaactggtcaccgaagtttgtctactgcattgtggacaagaaacacaacaagcgcttctttgtcaaaagcgggcagcaagtggagaacacggagccgggtggggttaattagttgtgccatgcctttccctcattcatccgttggccaacaattaacggacaaattgagaacggcacaaatgtttacgagtcaatggcttatcacctaaaacagtgcaggaatgccgaaatcagtttcaaatacggaacgggcaaaagccagtcataagtgccgtcgtattcaaaaaagtttcatttccccccaaaatttggataagccactttttctccgaccgatgcctaatatcaaaaatagcacgaatgctgaattaaaattaaagttattaattttgaggaagcgtcgtcgattcgaaattcacgcgcattgacattcacgagttctggctgcagtctcacgttccgttgaaggtgattttgatggccttgaaatgacggaccgttcgttacgaatttattcgcttaattatgctttattacagggaaccaccaaaatccctcaatatgtcttcccggtgaaccaagtcatggccaataacaacgagttgcaaaggtggattaatatattgagaaaaatttacgatttctatgtaattggaaccaaaaaaagggacaaaaacggtgccgaggggtgggggattccgatatcagcaacttgaacacaaaatcgtctccaatttctttaatttgttgctggtgtcatgctttttaattgattttccagttttctcctttcgctctgctgcaattggcaaattgtgacattggccccgggtttgccaacccccgtccgccaggctgccgaattggccaagcgcgggcgtgccaatttcaacgagctgaagcggtgagtctccctagccaatctaatcaattaacggtgataattaatccctccagcagtacgccaaaattcatcccgcgcgttgaggacaccgaccagattaattatactgtgctgaacaaccgcctctgttataacgggcatattttggcggacacgcgtttcaacgcttaa

SEQ ID NO: 55596 - DNA, 1910 bp, Heterodera glycines
  Genomic contig location: Contig_ID=SeqID_4746; Location=163..2072; Strand=-
  SCN-specific regions: Sequence locations=1-372,394-468,490-511,534 -588,610-1611,1634-1694,1717-1738,1760-1910
  Gene Ontology: Mol. function=purine-specific oxidized base lesion DNA N-glycosylase activity; Cellular component=nucleoplasm; Biological process=base-excision repair
cgctaaattacaaaatttttttccgtcggcgcctatcgcgactgctgtaccccatcccctgcccattcctcaattttttcggaaaaatacgccgcaaaaaaatccttaaaaatctgattttttgatcccgattgaactgaaaataatttacaaattgcatatgttttccacaaaattgctaaaatccattttcggaaatgtataaatttctcatttctaagccggaattgctcagaaaaatagttggcggcgagaaatatgttgctaatgcttgattttgttgaaaaatgctatttaaagttttggaagcgtgttttaaaaaatgtccttatttttgatctaaaatcttattattgcccagcgatgttcttatttcgggaaattttcaagggtaaccctggcttaaagggtggagggttttaaaaagcagaatatgaaaaatgctatttgggcacttttgccgtttacgaaaaaattccaaaaggggggacccttttatagggatttggaatttcacaacttttgacaaaaacaattgcaaaacaaaagtccctccctttggattttttcgggaggggggggggggggataaacagcaaaagtgccattaattattatgagttccgcttaatctatgtttttcagcttggtgttaaacttgagcaattgtacaagtcttggtcttctcgagacaaacattttgccagattcttgacggaaagacgagaaatgttgcagggcattcgcattttgcggcaagaacccgtcgagacgcttttcgcattcatttgctcagcaaacaacaatgttccgagaatatcaagtcagtgaaataaaataaagagtcaatttgtggtgactctgtttattcatagggtttttaatttcgctgatactgaacacgaaaagtacattcattttgaccaaatttaaaaaaaaaaaccaaataattaatgaaaaaaggtaatagtcaaaattgaattttcgactttttgttctaattcggtaaaaaaaatttcgaagaagatgtaaaacaaactgcaattaagttcgcgatttaaattttaattcattaccatcggataaaaaaaagtgtagctaaaaaaattgagtcgccaacaaaatttggctactttatatttaccaaaaatattaattctagaaagaggccgagaacctcgagcagttctattagttgtaattcagaaatggtcgaaaaactttgtcaattttatggcgattctgtcgaggtgaacgctcaacgtttttacgactttccgtcagttactcaaatggccgcacatttaaattgtatggaacaaactctcagagatgccggtcagcatttaatttattaataaccgcagctattaaatactcaaaatttcacaggttttggttaccgggcgaaaagcattgtgaaaacggtggaaatgttagctgatggtaaattgggaaattctgcctacctttggctccattctctgcgaaatttgccataccatgaggccaaattggcacttatgaaattgccgggggttggccctaaggttttcattcaaattcgactatttttaacgcattaaaacttcccaggttgccgattgcatttgcttaatggccttggacaaacatcaggtggtcccggttgatcgtcacgtgttcaatttggccactgagatttacacaccgacatttttgaagggttgtaaaacattatccactgcgatctacggccaaattggttggttttggatggaagtgtaaggatggcgaggggccggtcccttcctttcgccctcccgttccaaccgaatcgttgatttcctttttttaatttaaaggtgcctttttcgttgatcttcacggcgattatgccgggtgggctcactccgttttgtttagcacgc

SEQ ID NO: 55597 - DNA, 900 bp, Heterodera glycines
  Genomic contig location: Contig_ID=SeqID_4748; Location=320..1219; Strand=-
  SCN-specific regions: Sequence locations=1-109,132-758,780-900
  Gene Ontology: Mol. function=diacylglycerol O-acyltransferase activity; Cellular component=integral to membrane; Biological process=triacylglycerol biosynthesis
atgccgttcaattgcgaatttgccggcggagtttgtgccgagatcggtcaagtgctcgccgtttggctcttccaatggatgttcatcgatttcgcctttgtcggcaccgctctgttccttctcctccttttgcatcgttcgctttggcctttggctctgttgtacttctgttggtactgttacgacttcaacacaccgaaaaaaggctcacggcatttccgttggcttcgaaatttgcacttgtggaaaagtgtggccgaatattttactgtggaaacggtcaaaacggcggaaattcccccggacaggaattacattttctcgtcagttcatacaaattcaaattcatccgatattaattagaaaccaattcgaaaatcttttccagtgctcacccccacggcgttttaagcatttcctcggcgttggcctttggcaccaatggcaccgacttccaaagactgtttcccggcatcgaatggcgcgtggccaccctccccatgaattttttattcccttttcgacgtgattttctgatcgcattgggttgtcagaatattacgtcctatgcttatctttatatttcaggagttatctcaagctccgccgcttcgattggccattcattgagtttggcgccgggagggaacgccgttggcattgtgccgggaggggtcgcggaaatttgcttttcccagatggacgaaggactgcacaagctcaaattggcaaatcgcaaagtgaatgactagtgagcctttcattctgtacagttttacttttcagggatttgtgaagttggccatcaaaaatggcgccgatttggtgcccgtttatcattttggagagcaacaactgatgcgacttgccattctgcccgcccttttggacaacattcaa

SEQ ID NO: 55598 - DNA, 899 bp, Heterodera glycines
  Genomic contig location: Contig_ID=SeqID_4748; Location=1671..2569; Strand=-
  SCN-specific regions: Sequence locations=1-318,340-542,564-757,798 -875,897-899
  Gene Ontology: Mol. function=sodium:phosphate symporter activity; Cellular component=integral to plasma membrane; Biological process =hermaphrodite genital morphogenesis
tcttctcctggtttttcccacgaaaaggaccgtcgcgaagacccgcagactttgcgaatgttcagcacaattcaggtgagtcattttctactgctttgtccatgccttctttgactgtcctcccttcttctttttttggtgttcaccgcctgtttcgccggcttcgcccacggagcaaatgacgtcagcaattccatttcgccgttggtggcactcctttccgtgtggcacaatggcagcgtggaacagagcgaacagacgcccatttggctgcttcttttcggcgtttccgccatttgcgcgggcctttggcttctcgggcacagaggtgaagccaaagaacgaacgaatgaatcaatgaatattcggccggttcaattaaacaatattcccttttaagtgatcgaaacggttggccaaaagctgtcccatgtgaattcgtgcaggtaatccctcccctctctccccccatttggtcataaattcgcaaattcccctttcagtggcttcacaatcgaattcggcgctgctgtcaccgctctgttggcctccaaacttgggcttcccatctcaacaacgcactgtttggtgggcagtgtcgtcgccgtgggctccattaaatcgggcgaaggcatcaattggcgcatttttgcctccatcgccacttcctgggtagttatttgtgatggggcgggaattcttgaaaccttacttaagaaagaaataccaatggactaaatttgtttggttttaaatatctaattaattaattagtttgaattttaatccccttaattgcttcgtttccttttcattttgtccattttcagctggtcactctccccgtgtctgctgctgtttccgccgctttgatgttcattatgaagacttttcttctg

SEQ ID NO: 55599 - DNA, 681 bp, Heterodera glycines
  misc_feature (617)..(617): n is a, c, g, or t
  Genomic contig location: Contig_ID=SeqID_4749; Location=1..681; Strand=-
  SCN-specific regions: Sequence locations=1-477,508-681
  Gene Ontology: Mol. function=sodium:phosphate symporter activity; Cellular component=integral to plasma membrane; Biological process =hermaphrodite genital morphogenesis
tccccctctccctcatcgttcgtcccaactttttccgctccttttgatggtgccgccctctcccttttccaaaatgccttcctttgggctttgatcgtcggctttctgctcgcttttgtgctcggattcggaatgggtgcaaatgacgtggtgagtcatcatcagtcattgggggagggcctcaaaaaaggggaaaacggcaaaaatttaaggcaaatgcattcggcacttcggtgggctcaaatgttttgacattgcgaaacgctttcattttggccacgattatggaaacgcttggcgctgttcttgttggtgggcgagaaacaaatcattctgaaattaattaaatacatttgcaggatataacgtgacagatgcgatgcgcaaagaagtggtcaacattgacttgtacatggaccaccccaaccaatttttgctagggcaattggccattctcgggggtaatcacaaagtgccaaaggaaagcaaaggaaaaacgcagccattcattgctaattttgggctaatgagtgccttttctttgctctactaattaatttcataaagagtgattctgtagtaatttacgccttccaacgccaattttttcaggcggnaagtgtttggctgctgacagccactttgctccgtctgcccgtctccaccactcacagcattgtc

SEQ ID NO: 55600 - DNA, 979 bp, Heterodera glycines
  Genomic contig location: Contig_ID=SeqID_24854; Location=658..1636; Strand=+
  SCN-specific regions: Sequence locations=1-373,397-516,538-647,672 -835,876-941,963-979
atgggccaatggcgtcagctggaatttgacttccgcaccggacagccggacattgagcaaattgtggccggatgggacccggcggacaatgggcttcaaatgaaaatctcgctcagagcaggtggccaattataacaaatttcgtccatttgtcccttttttcgacattttgtcatgccaaatggggccagctaactcgaattgcttagtcatagttctatctagtcgagaaatttcttgggttttgggattctcggctttctgcaattagcccattttgatactttgtcgtgcgatgtcgaccatttgtccaatttattaaaaaaaaatttggttaaaaggttcataaaaacaaggatatttttcaccttgtacagaattaaaaagtattttctcgatagtctttcattttttgttaccccaatttaaaccgtaacccaatgtgttaggctaccgtatcgagttgacactgtcacatcaggcgaacattgagcaagcagaaaaaagtgccgaaacggatgacaacatggacacatccaatgataataataaagtatttgtccatcaacaaaagcggggcatacgacgagaaatgagtgtttccattgcatcccaacggcctttaaacgatttgttttggcacagggtaattaattaataaattaaaattagagtattcaacaactaatcaatgctaattgcttttaggtgttggtcgaagtatttcgtggtgaaattcgtttttctgtcgaccgtttgaatgcatttcaaccactttcatttccattcgcaacatccacgaaatttagcattggaggcgatgaaaagtaaaaccataaaaatcatttttaaaaatttattataaattttattttcagaggcaatggctttgtcggatgcattggcaacttccaaattgatcaaatgctgcatgattggacccagcaattagcacagaaggacagggatgaagatggta

SEQ ID NO: 55601 - DNA, 981 bp, Heterodera glycines
  Genomic contig location: Contig_ID=SeqID_24855; Location=383..1363; Strand=+
  SCN-specific regions: Sequence locations=1-556,579-981
atcatggttccgatccaaatcaatggacacaaaatcgaattggcagccgactcatgctcacatctcacaatcattcaaaggccgatgtggttaagtctcggagggccaaaattgattaaaagtggtaaaattgtgggatctttttcaggccataagctttgtttgctaggccaattcaaatgttcggttgagtttaaaggtgttcagattgctccttttgaacaggcaactgaacaaccaatcgcaacgacgttgagttccgaacattttcaaccgaaaactttggcaattgcaattcccgatgaacctcaagggctggcggaacagcttaaaaatgcttttccccaagttttcgcccccggaattggcagatgttcaaagatgaaagccattctgcatctgaagcctgatgcatctcccattttctgtcgagcacgtccagtgccacatgatgttcaagacgcagtggacaaggaattggatcggttgctcgaaatggatgccatcagaccagtcgatttctcacgttgggctgcacccgtgctcgacgttcgtaataaaaatggagcagtaagaatctgcattgatttttcgacgggtctttatgatgctctagagctaaaggcaccccctgccccgcacagatgacatttttcatgcattgcgcggctcgaaaattttctctcagctggacttccgtgatgcatatttgcagttggaattggacgacaaatcaaaaactcttgtgggaataaacactcacaggggtcttttccaatttcagcgtcttccgtttcgagttaaatcagctccatcgatttttcaaaagaccatggaccagttgacagccggaattaatggtgtgttcacatatctcgacgatgtcatcatcgcttcaaggaacgaaaatgagtaactcggttcttgctttgaactatggtaaacgcagtaagccaagttggttggaaggcaaaattttaa

SEQ ID NO: 55602 - DNA, 1276 bp, Heterodera glycines
  Genomic contig location: Contig_ID=SeqID_24857; Location=189..1464; Strand=+
  SCN-specific regions: Sequence locations=1-117,139-321,363-995,1038 -1068,1090-1184,1207-1276
atgggacttaagcatcgaatggatgcaaaaattgatgccagtggaaacgttaaaagattttcgtgggatgaaagcagagagcttgttctgtcgacaattttggaccctcgtttcaaactttcttttttgaatgcagaaaagcatgatcgatataaaatttggcttacaaatgaagcagagaatgtccaaaacggctcaagtgaattccatgatcttttctcccgatgtgaacaaaatattgccacagaatgcggattagacattactgcgcaaccgttacctagtccagaaacattgaacaaccgccaaaaagcggaagtcataattattaaattttcaaaatttatttgtttttaattaaaggttgaagtcaatgattatttgcatgacaaaaaaattccaatcgactctgacccatacgggtactggacgggggacaatgctgtaaaatggccccttcttacatgtcttgcgcatcgttttctttccgcgccggcgacatctgcagaaagtgagcgcctatttagcgctgcaggattaataattaatgatctgagaaaaagattgactccggaaaatgcagagattttgttgtttttgcatcacaacctcaaaatttatgattttgactattcgtaaaattttttgaaaaaaatttcgcttttcgcatttcgcttttcgcattttcgcatattttggcttttcgcatttcgcttttttttcatttcgcatattttggcttttcgtatttcgcttttttttcatttcgcatttttcagtttcgcaaatttcgcttttcgcatttcgctttttatttttcaatttggcccatccctggtatagaggcattaatatcatttttttatcatagaaaattgttacttggcaccgctccatgcatcagatgtgaatagaagccattttcatacttctaattaccttttggttttttactcaactaaaatcgctttatgtttattatagaacaagataagaatttttaaatttagaattgttataaaatatataaatttaatctttaacgcaataccatagaatgcgattaagataattttacttaaaattaaagtaacattcttctaaaactgtagagacatttgggtcgattatatttttaattttgaggttgcatcaacagagtcattaaaaccttccaatattaacagaacaggtgggatatcttattatcttctaaaatattattttcagccaaaaaatgcatatatctatgagtatataattatgtttctgacca

SEQ ID NO: 55603 - DNA, 1027 bp, Heterodera glycines
  misc_feature (680)..(680): n is a, c, g, or t
  misc_feature (694)..(694): n is a, c, g, or t
  Genomic contig location: Contig_ID=SeqID_24858; Location=605..1631; Strand=+
  SCN-specific regions: Sequence locations=1-299,321-1027
atgtgggaatggtcggtgattttcaccgactgcgctgtaaatgctgttttggatttatcattccttcacctttgcaatttaaggtacaacaacatcggcagcgaacggcagatgatccaaagaaggggtaaaatgggcgagggattggccagggcatgggaccgatttgaaggagcatgagagcgtttacaatcatagtgggactgatcacgaggcattaaatgattgtgaggggctgataaagcacatggaagcaatgagaagcactgatcatatggattggattgaatgaaaaatattttgctgattgtggtagctatgttagcatcgcgcgagcattatcatcgacattttgcccaacacattatttataggccgtgcccggcacaagcacagtctgtccattctgttggcactggacaccggcattgagcagcgggagttcagcaacatgcgcaaggaggccatggcaagtgaaagagcggattatcagtaaggctgggaccgaaggccttaaaatttagcgaaagtccagtccaaaaaccatgaatccggccccacatctggcttggatgttgatttttaaagtatattttatccaaatccaacagatgatgcgctgcattgaggacatgcaagagcaggatgagcagacactgcgcagatcggtgggtggcatntggcaattcgaganaatttccaaataaaaaaaatattcatttactataataggtgtcaattttttttacagatcgaggaaaaggccattgaattggccgaacttcgcaacgacgagaaaatgaaggaggagaacaaacgggcccagctgatgggcagacggtgtgtttgttttatgtcattgtgccatttttaatttatgattattttcagtttcgatttgagatgcgcctgtggcacagtgatttgctgcagtgaccgcgtccgatcggtgatgggcactctgtttgtgtgctgcgatccgaaagtgtggaagcgatcgaaacacacgctgacacgggccccaacg

SEQ ID NO: 55604 - DNA, 78 bp, Heterodera glycines
  Genomic contig location: Contig_ID=SeqID_24859; Location=339..416; Strand=+
  SCN-specific regions: Sequence locations=1-27,54-78
acttggacatttcgtgggtcagcggttgaagcaaagaaggaagcaaatgggaaagagaaaaattgggcttacaattag

SEQ ID NO: 55605 - DNA, 1562 bp, Heterodera glycines
  Genomic contig location: Contig_ID=SeqID_4750; Location=313..1874; Strand=-
  SCN-specific regions: Sequence locations=1-29,51-580,632-666,688 -829,851-1009,1031-1097,1119-1158,1190-1240,1262-1295,1317-1562
atgttttttctaaaactatttctgttgtctttcttggtaattgggggtcagtgttgttgttgcttgtcgaaagaagaaaagcagcagatggatgcctcccgaagggttgttgaagaagtaattaaagatataattaggttaactaatgaggccaaagacttttcattttctgctcataataccatggttgaagctcaaattattaaggataggaattcgggaaaatctgaaatcatattttggcatgaaaaactattaaacggagttagaaaaatacattcacaatttgataaaataaaaaatgaggaaaagaatataaaaatattaaaaaaggcatggaaaaatgtctagacagaaaggacccagtgatgtgccaagaattagccgaagatgccaaacaatcaatagaaatagctaaaaaatataggcatgaaattggacagacttatcgtaactcttattcacagccagatttaggaattggagatatggccaataaaataaaagaaataatgcgagaaaatcaaataaaatttgaaaagccaagaccctcagcagaatttagagacgaattcattgcatataaaatataataaaaatatataaaagaaaaacagaaaaataaaaaatagaaaagctaattccattttgttggaagctgctaaaagagagacagagagagcatggcgagatgtcgttgtgttatcggatgatgtaagcgattttgccaagtcttctcgagaaactcttaatcgtgcaataaaatcaagagaaaaagctccttacgctaatggtgttcgggaattgtatcttaaaatgtccgattcaatttgggaaattttcaaattcctggaacaaatcaatttggagtcagaaaaagctgaatctgcgtggcgtgagttcgaaagatgcaaaacttttgaccaggcaacaaagcttgaggaacaatctcaaaattctttaacagaagcccgaagattacattttgagtcccgaagggtgcaaagccaaatgttaaattatgaaaataggctccaaacaattgtttgggagcatatgggtatataagaacataaaaactaaaagggcaacactcaaaatggaagggtgttctttaattgagtcatttcgtcatgaagacttaaaatttggctttacaaaatataaaactaaattttattttaaaaatcctttcataattaatgctgaagaaaattttaaagatatcctcacatcgttaattaaagaaaaatataaaaatgagcaaggcaaattcagaagcattttgaagctttcttttggttttgaatcattttattgccctcttcgataccctagcgaaaacacggccgaggctttgttccaacacgtattattaaaagaagaacaatattcacttttttatcctttggatggtgttataacactagaagtaattataatcccagatgtctacagtaattcaagaaattgattttattaagaataatttaacaaaaaattggaaaatagccgggaatatacttaaacgatcaaataatcttgaaatctttgcaaataaa

SEQ ID NO: 55606 - DNA, 684 bp, Heterodera glycines
  Genomic contig location: Contig_ID=SeqID_4750; Location=2460..3143; Strand=-
  SCN-specific regions: Sequence locations=1-611,654-684
atgtactcgttcaaaaaatattttgaaactgctcttgagaaggaagactttttctggcctaagaacagagctgaggttgaagcgatgttgattgaatcatcccaatataaagtggccatacaccgggattatgaaagcccgttttccggctacatagaaatgcacgaacacacgtctgcgttttgttttaccatggttgagcgagatatgcgaattttttatgactcaggggcgggtactcctatgggtagatacacgttggtactacacggcatcgtacaggggaactatttgggaaatgattcgggattgggactccctattttttttcttctggttttactgggagggaaggagccagacaaaccgcaacggtttttttaggagtcgtctttttctggcaaaggtccaaatgctaaaggtcatggcattagcttggggaaaagaactgttgacttccccaattgaagtactactaaatgttttctttaatcgtatggacaggtctttaacgattaaaaatctatatgtcattattattacagagaattgcttggctcttggtcgttgctctatcgggtccctccaagtctctttgatatttctcgtcgaattgttgcagaaaaaatgatggaagaatttttaaaactgccatcacactttcgaattgctttttataataaa

SEQ ID NO: 55607 - DNA, 1160 bp, Heterodera glycines
  Genomic contig location: Contig_ID=SeqID_4751; Location=1113..2272; Strand=-
  SCN-specific regions: Sequence locations=1-35,57-199,221-305,327 -868,893-1160
gaatgcgatgtgaaagcggaattgaaacggaacagagcgatgaagaggttctttgacgctgtgccggataagggtccaataaatccgagggatgcttacgcgggaggacggacaatgcctttttgtttgtatgcaaaagcaaccgaagaagttgagatttcgatgttcgatatcataagcttgtatccgtttgtgaattatggtaaaaaatctgcttgcatttttgaaattttccttcgcttaagacaccccttatccggttggggtccctaaaattgtggtgagcagggaattcgatgtgaattggacggtgcccgacgatgtgccctatgatggtctgctaaaggtgaaggtcatccccccaaaggaactgctttatcctctcctccctatgcatattgataatatgcttctcttccccaattgttatacatgtgcgaaaaaaacgaagaaagagtttgtgttggctaaggatgtcaaaaaatgtaaccatcggccagagcggagagctttgattggtacattcacctcgatagaactgcggaaatccttggcgttgggatatagagtaataggcttctatcgggcctatcactttgagcaatttgacagtcagctgttcaaaggatatgtgcgcatgttcttgaaaataaaggtggaggcgtcgggctggccctcggaggtgagaaatgaggaggaaaaaagagcattcatcgaaatgtacaaggccaagtacaacatttggttggaatatgataaaatggtgtttaaccctgggctacgtatgatcgctaaattggtgagaaaaacaaataaaattcaaaaaacaaataaatattaagggattgaacagtttatgggggaaattttcaatgaggaacacactttctgtgactgagattgttaataatttggaaagatggacggagctcatcaaagatgacacgattgagtttaaaagaccgattgagataaatgagggtgtgatgagagcaatataccagaagaagcaagagtttataaaggagcataaagtttcgaacataattttgtcattgtggaccacgagtgctgccagggtaaagctgtacgagtatatggagcaggtctacagggaggaggggtctaagctattgtattgtgacacaggtggacattag

SEQ ID NO: 55608 - DNA, 386 bp, Heterodera glycines
  Genomic contig location: Contig_ID=SeqID_4752; Location=89..474; Strand=+
  SCN-specific regions: Sequence locations=1-132,160-386
atgctttttgatctgatcagcagcggtcgatcacttccactgggcccaaccaacgaaagggttttcttctccaacgcattacggtaagtgttttacttgggttcagcatactgtaacagaatcactacagcataaatcaaaaaatatatttttgttttagtaaccacaaaaacattttacttcaacttcgcaccgtcccagcgccaatgttagggttgaaaaagcgtcggccaaaatttggacgaattgttggcaaaaaatacagaaattgtagtttattttcaatataattttcactcattttttatattttgtttaggcttcttctcgcctgttcagtgcatgttgtccttcagagaaggctccatttttatggacaattacaa

SEQ ID NO: 55609 - DNA, 348 bp, Heterodera glycines
  Genomic contig location: Contig_ID=SeqID_4752; Location=795..1142; Strand=+
  SCN-specific regions: Sequence locations=1-209,231-348
atgacggcctacaatgagtacagcaaacatcgtctgccgaaaaagccaacagacttcgactttgccaagacgccggagatgcctgaaaagcttgtttgcatagcctcagtcagtgtggatcaaccggtatttgtgcttgcggatgtgactgagttgtagaccatgctagactcagtcacaactagagatcggaaatttcaaatttgctgatcctgttgcaggatttgaattcaaaattttttacaggacaggatccggcaggattaatcctgcaaatcctgcatttaaaatctgcaggatcctgcgcaggattacggattttaggaaatttcaaaaaattctgtatta

SEQ ID NO: 55610 - DNA, 250 bp, Heterodera glycines
  Genomic contig location: Contig_ID=SeqID_24862; Location=385..634; Strand=-
  SCN-specific regions: Sequence locations=1-58,80-250
atgattgaagacataaccggacggagccatgttaaggaaatttgcttttacagtaagaaattttggaataattaaatttaaataagtaatttagctaaagatggtggggatagaaaaattggacgatcacgaaaagcaatggctatagtgcttatgtatggtttgatgaatggaaaaagtcttgagttatttttatgttcataagttgtatttgtagaagctgttgttgggccttcagcaagccaataaa

SEQ ID NO: 55611 - DNA, 700 bp, Heterodera glycines
  Genomic contig location: Contig_ID=SeqID_24866; Location=284..983; Strand=+
  SCN-specific regions: Sequence locations=1-100,168-376,432-639,662 -676,698-700
ggtcgacgatgttcaagcccgttgtgatgagctcaatttgcaatttgtgcaccgttttggggtgatgccggaccagcatttggtgaagtaagtttggcggattttttaaaatttattattcaatttagaaaagatatttttatttgatcatttatttttaaaattaaggttttgcccgaagaagttcgacatgctgtatgtttaaacaacaaccataaatttgatttttttctcaagcaaattattagaaattgaacaattaataaagtgctcaaaattttttccagtttttttggttgcaaaattttagttttttttaactttttaaggaattaagttgggagcagtgctcttccccccccccccctctctcgccaaaaaaaaaatttcaaaaaatcttattttctaattttttattaaataaatttaaagactggtgggggggggggggggggtgagaatgtcatgcaccgaatttcgtcccaatttttaaacacagccttggaatcgatttgctggttggccttggattgagcatggactatggcaaattggcaatcacccacaagggcaaaatggccaaatggttgaccgaggaggaaattcaaatcgaaatggaggacagctactgaagaaacgaaagaatgaatgaacaaaaagtgatcggaattttgtgatcagagaaacagaaatcaaacaa

SEQ ID NO: 55612 - DNA, 196 bp, Heterodera glycines
  Genomic contig location: Contig_ID=SeqID_24867; Location=295..490; Strand=+
  SCN-specific regions: Sequence locations=1-117,139-196
tacccagttgcggatgcgtcaatgaaagaattagacgtgttgatgcagccattgttgtcggacacgcaaaaggcagtggaagggatttgaaagcgaatgccacggatctcaaacaacaattctctcatcacttttgtgtgtcattatttacgaaaaagtcagacctcctaaatcctgaagattttaaagtattaaa

SEQ ID NO: 55613 - DNA, 620 bp, Heterodera glycines
  Genomic contig location: Contig_ID=SeqID_24868; Location=193..812; Strand=+
  SCN-specific regions: Sequence locations=1-174,196-572,596-599
atggcacaaaaagccgttcattcaattcaggagactcagtctgtcttgaattatggaggagtggtaagacatcatggttggaaggtaaaattgtgagtggtagtggtttgatttggaaaatcgaaattccaatccttggaattaccgtaacgcgtcacgtcaatcaaatgcgttcattttccccttacatttcaagtaagattgtgtccgatcagattcaagccgctccgcaacaacacattcctccaatggcgccaattcaaattgatcagacacctgtccgtgatcaaactcctgtccgtgaccgcacacccgaaccagtcaaatctcctcgtccgcagcgacagcgcaagaagccaattcgctattcgcccggctaattgccacggacggtctttccaaaagagggagatgttggatgtgttgatatttaatattattaagtttcgacacgaatacttttattgattagttatttgttgatgggtcctctcccatcgactcattctttgcatttgtgttattttgcaattcggtgtttatttttcggactttctaatttgactccgtcgttattttattattattttgtgattctaattttattgtttattcattta

SEQ ID NO: 55614 - DNA, 647 bp, Heterodera glycines
  Genomic contig location: Contig_ID=SeqID_24869; Location=635..1281; Strand=+
  SCN-specific regions: Sequence locations=1-94,116-349,371-647
atggaagtaagcggacgaattgaagtggagcctcaagagacttggctgaatttgcggctaaaatcagtgcgtaaatgatttattttagaaagcgaattaattaattaacttaaaatagctgaccccaataatcgaaattattagtctaaattagggttaatccccgacccaatgcgggaaatttcgaatctcattcattgcactccaaagactttcttttttgttttagaaaatttcgttatttttttcgacttttttttttggaaatttcctccttgatgagggtggttgctccccgacatttttttaaattactccagccatccctgaattttatccttctaaaagatatcttttcaaatattgctttatctcaggtgagcacggaggatttgaagaaggagttgggtcgagtgaaggatgatcaacgtgagaaaaaacaattcaaattattcggcaaaattaaaaaagccaaaaaatttccaggccaaaatgcttaccaggacacgctggccgcattggtgtacgacgtgaatgcaacagcggaagtgcttcgccgcggttcattgaagcgcaaaaagcccaaaagtcacgaggtgcggtttttgtcagcgcgatattcgtgcacagatagacatgtacagtaa

SEQ ID NO: 55615 - DNA, 575 bp, Heterodera glycines
  Genomic contig location: Contig_ID=SeqID_4753; Location=136..710; Strand=+
  SCN-specific regions: Sequence locations=1-25,47-163,185-547
ccataagtaaaaaatccaaatttttaacaatttgtgttggacatggttatgggtttatccgtgccaccacttcttccgccagctatcaaattcaatttactgttcatgcgccaacggaaattgtgccatttgaatatgtgaacgaacggaccaacgaaaagctgacattggagaaagcagaaaacaatgatgaaagtatggatgaagaagatgatgatgaatgggatgagcgatggataatgaagcgatgtcaaattggggagactacggccgcgttaaaccaaaattcgggcaatttgaacaatgtcagctttacgttttatggaaattgcattgggtgagttgcaacagcttttgctttaataatcaaattaaaaatttcgcttaatttaggccattgtcgccaccggcagaagacgaagaagcgggacaaagcgccggaaaagagtcgacgtattgtgacatggatggattaatttggaaatgatcgatcattatgtattatgtgatgaaatgaattttatgaaggaaattcgcaaatatctacattcatatatatgtatgtgtacatgtaa

SEQ ID NO: 55616 - DNA, 1295 bp, Heterodera glycines
  Genomic contig location: Contig_ID=SeqID_4753; Location=912..2206; Strand=-
  SCN-specific regions: Sequence locations=1-328,350-965,987-998,1034 -1295
attcatcgaccactccgttttcgcgtttatccgtgccaataaacaaatttgggacaaaggcaccaatttgaatttgtatgtgccttattcccataatgccaagagtgtgcagcaaatttggaatgattttgttcgtgaaatttggcccatttttgcgccaaagattcaccatttgaactttgccgatagccatcatttggacaatttgcgtcgccgcacttcgccgacaattctcaccgatctcaatcagctgaattcaatcaattccaatcgtttgttgcccgatgcaattgccgatgatgggccaaatgcaactgctggccaagcgctgtccaaatggttgaacactccgacaaaaaatggaaagccaaagcaattgagttgtgattatacgtcaaaaaccaaaagaatgatcaccaatttcaaagaggtgtggccacattttcaataaaatattcggattaattgccatttatttgcttttcgtttcccattttataggcatttctccgtgccaactcttcttcggccagctacgaaattcgaattaaatattttaaatcaaagcaaattggcccatttgaattggtgaatgaacggaccaacgaaaagctgacattggccaaagaaaccgaatataaatggtacaaaaaatggataatgaaacgatgccaaattgggcaaacggcaacggttagatgggacgacaaaaagacgaacaaattgaacaatgtcagacttcatcttcattatcaatttgggtgagtggcaacaacattttcttttgtttaaagtaattcaaattgaccttaattaggccattgtctccaccagcagaagcgggccaaattaacgcaaaaaatcgtctgaaaatgaatcctgggcccagcggacagcaacagaagaaaaagtgaaagaattattaggaatgattgatcgatagttatgaactgatcggataattgccccttatatttatttgttgcttctttcgcttgaatacacatttagttaattaattgtttgcatttttggacttttacgcagatttttaaacctgaaaatcaccactgattattctaagctcaaataattaaaaaagttaagttcagggtcataatgtttacaccccaattattgtctgtttttaatagaattctaagctcatgaaatttttacctcctttttcaatttgtccctttttttgcctttttccttttaggtgtctttttgtcagtttttctgcattgaaatccgttccctaatcatttcttctgacattacccggtaataaa

SEQ ID NO: 55617 - DNA, 314 bp, Heterodera glycines
  Genomic contig location: Contig_ID=SeqID_4754; Location=11..324; Strand=-
  SCN-specific regions: Sequence locations=1-314
atgctaacattgacgaaagaaaacagtgatgaaaatgtggatgaagaaaacgataatggatgggaagagcgctggataatgaagcgatgtcaaattgggaagacaattcaatgggatgacaaaaagacgaataatttgagtaaaatcggttttacgctttatgaatttgggtgagtgccaacaccattttctttttttcaattaattcaaattgcacttcatttagtccattgtctccaccaaaagcgggccaaatgaacgcaaaaaatcgtctgaaaatgaatgccgggcccagcggagagcagaagaaatga

SEQ ID NO: 55618 - DNA, 1770 bp, Heterodera glycines
  Genomic contig location: Contig_ID=SeqID_4754; Location=712..2481; Strand=+
  SCN-specific regions: Sequence locations=1-118,149-432,454-1342,1364 -1458,1483-1770
atgttaaatcatgaagtgagtttatgaatttccaaaaattagcttaaatttcacgcgcttaaaaaatgaaaatttataaatgttttttatgacgcgatgattttttggcgacatgttcaataaatttcaaaaattttaataaataaatctgtcgaaaaataatccacccgtctccatttatcccttcttatcttctaatcccccttttctgaggaggttgaaaaattaattcgagaaaatagtaagtcgtattatagcattttgatgctgcttagtcactattttctaataattttgaccaaaaaaccaccttttgtaattttatttatatttttggtacaatattttgttttttgtacaaatttcttacatacagttaatcgttggattaattttgacatttggaaaacgacaaagtcaccgcgtgaccatgaaaatgaacagacggtaaggaaattttaaactttcaaattctaatattaattaattatcccgcatttcagttggatttgtagcgacatttggatggacactctcccgttctttgaccatgcccaactcggcctcaaattggcacttctttcgccacggttcaacgcgttggtcgacaaacattttgatggcaaatcagaattgacacttttgggaccaatcgcaatttgcaaggacattgtaacagaagtgccaaaattatgtgtgtttattggtgccaattctgttgaatttccattgcccgaccgtccgttgcccaacaaaattcgctttaacgacattcggatcgtgtaattcaaaactttgttaaaatcattttgattgttgtacaagtattattttcagttacattaaccattccgtcctcacatttctccgtgccaaccagcaaatttgggacaaagccatcagtttggatttgtatgtgacttccgcccataatgccaagaaagtacagcaaatttcgaatgattttgcccgtgaaatttggcccatttttgcgccaaacattcgccatttgaacgtttacgatgttcaacattaccacaaattgcgtcgtcacatttcaccaacaattctcattgatcttgatcagttgaattcaatcaattccaatcatttgttgcccggtgcaattgccgatgatggaccaaatgcaactgctggccaagcgctgtccaaatggttgcacactccgacaaaaaatagccaacccaagcgattgagttgctgtgaatatgcgcatacctcagaaaccaaaggatgggtcaacagtttcaaagaggtgtgacccaatttcgtaaatttggaaaaattgcatttaatttcggtttccatttgttcaggcatttctctgtgccaccgtttcttctgccagctatttaattcgccttgcgctttatgaatcaacggaaattgagccatttgaattgataaacgaacggaccaacgaaatgctgacattggagaaagaagaaaacaatgatgaaaatgtggatgaagaatacggttataaatggcacgagcgatggctaatgaagcgatgtcaaattgggaagacaattcaatgggaggacaaaaagacggacaatttgaacaatgtcatcattgcgttttatggatttgggtgagtggcaactgcttttggcatttttaaactgttcaaaagatttaaattgcgcttcatttaggccattgttgcaaccacagccaggccaaattaacgcaaaagatcttcttgaaatgaatcccgggcccagcggacagccgaagaaatga

SEQ ID NO: 55619 - DNA, 117 bp, Heterodera glycines
  Genomic contig location: Contig_ID=SeqID_4755; Location=1988..2104; Strand=-
  SCN-specific regions: Sequence locations=1-117
tcttcgcatgctcccttttgcgaaatttttgcttttaaatggttatttcttttggtactgaagtgtccattttcgctgggactcagttgtcccagtgcttagatggcattggttcga

SEQ ID NO: 55620 - DNA, 230 bp, Heterodera glycines
  Genomic contig location: Contig_ID=SeqID_24870; Location=445..674; Strand=-
  SCN-specific regions: Sequence locations=1-2,149-149,174-195,218-230
atgggagagaaacgagaggaaaagggagaggaaaaagagcagcaaaagagagaggaaacagggaaaatgggagagaaacgagaggaaatgagagagagaggaggaaaagaacagcaaaaggaaccgcagaggaaaaagaagcaagagacgacaacaacaaaagcagagaagaacacccgcgggcaaaacggagggccaacggaaggccaaaaagggccaaattcaaaaat

SEQ ID NO: 55621 - DNA, 712 bp, Heterodera glycines
  Genomic contig location: Contig_ID=SeqID_24872; Location=330..1041; Strand=-
  SCN-specific regions: Sequence locations=1-712
atgttggacgaactgtcgcaacagtgccgaacggagcgacaaatgccgaaaaaggacaaactgccggagaaggaagtgagcaaagagcaaacgacaacaattgtattcaatttccagcaaacaaagtctcccgctcggaatgaatcgcccgacttggacgagttggaagccgtgcaaatggcactggaaaaccgcgtccctcccgtggcattccgtcttcagcaaatccaaaaccgactgaatgcaatctcttcccaactctcaacgtcggcaagagaccgttaccagcagcgcattcaattatttgtgaacgactttaatgagtgcgcgaaaatggtgaaagcgaagaaacgagcgatggaagaacgattagcggatcagacgaggataagcggacagatggaggagttggaattctggtgcgacgaaacggaggcactcgtcgtaagaacggcacaaaccgaaccaaacgcccaattcactgtgccatttgtaggaatttgatgagccattgggcgctttgaacatggcgaaattggagaaacataccgaaaaagttcgggaacggcacgaatccgtcgatgccaaaatgaattctttccgaaatttggacaaaatgaaggacaaattcgtcgcactggacaatgttgagcaacaggcaaagcatgaagttcgcagaagtgtggccctattggggaaaaggatgagcgat

SEQ ID NO: 55622 - DNA, 471 bp, Heterodera glycines
  Genomic contig location: Contig_ID=SeqID_24873; Location=236..706; Strand=+
  SCN-specific regions: Sequence locations=1-198,220-284,322-471
atgaccaaacagcacgaggacaacactttgggactgcggtgtcgcctgaagatgaacgatgcccagttgcagacgctgggcaaaaccattcagggcaaggtatcaaccaaagtgatggccaaaaatgccaatatttgcaaaactctgggacctcgggagagggatgcaatttttaacgctaagtctgacacaaacccttttaaatatttcaattaatttaggacgatgaaatcaaagagttaaaagcgatgtgcgaggaattgatgcagaaaaaagggataatggacgatgatgaagacgaggaagaggaggacgacgacggggaaatggacggcgaatagaacaaattttaatgaatgaccgacaaaatacccccatgattgtatgccctacatttttctacattaccctgtacaattcacttattatgggattgattttattatggctgcctattgatgataagcctaa

SEQ ID NO: 55623 - DNA, 844 bp, Heterodera glycines
  Genomic contig location: Contig_ID=SeqID_24874; Location=430..1273; Strand=-
  SCN-specific regions: Sequence locations=1-37,60-377,410-741,768 -787,813-844
ctacattgaccattctgtgctcacatttatccgttcaaacaagccaatttgggacagaatgggcaccaaatttgagttttttgcgaaaagcattcgccagttgggctttaccagtggcgatgcctttgacaatttgcgtcgtctgatctcgccgacaattctcactggtcttgaccaattgaattcaattgattccaatgaactgttccccgatggaattgctgacgatggaccaaatgcaactgctggccaagctttggtcaaatggcttcacactccgagcaaaaatggccaaccgaagcgattgtatcgcaataattattttggtccacagaatctcgaatgggtcaacaacttcaaagaggtgtgtctagccatattttctataaattgtttttgtttttccaaatttgtttagacatttatcagtgccaccacttctgtcagttacaatattcaactttattttcatgtgaacacaattccaactgaaccatttgaattggtgaacaaacggacgaatgaaaagctgacactgaaacaggagatcgacgaattcgacgtaaatgtgtataattggctgttgcaacggtgcccaattggggagacggcgagggtgccagcaattaaatggggagacagcttaaatccgagtgccaatttgaacagtatcagatttgatctgtggagtttcgataaatccattgagtgagcagcagcaatagcatttgaattttatcgaaaaataaaatatttaattaattttaggccattgtcgccaccaacggaagaagaaaaagaagaagaagaagcggataaaagcaacggaaatgtcgtctgctga

SEQ ID NO: 55624 - DNA, 1368 bp, Heterodera glycines
  Genomic contig location: Contig_ID=SeqID_24875; Location=234..1601; Strand=+
  SCN-specific regions: Sequence locations=1-301,324-339,379-409,431 -440,462-719,742-893,968-1180,1204-1272,1318-1368
ctactgtgtcacagtgaattgtcatgacgaacgtgctactgtagcgaagactttagaatacaacattacaaaagactcaaaagatgggttgtggacgaccttttcagaaggaggaaaatcatttgaaagggttctatttgactttaatgaagaaaagtgcaaggactattcaatttttatcaaaacaaaaaaactggaaattgagaacaaaaaactgctggaaaacgaacattattcacttcttggcatcttagcaaaggtaaattaaaattctaaaattagatgtaataaaaaaatgtatttgaaaataaatgaataagtaattgtaaaaaggtaagcattttataatatttattcattttttatttaaaaatatttgacataaggaatataatattgggaaaaagaattttataaaaattcatttttagaggggcggcatattttaaaaaagctaattagtgagagattttcttgatcattttcaggattatgttcacgtgaataaaaaagccgagtcaaacgggaggacagaattcaacataacttgcaaatatttttttgtcaattttacgccggtgctcacgcgaaaggaggaattttatgagattaaagtgtactgtaatgataaacagcaacaaaatttggtttatcatagtgatatccaatgtggcaaagacggatgccaacgaattattttggcggatgaacaaaaatgccaaacaaatgtctatgacgttcaagtgtggcgctggagcgagcgatggacgaggtaatcgggtcagagttcgggttcaaaatgacggtttttcagggactctattttagatgggcaggacagacaggaatttaggagggtgaaggggctgcatttaggaaaaaagacacctaggtatataaaaagaaaaattttaaacaaaaatgagtaaaatacaaaaaatatatatatatttaattttaaattttagagagaaacttgtcttactgagccaagaagcacatatttttcagacattcatataaatgacggtggaatgctagaaattcaggaaaatagtgacggttttcaaacattggtgaagaaaaactaagacagaagtagatattatatacattctttctatttgtcatggtgtagtattattatctttttcacaattgttgctattttttttttgaaaaaatttccatttttggttttaaggagatttaattgaatttaaaattatacaaagttaaaataatattgtgatggaaaaggtcgaaatttggttaattatttctatcaatatttattttaaaaaaaattttaattttgaatttgaatttttgtggctaattttcggatacttagtgctctaaaatgaa

SEQ ID NO: 55625 - DNA, 1670 bp, Heterodera glycines
  Genomic contig location: Contig_ID=SeqID_24876; Location=100..1769; Strand=+
  SCN-specific regions: Sequence locations=1-313,339-510,533-592,614 -1449,1471-1670
  Gene Ontology: Mol. function=sodium/potassium-exchanging ATPase activity; Cellular component=sodium/potassium-exchanging ATPase complex; Biological process=neurotransmitter uptake
ggtctccgaccgataacggaagagtttcgcaaagaatgccaaatcgcatgggaccatttcggctcggaaggccggcgcgtgttcgcatttgcgaagaaactcttccaagcccctcagaacaccaaattcacggcacaatcggacaattatccccaggacggactcacttttttgggaatggccgccattacggacccaccgaggcaaatcaccactaaccaaacaccaaaagaccaattaacttttactaattaacggtgggaattattaacagaaatgaaacagcagcggccattcagcagtgtaaagacgcgggtaaaaagagaagaaaaaagcaatggaatgataagctaagcgaaaattcaggcattaaagtgttcatgatcacgggtaaccattcgatgagagaaatggcattttaaaatcgaaaaaccaaaaaggcgatcacccgacggcggccagtgctgtggcttcccaaattggacttttcggtctacaaaatgatatggtaatggatattaaaaagcaattaaaaacgattagtccgccaattattccatttccaatcgaaggtaaagtcgcgcggaaatcaacaggtgaagctgagtctcgacctcagcacaaaagtcgattgggccattgtgcttggcgagtcgttggcacaaatgagccccgctgagtgggaccgactgttggcacatcgatacatcgtattcgccaggttctgctggaaattggcgaatgtccgcccaataaaaattttttttaagaacgacgccggaacagaaattacttattgtggaggaatgccaaaaaagaggtgaagcaaaaaaagtagaagaaggctgatgagtgaaacccaaatgatcgcaaaaatttattaattaactaattaggggagaccgtagcagtgactggcggcggagtgaacgacgccccggcgttggccaaggcaaacatcggaattgcgatgggcgttaatgggagtgacatcgcccgaagggctgcggatatgtgagaggagaggggggggggagtggcacggcaccacccaattaacgcataaataaacattttaaactttctaaaatttatgatttgcaattattgtctcatttgactaaatcacttcctcttgagtgtgctgactgatgacaatttcgcctccattgtgaagggcattgaagagggtcgtcttttgttcgacaatttgcgtattttgccccccgcggcgtttgtcccaccaactcattcgccatttagggctgtccattgcgtacactttggcccatctttggcccgaagtgtgtcccatcattctcaactttaccctcggaatgcccttgggattggagccactgcaggtgaatcatcagccgatgaaaagaactgacggagcaaaagcatcaatctaaacagattctcagcatcgatttggccagcgaattgccccccgccgtctctttggcctacgaaagccccgaaaggtcggcaaaagcgaccaaatgcaacgcaatgcctttgaggccctttcagagacataatgaaaattccgccgcggaatcgaaatgccgaattggtgtccagccgactgctgctctattcctatttgttctccggcacttttatcactttgggatgcattggcgcttatttgagtgtttattggt

SEQ ID NO: 55626 - DNA, 572 bp, Heterodera glycines
  Genomic contig location: Contig_ID=SeqID_24877; Location=370..941; Strand=-
  SCN-specific regions: Sequence locations=1-125,147-149,171-292,315 -409,434-499,525-572
atgcttaaaaatgcacaagcagaaagtaatatgaaactaccaatctcaagcaacaaattcaacaagtacgaactctacaaatttcgacatgcgactatggccatcgttgaaaatatcggagtaacaaatacattcatttccaaatttacatttttcttgttttgtcttttagttttctacttctaacagctccgcagtcagttccttgtcttttctgcttagaacttattttgagcaattgtgtcgcgactcgcttaactcggccattaattgtgattttcattttctccccttcatttatttattttacaaattcagctggtcgtgcagaagttggcttggaagatgtttcttatgttttcggagccaatggaattaatagtaaattcgatgtccctccgatttcccatttattgtttgctttttgtttcagtaactgaacttcatgattatatccagcaagttcaaccatatgcggctgatgaggtttttttcacccattattatttatttttttaattattcgttttcttatttaagcatcctttgtttcccgtcactgaaccattaaa

SEQ ID NO: 55627 - DNA, 206 bp, Heterodera glycines
  Genomic contig location: Contig_ID=SeqID_24877; Location=1238..1443; Strand=+
  SCN-specific regions: Sequence locations=1-206
ctttttgcttttctctcccgctcactgactttcccaaaacaaacaacaaacggtcgaaacaacaacaaataaaagtaaaagtaggggaaaccatacggacagaaaatctatgcacagccgagcatcttttttacggtgtattgtaaaaacagcgaaattattcatttttcgccttatttacatttagtaatgccataatttttttg

SEQ ID NO: 55628 - DNA, 742 bp, Heterodera glycines
  Genomic contig location: Contig_ID=SeqID_4756; Location=685..1426; Strand=+
  SCN-specific regions: Sequence locations=1-21,62-254,279-362,394 -711,741-742
atggttagtttactttgaattcattccagggaaaatacaaaaaattcttcatttttaattagaattggttaaatttttatagtactttggatttcacaaatttcccccgttatttacttcgcaatttgcaagcctgttgttggaaagtgactcgacccaagccctgtataataaaatacgcttattgataaaaaaatcaatatttccatctttctataattgttccattttttaaatgggattaaaagtttttgataaatatttaaaaaataattaaactgaccactgcttttattgaaaaatatcattggaaaagacagatttttgattttgcagtttttgtgaaccgacaaattataaggtttaaaaattattcaaattaaaaaaaaaattcattcagatctcttcgaaaaaaacattgaacattgttttatctttggcacacttaatgccattaattagcgaattctgcctccgccgctatgcagcacttgtcgttttcatcgttttctttttcgaacctatgtatgaactcgctatgccacttgacatctcatctgctgtattaattaatcacatttaccatttttaattattgccatcgtttggaaactattcattttaatcagcagcggctctcacttaatttgttaaccgtttcacttaaagattctttaaatcgcatttcaatcaaatttttgaagaagttatattcaatttttgcttctttttctttgtttta

SEQ ID NO: 55629 - DNA, 1180 bp, Heterodera glycines
  Genomic contig location: Contig_ID=SeqID_24882; Location=261..1440; Strand=-
  SCN-specific regions: Sequence locations=1-51,88-209,244-685,707 -982,1004-1180
atgaaggcccgcaaaacaggagtctacacaaccaccgttttccgggacaggtaaatattttgaatattaaatatttttaaaatttttgatcactttagttacaagttgatcccaataaaacttgccaattttgtcaagacgtttggtctagaaattgagggcgtggaaaacaagaaatattttccacacaaattcaataaggtaagaggaatttataaaaaaaaaaataaataaaaattaatacaatcttaggcggaaaattatggcactgtgctggacaccctgccaccaattgagaactattacccaggtggcctcttcccggcagagcgcgcaaagtttgagcagtggtacgacgagaaccgggaaactggttttgagctctgtgaagtcatcgcggactactgcaagacaggtacaatttttgaaaaaaaaacatgcaaaaataacaaaaaaaattgaagatgtccaaatcctggcccatggtatggtaaagatgcggcagctgttcttgtccgagactcggcatgacatcacggattcggtcaccatcccgtccggctgtatgaagtattgggtgcagttggctcaccacgacaaagaacgggttgccatcatcccacacttgggatacgagaagcgaggcaaacagagctccatcgcccggaaatatttgaaagtgtatccaaattattttaattttacattttgtcgactctcagtggcgtgccgaagaagaattgcgggagaatggccgagtcctgcgccatgtcgaaagccctggaggggagttcaaattcggcaactacagcttagatgggatgatggagcgtccagatgaggacaaaaacttggccattgaggtcaatgggtaaggaaaaattccaaaaatgtgccaatttacccattgaaaaggtgctattggcatggatgcccgagctgcttccccgacgatgcggcaattgtgggcggaggagaaacggccggagccctcagggcccgggacgcaaaacgaacccgggacattgcgcgggaattcgaagtggaagtgatttgggagtgccacttgaacgcaatgctggaggacaacccagccatgaaggcgtacttcgacaactgcccggattctggcccaattgacttccatgatgcattctttggcggtaccttttccatttaa

SEQ ID NO: 55630 - DNA, 351 bp, Heterodera glycines
  Genomic contig location: Contig_ID=SeqID_24883; Location=686..1036; Strand=-
  SCN-specific regions: Sequence locations=1-77,100-191,213-351
atgcccgatgaacgtgttctacacctcgagtgctttgagagcggtgattatgatgtaaataattgttgaaaattccattttttccctcaattttaatccatttcagatgatggaattgtacggaccggaccgcgctaaagagatgctgatcgacttgcgcgactatgcagaggcgcacggaatgccatgtaaacatgtgaagatgctgttgtacaaactggacaaaggactgatcaaatggaagggaaccaagccatgaaatggatgatgagtgatcagatattttggtgacaggacgaaggggggatgattgaactcattggtgatggatgtgatttaaaaaaaaataaa

SEQ ID NO: 55631 - DNA, 819 bp, Heterodera glycines
  Genomic contig location: Contig_ID=SeqID_24884; Location=403..1221; Strand=-
  SCN-specific regions: Sequence locations=1-235,257-609,653-774,803-819
atgtcaaagaaaggtcataaacaatttctagaatacgttgtgagcattttttcgagtcataacttctctgaacattgtcagagatgttggcaatatagcagcttaatagaggtcagttaggaatatggatcgatactaaatatgttggatattgttggcaaagaaaaaagttatagccaagaactggcgcttgtactaaaacgagccgtactaaaccgagccccccgacccgtttaaagttatgaggtgctgaaaattttgcatttatttctctctccttttggacagcagctactctttctcttcgagtggtgagtttgagtgcggggcgggggaatggcacaatttcaatttgtgtccattaattaaactgaatttttagattccgaggagagcgaagaacagggcccgtagaataagaaggtggttaaatgaccgggtcaaacgaccatggttaaatgacctggtcaaatgaccatgaagttggtggtaaacccgtagaataagaaaatgaccacgaagtgccgtttttaccaccaacctccgtcaaacgaccatgaactatgatcttattctaccgggttatttgaccacgtgcacttttgggacaatttgtttacacattttttatggaaaaataacttttgttttttaggtctatcgcataacacatcattcctattgatcaatttttatgtttacccaaaatgttacatgtatttttgcaccgccaatatattatttatttgtgagttaaagacgaatgatcaactcataaaataataatattttataattaaatctaagatcacaaataaa

SEQ ID NO: 55632 - DNA, 739 bp, Heterodera glycines
  misc_feature (19)..(19): n is a, c, g, or t
  Genomic contig location: Contig_ID=SeqID_24885; Location=515..1253; Strand=-
  SCN-specific regions: Sequence locations=1-65,89-120,177-177,267 -272,336-349,379-415,443-659,692-700
acaccaaaatggacacccntttcgggcgcactcccgttttaccgattaagtaaggaatcgatgaaagtagtggtatttcactggcgccttgcggctcccacttatgctacacctctcatgattcttcacaaagtcagactagagtcaagctcaacagggtcttctttccccgctaaatttgccaagcccgttcccttggctgtggtttcgctagatagtagatagggacagtgggaatctcgttgatccattcgtgcgcgtcggtagttagccgacgaggcatttggctaccttaagagagtcatagttactcccgccgtttacccgcgcttaatcaagtttccttggcttaacattcagagcactgggcagaaatcagacacggtcaacgtccacaaggaccatccgtctcctctgttttaattagacagtcggattccccgagttcgtgccagttctaaactggtcgttcagcgccaaccgaagtgcataccctgacgagcatacacgcagctgaagcgctccacaagcagctctcaccactagtccacgcaccatccccgaaagaacagcacgcagccacgggcaaaagccgcctgtttcacgcaacagcccggctgacccgacctttagagccaattcttttcccgaagttacgaatctaatttgccgacttcccttacctacattattctatcgactagaggctgttcaccttggagacctgctgcggatatcg

SEQ ID NO: 55633 - DNA, 1455 bp, Heterodera glycines
  Genomic contig location: Contig_ID=SeqID_24886; Location=959..2413; Strand=+
  SCN-specific regions: Sequence locations=1-407,489-638,660-880,906 -950,973-1146,1168-1178,1392-1455
  Gene Ontology: Mol. function=guanyl-nucleotide exchange factor activity; Cellular component=filopodium; Biological process =lamellipodium formation
atgtacagcgaatacaccaacaattacaaggcggccattcaaatgtttgaggaaagcatgcgaagaaagcgcaattttgaaggtgaacaaatggaagcggggacaaatgatcaaaggacaaaacggggaacggacaaatgatcaaaaaaggggatggacaaattgtcgaaaaaatggagaaaaatctgatcagatcacattcatattttagaattggtaaagcgagctgaacagtgggaggaatgtgagcacttgtccatggtgtcccatctgatctgcccggtgcagcgagtgatgcgctaccaattgttgctgagggtcagtgatcggagggatatttatttcagaaaagattgattgattaatcagtgacactgatcagtgatggaagcgtgatcacggtgatcagagaaagagaagagagagagagagagaaaaggagagaggggagagagagagagagaaagaaggagagagagggcgagggatttcataaaagagatgaaattgtgatcaactgagttgatcattttcattatcgaatgaattttgattattaaatcaatgatttgttcatgaatagagatatggataagtgagtgatcagttttcaatgctaaggtgatatgataatatataaataatttcaaaaatcaattaatgactgtgaagcaaaaagtgatcagtcaatgatcaagaggtataaactgatcaatgatcgaaaaaattaattagtaataggtacattatttgattactgtacatcattttactcatacgatacccaaggcttgatcaatcactgttatgtgatttgtttcaggaataccaacggcatctgagctcaacagaccccgattgggaggacacagaggtagccaatataaaaattaaaattaaaaaaagaaagcgaatatttaaaaaaacaaaaattgaaaaaaaggtatccaataatttaaaattcaaaatttttcaaaggctgccctttcgcttgtgttagaagcggcttcacatgccaacgaaatgatgcgcaagcttgacaggcaaaaacaaagttaaaattgtaaaatttcagatttgatttgggcaggtatcgaagtgtgttggaggtgcaggaactgttgggcaattgcatttcattggtaaattattacatatttttaattgatcaatttgggttaattaattttcaaaaaatttatttaaatattttattcaattgaccaatttttctttatttatttcaaaaagattaatttattgactattcttaactttttttttgaatatttttataaataatttttacttacctaattaatttaatatatttttttaatatttttaattattttaactttttttcaattatttataattaaacattttttcttcttttttaggttacgcctacacgtgaacttctgacaaaagctcgtctttggaagtgtactg

SEQ ID NO: 55634 - DNA, 1845 bp, Heterodera glycines
  Genomic contig location: Contig_ID=SeqID_24888; Location=432..2276; Strand=+
  SCN-specific regions: Sequence locations=1-296,333-337,359-493,515 -733,786-1059,1090-1330,1352-1391,1413-1649,1672-1845
actcatgcaaaggccatgaggacaagtgtcaaaactggggctatttgaacccaaatgattgcacaaaatgccattgtccggacggatacggtggtcaaaactgtaaagaactcgaagagagtgagcattaattccatcaattaaaacaaattatataaattaattgaagatttgaattgtgaggatttgagtggaattgcaagagaattggtggccaataagtcagcagtgttttcgaagacgaaggccaaatgtggggggaattggccgtgccgatgccattggcgaattaaggcaataaaataatgtttagaaaattataaaattattttgagtgttattaatgcaaattttaattgctttcagcctgaagcggggaaaaaggcgcgaattcagttcaaaagtttgaacaatttgtttgaatgcacatacaactgctcatcggcgtatgtcgaggtcaaataccgagccgacgaaagggcccaaggcaaaaataaataaacaattaactaattagttacaattattaatgattatcaaaatattgctcattaaggtgccaagctttgttgtgccgcatcactcactgatctgaacgcaaatgaatataaaaattggattgcggcggaaaagccggacatggacattgtcatatccgcgtgcctttcaccaaaatggaccgtaccatctaccgtattcgagctgacgtatgaatcaggcaaggaaaattgtgaaataaatttttatatattttcaatatttctataattaatttattttaaattgaaaattgtctttatttcaatggctttcgtaaatcagaaccattacacaattaaaactgttcaaaaatgttaaggcaaagtcaaactcataaattcgaacaaatgcgtaaataccgataatttgtttgccgagaaaaggaaccccggcaccggcggtttgaaatgttatgacgagatcaagcaccaatcttatgactgctcctgtcacggtgatagaaatgcctcgctgaagaaaaatgggcgcacgacgcctttctttgtccaataataaaggtaattaattaatttattattattaattaatgccaaaagacaccgccacagacaaatttcatataatataggcaatttaatttttaagtagagtgaagcgggactgggacctggtagcggacaactgagtaccaaggttccgggtttgacatggacctggggactagtcccggttttcccagccaaaaattaacggtttttcaactcgaaaaggtcccggtccggttttacccaaattcccggttccgcttaactctatttttttgtatcaaaaaaccggaaataataaaaaatagggacgataaactggaataaggataaatatgacaaatgataaaaactctattttattaattaatttgaaaattcaggtcaattcaatttcaaatcaaaggaagccgacacgagtgtttactaacccaaaagattttcgatacaattggactcggattgaggttgattgttatgtgagttggggttttctaatttcaaaatttgtttaattgattaattttacagaaggccgatgcgggcaccgtaagcttttggggctacagtaagccggagacaaaggaaatcattcgggtggacgaagtccactgtttgacttatgaaactgctggagtgccaaaacggttcaaaagtttgcaagtcgaagaacagccgccgatgaaaaaactgaatccaagtccattcttggccatgcttcatcacttatccatgtgttcgtgccatttgttggccatccatgagagaagggggaaatcagtgatcagtggatctgtct

SEQ ID NO: 55635 - DNA, 401 bp, Heterodera glycines
  Genomic contig location: Contig_ID=SeqID_24889; Location=808..1208; Strand=-
  SCN-specific regions: Sequence locations=1-316,338-363
atgctgctgcttcccgacccccctctcccgttgctgctcctccaaaccctgctgctgctgcttctccgtgcttgccccgagctggaccatctgctgctgctttaaaacatggggagggggtgacattttaaattacaatttgtaggaagtgatatttctcaccgaaaacataatactctaccaaggggtagagtatgcctacacaagtcccgccctccccatcccaatttgccggtgtctggtggccgcgtcttcatctgtaggcgtgttggatgtgccaatacaagaattggacgctgttgtgcatggttgaatatgaaatggggaacagatgaaattattaaagaccccggggttcataagaaaaaataaaaacattttttgtaatttttttaaataaa

SEQ ID NO: 55636 - DNA, 860 bp, Heterodera glycines
  Genomic contig location: Contig_ID=SeqID_4761; Location=203..1062; Strand=-
  SCN-specific regions: Sequence locations=1-34,56-586,609-709,738-860
atgggcattttggagacgaagccgccgaaacaggagggaatggcactgttgggagctaacaggtgagaatggtcgacggcaattggccacggttaattgttgaagtgtgataattggtgaaaagttaggacaaccgcacggggttttgttggcaaattaaaatcaaaaacagccaacatttaataatataaaatgacaaaattaggcacaaacatttgaaactcttaatgaattgtctctcagctcaaatcgtaattagccttgtgaattggttaattaagtgcctatggacagctaatgagcggaaattatccgacagcaactgcggcaatgtattattatgggtggccatcaatgaacgaatggggtcagttggacaaggaaatatctgccgaccagaggggagacaaaatgccaaaaaccctccaaaaataggatcagcagcagcaacggcgtcggcaaattcaacaatgatcagtaacgaaggcgaagcaggcggagaaagtgccgaagcagcagcaacatctgaactgattggcacaacgccggcaaaagcgagtgccaaaaggagtagcaacggatcaacgccgaaaggcaaatgccaaagcaaaagcggtggcggaaaaagcaaagggaacggcagcaacgagcagcagcactcggatgacacgaaggtggagaacgaaagggcgacggcatcgacaacgagcagtacaaaaaacaacaacaacttcacatcgtctcttggcacagtcggtggaacggcaccggcagcgatggcaccattccttgcggcaatgaacccggcgggatacggtaggggcacaattgggagaggattcatcggatggggggcataa

SEQ ID NO: 55637 - DNA, 717 bp, Heterodera glycines
  Genomic contig location: Contig_ID=SeqID_24890; Location=52..768; Strand=+
  SCN-specific regions: Sequence locations=1-234,257-360,383-717
aaaacgggcgcgaagcgcccgtcctgaggccgcgaagcggccgaatgttccccacaaaattaaaaaacggccgcgaagcgcccgtcctgaggccgcgaagcggccgaatgtcccacaaaaaattaaaaacgggcgcgaagcgcccgtcctgaggccttgaagcggtcgaatgtcccttaaaaaattaaaaaacgggcgcgaagccacgtcctgaggccgcgaagcggccgaatgtcccccaaaaaatttaaaaacgggcgcgaagcgcccgtcctgaggccgcgaagcggccgaatgtcccacacaaaattaaaaaacgggcgcgaagcgcccgtcctgaggccgcgaagcggccgaatgtcccccaaaaaatttaaaaacgggcgcgaaccgcccgtcctgatgccgcgaagcggccgaatgttctcaacaaaattacaaacgggcgcgaagcgcccgtcctgaggccgcgaagccgccgaatgtttcccacacgataaaaaacgggcgcgaagcgcccgtcctgaggccgcgaagcggccgaatgtttcccacacgattaaaaaacgggcgcgaagcgcccgtcctgagaccgcgaagcggccgaatgttccccacaaaattaaaaaacgggcgcgaagcgcccgtcctgaggctgcgatgaattgctaaattacatcactttctagcgacgcggcgaagccgcgtcccatagcg

SEQ ID NO: 55638 - DNA, 748 bp, Heterodera glycines
  Genomic contig location: Contig_ID=SeqID_24891; Location=970..1717; Strand=-
  SCN-specific regions: Sequence locations=1-56,79-194,216-263,285 -332,354-401,423-539,562-748
gacaaagtgacgaaagtgatcattttgctgggaagatacaatttaaaggacatataaaagaaacccaggacaaagtgacgaaagtgatcattttgctgggaagatacaattcaaaggacataataaaagaaaaccaggacaaagtgacgaaagtgatcattttgctgggaagatacaatttaaaggacataataaaagaagaccaggacaaagtgacgaaagtgatcattttgctgggaagatacaattcaaaagatataataaaagaagaccaggacaaagtgacgaaagtgatcattttgctgggaagatacaattcaaaagatataataaaagaagaccaggacaaagtgacgaaagtgatcattttgctgggaagatacaattcaaaagatataataaaagaagaccaggacaaagtgacgaaagtgatcattttgctgggaagatacaattcaaaagatataataaaagaaatccaggacaaagtgacgaaagtgatcattttgctgggaagatacaatttaaaggacataataaaagaaacccaggacaaagtgacgaaagtgatcattttgctgggaagatacaattcaaaggacataataaaagaaaaccaggacaaactcccgacagtctctcccgcaaattttgacatttttcaatttccaacgcataataaaagaaccccttcggttgcccttgactatgttccaattaaaaattcgtccatgggcttaggaattgg

SEQ ID NO: 55639 - DNA, 751 bp, Heterodera glycines
  Genomic contig location: Contig_ID=SeqID_24892; Location=152..902; Strand=-
  SCN-specific regions: Sequence locations=1-178,214-241,263-646,668-751
  Gene Ontology: Mol. function=structural constituent of cytoskeleton; Cellular component=actin cytoskeleton; Biological process=signal transduction
atgatcactcccacaacgacgacaatggttttggagggtgctgaagtgccgaattcccaaaaagcaaagggtaagcgaatgaatagagagaaaagcgaattgtaaggcattcgagagcatttcaaagcaggatttgcatgaaaaacccagcaactttttaagtcttcaaatgcgattaattagacataaatattcatcttgggttaatttttgaaattccgtgatccatcaaaaccacacagaccccccaaaagcctaaaaatgccaggtttttctgcaaaataggaatcctgtttcaaagtatggtatggattggctgttattggttttatgaaggtgtttgaattctttttcaaatttaagctatcagatctttttgacagagttcgccaaagttttgtacaattacgaggcggcaaactcggacgaactttctctctccgaagggaccgtcgtcactgtggtcagccggcactgtgaggaggaggattggttcattgccgagcatgacggacggcggggccttttccccgacaatttcgtccgatttctcgaccaaggacaaatgcaggtcgaatgcggtggccgaatgtatttcatgtttttcaaatttaggcttccacaaatgctcaaccgccgtctctgccggcgaaaccctccaaatttagcgcaattgccaacccttcggccaatgcgctgcaaaatgccgttgttcctccgatcagttcgagaaattctgtcaatgctttga

SEQ ID NO: 55640 - DNA, 1047 bp, Heterodera glycines
  Genomic contig location: Contig_ID=SeqID_24894; Location=89..1135; Strand=+
  SCN-specific regions: Sequence locations=1-1047
atgaatgtcagtgacgaagaaatccatttctctcggactgttcgtcatcttaatcagcggctgttcttcggtttgttatcgcaattttcgggaaacattgccattgtttgggacggtaaagcgatgaccacacaatttgacatggtaagcaaaataggcgaagttgaacatcatcttccagcattttactatataatttacagatagttactccgaaattgctacaagagcacaatgtgaccaaaaattacaaattggaactcgtggcacaacccgacacacaacacgtgattcttttttatttttgttacggaatccaagttcttaggttgtctatttgatttatgcgacccgtcaatctgtgttattgcttatgcgaaattggcttcaccaattgcccgacgatgtgagttttaactgttgaggaattatttaatttttacaagttgtatataacatacagcgaatgatttttttaggacttacgcctccatcacgttgtgttcatccccgacgcttcattaactctcagacaacagttgcgtgaagatcaacgcgtttgggatcgtctccaatcggtcgactctttgcctttgcattggttcccgacggaacagcacaaactgctcacgatggagttgcctcagctggtggcgcagctggtgctgaacggagactggaacttcctgttcagatgtgccactgcgatcagacaattggagcaactgatcacaggcagtgacggggcgctcacaatgcgctgtaagggcgaatggtccgcacgcattgtggacatgtgccgcaaaatcagagacgatgttggtgggaccagaccaagcgggaggagtgctttcatccctttgaagcatttcgattgtttaagcccaatgagaagaaactgccgctggagaccgacttttttcccagcatccacgggttgcgggcggtgaacgaaattgtggtcgtggaccgatgggtggacccgttgagtccgatgtttcaacaattgactttcggaggagcatgcgacgagttgttggccattga

SEQ ID NO: 55641 - DNA, 762 bp, Heterodera glycines
  Genomic contig location: Contig_ID=SeqID_24895; Location=485..1246; Strand=-
  SCN-specific regions: Sequence locations=1-359,381-612,634-722,750-762
atgcttctgaccaatccaaatgagttcagcaatgagaagcaacgatatttgtttgaactgagcatttattcgaacgaaatttggcaccgctttttggcacagagacattttgccaatattgccatccaattttggcattcaaaaacgaattttcttgttgagaaatggacagaaattgaaaataagcaaataataaatgaaaaagacgaacaattgaagatggaactgcacgaaatgttgagcaatttttccacagattataagcgaaattttgaaaattttggttggaaaatttttggcgaaatattatacagaaattggttggccaggactctgttgtccaatgctcgactgtcagaggaatggaataaattgaacaaagattctcagaccaaagcaattacggtaattttcgctgcagtaaatgaaaaccggaaaagcaaagatggaaaacgcaaaaatatgcttaaatacatggaaaaatggagaaaaacgctggagcaactgaagcttggtaaaaatttaaatttaaattcgaaaaaagcaagaaatttaaataaaacagttctttaattgttttaaattgattttagataaaagcatttttgatgattttgttgaaaagaaatatttgattggacaaatgccagcgtattggcgagcacacattgaatatattcaagaaattaattgtgatattatgtccaatttccctgaagccgtaaaatatatttttatttaaatttaatcattcgaattaaa

SEQ ID NO: 55642 - DNA, 1368 bp, Heterodera glycines
  Genomic contig location: Contig_ID=SeqID_24899; Location=1133..2500; Strand=+
  SCN-specific regions: Sequence locations=1-121,167-173,291-379,405 -452,536-771,793-798,827-1190,1212-1368
atgactttagccaaagttaggcggcgctggccgattggtttttgggcccattatatttttgctcgttggtcacaaagaccaaaggtatggcacagttttttttggccattttactgaatttatatacatagatagatagatatatgtgtgagttttgattattttagttgttcatttattttattatttactttttcgtaatattaaacattatattttgattttaattcctaaattaaaaaattaaatcacatttatacttattttgatttaaatgtttttttttatttcaaatcattggtgagtgctcatttgcgcctccacatttgcgcctccacatttgcgcctactacatttgcgcctccacagttgcgcctccatatttatataaaataatttaaatactcaaaaatatttgctataatacatttagttggacaaaccacaatacatttatttttttatattttctttgtttttgtattattttcttgttttttttattttcttgttttttattatttcttgtttttttaaaaagatgctcaatcgagccaatgatcaattccttttgtggtaagtcgaaatgacagtgcgtgtaaatgtgtaatccatctttgatcatcacgctgatcaggaccaaactgatcaaattgttcaatcagatttttgatggctcgatcattttccaaatattttttggtgcggggtatttcagctgctggacgtgtctggtcaatttcatgtggtctcattttatttctttggtattcctcttcatctttgatttttaatatgaaacttaaatttgaattttaaaaattgtcaagtaattattaatttacgttgataaggggggtttaggtgctgaaaagcgtttgttgaagcttgaatgaaagccttccattccattattggttcttccaagatctgcagttaccgaatcatgcatgttccaagtttcaggaataaaataagctggtcttcggtttccgtcgtcatcaaggcgaaaaagataggttcttaaaaatttcaaagcattatggtcgaaaaaccaatgaaatttgcattaatagtaagtttattttaaaataaaaaagatcatatttaatcaaaaagcaaaaacgatggcgacacgaaaagtgaaaaattcgaaggcggatcttggccttctgatgctttatgccgtcaaaggagacggaaaacaagagttatttggatgtgcataatgattttttgataaaatcactcccgttagcccttgggcaaggcaatttttacacatttacacgctctgtcattttgacataccacaaaaggaattgatcattggctcgattgagcatctttttaaaaaaacaagaaata

SEQ ID NO: 55643 - DNA, 378 bp, Heterodera glycines
  Genomic contig location: Contig_ID=SeqID_4765; Location=56..433; Strand=+
  SCN-specific regions: Sequence locations=1-181,203-378
agattcctcgaaagatcaaaatcagcagcagcagaatgaaaacgatgagttcaagcagtacatggatagtgtgtttgctgcaatccgacgtttgctgatgggccccggacggcggatgacctgccaaaatttggcaatgaggcaattggcatcgtccattttggggccaatggcatcggcggaagacatttatgagccaacagaattggccaagttggcgctgaattgatgagtcaaattaactgtggccctattatttaaaagatatgccatccaagtgttggattcgttgtccgaaggtgttttgatgagtcagaggctgcattttgtcggcgaactcattgagacaaaggtggcaattttctgttaatttgagca

SEQ ID NO: 55644 - DNA, 1059 bp, Heterodera glycines
  Genomic contig location: Contig_ID=SeqID_4766; Location=25..1083; Strand=+
  SCN-specific regions: Sequence locations=1-410,433-727,758-1059
ggtgactttgcttggcgacccgacacatcagcggacgctgcacgctctgctgctcggactgttagacaaattttcggcagaaaattttgacgcctattttcgcgcgctctccaatcagttggaacggtaattatgtgtaattatccgacacctttgaacaacaccctgtggccggcgagcttttcgggaacggcttttttggctcagctgatgtgccaatttccgattgaaaaggaggcccaagtcttctcttagtttcgattgtaattttgatctcgagaatcacctcctttctacaattaaattcgaccttttccccgcacttcgttggcattttttgtggttgaagtaagtatctctgttcaggcttgacactctgtccgaaatgcttcacatgttccgcgatttgctcctccgttgtcccgttcccgcggaatggtgccgtccgtcgccactttttccgttaattaatatgtgccaccattttcgcaggcaatcgttgcgccgtattcagctgcgactgttcgccaagcatttgcgaatgtccgccgcgttgtgccgacgcgactttggcacgccggcgcactttgacgcggccatttggtgcgaatgcattctcagttgtgtggcgttggcaaaatgttgcgccacgacgacgactcaaaaatcaacaatgatggcacacaatgccgaggcggaggacaatggcacaacgcacagcgattatgaagagggagaggaagaaaaaggtgagaaatgccaaaaaaaaagatggggccaacagcagaacgggtcccaacccaaaatgggataagacgggaattttgaagcctttagtcctgatttctgccaatttttttgcagactccgaattctgttacgtttaaagcccggaattttgattttccaacaatttttttttgaaaatttcatagatttttaaaatcgaattttggcaaaaaaacgaaattttctttttaagtcttatgtgatcaacaaattgacaattctgaaggtgaacaaaagctgggaaagtatgcgaccgaaattctaaggtaa

SEQ ID NO: 55645 - DNA, 1083 bp, Heterodera glycines
  Genomic contig location: Contig_ID=SeqID_4766; Location=1415..2497; Strand=-
  SCN-specific regions: Sequence locations=1-41,63-195,217-941,986 -1031,1056-1083
atgggccgaccatttttaccattggcattttctttggttttgctgctgctggcggtggtgatcagcaccaattgcgcaaatgcttctccgatcgttggagaggaacagcccatggcaccggaacaaaaagcgacaaaaggcaccaacgacggacaaatgggcgacgacaatcggaccaatcggcgcaataacagtaaatctttggatagagaattagattcacttacactgctgtgaggactagaatttttgacaaatttggagatgactttcactcgcgcagaattagctttaagaggcgtctgtttatcttgcgaatggcacttttgtttttagcactttcgcgccgccataaaatgccaaaatcatgcgattttggcattagcttaattggcacttttagtggctgctgctcagcatcaacagcagaaccgcaacgccacatccttggtggcacttggctggttgggcttgcgtagcggcgcgagcagcgtcaacgcggtcaacgtggcgtcatgttacgacagccgactgtccagcttcataaacgacggcctccgctattattcggcacttatttttcggcacaattttaaaaaaatattcccaaatttagcataacatgggccaactgtctaaatacatcattgaccaggttcagtacagcacaacacagaaatgcaaattcaagccccccttttcctcgtttagattaagcgtgtccgctactcgggctattggtttgtgcatgcggtaggtaccgtataccaatacaaaacacacggatgaccattttgaaaaatgaaatgtgggaactacggtacaattcaaattatttcgcaggcaatgatcggcggacaaacacagggactccaatggcagtcgcaatcgaacggggacatttttgcgcagacgagtcggcacggatgtgtgttttttggaaaaaatgaaaattaaaaaattaaactaaaaatttaaaattttaggctattaccacgacacacagacatacatcataatcatccgatactgagaaagaaaagaaaggaaagtaatgttatgcgaatcaaagaaacgaagtga

SEQ ID NO: 55646 - DNA, 723 bp, Heterodera glycines
  Genomic contig location: Contig_ID=SeqID_4767; Location=1353..2075; Strand=+
  SCN-specific regions: Sequence locations=1-64,94-549,587-723
  Gene Ontology: Mol. function=small GTPase regulatory/interacting protein activity; Cellular component=plasma membrane; Biological process=myoblast fusion
atggcggaactgttcacccaaggtacagtaattgggaacagtaattttgatttgcataaaaatgatttttacttaaattccaaattattaaaaaccatacaaaatgcttcaggcgagcactgggaattggccattgaaacaaatcgggaattggccaacatttacgagacggccacctttgactttgccaaattagccgatttgttggcacggaatgcggcgctttatgataaagtgacgaaaacactgcgcatggaaagccactactttatgatcgcattttatggcaaaagtgagggatcaatcgatggcacaccaaaatgccaaaaaaagagaaaaataataccatccctactttcctcttattttaaggctgtccctcccatttggtcaccctcaaatttgtggcccggggccgtcccctggagcaatggggctgtttcaagcagcgatttgtggccaatttctccgacttcaaatttgtggacacattggacaactgcgaggagacttaccgagaaatgaacggaaaattccttcaggcaacagaaaaattttaattttttgttttttaaaattttattttcttcctcagattgtgccggtcacgccgataccgctgaaggaggtgtatgccaaactgttgcagaacagtccatgccgtttggccagttggtactacaaacatcacaggtggttgagaatcagcgcatttttgggcaa

SEQ ID NO: 55647 - DNA, 1182 bp, Heterodera glycines
  Genomic contig location: Contig_ID=SeqID_4767; Location=2402..3583; Strand=+
  SCN-specific regions: Sequence locations=1-77,119-407,438-517,540 -627,649-999,1033-1182
atgggcccagtggtgagtgagttggacttggacccgttgaatccggtggaagtggccattgaaaaaatgcgcgagggtatttttaattaaaacaatttaatttatttaatttaaatttcttacagccaatgacaaattgacagagactgcggcaatggtcggcgaaggttttgcccagtcattggtcaatttggccggaatgattcgcggcattgttcaggccgatgttggcggtggcatccgtaattaccaggtgaattaatggtcggacttcattcaattcctgctaatgtgattatttacctacatgcaaaacaggaatggggtcgagtccttcaatcagtcgcgaagtggcaaaatgtggaagcaaaaaagggggcggggtgagggcacgagaggaattttcgaaattttttttacaatttaaaaaaatttatctaaatgtctccttactgatgccgaaaggtatcggaaagcctaatttcctcacattttttaattgaaaaacccctgggaatttaataaaataaacaaaatcaattatagctacagtaattggtgtttttttctttaccccccccccccatttaagccatttttctcggaggaatcgtacgccgtctgtacggaggaggaacggaatgccattgggacgctgaagcggctgattttggagcaaacatcgcttttggaatacgctttgtacatccattctcaggtgctaatttggtacatacagttttatgatataacccccccccccccccctaaatttcagagtgaacgtgcccaagcgaatgccctcttccacaattcgttggccggctctttcatggagcatcgccagcgggtggagcattggctgggcccggtcaagtcggtgctgcctgaaaagacgtccatttacatgttggaagcgaccgcagcagcagcggtggagacgatgacgtcactctctcacgccgtaacggatggaagcggagggttggaaacattttgaaaatatttttaaatttaaaaatgtttaaaattcagtcgcaaccaatcggcgcaacaattgtccgctgtttcgtccactccaccgccacaacagaaactgacgcggatgacgtcactgcatgaaaatgggatgacaacaacaaacaacaacatgatgatggtctacccaacagcagcagcaag

SEQ ID NO: 55648 - DNA, 190 bp, Heterodera glycines
  Genomic contig location: Contig_ID=SeqID_24900; Location=51..240; Strand=-
  SCN-specific regions: Sequence locations=1-7,176-190
ggagactaagaaaaagctgaataatccgagggagacgaagaaaaagcggaagaagccgagggagactaataaaaagcggaagaatccgagggagacgaacaaaaagcggaagaaaccgagggagaccaacaaaaagcggaagaagtccgagggagaccaacaaaaagcggaagaatcccagggagactaa

SEQ ID NO: 55649 - DNA, 843 bp, Heterodera glycines
  Genomic contig location: Contig_ID=SeqID_24901; Location=186..1028; Strand=-
  SCN-specific regions: Sequence locations=1-145,309-392,458-566,596 -616,652-820,842-843
atgcccatggaattcaaaggcggttgggaacaatatgctgaagattattgtttcatccaaaacacttattatgtggcgccagaagaagaaattcctgccgaaattaatgaacgtgatgagcgccaatttggttactaccaggtacaattagttaattaattgagtaattaaaaatgagtcatggatgaattaattaaaattatttagctaattaataaaaataaaaattaaataataaatgaattaatttaaataaatacttaattaattaattaaatagttcattaattgaataattaaactaattattttttattaagagggcttttaaaatatacgacaaaaattttatttaggctaatcaccattatttttttttgtaatttctttcgtaaaaaaaagaatttttttaatgaaaaccaaaatttgtaaaaaaaataatttttgaatttattttccctttttaaatgtattaaagtttagtgggtgccaattgttttggcactgcaggcagtgatgttttatctgccgaattggatttggaaaacgcttcaccagcagagcggtaataaataaaattatgtatttatttattctgtatttcctctaattacggtatatatttttttaaattaaatttaatttttttaaggcgtcgacttggagacggcaatttcggacgcgcgagcactgcgcagcatgcactctgacaagcggtcgcaagagatgggcaaactggtgcagtacctgaacgagacgctcgagttgcacgaggtgcgccgtacgccccgttactgtatgtttactgtaggatgttaaaacaccataatttactcaaataaa

SEQ ID NO: 55650 - DNA, 622 bp, Heterodera glycines
  Genomic contig location: Contig_ID=SeqID_24902; Location=723..1344; Strand=-
  SCN-specific regions: Sequence locations=1-88,110-225,247-286,311 -478,500-503,546-599,621-622
atgcgcagtgttcggacaagcatacgccgaaaaacgtcagcaggacgacaacggcaccggctgaggccacgcattgacacggaaacggcactgttggatggacggaacagtgcaagtggggcaatgagccgaataagcaactaccaaagtgttgtgctacaacaggtacagagtaattggctaattagtgctgtaataaatacaataattaattttaaacgcctgtatttggctaattagtgctgtaatcaatacagtatctacaaaaaggcatcttttcaaatactataatattaaataaatttttataggatttcaacgaacacggagcaaagccgagatcaagaataaacacggcgtatgacatcatcctgatcacttgtgatcacaaaaatgaaaagagtgcccatgcaaaacggcacatttcattgccggacattgtgattgatgctgcaactccaaagatggatgaaaagagcacagcagaaggtgatgagagacagaaatttattaaaaattctaaataaaacaaaaaaaaaatttaagtacatttcaaaattggagaattcattttcaagttcaagtacctaccttaaaattgtacataaaatttggaaataaa

SEQ ID NO: 55651 - DNA, 1074 bp, Heterodera glycines
  Genomic contig location: Contig_ID=SeqID_24903; Location=778..1851; Strand=+
  SCN-specific regions: Sequence locations=1-97,267-354,394-436,466 -553,590-639,673-782,914-1074
atgactcatggacaatggataaaatatttgtacaaatttagtctaattatttttacatttcatcaggttcgaaaccaggagatttaaaagatcaaagtaaaataataaatataaaatgtttagtaaactaaaaaagtagttttgaaatttcattttaatttttaaaaattaaaaaaatatttttatttatcataaagtgaataaatataaaaatcattagtaatagtaataaaaactagaaaataaataactttactaaaaatattgactacggcttgtattcaacttattatcgatccccacttattagccacttttgaataccgttaaaaatggcattataagagagaaagcaataaattactttaatttataattaaaatttaattttttgttgttagtaaattttcggtgaaaataatttgagattttataaaattgaacaaaaaatcacaaaattcggccaataatgaaagaacaattattcatatcaaaggagaataatttgttaaaaattgaaaatacttatttaattcaaatgcccgattatgagaatttaaaatagaaaataataaaatgattaaaatatctatttgaaaatgattgtatatattcacaaagattatacggcgaaagaatagttccatttgaaattaaaaataaaatttttcctaaaaatgaatggaatttggccttgtcagtacattttccaatttcaataaacatttcaaactcgttcgttgagcaaataaaagtgtgtcaaaattattgtaaccaacaactataaaacataaaaaaaataaagatttatttggaaaaaatattaatttaaataaattgtataatgcatttgaaataatatattagtaaaatattattaatacaaaaaataaaaattttattaaaaaaattacctaaaaattgcaaaatatatacaattccagcataatagaatcataaataaggaacattaattttacaaatgaaattctaaaaaaatgaattacttaattatatatgctctgatcagttatctaaattagtcaattatagaaacaaataagtataatttta

SEQ ID NO: 55652 - DNA, 464 bp, Heterodera glycines
  Genomic contig location: Contig_ID=SeqID_24904; Location=10..473; Strand=+
  SCN-specific regions: Sequence locations=1-2,83-96,374-424,458-464
  Gene Ontology: Mol. function=pre-mRNA splicing factor activity; Cellular component=nucleus; Biological process=regulation of transcription, DNA-dependent
atgagaggaagagaaaaaggaagaaagagaagaggaagagaaaaaggaagaaagagaagaggaagagaaataggaagaaagagaagaggaagagaaaaaggaagaaagagaagaggaagagaaaaaggaagaaagagaagaggaagagaaataggaagaaggaggagaggaagagaaaaaggaagaaagagaagaggaagagaaaaaggaagaaagagaagaggaagagaaaaaggaagaaagagaagaggaagagaaaaaggaagaaagagaagaggaagagaaataggaagaaggatgagaggaagagaaaaaggaagaaggaggagaggaagagaaaaaggaagaaagagaagaggaagagaaaaaggaaagtggttgattaattagtgacaaagggtgaggattattttttcaaaaagacaattttaataattttgcataagaaacataatgcttattaa

SEQ ID NO: 55653 - DNA, 1124 bp, Heterodera glycines
  Genomic contig location: Contig_ID=SeqID_24905; Location=98..1221; Strand=+
  SCN-specific regions: Sequence locations=1-183,205-256,278-347,369 -813,835-966,993-1075,1118-1124
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttctccatcttcctttttgatactaaagcatcagaatgctaaaattaagttgtaaataaaattttggtgcactttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgagggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaaga

SEQ ID NO: 55654 - DNA, 1041 bp, Heterodera glycines
  Genomic contig location: Contig_ID=SeqID_24906; Location=430..1470; Strand=+
  SCN-specific regions: Sequence locations=1-113,143-170,197-364,393 -719,741-933,959-1041
atgcgcaacagctgccaaccaatgtcgaagtgagtcgaacaccgtccgattctcataattccctaaagtcgaactccttggataactaaatgcattttaaagagttggttgaccttgtgaaatgaaattcttttcaaatttcgtgcaaatcatccgacgacagtgcctcctctccaaccaccgctttcattgcctgcacgtctgcccctttgtgtcagatttccaaaaaaatgaatttttttttatttaccaaaagcgctgctaaaaaattgttttttggaatttaaaaaaaaaaattttcgtccgggtccggttgcgccgactcttcatgaacgccttctcggccctaccaatggcaaacgtatttctgtgacttactctcttttccatttttcgttatttcagcatttatcgtctgaacttacgcacttgtcggggcttcagtttttggcattggaatgttgtgctactacggacttaccacgactgtcgacagcgctgctgttcgttctaagtacgtttttcttggcttatgcgaggatttgttctttaattcacttaaatttcgccgacacattcaaatcgctcctaacaatcctttttatcctgttttttagtttatggcctgattatgttcgtcagagacttcagtcgacctacgcttatttggctggtagccttgccttgactgcggctgttggagtggctgctgcccgtagtcctggaattttggctcttaccagcgctccatcacttctggttagtcatcggagacgaccctgggatttggcgcggcggtaccgttcccagacgacacttttttgcctttccgccagccaaaaaaattttccgttcaaacaaattttacgataaacgggtgttgtcattgccagaaggcgccgctggattaaaatgaaatttgcttatattctaattgctttttaggtttggtttggttctctcgctgctattattggttctggcttggttggctcattgtggcatttttggtgcggttttggctcccctttgttttgttag

SEQ ID NO: 55655 - DNA, 630 bp, Heterodera glycines
  Genomic contig location: Contig_ID=SeqID_4768; Location=3489..4118; Strand=-
  SCN-specific regions: Sequence locations=1-518,542-630
atgaacagatcagaaagctttcgcctgctttcaagtgttgacagttgcaggtattctaatctttgttggtatggaatgggtggaaggttacacttaaaaaatactcttttggtgaaatatttctgacacttttcaattttttaaatattttttagaagcgatggattccaaacctcaggagcatattccaataacggtctaacataagttttgtacaaaataatccaaatcctagaagacttggacttaataatccgaaattaagaacgcatacgtaaatatgcattctttattatttgtgcgacatgattggaaaattgcaatttattatcaatatttatgcctaaatccctaattgtatccacaacatttattatatttccatcaattttatatatttctttggggtttttattccccaagtaaagtacaaaagtttttttaattgagattatgatctgccatttatttgcccattccgataaattatgcaatgctttatgcataatttctgtttcggttctttctttataacaaatatacaatttaacatcatcagcatataatttaattcttactcctgatggcaaagcatcaggaagatcgttaatataaatcaaaaataataaa

SEQ ID NO: 55656 - DNA, 1719 bp, Heterodera glycines
  Genomic contig location: Contig_ID=SeqID_4770; Location=162..1880; Strand=+
  SCN-specific regions: Sequence locations=1-1113,1135-1359,1382-1719
atggcagcaacggacggaatggtcgaagatggcaaagtgggaaatgacctcgaatcagcaaagttcacaaaggtgagaaaagtcgtgttcgttgtcctaagattgtgaatgataccttaaaggacaaagaagtcgttgacattgtgcagccaacggccaaattgataggattgacgaaggagcagctcgagcagtaccgaaatgaccccttttggaaggcgattcggtaaaatgggctattaaattcgaaggatttgccggaatttgaagctttttcattttacgcgtcttatctttctttgctcagttactcacttttcgtcgccttttggctgatttggctggccatgttcgtgggcgctgttctgattgttgttttgagcccaaaatgtcagcaagtgaattggaccgaaaaaatggtcgcttacaaagtgagacaaacactttatactctctcaaataaaacatcaaacaaatttagattttcaccctcgcatacaaagactctgagtccaaaaatgggttcggagactttgaggttattgagaaaaagttggaccaaatgaagggaattggagtcaatgcaatttggccaactcccgtgctcaaatactataaaaatgcgcttggcccagaggcaatcgaaaagttggaagtgtcggaccaactcggcggggctgaggggttcaaaaaactgatcaagcgggcccatgacaatcaaataaaagtgatcgtcgatttgccattgacagtcaatgccaaaggaaattgggccaacaaaacttctgatacaaaaagtgggaggggccggtatcccatgctgactaaacactctttcaagatggtattgccctgatcgaccttgacagtgcagcaaaccgagaaggacttaaagaagcggcagtgcgctttttggactttggcgtcgatggactggcaatcaccgattacggcctttttgccaattccgtccacttgggttctcttgtcgatcttattcgaactataccaaaggcggaaaaaatgtacagtgattaaacatacaaaaattacttaatcattgttttagtcccatttatgcacgtggctctttgaaagggccaactgaattttatgagattttgtctttggttggcgatgtgccgtccgatggagtgaacggattgaagaaaatgctggagggaagcattaaaaacattgaggagaatgggggtaataagtcgcgaatttggcaattggggagcatggatccgagtggacaaagattggaccaactcctcggcaaagagtcaaaaaggtaaccgaaaatggaattggcattaaaacagttttcttcgtatagtaaatgacttctccgattgtcttttgttttcttagcaatgagcagaaacaacgcatttcttccctcttcacttccgtccatcttttcatgccaaaaccccgtcgtcgttctctacggcgaagagcttggcctgttaagtggaaaaccgacagccaacaaattggccaaccgaattgtctatccgtggagtaacgaaacattcggcaatcagtcgcaaggatttttcgttttcccccaacgtacaaaaaacggagacttcgaggtaatttatacggataattattgggaattattattatgtttcattagagccagaaaaatgacaaacattcgccgctggcgttgttcaaagaaatcgcaaagctacgcgaggtaca

SEQ ID NO: 55657 - DNA, 843 bp, Heterodera glycines
  Genomic contig location: Contig_ID=SeqID_24911; Location=189..1031; Strand=-
  SCN-specific regions: Sequence locations=1-250,272-352,374-461,483-843
atgcgaagaccgacggaagaagtgcaaatggagacgaaaacggaggaacaaatgagaaaggaagcggaggaattgtgggaacagcagaggagggaggagctgaatgaagcactgaacaagaagtacacggagtacgtgaagatgatgcaaaagtgaagcgcagggccaacacgacgacgaagtccattacctttttgatgtcagattttttgaattttattttgtataaactcaaaaggattccgtactcaaaatgatggcattttatttttggctttcatatcaaaaaagtgtgtgaaaattgtcctcataattttgtctaaatgatttccccttcacctaagcttcagaaagattgtttcaatttgacaatgacatcacaaaacgaaggagccgtcccggctgaagaggttggactgcataaaattaatttgaaaactttgttttctgggtgggttcaaacaaataaccgaaaccaacgtccgccgtttggcaatttacagatcaaaaagctggtcaaggagaaggacgaagccacggatggcttttacttccaacaaacgatgtaccgtatcagagacccacgcgtgtccattcccttctactgtaacgtgctcggaatgcggtcggtcacttttattaccatacaaatccattgtctgattattattatttttttctttgaattttaggctgctcaagcaattggacttccctgagggaaaattctcgctctttttcatgggctacaaagatttggacgaaatcccttcggacgatgcggcccaaaagaaattcgccctctcaacccattcgaccatcgaactcactcagtcttactag

SEQ ID NO: 55658 - DNA, 1373 bp, Heterodera glycines
  Genomic contig location: Contig_ID=SeqID_24912; Location=192..1564; Strand=-
  SCN-specific regions: Sequence locations=1-75,97-195,226-320,342 -589,622-1170,1192-1254,1276-1373
ttgcaaatgttcggcaacccttcgaattgttccgcaaaagagcggaacggaggatttgactggacaaattgaccaccattcttttaacaacaaatcgaacagctggggattcccatatttcatcacttttgcggtgagtggcaatttaaaaaaaatgtccatcgctaagaatgagtcatccaatccatattttcctttattataattttaattaaaaataaaaaaccaaaatatatgtaataaaggaaagcgataattggtgagacccattcctaacgatgccaaaaaacttgttctattttaccaaacaccaaatgaaattgtcaaaattaagaaattaatggactcgagcaaaggattttacgaccaaaatgaggacaaagtgactttggccattgattttactgtggagaaagaaaaagggacaaaacgaaaattggccaatgaataaacaaacccacacaatccacagtatcatccgtttttgtcaattatttgattaacgtttgcaaattttaccttacaaataaagtccgtgtaaaaattccgtaaacgagaaataaaaaaagcgattgggaatctcgagctgtaatttaaaaaaaatttttctaaataaaatttcaagcaagtagtggggcgagacggagggcggaggaatactggccgccgtagtcgagtgtgcggcggttttttagcgcaataaccaaaatgacctatttgcaccagtttccctacggcgccaattaaaacaattataaattacgtttggtactgaattggcactataagatttgaatcggttcaaaaaccgatttatacttgtcggtttttagatggcgcggttcgacttcattccctgatttttagattaagctcgtcaagagctttcaaatggtaccaaatttgtcaggattcgatcgtttgaaaaaaagttatagtgcgaaatctctcaatttttcgagctttgaaccggttcaaaaaccggtttttttgaatttccacaactcgcgacatatttttccatgcttagctccttgagacgaatcgatcggtatatcatttgactctttttttcacggggcgttcactacagttcacccttgcatctctctatttgaataggcagcaagcgccaattgtacatatatctctttcattcctctttagatataatcattttattatgtctgcaaatttggaagcgagtaaggataaattggatcaggtacatattgcccaattactctttcgcttaaacaaatttccttcttgttttgaataataatcattttaattttcagaaaaactgaaagaaggacgtggaaaaaacaacgacgacctgcagcaggagtcggatgacggggacggggacg

SEQ ID NO: 55659 - DNA, 411 bp, Heterodera glycines
  Genomic contig location: Contig_ID=SeqID_24913; Location=1125..1535; Strand=+
  SCN-specific regions: Sequence locations=1-107,132-164,186-229,263 -374,401-411
atggcaccacgacgcaaaagaaaggcggctcaattggtcgggcaggacgaagcggtggtgaacggaccgagcgcacaggtgaattgtgttcaccatcaaattttcacatttaaatttcatatgctttttattttcacagttgccaacgaatgacggacaacaattggcgtcagcagcaccagtgacaaacaatggcaccgtccaacaagcggagaacgacggaactgatgcggtggcggcagcagcagcaattgatggcaccggcggacaagtacaatttttgtattttcgttagctaagggcgggcgcttttggtttaaaaattcaccggatggtatatgaatattttatgacatctaaattgaaaaaaaacttgttaatttggaaaaaatttgggccaagtgttgttta

SEQ ID NO: 55660 - DNA, 138 bp, Heterodera glycines; identical to SEQ ID NO: 50950
  Genomic contig location: Contig_ID=SeqID_24914; Location=395..532; Strand=-
  SCN-specific regions: Sequence locations=1-138

SEQ ID NO: 55661 - DNA, 492 bp, Heterodera glycines
  Genomic contig location: Contig_ID=SeqID_24914; Location=551..1042; Strand=+
  SCN-specific regions: Sequence locations=1-43,65-179,201-332,359 -441,484-492
aaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagact

SEQ ID NO: 55662 - DNA, 1455 bp, Heterodera glycines
  Genomic contig location: Contig_ID=SeqID_24915; Location=83..1537; Strand=+
  SCN-specific regions: Sequence locations=1-45,94-221,244-303,353 -383,405-421,509-687,740-794,832-951,999-1096,1148-1285,1340-1455
atcacatattttattattgaagaaaaaatggatggatctggtaagaaatatttcattaataattttatttattatattttaaaataaaaataacaatgtttagacacttaatagagaccgtcacgattggtattttaaacgatctttctttcttttttgatcgctttttcggagctttgcttttatccaacaaaaagattgaattacttgtctgatctttaaaatgtttggtgctttgctttttgagaataaatgaatttttcgcctttttgggttttgagagaatatttttaccatatttggaaattttataataaaaatacaataaaacatcataagaataaaaaaaaatcgagaagtttgtttcgtggaggatttcttggaaaatttttcaaacttttttgtatttggaattgggcactattaatataattttaattataattaattaattattttattttaagaatacaaaatggatctttttatattattttttttatttttagatttcattcgctccgttttcaccgtttccgcttcagtttcatttgtgcttggcattctgttcaacacatttatggcatggatgatcatcaaaaagaccccggcaccaatgcttatctactcaaaaatactgatggcaccgtgtataattgtaaatgtttagctttatcactcatttacatttatattaaaaaaacaatttttaatttaaattatcaaatttaatttaatacattttcaggacattttcttgtccctttgcgcatttattgtccaaccaattccagtaaaatttgtaaaataaaattacaattttattaaaaactaggtatttgattcgctaaacttattataatatccatcccaaggttgtctcgcatggttattttgctgtcgtgcagaatggctttttccgcaacgcttccggcttttacaattatacggtaatttataattaattaaaaaaaacagtataaaaaacaattattaaacttttaaggcaaatgtgctgtggttccaaatgcttattctgtttgtgtgttgtacaacaattcaattcgtgtttcgctactatttgctgatttggtcctaataattttaaattaataaaatatttaaaaatgattaagtaatttttattggggatcatttttcggtaaccattaggctgtatgccatttgggattgacaaatgtgatccatgaccagtgatttctttttccgattccatttccgggtacaaagcacgttgaaattattttttccaatattattttggtattaatttttcattttatataaataaatttcaaatatttttttaaatttaattccttcattattcttcagcgatggccaagtgccggcccggctcaaatacttgaccagtttgatcatcgtctttctgctgattgcccatgtgctgctccattatctgtccgactttcc

SEQ ID NO: 55663 - DNA, 510 bp, Heterodera glycines
  Genomic contig location: Contig_ID=SeqID_24919; Location=281..790; Strand=-
  SCN-specific regions: Sequence locations=1-510
atgaatttatatatatttttgtccgctttaattgcatttttattaattaggtaaaattgaaattagagcagaaaataaaaaattgaaagaaaaaacatttgggcgaaatatttagagaaaaatgggaaaaaaagaaaatgaaaatgatcagaaaaactgagaaattattgagaaattccataaaattaaagagaaaataaagcaaaacgaaagaaaatatacagcaaaagaatggagaaaaattgatgggaaaattgcgaacaaattcgagacaaatcgcaaatatatttatgaatagatcaaagcattaggactttataaatttaacaaatcaaaaacggatgaacaaaaaagttgaaattgttcaacaatttatagcaatgacaaatgaatataaatattcaagaaaagaatggaagaaaatttatgccgaaattaataagaaaaatggagttggtcaaagatcaattgataaatggaagaaacaatttggatgagtggaaaaataaa

SEQ ID NO: 55664 - DNA, 90 bp, Heterodera glycines
  Genomic contig location: Contig_ID=SeqID_4771; Location=3451..3540; Strand=-
  SCN-specific regions: Sequence locations=1-90
ggtcttggtctccgatttttcaaacgggggatcggcggaaggggagtaggctggcgttgcgaacgttaactcgtcgggccattccgtttc

SEQ ID NO: 55665 - DNA, 2414 bp, Heterodera glycines
  Genomic contig location: Contig_ID=SeqID_4771; Location=1853..4266; Strand=+
  SCN-specific regions: Sequence locations=1-480,503-865,887-1463,1485 -2414
atgcagcaattcagcaacaccgtccgccaactaccgtctggccggtactctgttcgcctcacttggcgggaacctcgtcctccactcccctcgaactgggccatcgcttatcgccgacttctttcaacaaccaagcggctgcaatgcgcccctgagctcctcgaccgttattccgccgaattgacacggcagatggacgccgatatcatcgagctgaccgggcgagacgacgacgagcatttcctaccgcaccatgccgtcatcaatcccaagaaattgcgcatcgtcatcgatgccagcgcccacgccaaaggcactccaagtctcaacgattgcctccaccgcggacctgttcttcttcccgacctctgcgggatccttctccgctttcgatcggcatcaatgcctgttttggccgacgtccagggcgccttccatgccattgaagtcgagccggaggaccgacgcttttgcaaaatgctgtggttgaaaaaccctgcccgacccgtctcaggcgacaatctgttggtctatcgctacaagcggctcgttttcggcgcgacatgctcccccttcatcctcgccgccgttcttctccaccacttcgaaaggcacgaccacccattcgccaaggaattggccgcgaatatgtacgtcgacaacctcctcatcgagtgcgagacggaagaggaggccatcgacaagtcgtccatcgccaaacaaatcctcaaagacgccgacatgaacctccgggagttcctcagccactccccaaacgtcatgggacgaatccccgaggacgaccgactcgacaaaacgccggccaaagttctgggactgacctgggacacccccagcgattgcatcaccttcagtctcccaaaagacacagacaccactgctacacggcgttcagtcctgagcatcattgccagcacgttcgacccgcttggactcgtcgggccatgtcttctgcccgccaaacggctcttccaacggctatggggagaatgaaccgcctgggacgcccccctccccgatgccgagcggcaacttggagccaaaccctttccctttggcaacaccaaacacttgtcattccccggcactccattctcggcaagcacagtcgcctacaactccacgtcttttgcgacgcgtcggaacacacgtttgccgccgccgtctacatccgaagcgagactgccgatagctcccaagcgaacttgattttcgccaaaaatcgcctccggtcacgaactgcgaaccagcgcttcaccatccctcgactcgaactcctcgccgttcttgtcggaatccgcgccatgcgtttcgccgagaaagagttccggcgcccgatcgacgggcgacacttatggtctgactcccaaattgcgctctcatgggtgaagtccgacgaacccaaggcccaatttgaacagcgaagactcgtcgagatccgacaagggccgcccaccacttttcatttcatcagaaccgaccgaaatcccgccgacgtagccacgagaggctgcacaccggcggagctccgaactcgccacatttggtggaaagggcctgagtggctcacgagtccggaaacggaatggcccgacgagttaacgttcgcaacgccagcctactccccttccgccgatcccccgtttgaaaaatcggagaccaagaccccagtatatctagaggcaaccaccgatctgtcagccccgagcttcatcaatgtcttacgacgattcatcagtcgtcgcggccgaccaaagcgaattctgagtgacaacgccccgacattcgttcaaacgagcaaggctctcgacattctgaccggccctccgtccgaaaccgacgccgtcacctttgccgcgcgccgaggcattcagtgggacttcattcccgcctatagtccatggatgggggcttgctacgagcgactaatcggcctcgtcaaatcctgcatcaaaaggacgatcggtcgacgaattctcgactacgacgatttgagcgcattccttgccgaaattgaggccagcgtcaacagccgcccgatcacatgggtgtcagatcaaccggactcatcgaagcccctcactccgaaagaccttatccagcccggccttcccaacaacttggaaatcgtcgactctgatctcgactacgacgattgcctctccggtcccgcgcgtctcgcagcactttggaaagcttacgggaggccgccgaccatttctggctcaaatggagtcatgagtacctcctcgccatcagagagcgcgccggatggactcataaaggtccccgccttcgaactcccaccgccccccacatcggccaagtggtcatcgtcgaagaggacctccgcccccggaatttatggccgatgggcatcgtcgttgcactaa

SEQ ID NO: 55666 - DNA, 393 bp, Heterodera glycines
  Genomic contig location: Contig_ID=SeqID_24920; Location=561..953; Strand=+
  SCN-specific regions: Sequence locations=1-264,286-393
atggccataaaatatggaccaaaaatcgcaaaatatggacataaaatggcaaaaatcgcgaaatatggacataaatggcaaaaatgtcaaaatatggacataaatttttcaaaattgagtgcaaaatttcttcaaatttattggttgaaattgcatatgagatacatttccaaattttttgactcggtaaggcgctttgacaaagacggctttcgttttgcaattagtcggtcaacattcggaaattggtctcgaattttttcggcaattacgtgcaatcattttaaaagaaaaaaaaacataaaagccaaaatttattaatttttttagcgcaaaatcaacaacaaaagcgaaattttcgcttttttgcttatttttgacataatttattaa

SEQ ID NO: 55667 - DNA, 155 bp, Heterodera glycines; identical to SEQ ID NO: 51421
  Genomic contig location: Contig_ID=SeqID_24920; Location=688..842; Strand=-
  SCN-specific regions: Sequence locations=1-155

SEQ ID NO: 55668 - DNA, 839 bp, Heterodera glycines
  Genomic contig location: Contig_ID=SeqID_24926; Location=98..936; Strand=+
  SCN-specific regions: Sequence locations=1-839
tcactgggactcaattctcctgcatttcaatcactgagactcaatcctccagcattccagtcactgggactcaattctcatgcatttcaatcactgagactcaatcctccagcattccagtcactgggactcaattctcatgcatttcaatcactgagactcaatcctccagcattccaatcactgggactcaattctcctgcatttcaatcactgagactcaatcctccagcattccaatcactgggactcaattctcctgcatttcaatcactgggactcaatccaccagcattccagtcactgggactcaattctcatgcatttcaatcactgggactcaatcctccagcattccagtcactgggactcaattctcatgcatttcaatcactgggactcaatccaccagcattccagtcactgggactcaattctcatgcatttcaatcactgggactcaatcctccagcattccagtcactgggactcaattctcctgcatttcaatcactgagactcaatcctccagcattccagtcactgggactcaattctcctgcatttcaatcactgagactcaatcctccagcattccagtcactgggactcaattctcatgcatttcaatcactgagactcaatcctccagcattccagtcactgggactcaattctcctgcatttcaatcactgagactcaatcctccagcattccagtcactgggactcaattctcatgcatttcaatcactgagactcaatcctccagcattccagtcactggaactcaattctcatgcatttcaatcactgagactcaatcctccagcattcca

SEQ ID NO: 55669 - DNA, 461 bp, Heterodera glycines
  Genomic contig location: Contig_ID=SeqID_24929; Location=104..564; Strand=+
  SCN-specific regions: Sequence locations=1-356,378-390,430-461
atggccagcggatttgggatgtttttgttcgtgaaatttggccaattttttctgaaaacattcgctgtttgggctttaccggtcgtgatcatttggacaatttgcgtcgtcgcacttcgccgacaattctcactgatctcaaccaattggtttcaatccattcatttggtctgtcgcccgctgcgtttggtgatggttttgatgtgccaaattcaacaatttctgctggccaagcattgtccaaatggttgcactctccgagaaaagatggccaacccaagcgatttcgttgtggcagaaatttgaacgcacaagcggacttcgattgggtcaacagtttcaaggaggtgtggtgcggagggaggggggagcagggcaaaatgtcgccgcaaatttttcttttaattttaaaaaattattaaaaatttagttatctagcctaaatcaaaaaaaaatcataa

SEQ ID NO: 55670 - DNA, 2528 bp, Heterodera glycines
  Genomic contig location: Contig_ID=SeqID_4773; Location=480..3007; Strand=-
  SCN-specific regions: Sequence locations=1-5,27-234,258-272,332 -598,631-756,790-815,845-962,990-2463,2488-2528
cttcagaagacattaacaaactcaagggatggggtagaccctaattattcgagaacagaggacggaatagcattcaaaatcggagaattacctcacccatatgttaaaaattgttaagcctatttacattgacgtttcacagggatcacagaaattatttttaactattttttgagatgatcaaaaaatggcatacgaaaaatattcatatgcctacctagatagaatatgaccataaaaatatttattttaaataacttcagtactgtaactttattatatgtatttaaatattaactcaaaatatcaaaaattatttttaaaatttaaagttggtgtcggattttccagtgccggattttccgctagtgtcggattttcaagcggtgtcggattttccgcttgtgtcggattttccagtgtcggattttccggtgtcggattttccagtgtcggattttcctagagccataagggacagtcgaagtagagaactgaaacaccgtcaaaatttctatgcgatcgagttttagcttggataaggatttatttaaacagagaacacaataatttatttatttaatggtagtatgtatagaaaaaaatatatattttttaaaaataataaatgaattgatcaaacaacagttgtgtcagagaacgcaataaaactgagatgagttggttgattatgagcggcgggaggggtgggcgatcgtcgggagccaaaattgggatgatggcgaaattgtggaacattttggggagaaatgggctcagaaagaagggccgaatttgactaaaaaaacggaacgaaaaaatttttaaattttagaaaatatttggggtgaggcgcaaaactcaccaaaatgccattgcccgagtcaattagcgcacttagcgatttctcttcggcgggagacaaattgccacagcagcgaaaggcacaaacacagcctaatcagcagagaaagaggggaaaggagagataaaggggaaaagaaggcagagaaaaaaagggatgaccagtgatcagagaagtgagcagacaggcgacacccaccgcaatcaccagcgacagagtgcctttcgggggagggagtgattgaattgatcagaaggcagtcttgacaccccccccctccccctctggccaattaattaccggtgtccactctcgactcggggtcgcctcgcaattcctcgaacatttcacctaaagaagggacgacaaaatcggacgacacccaactcgtactgccccaactcgtactgttttttgacaaataaatggtcataacttttgtcaaagtcgaccaaattaaatattcttggtaccattcgatagcccttaatgttctctatctaaccaccaagtttcaaaaaatttgataaagtttgaaaaaagttatggacgaaaattttttttttacaatttttggccataacttttttgaaaagcaataaaattttcttgtattttgcagatagatggagaacattaagggctattgaatggtaccaagaatgtttaatttggtcgactttgacaaaagttatgaccatttttttgtcgaaaaacagtacgagttgggtttttaccgaatctcacaccaaacgattctcactgagctcgcgaacatttgttgcattgctttttacttatatatgaaaattcattaagtgttataagttgtttgatggggttaaaaatgtggaagagaaagtgaggaaatattgcccttttccccttttctatgttttctctgctgcaccactgtttcgcttctctctgatttctttgaattagaatttgcgggctccctgcgcgatggaacttcaaattcttcattaccggtaatcccaaaaaatcccgcaatttccaagagagggatagctgattagggtcaagcaaaatcccacgcgggattcccgcgccgtgctctattcaaaaggcaccgaaatccggcattgatcagcgtaattagtcagctggactaaatcagactaaaatattttattttaaagatgttttaagttttcggagaaggcgtcgtccattttcttcggccatttcatcatcgattgttccggcttcaccttcgtcgactgtatgggcgtaaatgcactcaaagaaatacttattttgttcaattacaattacactaatggaccctaattattctaatgagtgtaattattagaaaagtcattaatagccgaaaaaataacaacagattttcaccgaaatgcgcgagcaaagagttcttgtgtattttgcagcggcaaaaggtgggcgttatttaaaacaaattgtcgaaacaaaatgccaaaataatttagcgcccgtgcgcgatctgttcgaaaagtgcggctttttccgctacgtgcaaaagcacaacttttacccgacaattcgcgacgcggtggcaatcgcgcggaagcggcgaaatgcgtaagcggaaaaaataaataaataattaaaatgtgaaataatggtaaaggagggagagggaagcttaaaaata

SEQ ID NO: 55671 - DNA, 599 bp, Heterodera glycines
  Genomic contig location: Contig_ID=SeqID_4773; Location=2132..2730; Strand=+
  SCN-specific regions: Sequence locations=1-32,62-87,121-246,279 -545,594-599
atggcattttggtgagttttgcgcctcaccccaaatattttctaaaatttaaaaattttttcgttccgtttttttagtcaaattcggcccttctttctgagcccatttctccccaaaatgttccacaatttcgccatcatcccaattttggctcccgacgatcgcccacccctcccgccgctcataatcaaccaactcatctcagttttattgcgttctctgacacaactgttgtttgatcaattcatttattatttttaaaaaatatatatttttttctatacatactaccattaaataaataaattattgtgttctctgtttaaataaatccttatccaagctaaaactcgatcgcatagaaattttgacggtgtttcagttctctacttcgactgtcccttatggctctaggaaaatccgacactggaaaatccgacaccggaaaatccgacactggaaaatccgacacaagcggaaaatccgacaccgcttgaaaatccgacactagcggaaaatccggcactggaaaatccgacaccaactttaaattttaaaaataatttttgatattttgagttaatatttaaatacatata

SEQ ID NO: 55672 - DNA, 954 bp, Heterodera glycines
  Genomic contig location: Contig_ID=SeqID_4774; Location=1624..2577; Strand=+
  SCN-specific regions: Sequence locations=1-839,864-887,909-954
atgacgatgtcggtcttaatgaatggaactgagtcggttcctttgtctttggctgtggatttgcgccaggagaaggcgtttgatatcggcgtaggagtttcgaaaagccctgaccactcagaggaatttcttccggtggaggccgatgtgccaaatgtcgagaacaacgacttttcaagcaaaacaattttgtgtgagcaacataccggcggtgtaggcacaggttgcaaaaaggataacatgtttacaaagtggtctcataataaagaagtaaaaaaggggttatgcaattcttagacgcattggttttttgaacctctaacccggattcgaacatttttcgaaaattaaaattcgcgtttcttgcaaaaattgttaaggcattgttcgaattttacaataaaacacaagggattcagatatgaaaacggaaaaacacattggctgcattcaacaagcaatgttagtaaaaaaaaatgagaattttaaattttcaaaagagttcgaatctcagttcagggtacgaaattaaccgaaagaaggccagattcgcgctaagcgcatcggattaatttttgggaccgataatctttaccattgccttaaatagatgctgtcactgctgacaatgaacactttcactttggccaaaaccgtgaggaaacgattactttgaatgatgtgcatgagcaacagaaacagagcgatgaagtaattgacagtggttatcgtgatgaggaggcaaaacggcagtttggaatcacttcccggatcgaaatcccggtttcgcttcaaaaattcaacaaattaattgataaggtgcgagtttttaggaaagcaatgacgacgaattggacaatgaccagccccaaaaatcaacagcaaatgccaaaaagaaacgtggaacaaagcgaaggcacatgcccagtgttgctgcgacaaagtgcctcagca

SEQ ID NO: 55673 - DNA, 84 bp, Heterodera glycines
  Genomic contig location: Contig_ID=SeqID_24930; Location=1225..1308; Strand=+
  SCN-specific regions: Sequence locations=1-84
acaaagacggtcacagttcgctggaagtgctgtacaaatgttcggcgtgtggcaaaaatgtgcacagaacttatgagtgcatta

SEQ ID NO: 55674 - DNA, 1241 bp, Heterodera glycines
  Genomic contig location: Contig_ID=SeqID_24933; Location=359..1599; Strand=+
  SCN-specific regions: Sequence locations=1-835,857-1241
atggaacagcaaaatgatgactgtatagaacggaaaagctctatggtcttacaagaatattctgtgatcgaaagtgaggaatccatgctggacccacacgtaaagccaaaagcggtaagggaatcattaaaggcaaatttgtgggaatttggattttaggttcaccaatgtcccgtatgtaacaaaatcttcgtttccttcaaaggtaagtttatctttgcttttatggagctatcaattctttgaactcaggccttcaacaacacgccatcattcacacggatcagaaaccatttgaatgcgacatttgtcgaaaatcgttcagattcaaatccaatttatttgagcatcggtccgtgcatacgggcaccaccccgcaccgatggtctgtttgatatttctaaatcatgaaaaaatgtaatttttttgtactctcccattttcagtccgctctgtggcaaaacgtgtcgtctgaagggcaatttgaagaaacacttacgcacccattgcacaactaaagaggagttggaagtcgcttggcagcctttcgcttcgaacagacgcgccccagcggaaatcccacaagatgccataataatccgagcaaatgccgacccttccacgctcttcacgccatttgaacagcctaagaaacagcgcaagttggggctgggcacggacgtggcgtattgggtggacagaatcaaacgatgtgagctgttgccacctgtgccgatcagcagtaaggtgggcgagttttgaatttcaatgctcacaatcagcttttccatgcgacggagagcagagattttttgttacaattccgttgatatgatttaaatgcttgtttttcattgccatattttgattttaatcagatgtcaagattggctaatctcgtcaaaatggtcgaggaggggagtctggacatggacgggttgtatcaccatgctgggtctgttgatcaattcacaatttctttatttgttttttgcagtgctattccattcgagcgatacgaatgtccgttttgcaaatcagttttcttttcccccattgaatgtgcagaacatatggtgggttatctacgcgacgaatgggcgggggagggttaatgcggaaaactagccaaaattttcggaaaatttcctttccccactttgccgggttaatattttggatagtaaattattttcaaaaaaccttaatatttttactagtacactttaagaagttagaaa

SEQ ID NO: 55675 - DNA, 956 bp, Heterodera glycines
  misc_feature (107)..(107): n is a, c, g, or t
  misc_feature (146)..(146): n is a, c, g, or t
  misc_feature (176)..(176): n is a, c, g, or t
  Genomic contig location: Contig_ID=SeqID_24937; Location=805..1760; Strand=+
  SCN-specific regions: Sequence locations=1-140,176-176,200-337,406 -509,531-730,757-956
atgttttaccaagagcagcaaattatgaaagtttttgcgaagcttgagagcttcagttgccttatgtttttcaaaaaaggagatagtgtagaaaccaacaattttanagtaaataatcaactaattaattagcataagtcatttanattattaaaaataatttgttataataattngttttgtttgttcaattcttttaatagattgactttaattcaaagaacaaatatgctaatattaatgatgccgacgcaaaacaaatcattgatgacaatctaaacttagattttggcgctcaacaaagtcgcatttttagaaatatctttcaaagttagtgaaaaaaattgtattaaaaataaaataattttcaaatttttaaattaaaattatgtataattattttaagaattagaaggcccaagcgacggagcaagctcatcaccagcatcagacgagaacaaaaataagcaaaaaggcaagataatcagttcattattatcgttgggcggcaagaacaaagagaaaaagaatagacagccgaatgttattgattttatataaaaaggacagtaagggatgagagaagatacagtaagaatcagggtaactattggtgtggagatattgccgagtatggaccacttcagtcccaaaaatgattaaaacacaaattttggcgtttgtactatttttccttatttcaacatttttttggaaaatttattaactgaaatgaataagaaaaaccaaaaatacacccgccccctaagaatcgaccaaaaaaatacacttctaaaaactggaaaattttctcaaaagtcctttttttcttgacaaaatttttgatttaaaaaatgttaatatttgctaagaaaatattagaaatagttcattaaaaaaatcaggaggaccgaacttaacattttggattcttttacatgtgtattcatacaaca

SEQ ID NO: 55676 - DNA, 1832 bp, Heterodera glycines
  Genomic contig location: Contig_ID=SeqID_4775; Location=489..2320; Strand=+
  SCN-specific regions: Sequence locations=1-145,167-690,714-955,977 -1017,1039-1095,1118-1832
atggcggcttggcactttgagaaattgttacgtgatttttctttccaaatttcttcgccggaaaatgacaaaaaaatttctgttaataatcgaagcttaccacaacagaatgacactttccttcaaattgagcaatgcgttagggaaatgctgttggaaaaagaaagcagaagaggtgagctcggctcgactttttccatttgtgattttctgcccgaaattacgaaaaaattctttcaaattcgattatttttctgagaatgccctctcaattgggcctatttcccaaaaaagtctccaaattgtcagttggtttctttccattccaatttgttcttcgcttagatttgtttcattgttcccttcgtccggcacttggtcatttcgtcgctcttttgcttcattcttttggcaatgattccgacgttaatttacggtgagaaagtttcgtccgcaatttagtttgttggtttttggattttcaggttgagaagtggcgaatttctgtgtttgcttactcagttggattttgccgatgaatccgctgattttgttgcttttgttcttcccgggattttttcgggctgtcgtcaggtggcaatttcgaagagtttaaaagcaaaagttttacagattctcttaaatgttctgcccaatttgcattcaattgacctcgtaaggtgcgcttgtgaagtgagtggggaggggaggaaaagccatttcaaatggcaattaattaatgctaattgaaatgaccaattttcatatgattttacctttttgccttcattatcagctggtcaccaactccatttgcatttccttctcaaaaatcaatgtcaccgattgtttgagtgtttccgttggaaagtgcgtaaaatcgccgtcctctgaaaatgtcctcagctttcgtcgcgactccaattggctccaaacggcggcccagcgaattctcccccaggcaaaaatggcattgctttttcattttgttttctttttcagatttgttcacttttgtcacatctttccgcacattccgttgactccgttcgctatgagtcagccaatattttatcaaaaattcaacgacaaattccgtcgggtgtttgttgtttccatttgttacctctttgctatttatacactttttccagattactttggctcttcctttgtcaaaatgacaattgatgtctcccttttgctttacagtgacacaatgccaaagtttgcccttcgcgtaatttcccagcaaatgctctcttaaggacacgccatttggcacatcggataattgacgacatacggctccaacaaaaggaattattcgagtcgcattccctcgacaaactcaaaaaggcaatgaaatcgctcgaaagtgacgtcaaaaatgcatccgacggcggagtttacctccaaaatgttagtttttactacttttgcttataatttctcttttttttgaacagttcgtaaattgtgctcaactcgttggtccccatttgttgggtcgtctgtttaatttgccagaatttgttgacaaatttctttctccattaattcggctgatttctgttgatcacaacaaagaaatgatttgtgattctcttcatcacaaaacaaatggtttttaatttcaatctcctaatatttccatctttttagggctccaaaatttaccacccctaaaatatgggataaacgcaaaacatttgacacaattggccactctcatcgtcgaaactcacaattcagaggtaatcggagcattttgaagaattaaaaaaagagtatctttaaattattaattaatttccatgggttgccctcca

SEQ ID NO: 55677 - DNA, 1179 bp, Heterodera glycines
  Genomic contig location: Contig_ID=SeqID_4776; Location=457..1635; Strand=+
  SCN-specific regions: Sequence locations=1-139,162-384,406-442,464 -478,510-1061,1083-1179
atgctactcccttttcaagtttgtcctcgatttccgctcattttcgctgaattggtctcgcggtgtttttctctccaaattattctcccccaaattcgaagtgttgtcgccgaacttttgctttggctcgaccggagtgatcagaagcgaattatcattttggccaaagcacttcgcgcttatttaagcgcacttaacgaatggtttcctaatttgaagccattggttacgaatttgagcaaaacgaacgagaaatatgccaatttggaggagacggaaggggagaaagatggccatggagaggaagagggggcggagaaagtggacggacacaaaaagcaatgggaaggagacccaaattacccactggtgaaggacgtcgtgtccatcctgaacaggtggggtgcacaacgttaaaaataaattgtcaaacttagagaatttttggaaaaaatcagaattttccaataaatcaccgaaatttttgaaattttttaaaaaaattttttcgcaattttcttgaaaaaatcttctaagattttttttggaagttccttttacgtattgttaacaaaatgaaattccgtaagtcagaattccaatttaatgtgataatttcgtttttctttacgactaaattattttgtgtccccttttggtaataattttctatttttttcattgaacgtaattgaatttacaggacaaagcatttcattgcgtccgccaatctgccccttttgctaattgttcttgacgttctgcgcctctctttgctttttgtcagagattatgaagacgaactattgccaatgattcatcaaaattggatgggacttattcggctctttaaaattggcactgccggtcatctgttggattcacaaaaacttattatgatcaaggcgattgaggtcaattgaaaccttatagatagttcttgagattaattcccatttttaggttgtttcgtgcatttgcaaattgtcaaaagattttgtgtatcggaaaattgttcacgaatttgtcccttgcattgttgttttattgagggctcttctaaaggaatcacaaaatttgggcaaattgtacgcacagactgccacattcaaacttcaatgtgcaatattagatgggtacggtattttaattgaatcatttaaaaggatgcctcgcaaa

SEQ ID NO: 55678 - DNA, 1079 bp, Heterodera glycines
  Genomic contig location: Contig_ID=SeqID_24940; Location=32..1110; Strand=+
  SCN-specific regions: Sequence locations=1-17,39-981,1003-1079
atgaacttccgtggtgcaacggaagcatatgccattgttcattcaatgccatttgcccgtctttcgcatcatgttgtcaaattggcaattcatttgccaaaccaacagcccattgtatatagggcattccagctggtgagcaaagctcaacaaatccagcaaggcgaactgccagaaacgcagtgttcagcctattggaaacaatggcaaaatgagtggaagaatgatccaaagtttaaggacattcttttcgaaaaagtcccagagcggttccgatgggcaaaggacaaatgggtcctgtacaaaaggcagcaaattaaaaggccacctatcggccgaattgttcctgtacccccatcggacccggaaaggttcgcgctctattcacttatgcgtcactttcctggagacccagaccatcttaagatggttaatgggttgctttgtacctcattcactgaggctgcaataatgcatggtcttcttgaagacgacaaaatttgggacaaaactctggcggaggcagctctgtcgcgctggccagatcagatgagatggctttttgtgagcatcctggtctatggccagccgagtaatgccatagaattgtggaacaagtacaatgaccaaatgtacaatccgcaaggcattattactctggcacagcataaagtagcagagcttgaagccctagccgacattgattggcggctgcacagctgctttaacttaagctgtgtgcattttagcctgccagacccgccaacttcaattgccaaaaatactgacgcggcaattgaagagtttttctttggcgatgatgatttgaatttgcctccagggcaaccaaatcctcgtccacagccaaatacccctccgccacttaacagcgaccaacagaaggtctttgatgctgttttgttggcaatacagtcgaaccctagggattcgactgtcccccgccgtttcttcatatacggcgatggaggcacaggaaagacattcctgtttggccaaattattaggcgcttgcgaaaggccccatacacctacaaagtgcttgctacggcatccactgg

SEQ ID NO: 55679 - DNA, 519 bp, Heterodera glycines
  Genomic contig location: Contig_ID=SeqID_24943; Location=362..880; Strand=+
  SCN-specific regions: Sequence locations=1-5,84-377,399-452,474-519
atgcgtcttcttccgttttgcttcttcctcctcctccccctccttttgtgcttcttccttttcacttttggctcttcttctccgatcgtcgattccgaaatgtttctgcccccgcgcttttacagaacaatttggcccattaatgcgaaaagaagccgtgagtaattaggcgaagcatcattaaactaaacctctttatgctttagcaagcatcggactgtccctggccgaatatatggccgcaggaaaccaaggccaggagcaatttcatttcatccccggaagcggaaggaggaagtgaatgccaaaaacggacggaagatgaagcggaagagcggaaatgaagaagaagaaaagcgaatggatgaaaagaaacgccggggtggaatttgtgaaggatgaacaagaaataactgctgttgatcgattgacccttcagtgatctgatctcattgaatatttcatgcatttttcacataactttatcctttccaaccgatggtgagcaaaagtgagcga

SEQ ID NO: 55680 - DNA, 1005 bp, Heterodera glycines
  misc_feature (953)..(953): n is a, c, g, or t
  Genomic contig location: Contig_ID=SeqID_24944; Location=279..1283; Strand=+
  SCN-specific regions: Sequence locations=1-328,363-624,646-726,748 -978,1000-1005
atgcgccgtaaaaaagtaccgcaaaaagaaaaatgtaaaagattccttaattaaaaaaatctaaattttggggtcaaaacagaatccaaagccgttgtggcgaattaaaaaaatggcgactttgtttgtgtcggtgtcattggcgttgccgccgcttttcaccgcggcgcgccaccgggcgatgccaatgacgcgagggaggaggcgtacgacgatgacggcaccaccgctgcggcagccggcaagaaaatcaaatggtggccgatcagtgccaaagagcctctgcggtggccaagggccctcgcacagaaacacgcgtcaagccgacacaaaatgccaatttaaaaattcagtaaaatagattcgatttaaattttcatgacacggctgctaaacatttttgccagataaaatagaaaaataagttaaaactcggtgctatttgatcccaaaaagagcaaaaatgctcggttttgagcgattgtgccatgtgctcatgggttttcggcggtctaatcacgaatttgatattcaaaacgagttgggtttttaccatttcatgcttaatttaagggaaggaaggggcacttctaattcaaccaatacgatttatgacaataaaatatttataaacccaattgaaatccttggcttttttttaaatgaaccgtaaactgttgctctcgaaaatttcaatccaacccgactgttgaaaagctcgttcactacaatttaagactatttactaaaaaactttttaagtgagacatcaaaacgtttgatcattttaaatccatttcagggtccgagctcctccgaaatgattcgttgggcttcactttccgaaagaaatgggatgctgtatccgtcctcgcctccattcgcaatcgcatgttggcaatgtcaatgtcagcgttcaaaaagatcatgatgtttagcccaaaccttaattnatctatcagtgatgaggaaacaatggaaaagataaagagctacagagcatga

SEQ ID NO: 55681 - DNA, 493 bp, Heterodera glycines
  Genomic contig location: Contig_ID=SeqID_24946; Location=811..1303; Strand=-
  SCN-specific regions: Sequence locations=1-4,26-113,136-225,248 -395,423-470
atggcggaggacgacgacgaagacgtgcaggaagaagctggcaaagacgtacagaccggtgagtgattaactatggggttggtatacatccccttaaccatttctatggggatgtatccatccccttaagcatttctatggggatggtatccatccccttaaccatttccatggagatggtatacaacttttcataataaatctttatacttttagggttcaagcaaaaggctaagaaggttaagaaaactttggccaaagtgttggcgcagcgtgccaagaagcctggggagttgccggccgccatcattggcgatgatgtgcttgtttaggaatgccaagagaagtgtaggcgctactaccatcagacgtgtagtaagaagtgtgtgtgccagaagacagaagaagaagaggaactgaaacgactgcagtaagaacgccggccctccgactaatgtattttcgggttcatttttttattatttataataaa

SEQ ID NO: 55682 - DNA, 931 bp, Heterodera glycines
  Genomic contig location: Contig_ID=SeqID_24948; Location=25..955; Strand=+
  SCN-specific regions: Sequence locations=1-899,921-931
atgataccgaatccattgtgtaccgattggatgagaggtgaacaacttttaactggttatgtggaacgaggagaccttgtagaaattcgccgtggatcttacatggtttttgcagtttttattttttatctgaccatttttttcttagcattgggctgtctttatcggacatatcagtggacaaccgcttgtaattcatatttcgacagagtcatccgatatgggaattagcacaaagaaggaatttgtccggaagatggccaagggttgtgctgctattgtaatgcttctcacatccatctgttcaactttacaaagactcgtcctttctctccgtttttcatttctcaatttgttcaaggtccgcagcgacccttttctgaatgttatttcgactgacttctgtcgtgtcaataattgtttggatgcaaatcgacgaccttttccaccctcaattattgtcgaacgggcattgactaaggcgagttatgcctatttaattatgtttaatttactacagatcctttttagcttggaactggtgggtataatctcatcaaaaacaactgtgaacactttgctaaatggtgtcgttatgctcttcgagaaagcgagcaggtgaagagttttttgtcattaaaccaatttctttttttgactggctgtagagcattctgggccatgcggggatgatctgtgtgacggcgatggctgtaagcacttcaattcctgcgggcatcgctgccggtgcggtcagttttatcgcgttgaaggcgggtcaagcattgagacggaagcgaattgggtggtcaatcatttgaatgttgaccactgttaaatgcgcacgaaattttgtaaaattcattccaaaccattccttgcattgtcagtttatttcttatttgtatctatatatatggtcgttttggaa

SEQ ID NO: 55683 - DNA, 220 bp, Heterodera glycines
  Genomic contig location: Contig_ID=SeqID_24948; Location=1178..1397; Strand=+
  SCN-specific regions: Sequence locations=1-220
ttttagcttttctaaaaattaactgctgccaaagtcttcatcatgtcttcaaagcctctctacggaaaggatgttgtgagtttttctgtctaagcagtttaaatcttaaaaaattgcttatcacaataacttgataaatatgtacacgaataatggcgacgtcaattttaacttaaaaatttagcttacggaaggttcggagatctcgcgtgaattggag

SEQ ID NO: 55684 - DNA, 792 bp, Heterodera glycines
  Genomic contig location: Contig_ID=SeqID_24949; Location=551..1342; Strand=-
  SCN-specific regions: Sequence locations=1-175,199-769,791-792
atgagaaggaaatccgccggattgtcccttttattgctcaagcacagcaggcggtcccatgagcagctccaaattcccaatgcatcggcccaggcactgctcagagttccgcccgtttatactcaacagaagggcagtgccgtgccgtccttcgcttcatcttccgtaccgtatgcccaacaacaacaacaacgacagtacccccaaaacagcgttcagtcttcgccccactcgcactcattgtcagcagcctatgcacatccacaaccccttttcgtgccctcctcctcctcgccaccgttccaacctctccaaattcgaccccagcaaagtcccgccgcaattcccagcgttcggcactcctccgtcccccgaggggatgacgttgaccgggcgaatgcctcgccaaaaaacaaaattccaccggcagtgtgcgcagttttctccgttttggaagtgctttttggcgtcgtctcactgttcgtgggttcgttcgtgcccaaatgctttgagtctctccaaattcgcccgacccattcgcaggtgcgctcaatgcgaatccgtacaattgcctcatccaacccaacgtgcccatttatttgatcctttccggcatccttttgatcatcaatggagcggcacgccttttcctaagcctttctgcttctccgactgactcgacaaagagaagggacacccgtcaaatgcgtcattcgcacggccgtcgtcccgcgctgacttatgccgttgagggcatcggactgttcgccatcctcgtcgtcctcatcttgg

SEQ ID NO: 55685 - DNA, 1213 bp, Heterodera glycines
  Genomic contig location: Contig_ID=SeqID_4779; Location=1505..2717; Strand=-
  SCN-specific regions: Sequence locations=1-200,222-308,330-401,423 -531,554-676,698-737,786-847,872-945,967-1213
atgtgcagtgaactcgacaccgatgccgacagcggtgatcagagtgacggacgaaatcgggttcagcttgacgcccgcaaggcccatgaagccggccaactccacggtcatgctggccacaacgcaggtgacctgtgttgtttggggataaatggtaagtgatcagaaaaaggaaaaagcaaagcaaagaaacaaatgattaggaagtgctctgaatgagcgggaacgatcagaaaaaggaaattgtatgatttgatgtcagtgatgtgatcggatggtggaatggggaaagtgattagagacgagagaaataatcagaaataagttaaaaagttggcatgaaatgatgtgatcagaagaagtgatcggaaaagcggaaaagtaattagcgaacaattaccgaccatgtcaaaaataaacaaaatatgatttatttatcagaaacacatttagaaatgtttggagaatttgaatgaccaaaaaatttaacaaattgtatacaggagaatggggttggggcctcggcaagacaaaaaaaaaaatttttttttaaccaaccaaagcggcggcccacgggttgaaaatgatggtggagataacgcagaagacggacacggaaatgatctaaatcttttttttgtataatttgttagataaattcatcaattttatatattttaatgaggaatttttaagtgttcagcgaattaactttttttaaatttgtgatgaaaatgtaattttttttaatttctaaaaattttttttttaaattaagaaataatcaagcaaagctatgaaaaaatcctttaacttttagttgaatattttatttttcgtataataattgttcaccaaaaagaaagaaaaacttacgccaatagccaacaccaagtagtagtccaagtgcaaatactgctcccaaaaggtgaaagcgacgccttgaaaaaataaatttgtattttccccgaaaactttcctaaatttccaaaaaaaaaacaccttccgggtagttgggcaggcccgcacggctgtaattttcgctgattgccctgatctcgcggatcatgcgcatgatggtcggcgtgtcgcgcaacccgtcacagtaaaacggaattcggctgaacaacggcttcggcgcgggcggaatgaaatagcgctgagaaaatgggagagatacattgaaaaatgtatgcatataatttgaaataaa

SEQ ID NO: 55686 - DNA, 1018 bp, Heterodera glycines
  Genomic contig location: Contig_ID=SeqID_4781; Location=9..1026; Strand=-
  SCN-specific regions: Sequence locations=1-149,177-235,267-385,407 -1018
atgggccaaatgcaactgttggccaagcattggccaaatggttgcaaattccgagaagcgatggaaagccgaagcaattgggttgccgtgcttctacgtcagaaatcgagtggtatgcgtagtttggtaacactggagaattggtgacccggaggaaaataaaataaaaatttttcattcgatttttctagtgtgaaaaaatacccgattaggggggacctgctgagctcagatcaattaattgaatttatttattttttgtgttcaggtgacatgaaaacttatttctggggttttgggtcgcttatcacgacattcattttggccaaaccaattcggaactgcgaaattgagaataatagtatttaattccacatatgtatacatattgttaataaaaaaggttgattttcatttgacactcacaataaatggtcacactaaaaagactcgttggcccgtccgctcattcggtgaatggcaatgtgattagtaaaaatctaatttcttgaacctttaaaattaataagcaggaatttcggactgaaatgttctaaaattttctgaattcgtatatattttttgctgatgagtgtctaggatttgaattttcggttgctaaatatgaccatcatcagaaactcttttaaagcgatcatggcaaacagcgtacgaagttgcaaaaagcatctttcgccaagcaaatggaggaccttttttcgagaccacgaaaatcgaggtgttagccccaccagtgggcccagaagacgatggaaagatgtacggcgaatctgggtcggcagcgattttaatcgcgctgtatgctttggccagtgggctttttgtgaagaaaaacatagccgtatcagcggtgatcaaaaaaaacaaacaaattggcaaggttggtggccttcgctataaagtgatggcggcggcgaaagcccgaaaaaccactggtgtcctgtctacagaaaataagacagagttcatgaagttcgaaaagaaagtgaagaaacat

SEQ ID NO: 55687 - DNA, 1167 bp, Heterodera glycines
  Genomic contig location: Contig_ID=SeqID_24951; Location=126..1292; Strand=-
  SCN-specific regions: Sequence locations=1-58,80-132,184-225,267 -346,372-533,555-1077,1111-1167
atgccgagcaatgtgatgatccgtaagtgttcgataatgattaattaatggtgtcaaatttaaactaattaattcataaatttattttggattctgtcttgctaacaatctgaaaatggttgttaaaattcgtaaaatatctttaaatatttttaaaaatgtaaatattacaaaaaaaaaattgacgctatttgcaaagtgacagttaaccaatgaatcgaacccataaattttgaaaaatcaaatttccaatttttaagtttttattcgaatacacctaaaaaaagtataaaaattctcttgcgatggcatttgccattgcccccaggcaaaacgggcgaaattcatttatttaaaaaagtataaaaattctcttgcgatggcatttgccattgcccccaggcaaaacgggcgaaattcatttatttattttcctaaaatgggacaatgttggccaaactcaacaatggcacagaaaaaatttctccatattttcaagaaaaaaaatcaaataaaaaatagcaaagtacaaaattttaaattttctcattttaaagaatatgacaacaaatttgtgccaattgagcaaaaatatttgtcgtgccagaatgtgcccaacggcggcattgggtacaattgtgaatttagtttggacaatttggaggtggacgaagaaagctcgaagctttcaatttgggccaatgtgcgtaatgataacagcagctcacttcaaaaattaaccgaattggtagcgaaattgcatttaattaattaaaattaggctgaaattaattcttttaaattttagtttaattatttcacaatttttgtactccccgcccttcgtggagcaaaaaagacggggaattttgtcggggatggctggagaaaattaaaaaatatcgaggagcaattccttttgggcaggaaattcttagacaaaatttgtcgtggatggccagagaaatttcaaaaatgataaaaacgctcattagccatttggtatttttaaagtcaatttgaatttttacacaatttttggcaatttttaggcatatttttagtgcgtaaattcacattaattaaatttcttaaaaataattttaatttcgtctcatataaattttatttccattttctgtataaacatatagtatatataataaa

SEQ ID NO: 55688 - DNA, 1524 bp, Heterodera glycines
  Genomic contig location: Contig_ID=SeqID_24952; Location=47..1570; Strand=+
  SCN-specific regions: Sequence locations=1-641,673-734,757-794,886 -945,967-1204,1254-1276,1298-1364,1395-1433,1455-1524
atctgtttgtgactgcaaattcatcatgtgctccaaagagcgagtgagtggaaattatgtaatataatttaaaaaaagggttaaactattttaaaacaatcgaatcctgacaaatttggtatcgttctaaagctcttgagagctaggtctaaaaatcagggaatgaagtcgagccgatgcaaacccggactcgaacaaaaaactcaaatttaattttcgccaatatgaattatatgtcttgccttcagaatactattttctgtttatttcatgcagactaggcctaagcaagcctaagctgaatccaaggcctaagctgaagcctaaacctcagttgtcccagtgcactgatggcgtcggctgggttcatttcctgatttttagactaagctcgacaagagctttcggatgtaccaaaattgtcaggattctatcgttaaaaaaagttagagtgccaaatctcccaatttttcgagtgttggtcggttcaaaaaccggttttcacgggctgttcattacagtacacccaaaatttttaggagcgtattcagaaaaaagtaaaaaacactttttttaaattttaggaatgcactcgtaaacgggcaaacagtgatggatgttatttatttgaggtgatattcaaattaataattaatttgtaaaattaaaattctctaaaattttgtttatgcagtttttcgttaaaattataattcacggttttttttattctgaaatttatttttgatatataattagttagaatttttttcgggttttaaagcagtttttcgttaaaattaataattaaagttttatattctgaaattatttttaatatcgtatttgttagaatttaacgaatttaatatatttttttaatttcatcctcaatttttttgaatttatccaaatgggaattttaaaattttagtatgagaccggaattgccttcctgccctctcaaatccgaccgtcaacacatctgcgacgccgagagcaccagcagccacatgttcaattggaagattttaaaaaaaaggtaatctgaccaggggaaaaatcttttttttggtttcaaaatttgtgtcgcggtatttggtgatttgtaacttggggccccgacatttgggtaaccgacacttaggattcctttttttgagaccacataaactccgggattctgttaaaatcctttggccactatttcaaccctaaatgtcacattaaatactttattttaattttaatttgcgcgattaaattaatatgtgatatagtaattttaaaaaagagatacagtatgacaatgaattttgatattttttttactgtatttattactgacaactttaccgggtcgcaaatatttttatttatttcatttaaaaaatgttcaaagaactgtgagcagaacaatcctgaaaatataatttaaacaattttacaatttttaggaacaatttccttgcccgaaatgtgaccgagtcttgccctccaaacaaggactgtcaaatcacctga

SEQ ID NO: 55689 - DNA, 124 bp, Heterodera glycines
  Genomic contig location: Contig_ID=SeqID_24956; Location=890..1013; Strand=-
  SCN-specific regions: Sequence locations=1-21,47-124
aaattgtacaaaacttactggttttaaaaaaaaattaaaaaatttacgacttttcatcaaaaatttcggaagtcggaattccgaccccaaaaatgtcggaaatcggaagtctttccgtgccata

SEQ ID NO: 55690 - DNA, 1563 bp, Heterodera glycines
  Genomic contig location: Contig_ID=SeqID_24957; Location=572..2134; Strand=+
  SCN-specific regions: Sequence locations=1-510,532-585,611-674,696 -813,855-937,960-1067,1126-1127,1149-1359,1381-1563
atggaacgaaatagcaaaaacaactttctaaaacgattggacaagaaactgctcccaggctacatcatcgagatcaacggcaaactgacaaaatcccttgatgaaaatctgccgattacgatcagtttactaagtcagactgatgatcccaaatttgccgagattgagcatataatcaaatgcaaagaagaaacgggagtgaaatgtccaggtgaaaatatgaatgatgagatggtttgtttaagcaaattttacggtgccaaaaaacacaaactttggtttcgaaaattttgataatttttttaattagctttcatatatatagtggagaaccagattaaattctttgtataatttgacaaggaaatttaaattttcataaaccaaagacaaagaaaatcattaggggttcatttttaggctttgtggccacggaaagactgctttttgtaactatgtgtcgaacttcgaaccattttactaaaaataataagacattctgaaaacagtgaacacatttacagaaatcaattaaaaattcttccgttcgttttttgtcaaccacaatcataaaaaagttacagcaaaaaatattttaattttatatattctttttagctttttgtccattgcaacttgtctttttttggaattcttcgtcagcagctgtacaattaaatgtgtttgcgctaaacggcattgaaaacatcaacatttcaacgaacaaagatcttcctcaattccctcatactgctggaaaagagatcaaattgaggatccacattgcgcatactagtaagattaaaggtttactttaattattaagatttttgatttttaaaatatttattttagggaggttagggatccagaattgaccaaaaagtgatcagattcgtgagcagtgaccccgaaacccccggggaagcgttttctcgctttttatgacaaacattttccatataaaaaggtcctccctccttttggtttttttaaagttttctccaattggaccttcacagatagcacaaacacaaatattatgtattaaaatttttctgcctaacaaattttttttaattttgaattttcaaaatgtgattattatttttttttaataattttgtttcaaatgcttatttttaagaatacttattaactgagcatggactatcagaagaaattccctttggagatgaagaaaagagagcattgcccccttggcttgttgaattcatccacgtaatttataaaattattggtacttttctgttttgaaggcgcaccccatttctgatcaataatatgacatacatttcgaccaatttcgaaccccggacccgaacaaaatccaaaattctttatcaccaaaatccacctttattgtccaaaaccgattcaaatgcattgaatggaaatagcaaataggatttacgggcattccatgcatttgaatcggttttgaacaataatggtgtatgttggtgaaaatgaattttcgacttttgtcagaattcgggtccgaggtcgaaatggatatcatatccgtgatcagtggaccga

SEQ ID NO: 55691 - DNA, 1515 bp, Heterodera glycines
  Genomic contig location: Contig_ID=SeqID_24959; Location=195..1709; Strand=+
  SCN-specific regions: Sequence locations=1-174,196-683,705-1515
  Gene Ontology: Cellular component=integral to plasma membrane; Biological process=development
ctctggtttaggattcttcttcagtacaacatttgtgatgtcgaaccaacaaaatggtgatgtcgctgttccggcagcagttgctccgaatgaacaacctaatcaagtccgttttacactttattttcccggagtatctttttctccctcttagaacaaccaatttcaactttggccctttctcaagtccattttgacccgtcttgtcatgttctggctgatctcgtcacttattcgaaactttttcggccctaaacaggaacgtgacgccgaccaaaatacatcattgaccggcggtggaaaaacgtacccgccctcttttaatatgttcatggcaaatgagcattttgacttatttgtttacctttctgcaaaggtagtgcaaatttctgttttttatgttgtacagtataatatctttttgcaattttagtccgaacgcttccatgatttcgacaatgttgaatctcttttttggcatgaacatgatctcgtttacggggattggacctccggtgccattggtgacggctctcgacaaaaggcggtgacgatgatgccaactccggaagtgctccagcggaacggctcactgtatttgcacgttttcctggtcaaacagggacagtctcatcatccgcgtgccaaaaattatggcgggagggaagtgagtgaaagaaaaagaaattataatttacccaattaaaatcaaagattgtgtactccagccatcaactgaacaaattcaaaaagaagtactaccaaaaaacagccaatttgctgacaggcaaaactggacaaagtgaattggaccgtcaaaaggcggaggagggagtgaagttcgacattttgaactattggcatccgaacattaccgtcagtttggttactgatttttcagcctggacaaggggttcgcttttcacaccgatttgatcttaagattgttttcggtttttaggtcagttgccggcacctttcgatgaggccgtcaaattcgacccagccagcaatcgctattacccaatcgttttcttcaatagttactggaacttggccaccgaataccaacctgttaacgacaccgttcccgcgctcaatttgaccgtcactttcgcgcccctttcgctgttcaaatggcaactttacgcgtctcaacaagttttgtataataccagttaattgtaagtattgttgctttttgagatgcgtggaaaatgggcccaaatgttcggcggggaaatcttcgaggagagcgacgccgaccaagacgcaatcaaacaggcactgatcgagacgagtcccgtgctgttgggcataacagtcgtcgtgtccattctccacaccgttctcgagtgaatttcacattttttttttcttgttcctttagctgcttatattctttctattttcaggttgttggccttcaaaaatgacatccaattttggcgcacccgcaaaagtttggaaggcctttctgtccgttcggtgctcttcaacatttttcaatcactg

SEQ ID NO: 55692 - DNA, 232 bp, Heterodera glycines
  Genomic contig location: Contig_ID=SeqID_4782; Location=178..409; Strand=-
  SCN-specific regions: Sequence locations=1-44,79-191,219-232
atgtggataaatcctcataatgagtgtgtattagtaatattcagaatttatttttaaattaaattttattaaatttttgtcagattttcatgtgctgctgcccctgcaataactgctgagattggaacaaaacggagcttaaccaagaaatgaaagatggaaaaagaattgatcgtcgcattaatttggactaataattaattaatttatttatttatgaaacataaataaa

SEQ ID NO: 55693 - DNA, 2183 bp, Heterodera glycines
  Genomic contig location: Contig_ID=SeqID_4782; Location=1083..3265; Strand=+
  SCN-specific regions: Sequence locations=1-114,149-241,263-556,580 -692,718-1012,1034-1107,1136-1150,1183-1198,1222-1430,1452-1675,1700 -1781,1823-1906,1942-1972,2020-2155,2177-2183
atgtgcgggagcggtgccaaaaaagtgtggacacagcaaagactgacacggtggaaaggtggcattgtaaataacgaactcataacaaagttaaaagcctactggtccgttagtgggcaacccttgaaaatttagccccgaggctttaatttttcaacccccccccccccccctcaatagggggctgctatatatcaggggggagcttgtcattcacagcaagtaggggggaggcttttgttttccaccccctcccctcaataggggacttatatttgaaaggagggagacttctataattattttcgtaaaaataattttcgctaatggccaacccccaactcatttgcttcacccatcccaataaaatgagaatgaatgaacagattggtagctaaagccaaacaaacgatggtggtggtggtggaatttgtgaagctaacaaatggttacgtggcacaaaaaaaagcaaaaaaaaaaacagatagcaaaagcaaattggttttgatgatttggccaagtccacgacggaccatcaccaacaaatgaaccaatcgccaaaaggaaaatggaaaatctgtgctggtaatcagccgatccaatccatccaccgattgtcatcattttgagttgagcccaacaaattatgcacatatgtaatgaagttggtaatataatcaaaatgaaaagccaaataaataaataaataaaaatatacgaaaatattgggatggacttaaatggacagccttaaaaatcctcaaaaaaccctcattcggcagagataaataaactctcttcagatggatggatggatatgtgtgtaaatttgtattcggaccccccggcttaataattaaagccgccgtgggctctattagaggctaataacgataattatattgaaaataggtatgcacattaatttgtgttcaaaatgaatttcttcgaattcaattatatttttcttgaatcattttttcaaatttccataaacagaagaatatttgtcgttaatcaattaaattaatttctcaaacccatttatggggaataaaatttataaagtttccattcgagcatttaaattaataatcaaaaaggtcgttaattaattaattaattattgattaatagattgatgattatgaaatttattaaaattaataaattgtattttttgtcattttcaaagcatatactttttatatttacaaaaaagcaataaaaaataagaattattccaaatttttacaagatcaaggaaaatttcattgtcattaccagccttaagaataatttttaattaattgttctcaaattataaaataatttggtactttcctgttttgaaggcaaaccttggactcgtatttatgtgagtttctttggctcgaggattgtaagcaaccaacgtctatgaatttgacgaaattttggcaaaaattgttgcttttcatatgcctccaaaataagtcaatgttatctatccaattttttctaataatttcgacaaattttttgagcaaattcgtcttgaaactattggttcatttgaaaaagtacataaaatttccagtaatactcaaaactggaaattttaaaatttcagcactcgaaacacaaaaaagccgaatcttttaaaaaaaatttcttaatacttaaaaacccgaccaaaaaaaaaaattaaatttaaaaacaattacttttacagttaattgagaagctctaatttttttgttgatgagaagaatttgagaggaccaaactcaaaaaaaaggacaaattttcttttattttcaaaattaaaatcaatttaaaatctgcaaattcatggtcaacagaagaaaaatgttaatgagcagtgagtataacctgttgtagttgaacgagttcaatttagtcatcaaatttaggcaataattaattgaattttataaattttccataattagcataaacaattatgaacaaaatttagttttatttaattattaatatgaattaattaatttttttgtaaatggttttgagaaattaatttaataattaatcacaatttttgaggtgataattgacaaatattcttctgttagaaatttggaatatccaattaaaatcacaatcctaattttaagtgcatttgtttaaatagcaaaaaatatataaagtaaaatcactaa

SEQ ID NO: 55694 - DNA, 663 bp, Heterodera glycines
  Genomic contig location: Contig_ID=SeqID_4782; Location=4267..4929; Strand=-
  SCN-specific regions: Sequence locations=1-26,48-663
ccctagtaataaagaaactacaaagcaaaaaaggggcccaaaaacgttggaataaatgggaggagagaaaagcgcagacggccaaggcgagacaagcctatttggccaagagaagtgagtttttccatttttgttcataaattcccaaattttccaatttttagccgctccccagcccgacaccgatgccgaaatgccacaaccatctgaagaagggccgtcgacagaggcaccggcgcgggacaacgacggacgaccaacatcaactccatcaccgatgacaccgcaggaaatggacgtgccgtcggtggagatggtggacaccgaggcagcaactccgaacaattgacgccgctcgttacccagtccggccaaagcttcatcttctcgctgctcacgtcgttccatttgcacgcactcatctctggtggggactgatcagtgaacagggaatggagcatatgcacagaatgtgcaacaatttggtttaatgaataatttttcccattaaaattataaatccaggtcggtcgttatgctcatctcggcactccagagaaggttgttgagaagttggtgaaacacgtgacactgctgaatgcccttcactatcgaggtgtcgaaaacagtcaagaaaatggaaacaaatacccaaacttttga

SEQ ID NO: 55695 - DNA, 738 bp, Heterodera glycines
  Genomic contig location: Contig_ID=SeqID_4783; Location=204..941; Strand=-
  SCN-specific regions: Sequence locations=1-632,654-738
atgggcgatttggagacaacgctttcgacaacaccaactgcgccaatggacaccggagagacgaccccgccaccgctggccattgacgagcgatcagagcgcatcgaacaactggagaagcagctcaaggaccgggacgacaccatcaaatttctgcgcgagcaggtgcgcaatcgagaagcgctgatcagtgatctgcgtcgatcagtgatctgcgtcggcagctggacgagcacattgtaccaccgatggcaccaccaacgagcagcaaaagtgagtgaaaatctcacattttaattttaaaaaaccttcatttttcatttaaatttcaaaaaacccatttcattcaattttagcgcctccaaacagaggaagaccgaagaaaagggtggatgaactccagcgcagcgccaggcgcgacatcgtcgacgcaattgtgggcgtcatctatcgtgatcgctcgcgttccgcgagcgcgacttgacggggaacagcatccgcaaaatcctcgtccatgccgatcaaatggaggcccttttcgaaacggaatgggccaaaacaatttgcaaaacaatggcacatttggggaaaatccaaattttcaccaaagtaattggttttcatttttgtggaaataatttttttaaatttaaggcccagccattgtctccaggtgatttggatggactggagacggcagtttaccagttcaaggcatttctcgacgaacaaccaatg

SEQ ID NO: 55696 - DNA, 432 bp, Heterodera glycines
  Genomic contig location: Contig_ID=SeqID_24960; Location=1195..1626; Strand=+
  SCN-specific regions: Sequence locations=1-12,34-432
atggagcggcataataaaaaacaacaagcaaacattggacaattgattaaagaaaattgtgattggctctgtgccttggccaggactaaatccgcaaaaaaatgcaataaaatgataaagaaagcgaacacagaacaattgctttcacttgtggaaatttgtctaaacctagtcgcttcgcgtttccgactgaccacccgccagaaaaagagattgctaccccatgtggataccgtacgccaaatgagcagagcgagaagtgagcggggcgcccgacgtgtgcttgtccagaaaggcgcaggatttggaggactgtttgctgccgtattaacccccgttctaattgaattggcaaagtctgttatgaccaaaaatgcataaataccccacactgctttgtttttatgtgcattcatcatcatcattcattca

SEQ ID NO: 55697 - DNA, 627 bp, Heterodera glycines
  Genomic contig location: Contig_ID=SeqID_24960; Location=1687..2313; Strand=+
  SCN-specific regions: Sequence locations=1-234,280-313,336-365,388-627
  Gene Ontology: Mol. function=RNA binding; Cellular component=nucleus; Biological process=mRNA processing
atgtcggacacgagtgacattaatttggatgctgtacgacacgatttgaaccgagacaggggcgaacgaacaaatccctctgctaaaaatgtcaactacaaccaacagcttaggcggtatttgaaaatgaggagggatctaacaaacatgccgacaaaagttgagatgtcaaaaggaataagtgtactgttaaggagaggtggcgaagatgaagatggagaggttgtggatactccacctcgaccacccgctccaccaccaccaccacctccaccgtcaggtaaacgccctccgcgtggaccaaatcctcccgctcctccaccacctccaccgcctgggagacgtcctccacgtccacccagccctccttctccaccaggaagtccaccgcctcgtccacaacgtccccctagaccatgtagagctgctgcaccttctcggagaggtggtctcatagagcaatggcggaaaagacaatatgatatacaacaacggcggcccgtggtgcgggatcttttggcggaagcagctgctgctccattgcccgaaagtgacgatgaatatgactatatgctggagagtggattcgcgctgccagcaccatcacagtactatggagatttgcct

SEQ ID NO: 55698 - DNA, 790 bp, Heterodera glycines
  Genomic contig location: Contig_ID=SeqID_24962; Location=375..1164; Strand=+
  SCN-specific regions: Sequence locations=1-20,42-535,557-790
atgcttgctggtaggaaactaagttgaagtgttttctaattttcaaaaaaaattccaggcctctacctatacttggaagggctgcagaaattggcaacttttcagtaccaactttgcccagttcagtccccgttgaataactcattaggctttgacctgagcgcagggtggccagcggacttattgtagagctcggtgagctcgatttttccaaatttaaaaatttcgaaaattttcaaaatttttcgagctaggcctaaaaaacggttttcgggtttttgaattttaggattttttaacgaattttcccagaaaaacgaagaccacttccaaaacatagttttcgagctctatcgactggtatttttttcggaaaaatttcgattttttcccggaaatagaaaaaatttttggcctcagcgggacatttgagtcccgggcccataactcgtcaggggttggttttagccaaaaattgtcttagaacatttttgtagagaattttaaatgctatcgaatggtgtgcttcatgactggaaaatttcaaaaattttcgagctaggccccctagaaattttcgaaaatttttttggggtcctaaatttgggtgtaaaatttttttcttgggtattttggggtgctgagcacgaatatgatgtttgttttaagttacagtatttttggaattttttaaaaattctttattttttggtaattttttagcccttggaaatttgggttaatatttgaaaatttataactcggtgatggtttcatcgatttaactata

SEQ ID NO: 55699 - DNA, 742 bp, Heterodera glycines
  misc_feature (680)..(680): n is a, c, g, or t
  misc_feature (719)..(719): n is a, c, g, or t
  misc_feature (740)..(740): n is a, c, g, or t
  Genomic contig location: Contig_ID=SeqID_24964; Location=859..1600; Strand=+
  SCN-specific regions: Sequence locations=1-88,112-121,158-230,272 -621,643-742
atgagtttaatgagcaatctgatcagaatatttcgtctaatgatcaaagcaattcagcatatatggtaatgaatggtaaaactaacagaaaaataatttttaaataaaattcgaacgtacgattttaattatttataaaattttaaatatttatttaggagaaaaaaaacaagaaacgaaatagaaattgatcatttgaataaatttaatttgatgaagaaagaattacgaaaagaaaatgtttataaaaatttgacaactactcaattagaatccgaatttacaaagaaattcaatttgaaaacgaattggaaaattgatgaaaaatagaaaaaaaaatggtgttgcattgaaaacaatttatcgatggaagagaaaaaacgatttaatcactcgtaatattttttaatttgccaatttgagacgatggacgaggaaatttggcatcacataaattcgttagcttgtgtcaaacccaattttatccggtgacactttgctaatgcctaattaacagttctctatgggtgaattttcctattttcctattttccttgtttctttttttttctttttaatttctctcactttggcatcatactatctttccatttcactgatagaaaacaacatttttatttcgctctataatcattagggcttcgatttttaggcactanaattgccaaaataggcaaaaataggatctctcaaaattntttaggctttttaggcgctanaa

SEQ ID NO: 55700 - DNA, 450 bp, Heterodera glycines
  Genomic contig location: Contig_ID=SeqID_24965; Location=514..963; Strand=+
  SCN-specific regions: Sequence locations=1-280,304-450
atggaatctgtggctcatgattacactttttgtcggggccgcttccaaagtgtcaattatgacacatatggtcaagacgaaattccaattcctttggccactctcatcgatgactatgtaaagcgggaaaccatccaagactggaagtgtccgaagtgtggtcgttcacccggtcgaaaggaactgaaattccattcgttgcccgatgtgctcattttccacctgaaacgttttgaattggtatgatgttctggctaattgtaaacaatactctcagaactctagaaatcagaaacaaataaaattacaattgattttcagctcaatgatggaattgcgagcaaaattgaaagccgtgtccaagttccgctggagggtctcgacatgggtccgtatgtgttcaaccccgatgttcgagcaaatacactgccgaaagtaccttccaattga

SEQ ID NO: 55701 - DNA, 624 bp, Heterodera glycines
  Genomic contig location: Contig_ID=SeqID_24966; Location=189..812; Strand=-
  SCN-specific regions: Sequence locations=1-283,305-336,359-535,567-624
atgccaaaattctggtttccaagtacaatcttggaaataaatacagttaaaatttccaagcataaaagccaagtgcgtacttagcatccaagtacgaatgggagccctgctgatatacatacatatgtaaatttagattatggtctatagctacatatacggcacagctatatctacagcctttgctttctacaaaattgatgaagtggccagtttctgtgcagttccttttgccgtgtggactggattatactgtctgctcctgaattatttccacgacaaacagaagcaggacaaagaggaataatgaatttgcagaaggaaaatgatgaatgacaaaaattaatttgtattattagaacaagtacctatctgttttatcataaaacatttgtaatcgatcgacccattcatggaggataaagatgaaaaaaattgaaatagtcgtttagcgccgacctttcggcgccaggctcatttcggcaccaagccgggaattatacatagcgcttcttttcctatcactatcatttacaaatatttgtatttatatttattttattattccaaattcagccattccgaatacggcggcagctcgtccctccccccccccccattaaa

SEQ ID NO: 55702 - DNA, 1190 bp, Heterodera glycines
  Genomic contig location: Contig_ID=SeqID_24967; Location=5..1194; Strand=-
  SCN-specific regions: Sequence locations=1-302,517-568,732-911,933 -982,1044-1065,1094-1160,1182-1190
atgatgagaaaaggcacaacagtgatgagaagaggtacaaaagtgattaaaagaggtacaatactgattaaaagaggaagaacagtgatcagaagaggtacaacagagattagaagaggtacaaatttgataagaggtacaaaagtgataaaagaggtacaacagtgattagaagaggtacaactgtgattaaaagaggtacaactgtgatcagaagaggtacaaaattgttaaaagaggtacaaaagtgattagaagaggtacaactgagattgattagaagaggtacaaaaattgaatgcaatttattataaattttaaaaaataaattaattattccttttattaattaaaaagagaattttaaatgtacaataattgaatatttaaattaatataaaattaatttttataaattcaattaaaaaaatatgaaattctttattaaaagataattgttattttttacataaattcttttattattaatttacaacaaatctttaaatataaattgatacaacagtgattagtaaattcattaaatctaaaagaaaatatttttaacaaatttaattaaaaaaatacatgaaattctatcaattaaaaaaataattaatttaaacttataaaatttatttatcaaaaaaaaattaaattaaatataattttttatttattaactcaacaaaatattttaaattaattaaattcattgaaaataacgtaaaaatgcacaaaaaaataatgttacaccgtccggattcgaacctgcccccccccctcaaaatgatgcctcagaatccccaatcacacagggattctgaggtcttgacgatgtcaaaagtaaaatctgatcacgtattcgtgatcagcggcccaaataacccctaaagacatatttttggaagatttttgtgagaaaaatttttccactcaaaaaccatgtgctcccccctttggacccgaatcacaaaatcacttttatttttatatctttttttaaaaatgtgataaaaatttaaaataaaatttatattatagagaaaaaaattgtggatttttgtagtattttacttttctcaaatttcttttcagaaggcagttacgaatttttttctgaaaaatctaaaatttccagaatttctggaataacttttttcatattgatgttagaaaacctaaataaa

SEQ ID NO: 55703 - DNA, 1223 bp, Heterodera glycines
  Genomic contig location: Contig_ID=SeqID_24968; Location=408..1630; Strand=-
  SCN-specific regions: Sequence locations=1-80,103-113,143-262,284 -306,328-392,414-520,542-553,576-588,657-745,772-907,932-1087,1109 -1223
atgctttttttcaatttaccgccaaaaacccttttattagcattggtcatgcttttatcaagcaaaaggagtcaaagcatatcaaatttgcaaaaaatgcactctaaaactggtaaaaattaaataattttttttaaattttgcattaattaattgcctattcacattgatagattacttcaaattggccactgaattggtggactcgtcatcatcattcaatgaaattataaaagcaggaaaaattgatggttccaattttgaaattggatggtgggaaaagcgtgcctttggcattttatgtgttgccaaatttggatttaaaatggatgaaaatttggaaaactacacaaaaacattgtaaacagttggaaaatgatgaaaatatgctgaaaatacatatttctcaatgataaagaatcattgggaaatttgaaagcatttgtatcaaatgaaaagccgatcattgatacaaaaattattcttgaaaaaatcaaaaaattatcaattcttaactacaaaaatgaagaaaacattgaaacaatgctgaaatattttatttggggaacatagaaaatttcgcaattcattaaaagtatttaagtttaataataatttaaatttaatattattaatttattttgattaaaatttaagcaaaaagcctttcatttgtcaacaaagcagctgaaattttttaagcaaagcaattccgtttttctaatttttttttgagcttcggaatttaaatttctgaaaatttcaaggccccgtgaacttgaaagtccaatgaaaatccatctcatcaactaattaatccaattagttaatttccaattttctgcaaaaagcctaagcagcggagagaatagtcaaagaagaagaagaagaacaaagcgtatggacaatgctaatgataataatgataatatggatatggtgatgaacggatcagaaaacaagcggaacgaatagaaaagagaggagaagccaattcaaaaatgcacgaaatttgtgtgaatttaatcaaatcgctgatcgctttttattttggttttcgccgcctgatttatcttttttggacaatttaaattatttgggcattttcatattcatgatgatcagtttaagcagtgtaaaaaatttttttaatttgttgcaccattccttttctgtcccttttgtcttgttatatatgcttttgtatgctaaatctaaataaa

SEQ ID NO: 55704 - DNA, 1683 bp, Heterodera glycines
  Genomic contig location: Contig_ID=SeqID_4784; Location=166..1848; Strand=-
  SCN-specific regions: Sequence locations=1-531,553-585,608-996,1031 -1288,1310-1683
  Gene Ontology: Cellular component=basement membrane
gtgttctgtgccatcaacgagctgggccaaaccaagcgtgtggatgaagcgctgtgtggccaaagcctggaggaaaagccggtggcacgggaggagtgcgtcaacgaggagaaatgcaccggcacatttttcaccggcccgtggagcaactgtacggccaaatgcgacggtggcacacagacgcgtacagtagtctgcctgaactacgataaaaagccggtgccggaatggtgcgatgagaaggaaaagccggcggagcagcaggagtgcggcatggacaaatgccaaagtggggaaatggatttgaatatagtaataatttaatcattttaggcttatggagataatcctatcaccctgagttaatatgatttgtatgggttaattagctgatagcccagagttaattacgacagcgttcatttggacccacgcactaatcaatcgtccagagttaattacatcgtatggggttaattaattatttagattgtggtcaccaaacaataataatttatccaatcaccttgagttaattatattttatggttaatccatgtgtcatagaataataaatccaatttttcagagttaattatattaggcaggattaattaggctcatggtataatcaatcacccagggttaattagatagtacggagttcattaagcatttgggattcgtccgtcgtcctatcactttggaccaaaaagaaaagaaacgttcttgtttgacattgccttgccacacttcacagattgtaccgacagtgagttcggctgctgtccggacggcgagtcgttcgcctccggcccttacctcgagggctgctccaactgttcgtccgtggccgagtttggctgctgcgcggacaatgtgacggcgcgggaggacgctcagggcacaaattgtcctgaggcagcggccggcaaaaagggggtgacattcgacgaagcggagggcagcggggaggagccgaggtaagagccatggaaattttttaaatttttaattttaaagtttttttgatttcattggcttgacgaaacctcggcttcggcttgggaaactcccgagtttttttgagcttcaaacttcgagctttggataaattactcgaagtttcgggaaaaattaacttcctaatgatgggctcaataactaagagaatgacactttttttctctaatttttcaaaaaattttgctgaaaatctggtaaccaatcacaatcatatttcaaagaaatttaagtctaatcctgatcagaaagaattttaatcagttttgcattggtaaaaggcaaaaagcaattttttgggtccgatcatcgggctgatcacttcaatctaatcaatttgcattggtataaacgcatatatgatcaaagggaatcatttttgggtttccgatcagtcgggctgatcacttcaaatttgtgttacagtgacgctgaagaagcggcgccgccttccaaagaaatgtgcgcaattgaaactgtgggcaccaaggagaagctgcaaatcccatgcgcggaagcagccgccgtcacagaaacaatgaatgaaacggtgcaactgatcaaattggcgagcgccgatgaaacggcgccggaggccaaagaaacaaacgcaacggcggaagaagcggcgccggtggaaaagccttgctccaagacgga

SEQ ID NO: 55705 - DNA, 108 bp, Heterodera glycines
  Genomic contig location: Contig_ID=SeqID_24970; Location=1..108; Strand=+
  SCN-specific regions: Sequence locations=1-108
ccgtctagagcttaacaaatttaaaaaacgggcgcgaagcgcccgtcagagcaaaacaacatttgaaaaacgggcgcgaagcgcccgtactatgccgcgaagcgggcg

SEQ ID NO: 55706 - DNA, 382 bp, Heterodera glycines
  Genomic contig location: Contig_ID=SeqID_24971; Location=624..1005; Strand=+
  SCN-specific regions: Sequence locations=1-304,326-382
atgcctacaaatgtgttttataaattaatgaaagtaagttttaagggctttttggggtcgctgatcagtgatcacaatccgggctcagatcagcgcgaccgttcactacatgaggtttacatggacaatgaattgacaggcttcctgtaccaagggtaccctcattgtcaaggtgcccatgaggatacctaccattcatacaaattttcgtattttacatatatattcttactaaagtttaaataatcatttattgctgtttagataactttaagctcactttcatgtattaacaaaatacaattaaattttcaaaattttccccggcggcgccgccagaccccttaactcgacaattgttgtaaaaaataatgcagcaaaa

SEQ ID NO: 55707 - DNA, 1351 bp, Heterodera glycines
  Genomic contig location: Contig_ID=SeqID_24974; Location=1..1351; Strand=-
  SCN-specific regions: Sequence locations=1-67,89-874,896-1151,1174 -1351
  Gene Ontology: Mol. function=adenylate cyclase activity; Cellular component=plasma membrane; Biological process=G-protein signaling, coupled to cAMP nucleotide second messenger
ccatgtttaggagattggctccgacgcgggccattcgacggtgtcaatggccgaccgactcgacacggccatttcccaccaccacaacgccgcctctttgacccgtttcggtgggttcaaatgccaaaaatcacttgcggaagggaatgaatggcattcccttttaagacacggaccatcgggactttgaccagcggttggcacaagtgatccacggggcgaacggcactttcgcgaagggtttttggctccatcaaaaagtgccgcttattcaaaacttaaatgtttcatttctctttgtcaaaattaagtcgctcaatcgctggacgctgaacttcaaccaaaaggacatcgaaaatgaataccgtgcacattttgcggcaggcgattcgtcggaacggcactcagcgattcgaagcacggccaatgggttgaagaagcacaagcaagtgggtgccgttgattaacacttatttcaacggcaattcctggccacctctttcagctcagtgctcagttggaacggaaccgtggcggttccatccgtcccgttctgttggcctccgccgccgccgagtcgaagcagcagcaacggtcgcgacggccacgctatcgctattctggcgtgttcatcgacattttcggtgtcattggcaaattattgggcccttcctcaattcccactcattttgccaagtgtctgctctgctctttatcatttgctcccttctgttcctcgtccaaccgaacatcgccgtctctctgccttttgtcctttacattgctacggcttcggttttcctcaccggtaaaattcgattagggatggcaccgtttggtcgtcgcttattggcaatgtttccgcttcgctctgtttagctgtcgtcgttctcatcggacttcctctgctcagtcgccgtccgcttttgccttgtcttcaccagtgggcccctcggcacattgtcggtgcctttcttatcgctttgcccgttggcattgcgctgttcaacgtgccgttgtgcacctccaccaatccggccagttcattgtgcatttcaaatcggcaatttgcgcttcgtctgctctactcgttcaccatgcttttggcactgttcgcccattgcaatttcaggtgcattttttgcgaccgtgccattatgctttggggtcatttcccaagttattttcagccaacttggcgcttggccaaagacttgccaagctatcggcgtgggactgatctttttgctcagcacttggtctgtccgctgctgtgtcggttgatagtatgggttttatctccaggttttgccaacaacaactcgaccacattcgccatttgaacgacgtt

SEQ ID NO: 55708 - DNA, 489 bp, Heterodera glycines
  Genomic contig location: Contig_ID=SeqID_24979; Location=126..614; Strand=-
  SCN-specific regions: Sequence locations=1-6,152-175,201-346,368-489
taatgcttaattaaatatttattatcctttttaaaaatcaaatttgaaataaaatcaatttaaaagttattttataaattgttttattaaaaataagttaaatgaattattaccaaaaaaaaaaaaaattaaaaggaaaaaaatataaaatccctctaattaaatccgggaagggtttaaaataatttattttatttaaacgggcgcgaagcgcccgtctgagctcaacaaaatttaaaaacgagctcgaagcgcccgtccgagctcaacaaagcttaaaacggaaagcacgcctgtcaacaaaatttaaaaacaggcgccaagcgcccgtccaagcccaacaaagaaattttttaagaaaaataacccgtttccaaaagtttttttaagtcagaatattaaaaaagacaatcgctgcaataaattttctttataaagatttagtcccaaaaatccgcggatcacagtcgcgcattgcggattcaaatt

SEQ ID NO: 55709 - DNA, 380 bp, Heterodera glycines
  Genomic contig location: Contig_ID=SeqID_24980; Location=40..419; Strand=-
  SCN-specific regions: Sequence locations=1-380
atgggaaatgacccaattgatcaaatgaacggtttgaatgatcaaaacattctcaaaagtgttcagagttaaaaaagaatcaaactgatcaacaaaaaagagaaactgttaaaaaatttgatgcaattaaagaaaagttgagagaaaaaggagaatacaaagggaaagatcaaagcaaaattgagagaaaaattgcaaaattattaggaacaaatcggcaattaatacaaaaatggaaaaatgaattaaatttaaagaaaaccaacagaatgaaaaagagtttttatgatgagaaaaagctcaaactcattgaaagaattgatgaatttaaatggccaaggaaaacagaaagaatttgccaaggaattgcgcattcataa

SEQ ID NO: 55710 - DNA, 1281 bp, Heterodera glycines
  Genomic contig location: Contig_ID=SeqID_535; Location=1626..2906; Strand=-
  SCN-specific regions: Sequence locations=1-93,115-448,471-1281
atgtcggacaatccgaaagaagcagagaaagaaatggaaaaagcgatgtaatattctaaatttgattttctatgctaataattttgcttttccgttttcagcttcatctctgccgactgttggctttcggtgttcgatttgctgccgccctttcagcttggccttggcattgcgctgatcagccaccgttttgactatttcatcaacgaacatttcaaaacgcgcaaatggaaattgggcgaaatgaaaattcaacgcaaaactggagagaaaggcgcaaagggaatggaaattgtcaattctgatcaaaaagcattgccaatcccgcaaaatccgttgccgaacaaagtcatcggattcaaaagcatttcgatcgagtaaaaattgaatttggaaatgatttgtgcccataacagtttgattttcagcttcatcgaccaaaatgtgctcattttccttcgccattttcaccgctttttcgcttcatgtacaacaacattgaatattttcacggtgaatgttcgcatttcgaagttgattgtgctcaacatttggccaatgctcaaggacaccattcgtgggatggctttggacaccgtcaatcttcgtccaatccgccaattggctccgtcaatgctcaacgattgtccatcccttcgcgttatcactttctatggccccatttccatcgaatttccacctgatgaaagtgccaatgcatcgaatggccaagcggtgaccaaatggctgtttttgcctcgtcctgacaagttgccgaaggagctgacaatctgcattgaggattcagcggtggagcagcaatggttggcaaccgttcaacaaatcaaagcggtgatttgtccgatttaattcgtctttttctattttttgtctttttaaggctttttcctccgcttcttctcctgtcaatttcgtcattactgtttactttccgccgtcctcttcactttctgccgttatgccatttaaactgaccaacgaattcaccggggagcaattggcactgtccaaagaagatggagaagaagattttagtggcttttccatcattcgttgcccaattgtgccagatgataagagacagcagcagatgattaaggaattggacaaacgatggaatcgaattgacattttcattattagagacgacggagtcggcgatgggtgattaacaattttaaaatccaaattcttatttttattttcagtcttctcgacggttcgcccgggccgagtggtgatcagaaacagcagaaatga

SEQ ID NO: 55711 - DNA, 1652 bp, Heterodera glycines
  Genomic contig location: Contig_ID=SeqID_535; Location=4675..6326; Strand=-
  SCN-specific regions: Sequence locations=1-70,92-115,137-207,230 -293,348-1030,1054-1184,1206-1330,1352-1406,1479-1572,1597-1652
atgatggcatcggcagttggccctatttcacggctgccgcccgccgcggtggctgcgtgcgcttctgccgccgccgacaatggcagtggtggactgctggcagccgttgcggccacagcagcggcagccgcagcggcggcaatgtttgcgccgccaacggatgccattgccggcaacaatgccacgacgcctgcaacaacaatggtgccgccgaggagcagcgcggcgactgtggcaactcccgcggccgcttcactgcttgtcgccgcgatgaatgcggcggcgttcgctcgccaacaacaccaccaccaccagcagcggcaatgggcggaggcagcggcggcggcaacaatcgccaaaccaattacagtgagcaaaaaggcgatcgacatcagcggcaacataatgtaattttatatttggcgcacgactgggccgtggtggaagcagttcgtttccctcccacccccgcaaaaaataacattttttttagttttctaacatttattaatcgaaggaaaagttcaaaaaatccaagtttttctgatccagggggtcggacggtaacggcgaaagggtgggcggtcgggagcccggaacgtagagcagccgagaacaattcattttgggctaattatgaacttggtcatatgaaaaagcatttaacgtatttaacgaccgacactgttgagcccttcaatactactgtatttgatactgtatttcgcgaactccgaatctgtgtcttgaccgtaatttgaatttcctttaaagttccactggcatttcactaattggccaacagctgtccggtccgaattacgcaaccagcgaaagttcgtcgtcctcttcggcgtcgtctattgatgaaagcggtgaagagccaccaaaaaagcgaccaaaaagcgacaaaaaacaaaaaaccattacgactgacgcagctgatgatgaaaaagcgctcccatcaaaaacagaaagtaatttctgctttcacaattgctgaaggaatttactaagaaattagcaaatgaaaatattttatttttattttttcgtattgatgaatagtgccaaaatcttatacggaaatggaaatttgcgcgaaaaattatagtgactccaatcccgcgggatttgcaaatggtcatgagagatcccgccattggatctcgatgaaaaattgcaaaaaaataaaaataaaatttccccgaaatttgacggccggaattttgcctctgaccttttctctgtcatatatttttctcatttcaatttttttttaaataagcccaacttttaaggctcaagttttgatggtggcaccagtggcagtgaagctggcggcggcactttacaaagtcaagcggcggcaaccgccacaaaattatcgccaccgccgtcgccacgcgacagcggcggcgacagtgggacgacgactacgacagtcgacgggggcggcggcggcggtctgtggcgaccctttcatgcctgctaatgaaggtcgtccgtcggtcgccaacaaattagtgtctgtcgtcgtcgccggcggccggtcgcgcccctgggggcacaaacagcagcaacaacaaacaacaagttgccgccgcccgtcgtcggtgcgcttgtcgtcatccaatcgccggcggcgataa

SEQ ID NO: 55712 - DNA, 399 bp, Heterodera glycines
  Genomic contig location: Contig_ID=SeqID_535; Location=6343..6741; Strand=+
  SCN-specific regions: Sequence locations=1-399
atggacagtgcgcggaacgcggacggagttgcgcagtgccgtaatggtgggctggcggcgatgaagccctgctggggcggtggtgccgacgataccgccggagttacggtagttgccggaggcgtcatgccagcgtcggcgagttttgcgtcaagcaagctgttgttgccaaatgcacaggtcggctgtcgaaaggctgctatttgggatgcttttgtccgtgaactttggcccatttttgaaacaagcatacaccaacatttgaactttgccggtcataagcatttcgacattttgcgtcgtctgatttcaccgacaattctcactgatctcaacaaattgaattcaatcaattcggatgatttgttccccgatggaattgctgctgatgatgaatga

SEQ ID NO: 55713 - DNA, 478 bp, Heterodera glycines
  Genomic contig location: Contig_ID=SeqID_535; Location=7734..8211; Strand=-
  SCN-specific regions: Sequence locations=1-478
  Gene Ontology: Mol. function=DNA binding; Cellular component=nucleus; Biological process=G2/M transition of mitotic cell cycle
atggatatcgccacctccaaaattgcagcgatcaatccgactcgtcttggccttgtactcaactactccgtgttcctcgcggatctcctgaaatctgtgaacgaggcgcgcaacttggcaaaaaaggtgggaccaattcgaatgcttttattttcatcattgtacatataatcttgcttaattctccgccaattttcaggctattgacttggctgaggcggagattgcaagtatgacggtgccattggatgatgacgcatcgatcaacctacaaacgctgagggaaaacatggaattgtggacaccggcgcgcccccgctaagacgaccggagaaggaagtcagaccgatcggatggacgatattatgcatacaacaacgatattcaacagattgtgtaaataatgtatttattgtgtatatatatatgccattgcatagtattgtatatatttgtgtgtgctccttgtgctaataaa

SEQ ID NO: 55714 - DNA, 1353 bp, Heterodera glycines
  Genomic contig location: Contig_ID=SeqID_536; Location=46..1398; Strand=-
  SCN-specific regions: Sequence locations=1-495,517-603,629-746,769 -911,944-1153,1175-1353
  Gene Ontology: Mol. function=protein kinase C inhibitor activity; Cellular component=cytoplasm; Biological process=regulation of mitosis
atgacggacgagcccgaaacaaaggaccaactaatctacctgatcatcgtgtgcgagaaggcgcgacgcttcgacgacatggtggaggcgatgaaaaaggtgtggccatccatcccatccgatcggttgtggttgcaggatttcacaaatgttgatgatcaattaaatgctttatcccctctcccccatttcagttgatcaaattggaccccaatcttggcctggaggaccgtgtttcgctggcactggcctacagaggtgcgatgtcttcacgccgttcgtcatggcgcacgttggtgtccatcgagaagcggaccggcccggaaatgaacgagcgacaacatcaggtggtgccaccgtcgatatttggaggccccggcggcacattttccgttaaaaatgtcactgaccccttttttccccaaacacaggtgatggagagctatcgtaagcatgtgcagaacgaattggtgaccatttgccaagaacttttggtgggttttccgtttaaaaaaattttttttgtacatcccgaatttctcttccgttcaacagacgtgcatcaacgaaatgctgctcccgaaagcgaccgacccggagccgaaggtgttctacctgaaaatgaaagccgactactaccgttacatggccgaggtggcgacggatggggaccgatcgggtgagacagaatttgtccgatcccaatttttaacagcatttttgatccgccattttttcagaattttatgagtccaattatctttgaagcacccccagttttttggaccataactttctatgtttcagcaaatcatgcattttcagcgtttttcgaatggataccaaaatctgttgtatttagagcatgaaaaaaaagttatgacccaataaagtgagcatgttcaaagttgattctcataaaatgcaaaaaattaaatattttcgatcgtatcataatttttttttgttccgcaggtgtcgtcgaactcgcaaagggcgcttaccaagaagccatggatatcgccacctccaaaattgcagcgatcaatccgactcgtcttggccttgcactcaacttctccgtgttcaacttcgaaatcttaaaatcggtggacgaggcgcgcaaagtggcccaaaaggtgggaccagttcgatgcttttcaccatgcttttccttttattgtgaaatgtggccaaatctcaccccgttttcaggcgattgacttggccgaggcgcagattgccacactgacggtgccattggctgatgacgcttcgatcaacttgcgcatgatgagggaaaacatggaattgtggacaccggagggcggcagccacaccaagacgacctga

SEQ ID NO: 55715 - DNA, 883 bp, Heterodera glycines
  Genomic contig location: Contig_ID=SeqID_4786; Location=86..968; Strand=-
  SCN-specific regions: Sequence locations=1-506,536-883
atgagcattgaattcaaacattttttcttttctgcattgtttttgcatttaatatgcgtaagccatcaaattaccgccgaaaaagaatgccaagaatatgaaaatgaatttatgggatcatttaatgggttttcgaatgcttctgaatttgtttctttcaacaaattcacaaaggaatgtttttctttgtggttttgcgaaaaaacaaaatttgtatatcctaaaaatggtaaagatattgatgcaacaatttcggaaataatgacaaaaatccataagaaatattgtgaagaaattggaaaagggcaaaatatagagaatacattaaataaaatggaaaatgaaacggaaaatttaatcaaaaatttgaaaaaagacccgaaattgcaagaaaaggttcaaaatatggttgaaatggagctgagcaagaaccgaaaactgaatgaaaaaattcaaaacgcaatggaacgcagaaaagttaattccttctacgatttgcttaacggtaaaatttaaatttttattaatttaattactctttttagccgcttttcaaacattttttggaaactgcaaaaactgttccatcatgccacaaaaagaactgtcaggaagaaggaaacgacggatggcaaaacatgaaatgggaaatacatcaaatacagcgaatgagcaaaataatttctctattgctggacaaaatttggtgactcaaccaaccgttgtgcacaattcaaatgagacaggtctcgagctcgtcactcattcatctgatgacaatgaccatcaaaatggtggtacaaaccgaggtttttttgaatgccgaactcccaccacaaaatcggaatttgtctccgactcgtcaaattttgccggaagatag

SEQ ID NO: 55716 - DNA, 2202 bp, Heterodera glycines
  Genomic contig location: Contig_ID=SeqID_4786; Location=3153..5354; Strand=-
  SCN-specific regions: Sequence locations=1-773,795-935,958-1079,1101 -1655,1677-1718,1740-1893,1919-2145,2167-2179,2201-2202
atggtggatgcgaaagtgagaaagaacaaaaacaaatttgttctttggaatttctcctcactctggaaaaacttcccgaactaaatggaaatgaaggacgagagcaaatacggacatttttcaaaaaattttcgttagctaccgaagaatggccagaaaaacgccgaatttcagcactcgagtgtaagtggaaaggcggaacgtgctttcagcgccgctgcagtgaatcggccggcgaaatttgatgcaatacgaagcgaaatggagtcacttttggacgaatgggattgtaccgcaattcaagcattcaacgaattgtgggatggaccaaaacggcgaccaggcgaaaatctggaagaatttgcagaacgagtttaccaacttgtgctttgtgcatatccaggtttgccattggatttgtacaacgattatgcggcaaaacacttcattcgtgctttggaaaatgccaaaatttcgattgcattggaaatggctcgtcgtccgggtttgagctacgacagcttggtcgcgttggctgtgcgtgcggaaatagcgcaaaaagccgcaaagtcaattgcagagaatgaaaacgcacacatagcacgcagctttaaaccaaataaggtggaaaagacgaccaccgattgggaaaaattttacgtccgaccgacaaataaaagcgtctgttataactgccgtaaaattggccacatcgcgcgaaattgtaaggtcaaattcacttggaaaaaatgcggctttgaacaaaataacagcaatatgaattttcaaaaagagaaccaaagaattaggaccgacaatttaccgagagcaaaaattttcccaaaagtctccgcccctaaacgagcaaaggatggccgaaacgaacgcaatttgtcgcagaaaccgatagagtcagccgatgcttcaacaatttttgctggtctttttgcttcatttttggttgttgccaacgcgttttcgaatgtaaaggctaaaactcatagccgccgaatcagctctacggctagtagcagctcgaaattgccggcattatggaatccgttgaatgttgcatttgaaaaattgaggaaaagggaaaattccaaagaaaacggaatcaacagcaaagtgaaaacaccgaaagggaatggccaattgaggacaattgttttttcgaaggctggggaggaattggccgactcaacaggtccaacgacgaagttgttgaaagccgacacagaacgaaaattgtcagccgttgatggcacaattacgaataaatctgcgtcaagttacgctatcaggcctgttcaaaattgtagttttcgttttttccgcacattttacaggtcaaattatgatgttggtctgtgccactgctgattgtccatccttactgccccttttggaagccgaatgccctgccgatggatttgaagcgctgaggacatcgctttgtagagggcgaggatgtcatatcattgttgatttgaattattttggcgttttgttttagtttttgtgaccctttattttattttgttttggttggagtatgtgtgatatatgtgctcttcctaaatttgtaattgattggctgtgtgctgttttattaattggaagtaaaagaaagcagtgaaaagagacggcgatttggttttggatttgggatacaattcccctttcccattggactattctttttcctacgacgtccctatctccaatcacaattaaaaaatttgtcgtctgaaatttggcgtttgttgtttggcgttcgtaattgtgattgaaaccaacgacaaacgccaaatacttgggttgcgctcaacagcgcaccttaaatttgtcgtttgagaagtgtcccaaaaatccaccaaattattttgatccaaaattttttatttaatattaaaaacatttttctatgggtaaatgagttcgctgatcatgaatccaatctcagattttcatttctatatacttttatctatgattttcatccatttattcgggtctttcgaattcaggtttagggttagaattagagcaaattaaatattagattcggaatctacgtacctaaaaaacccctaggttgacccttctccgtcattcgtgcattctttatattattttccttcgtttgttatttaaatattcctccctaaatttgtgtcttccttttctgctccaaataaa

SEQ ID NO: 55717 - DNA, 477 bp, Heterodera glycines
  Genomic contig location: Contig_ID=SeqID_24982; Location=410..886; Strand=+
  SCN-specific regions: Sequence locations=1-7,29-107,129-291,338 -374,429-477
atgtgcaaaatgggcttaaagaagactttgatcaaaggtaatgtcggttgaaacagcgattgattttttgttaaaatttattattacatttgtccaagaatttcaacttttgggatattttgagccattttgaaattcttatttagggaaattttttttttgttgaaatccaaattaaattctgcttcattcctatttaggcttttcatccaagttgtccaattacgttttttccgtcgccatttcctcgaacatattttgagcaagcgtacaacgctcaaacagtaaatcattatttattataattttaatgtatatattttataaatcaaaattacacgataatcttgtccaatttttaaatagtgcttaagattaattttaatacaaaaaatattttgcttttttatatttcattttatatttttgttgaacttttagacctttacatagatgttgggatcgaggaatgacaaa

SEQ ID NO: 55718 - DNA, 888 bp, Heterodera glycines
  misc_feature (51)..(51): n is a, c, g, or t
  misc_feature (129)..(129): n is a, c, g, or t
  Genomic contig location: Contig_ID=SeqID_24982; Location=1769..2656; Strand=-
  SCN-specific regions: Sequence locations=1-204,227-229,295-617,639 -681,732-829,851-888
tttaaagcaggagtcatcggattcaatggaaaatgggcagcagaccagacntcattatacggagatattgacgaaagctcagagcacaggaacaataaaatatggacaagggcgatcaaaacgccaatntggcaaattgtaaaatatgcggacgacaatgtccagtacattttctacggtgtcaaaagctgtgaaagtgagcagatttgtttcaaaaatgagaaaatgcaataaaatttttaattaatttttttattattatattaatttaccagattaaatattaattaaattggaattgtcggatattgtaaaatattctttttgaaattgcaggttgtaagcaattctttcgtcgtgtcgtcacaaaacaaattttgttcacttgtccaagacgaaatggagttggaagttgggacaattaatttttgccaaaatcaattaaaatatttattttcataggtatggtaaaatgccgcggctgtcgcttggacaaatgccttgtggcaggcatggacccgactcttatcaatgtgccaccctcggacaagttcaagcagttcttgaccgaattagagaagcgcaaattgagcgcaatgctgactcattcggaaaagaattaaaaaacaaaattatttgaacaattgttttaagtttttgttttgaaaaactaagtttaacttaaaaacaaaaaaataatttttctatattttttgatagataattttttacccattctttattcagttatttatatttatttggctttatcaattatttattcttatttactagtattttattgcttaaacgacacttattgatcgcattttttggcaatgcttctccataatgcaaattatcgcagaatgatcaaaatgaattaaa

SEQ ID NO: 55719 - DNA, 146 bp, Heterodera glycines
  Genomic contig location: Contig_ID=SeqID_24983; Location=73..218; Strand=+
  SCN-specific regions: Sequence locations=1-146
atgcgccgcttgcggtgcagcacaaatgccccagcatctggcccgatgtgcgtgcttaattgctcgcacattgccaaagccgtagcactcgtgtgccatggtggaacgtcggggcgcaaaatcacttgtatacgacttgactactg

SEQ ID NO: 55720 - DNA, 504 bp, Heterodera glycines
  Genomic contig location: Contig_ID=SeqID_24986; Location=211..714; Strand=-
  SCN-specific regions: Sequence locations=1-79,102-141,282-435
atgcaagatttgagtctcgccatgagcttgaagcaatggagaacaatgtcagcgatgggctatgggactgaatggtcgttgccctgagaaccatggtggcactcctgccgaattggaacggcttcgggtgcagccttaaagaataattgtattattatcataaaaattttaaaattttcttaaatataaaaatatgtattttttgaattaaaattaaaatttttatagtatatttaaattaatttaaaaatataattaataattaaattatattttaatttcttgaatacagagtgaaagatccgaatctcgccatgagtttcaagcaatggagaccgatgtgagagatggattatgggacagaatggtggttgcccagagaagcatggttgcacttccgccaaatttagaaaagcttcgggtgtagtcttaaagaataattgtattattatcataaaaattttcttaaatataaaaatatttattttttgaatttaaaataaa

SEQ ID NO: 55721 - DNA, 258 bp, Heterodera glycines
  Genomic contig location: Contig_ID=SeqID_24987; Location=44..301; Strand=-
  SCN-specific regions: Sequence locations=1-142,192-235
atggcatacagaatgccaaggtaagagtcataaatttgtgccaacattttcttattttgctcaattcactgcttttcccgctaaaaaatgctcaaaattggcaggcccttgcacaaatgcgacaaatgcgtcatcatcaacctaattaaataaagataattattacttataaatttttaatttttttttaacaattaccgttgaaaagttggcatttgaaaagatgaacaaaaaggaatatataattaaaggaataaa

SEQ ID NO: 55722 - DNA, 1546 bp, Heterodera glycines
  Genomic contig location: Contig_ID=SeqID_24987; Location=333..1878; Strand=+
  SCN-specific regions: Sequence locations=1-584,606-920,960-1123,1147 -1163,1185-1341,1363-1546
atgaagtttgatggatcatttaccaaggatgtgtgtgtacagtatcgcaaatatttggacatactgtacgaatatttataccatgttcatgccggacattccgtaacgaggccaacattcattgaaaatgctgcattaagcagatataatagagatctgattgagtttctgatatcattgtcaaccatttccaaattttatctttttgattcggaatttgctttatcttctgtgacggatcgtgaggaaatcaaaattttttgcaaatttgaattggaaaatgagaattgcttagaatatcatcatggcctcgcatacaatgaaaaagaatttaataagaaaaaaaggcaaaaaattgactcggaaattcgagcaaaatttgaattattgatggaaaaacatttcaataaattatgggaaaatgccaaattgaaaaacggaaacaaaaacagtgatagaatgtccatatcattggcaaaaacaatgccatcggattatgctgtacatatttatgacacctttttgggcatgccaatatatgactttgatacattagtaagtgaggaatgtgccaaaaatatgggattaattttttatattgaaaatcagatggaagacgaagcattgattaattttgtaaaaactggaggttcaaaaatgactaatattgaaattgctgaagatattgaggatttttatgaagcagttgaaatgcatcttggccttctgttattgatgagaaacaattggcactgtgccaatgccaaagtcgcaaatgcagaaaatgaatgccaaaaactccgatatttcgtggaaattttctaccaatatttgttcagagaatggtgtggaattgcagctgtgaagccaatgttacaaacgaataacgattttgaaatcaagtaaaaactggtttagagtaatttaaaaaattaaagttttttaacaattaaaaaaatccaaaaaagctcagtttactgaaaaatgcttggactggggggctggattaataagacaattgatttccacatttatggcaaaattacgaatttttagcttggattaaaacattgaaattttattgaaatccttccgagcgattaatttaatcatcaagacgaccttcgttttattattattactttaatttcaggccggttatcctaagtgtggaagatattctgagctcctttaatcaaatttcaatgtatttttttggcgcaaattcgagtgctgacaaaaataaatttgcacatttgttgggagagttagctacttataaattattaaatgagcacgaattggattataatggaactccaggtaattgatgggtaggagataattaaaacataattaattcattaaaaaatatgtgacatttcaaaatcaatttgttacaaacatttcaaatagtgagtgcttcggcttcatcatcgactgctggaaatgcttctaatttctcaaggtaatttgttggcgcgtaattttaaaaaattcagggacctgtttcgaattgcacccggacttcatttcaagagaataa

SEQ ID NO: 55723 - DNA, 660 bp, Heterodera glycines
  Genomic contig location: Contig_ID=SeqID_24989; Location=44..703; Strand=+
  SCN-specific regions: Sequence locations=1-141,163-350,387-545,567 -623,647-660
atgttctgtgaaagtttggtccgttgtgccaggtcgcgcggtgttcaaatggagttgccaaagcgggggattgaccattttgatgatacatcactgtgagttaagggttaattcacggtcactgtttagggggcaaattccgttaatgattcacacggtaaattaacggttcacgggctcaattccgatcgactcacgtggcatttcaccgtcatttttcgcgcgatcatttcacgctcaatattcatgggggcaattcacgtcacatttcacaggatcattattgacgctcatattttttgggtgtcaatttttctgtcacggatttgctcagttgtttaaaaatgggcttttttaattgaatatgtttttaataattttttaaactcaaattaatatcatcttttttccagtgaatttgtccgtgagcaattcaaattgttttcaaaacatcttgtccgttttgtgattttctttgcgcccgcgaaggatgcgtcccatgccggtgatgtacaccatacgttcaaattgcaaggaattaaacagggcaagtccaactttttcctccttattgtagtgatgttcaagactcaaaatttccgaaaatttaactcaaagaatataggaagaaatttttcaattttacggaatataaattaa

SEQ ID NO: 55724 - DNA, 1463 bp, Heterodera glycines
  Genomic contig location: Contig_ID=SeqID_4787; Location=647..2109; Strand=+
  SCN-specific regions: Sequence locations=1-174,196-887,930-1116,1140 -1463
  Gene Ontology: Biological process=anion transport
ggtcagcagttgttggagtccaccttgcgcaatgtgttggaccagcagtcgcttcgatggattttcgttggcggaaagggcggcgtcggaaagaccacgtgcaggtcagttgatgtggatattacaaagaacgcttattgtgcgaaaatgatgccttgaattccgtcaaaatctcccaacttttaattaccatttcgaagtgccaaatttttagttgctctttggccgttcagttggccaaatatcgtcgcaatgtgctgatcatttccaccgatccggcccataacatttcggacgcgttcaaccaaaaattcacacggagtcccaccaaagtgaacggcttcgacaatttgttcgcgatggaagtcgacgggtccaatttcggggaccatggtgtgcccaatttgggtgacgaggacgacaagtgtactcacttaccaatctgtattcatttaattcattgtttccgtttttcagctgatatcttttccatcggaaagaactttttggccgattttgctgccggacttcccggcgttgacgaggccaccagtttttctcaaatgattaagtaatgtcataccaatttgctattttttcactaattgggttccaattgaccattcaaaatgtccattttatcgcgccctttcagactgatccgttccatggacttcgaagttgttttgttcgacaccgcacccaccggtcacactctccggttgctccaatttccgacagttatcgagaagggtctgtccaaatttctgaaggcgaagacgcaatttatgccgatagtctctcaggtggttttatgattattattattgtaatttggtgtacgaaaaacagaaaggtaattgctctaggccaataatctgtgattgtatttcatttcattttcttttaaagatggcaccaatgttgggtttgcccgactcgactttggactccacgacggacaaattggaggaaacgcttcaggtggtacggcagatcaaagacgaatttaggaacccggtataattttgaattgtgtgtaaatacgataagaggttctttaggatctcaccacatttgtctgtgtttgtattgccgagtttttgtcgatgtacgaaacggagaggctggtgcaggagttggcaaaacaggcacttgaacatttattaaatattttttggaatcaaagacgaaatgtcaaaatgaaaaatccctaggaaatcgatgtgcacaatatcatcgttaatcagctgctgttccccgacaaaaattcggacggttctgtcagctgcaaaaagtgcctttgtcgtttcaaagtgcagcagcgttatttggcacaaatcaccgaactctacgaggactttcacatcacaaagcttcccatgctggacgaggaagtgcgaggccccgaaaagatcaaacagttcagcgaaaggctaatcaccccttattcttctgctgtt

SEQ ID NO: 55725 - DNA, 1148 bp, Heterodera glycines
  Genomic contig location: Contig_ID=SeqID_4788; Location=303..1450; Strand=+
  SCN-specific regions: Sequence locations=1-418,440-746,771-943,966 -972,1068-1148
cttcctctgctcgttgacatcgttaagcatcgtcatgagctgaacagcaaatccacggccatccacgcgcttctgatttctcccggacaaacgcgcattttcgacaaattcgaggaggtgccaaattacgctttgggtcggtgagttaattcaatgcctccgaattttagaatttcacacttttcagaatgttccgccaccgaaaatgtcgtcgttcttttcccgtcaaagaattcgcagtccatcgcccaatttgtgcgtgaaaatggcccccttcaccgtatcgtcgtgctcgactcgacatggaacaccgtgggacaactaagaaacatggccaacatcgccaaactaccgatggttcaccttcgacagtacacaacggactactggcgaccgcaagtgggcgaatgggggggggataaataaataaatgaaaaatggacggaataacgacggaagggctcaaaagggagatgggggggggggcagagtctgcgtttagtggccaagttttaaggtccgcttttcaaaaaaatggatatgagagggccgcaggcgccgtcggggataaatttcgtttatgaatttcttgaatgtaagaaaatagccaaaacagtatttcttgaaaacgagtccccaggggttttatttttcaagcccctcaaaagggggctctaattcaagggggatatttatatgttgcgtatgttttggttcttttatgattacggtacccataatcttaatttatttttcccatcattttcccctgctaaaaaggaatttttttgggaatgttatgaataacataatgcattgcattacattaaattcaaaaattattcttggcgtcgcatcactttaattattgatcatctttatcacttcagaatggtctttcagccgaccatttggccacaatcgaagcaatttactacgcatgtgtggaaagtcaggaagctgaaagggaatggaggagaacggaggaaaggaggaggatgggagagggggaagaaaaggaagtgagagaaaatggaggaagcgaagagaaggcggaggaggagcagcaccgcctggacaagctcctcttttggttttacttcttccgcaaaatggtgcccgcgaggatatttcggatgaaaaaataa

SEQ ID NO: 55726 - DNA, 1250 bp, Heterodera glycines
  Genomic contig location: Contig_ID=SeqID_4789; Location=584..1833; Strand=-
  SCN-specific regions: Sequence locations=1-126,148-149,171-420,442 -501,524-747,769-1017,1039-1062,1126-1250
  Gene Ontology: Mol. function=ATP binding; Cellular component =extracellular; Biological process=reproduction
atggaaaagaacggaacggaggaggaacagacggcggacgacctaacgccgaagacaatggccatttttgaactgttggattacattgtgaacagagtgagtcatttggaagcaaagggaccgacgcccccccccccccccccccccgaaaccgttttctgttcagccccctcccgtgctgccgcgtggacttttctctgaccaatttgtggactttgtgaatcggtgtctgcgaaagaatgtggcggagagggcaacgctggcgctgttggcaaccgacgccttctacaaacggcacgaaagaatggaagaaaccgccgaattcgccgcatgggttcggtcggtgatcgaacagtgagttgggtgctggtggaaaatggcagtacaaagggtgacaaaagtggggctgtttttcgtccattgcagttaaacttttgacaccttacaatggaattttcgtttttttttcactcccctcccctcgaatgaacgttcagcttggccttacaatttataaattgcagtcggaatagcaatgccctgctgatgggatgatttgcggcgcccttaactttcgctcgcttttgccacaacaattcgcgagtgccgttgcccttctctctgtacgcttttccgatcactcgcaattcgattgatcatttgcctattctttggcattctttttttttgtatgcaatagacaggcacaatggctaattaattccgttttcactttggccttatgttctcccttcacggcgcccactttctctcttttcctctgtcacttgtccttttcctccctacttttccttgtcgttctgtcgcctttgctttcttccattattagcaccataataatctgaacaaagcaatgaatgcatcgtaatcaccggggggggggggggaaagggttggcttttgcttggattgcattatgccaatttctcattttctctgtccctatttattttttgcccgttcttctgccctctccttttctctagtcactctcccctatttctatgtccttttcgttcaccttccgttgtcccatccttctcttcttcttcctcctcctcttctctctccgcttcctcttcttcctcttcatcacttcttctttcctcctctcttttgtccgcttctcccccaaaaatccgatgattttctccatccagcaatcgtccacttttattgtaatggtaaagaacagtcaaaagcacaaagatagcgaagaacggaataaa

SEQ ID NO: 55727 - DNA, 634 bp, Heterodera glycines
  Genomic contig location: Contig_ID=SeqID_4790; Location=136..769; Strand=-
  SCN-specific regions: Sequence locations=1-586,608-634
  Gene Ontology: Mol. function=ATP binding; Cellular component =extracellular; Biological process=reproduction
atgtccagcaaaagacgcaatccgctcaatttgagccttccgccgactgtcaatgaggagggcgcggtcggcgccgatggcgcatgggtcggaggacagccgccgacggaaggagtcggaacggaaggaacggccgacgcgtcgttggactcgaaactgcgctcgctcaatttgtcaggctcgcaacagcagcgaatgtacgagtggataacgttgaagaaacaggcaagtgacacggcctattggaaatgggtgaatgtcggcgaacgcaaagggacgaattggcgtaaggacaacgcggttaattagccgattaatgggctttatgtaggtagcctaagcatccgcataattcaagaccaaagcaaactggaggaatttcatatccatagtgctttttgaaaactcatttcccaattgaagatcggcgaactcagtgacgatgtgttggaacggatctgcgaccttggccacggcaacggcggcgttgtgcacaaaatgcggcacacaaaaagtggcggtggcgtggttttggcccgcaaattggtccatttggaggtgaagccgtcagtgcgtaaccaaattctgaaggagttggaagtgctgcacaaatgcaacagtccgtacattgtcg

SEQ ID NO: 55728 - DNA, 218 bp, Heterodera glycines
  Genomic contig location: Contig_ID=SeqID_4790; Location=1177..1394; Strand=-
  SCN-specific regions: Sequence locations=1-218
gctacggcgactttttggcgcgactttccttttcgcgcggtcacggcggggggaaggccaattcgggtgccaactcggccacactgacggaagcgaaaacggacggcaaacagtgccctcttttgtgcagtcaaatcggttgcccattggccgctttcctccaatttttgacgttgacaaatcccagcaatcgctccgttctttttgccgttttgcaa

SEQ ID NO: 55729 - DNA, 887 bp, Heterodera glycines
  Genomic contig location: Contig_ID=SeqID_24991; Location=393..1279; Strand=+
  SCN-specific regions: Sequence locations=1-17,39-410,440-526,548 -829,883-887
atgtccgaattgagtggggatgtgctaagaaaatggaatgttctgcaatcagtgccggtgtacaaaaggataccaaaatggcggggattaattgccagtgtaaatttggcgtgatgaatgacgatttcggaaacagaaaattgcatgttacaccaaaaggacggaccaccaccactgttagcacgacggagaagagaaccaaacgcactcgcaccacgaccgaatcaacttcaacaacgaaagtgccaaaatcaaaatgaccaatagggaaaattcaaatttaaaaaaaaaattttgttggcaaaaaaatgatataaaattgggatttgttaataacatgaaaaacaaagttttagttccaacaagcccattaattggactcataaaatgcaatagaacagaagtatttctttttttcaaataattttattaaaattttcagccttctccttcacttgctaatgtcaaaattggaaataaaatgcagtgcatggccaagaacatttgcgatatgtttgttgctttaatatttgcttttaaacaaattgccccaaaatttgtttttgtttttttccagtaatgaaatgtggaagggggcaaagcttacgaaacgctttgaaattcgcaaaaagtgcgaggaaatggtcaaaaattgggaacagatgacgaaagaaattagcactgaatacgaaaatgcggacaacaaaaacagtgcgctcaacaaaaatggccaagtgttcttggcggatttcattagcgcgcgcattcattaagcccgagaaatgaatgccttttcgtcaaacttaagcgatgttttactaattttgggatttaaaaaaatatatatattatttaaaacatattcattttgtaaaatattttcctaa

SEQ ID NO: 55730 - DNA, 384 bp, Heterodera glycines
  Genomic contig location: Contig_ID=SeqID_24992; Location=495..878; Strand=+
  SCN-specific regions: Sequence locations=1-205,228-348
atgcttgggaaacgccaatttgtcctcattaatcatgtcattattattcattttacactcatcaaaatgctcgatacaatattgactaagccgtacatcaaagttcctgtttcgcctcagaatccgagtgtgcaagaagatatattgagtggggttggccttggtatgtcatttggcgcattcggcggcggatcctttggccttgtcctcctgggaattgctggaggccattatggagctttgatgaatgagcaatatacgaattgtcaaacactagttcgggcctgcatttgcaataaagccacctgtgttttaaacgcagatgaacgatgtttgctttcgtttttgttttatttttttaatgaaaaaatctatttaaaataa

SEQ ID NO: 55731 - DNA, 1385 bp, Heterodera glycines
  Genomic contig location: Contig_ID=SeqID_24995; Location=25..1409; Strand=-
  SCN-specific regions: Sequence locations=1-69,91-224,246-306,336 -528,602-1202,1224-1385
atgttgagcttcatttacacggacgatataagcggattaaacggcggcaatgcaatggcagtgctttacgccggtggatttgttttttggaataaaatttaataattgttgatttcctaattagccaaaaaatacaatatcactgatttggccgacgcatctttgcaaattcccttctccgaattgccaaatgttttctacgcttttgcccaggcccgcctttttgaattggaggtgggaaagaaatatcaattcttatttcgaatttacgaaagaatgcaattaattttttggatgagtctcatctattaaattattatttttaaataaaataacctataattgatcatttatttattatttgttaattgaaggaatattgcaacgattgtttggattacatcaacaaaaatgcggacgctttgctcaaatcggaggaatttttgcaaattgatcaaaaattattatgcgaaattttgcagcgtgaccaattgcgaatgaatgaagagatttctgtatgggaagcagtaatttttttaaaatttataaaaattactattttattattaaaatattcctatttaattctaatttattttttggcaatccgttgggccgacgaaaagtgccgtgaaaatggcattgattgttcagcagagaatcgccgtcaaatgcttggctcggcacttttcaaaattcgctttccgcttttctcacaaaatgaattttcggaaaaaattggtaaaaatcgggaattaatatataaaaaaatgtaaatactatttttctgcaaaaaaaaactaataagcatcgctagattttaaaaaaatcttaacctgacattttgaaagacttttgacacttttttaaaaaattatctttttaaaaactaaacatttttaaggatcactaacaattacaattatgtcatttatttttttacaggaccgtacggtattttaacagcagaagaattggccggcatcaaacagtaccatagccaatcaaaaatgtgcggaacgcctggcttcttactgaactacccactgctatttccgagtcaccagcgaaatttgtcatttgaaaaaattgtgatggacattgaaaaagtgtcggaatttgctgcagaatcagtgggaagttgccgatacagcgaaactgaccaaatgagaggacttccgcgagaataaagtggcaaaaatagaacaaaaaactgatctaaaatgcatgtgattgtacataaaatgcgcagcaccaccaaaggtaaagtagatcatatactaattattgcagacaattcgtaattgcgcggaattaatgaagacaaagattgtaattgcgaatggtcggaggcaacctttcgaagtgtttcgaaattattcaac

SEQ ID NO: 55732 - DNA, 816 bp, Heterodera glycines
  Genomic contig location: Contig_ID=SeqID_24996; Location=170..985; Strand=+
  SCN-specific regions: Sequence locations=1-299,321-443,466-816
atggaaatgatcagcgaagtaaattatgttggccaatggactgtcagccaatggaatggcaccgaatttgcagcgccgataatgacaaaaaattgtggtaccgttgttgtgaaactgaccttgcgacgaatttcgattggtctccaaattgtcaattagcttttccaccaacgcattgaaacgtggcgaaagcaatgccaatttgaggccgagttgttcacgtttttggtctaaaaatggtttaaattattgttttaattaagcctgatggatgactttcagttcgtatttaaacattaacaaatatgtaaaaaccgaaaaatttgaatttccattgaaaaaaagttgagttaatcaataacgcacaccatctcaaacatgagaatgcgaacatacagatggtgtataaaaaaacaaattgtggtcaaaaaatttatcgaaggataaaaaattatttaaatattagaaggggttcaaaagtgataaaatggtacaaaagtgattagaaaggtacatatacaacagaggtacaacatttgttagaagaggtacaactgtgatgagaagagatacaatagtgattggaagaggtacaaaagtgattgggagaggtacaaaagtgattagaagaggtacaacagtgattagaagaggtacaactgtgatgagaagagatacaatagtgattagaagaggtacaactgtgattaaaagagaagaaactttgaaatacaatgattgaatatttattaaattgaaaagaattttttgaaattctaattgaaaaagcaaatgaattatttaatttaaaaagaa

SEQ ID NO: 55733 - DNA, 655 bp, Heterodera glycines
  Genomic contig location: Contig_ID=SeqID_24999; Location=856..1510; Strand=-
  SCN-specific regions: Sequence locations=1-198,222-259,281-297,426 -531,562-589,612-655
atgatgcatggatcattttcagtacacatgtgtcaacgattggaaggaggtcatttttaattgcaaatttcgcactttaaaaaaaatcatttgtcaattttttgattatttaacaattttttttgtctaatttattattgttatttgtgcggcacggacacgtttcttaaaagacgatcaccccccccccccccctcactacaaaaaattaagaaaaatttcttatggtttgaaaaatatttaaagaaattccgataactaagtttaattttttcaagtttatgaaaaactttttcgaaaaaaattttaaatgagtatttagaattttttaaagaaaaaatttttttaataaaattcaacaatttaacatttctttgtttgatttctattatttctttttcatttaatttttttataaatttaaagttttcgtatccgttgcgcaattgaaactcaaaatttttgctaggccgaatatgattaacccgcaaatcccgcatttgcgcagggattgcgggatcttgaatattgattaaatttttaatttaaacaaaaaaaattcagcactttttttatccagttttgaataatcctttcttttaataaatttcctattcaaaaggttgaggcgatgtttccgaccacaaccacaact

SEQ ID NO: 55734 - DNA, 128 bp, Heterodera glycines
  Genomic contig location: Contig_ID=SeqID_25000; Location=280..407; Strand=+
  SCN-specific regions: Sequence locations=1-128
acgatgatcactcacgaaagagcagtcaaatatttgaagaaggagtccgtgttggatttgctggtgaccagggccacacccaaacacagcacggaaatgcaaatgtgaacagattgtccgactgctga

SEQ ID NO: 55735 - DNA, 716 bp, Heterodera glycines
  Genomic contig location: Contig_ID=SeqID_4792; Location=1391..2106; Strand=-
  SCN-specific regions: Sequence locations=1-682,705-716
atggcctcttcccgtccgggacagttcacgcacaaaaattatccacttagatacgtgagttttcgagggaggggtggaaatgtaattaatgctaatttggtcgtcttttttttctccagaaaagtgcctgcttttctgaggacgattatgccaagaggttcgacgacgctgcatgaacggtcgtggaacgcctttccgtactgcaaaacggtggtgaccaacccggactatatgaaggacaactttctgattcggattgaaacaatgcacttgagcgaccgcggcaccacaaaaaatgtatggatggaatgatcatcatcattactaattaattgttaattatgccacaattttccgtttcgtttttcaggcactcggtctgaccaaggatgtgctgaaggaacgcaaggtggtgcgcatcgacatcgccaacgacaacgagtttctgcgtgcagccgacatccttgacaacaccagaccgtcgacattccgctccatgaaaacaggccgtgggtggccgaatgagcctaccctttgatgggttaggcgaatgagcggcggcgatggccgaatgagccttccctttgttgggttaggctagatgagtcggctgctgatggccgagtgtcttgccactggttgggcaagacgaagagtcggctgctgatggccgaatgagccttcctcccttttatttctccctcaattaaaataaa

SEQ ID NO: 55736 - DNA, 476 bp, Heterodera glycines
  Genomic contig location: Contig_ID=SeqID_4792; Location=1594..2069; Strand=+
  SCN-specific regions: Sequence locations=1-476
  Gene Ontology: Mol. function=phosphatidylinositol transporter activity; Biological process=nonselective vesicle transport
ccacggcctgttttcatggagcggaatgtcgacggtctggtgttgtcaaggatgtcggctgcacgcagaaactcgttgtcgttggcgatgtcgatgcgcaccaccttgcgttccttcagcacatccttggtcagaccgagtgcctgaaaaacgaaacggaaaattgtggcataattaacaattaattagtaatgatgatgatcattccatccatacattttttgtggtgccgcggtcgctcaagtgcattgtttcaatccgaatcagaaagttgtccttcatatagtccgggttggtcaccaccgttttgcagtacggaaaggcgttccacgaccgttcatgcagcgtcgtcgaacctcttggcataatcgtcctcagaaaagcaggcacttttctggagaaaaaaaagacgaccaaattagcattaattacatttccacccctccctcgaaaactcacgtatctaagtggataat

SEQ ID NO: 55737 - DNA, 412 bp, Heterodera glycines
  Genomic contig location: Contig_ID=SeqID_4793; Location=48..459; Strand=-
  SCN-specific regions: Sequence locations=1-412
atgcgcaaagtgtcgtcgagagaagaaattgttcagcagagagtgaaagtcgccaatgcgaagaatgagtggatcacgcaaatttcatccctttttatagagaatttttacacggaattgacgggtaggaaaatgtttgtataaaagggacgatttaagcgcagaaacaatcattcttcatttgtcctttactgacataataagcgtctgtctccttcttcactttgttccccttttgactgcacttcagcaacaatgctcatcagagaatagtgagttgcttttttcatcatcattcttctgacaccttaattaattacgctttccttttttcagtcgcatcgtcatgccgttgaccattgaggagtatcaaattggccaattgttttctgtggccgaggcatcgcgacag

SEQ ID NO: 55738 - DNA, 870 bp, Heterodera glycines
  Genomic contig location: Contig_ID=SeqID_4793; Location=360..1229; Strand=+
  SCN-specific regions: Sequence locations=1-306,336-613,635-763,785-870
ctataaaaagggatgaaatttgcgtgatccactcattcttcgcattggcgactttcactctctgctgaacaatttcttctctcgacgacactttgcgcattcaatccgagcacacttcttcacccattggctggtcccatgtctctgcaatacgtcggcatcgctgcggtaatcctcggaagtaagtgccaaaacaattgttattaatccatgttgatttgctgctaatttatcgccatttttcagctgccatcgctctgttccaaactgtgtcgctcagcaccagacgacaaatcgccgcacaaaatggccgaagcagcagcagcggcagcaaacgccaaagcaagtcgccgtcgtccgcaaaaaccttggcacacaaaatcgctgcgacggtcatcgctgagaagagcctgagctccatcccggacaacgaaatcttgcagctgatggacatcggctttcaactgctcgacgaggtgggctcagcctggatccgggatgaccagccagtgcctctgttaattcgtgccaccactgttttcaggagccggcgcgtgttgatgtgcatgccccttgctacgttttcggtgacatccatggcaatttgtcgtaccttctcaagtgggttttggactcgtcgactcggctttttaacatttcagcggcacttgcaaatccgttgttgttcaggtacttctccgacacccacatcgaaccgcagctgctcaagctccaaccgccgctgttccatttgctgttcctcggcgactacgtggaccgcggcgagttcagtctggaagtcattgcgctgctcgtctcgctgaagatcctcttctgggacaagatcactctgctgcgtgggaaccatga

SEQ ID NO: 55739 - DNA, 444 bp, Heterodera glycines
  Genomic contig location: Contig_ID=SeqID_25002; Location=54..497; Strand=+
  SCN-specific regions: Sequence locations=1-327,385-444
atgacggttgttcaaattgtgcaggagcaccaaaatcgccccctgtgtttcgccaccttgtccttttgtgagcaactgccggcactgtttggggagacgacgcatttgatcatcgatgaggctggacaggcgccatacgtccaaagcctcaacttggtaagccaactccccttggaaataataaattgctcactgttatcgtgcatagcgcagtcgttcacgctccttcgcttacttaaatacatgaaagttcgagtccgctcgaacgcacggcattttttattttattttccaaatcttttcatttttatttttcccaataatacctataataatatttaaaaattattgaaattcataaattaaaaagaaaacatatttttagtggatttagaggatgctgaaattgaccactaccctcgagcgatgtattaataatgacga

SEQ ID NO: 55740 - DNA, 437 bp, Heterodera glycines
  Genomic contig location: Contig_ID=SeqID_25003; Location=132..568; Strand=-
  SCN-specific regions: Sequence locations=1-437
aaaatggtcaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaaatggtcaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaaatggtctaagtaaaaatcgtaattacgctcaaaaagcttctcaaacaattttagcgcttccaattccttctacaatcgcctttatacatcccattatgaacgctaaaattatcagagtgccgaaaatcgc

SEQ ID NO: 55741 - DNA, 869 bp, Heterodera glycines
  Genomic contig location: Contig_ID=SeqID_25004; Location=347..1215; Strand=-
  SCN-specific regions: Sequence locations=1-846,868-869
atgtgtacattttgctttatttttgttttgtcatcatttgctacgtgcgcaactgacgaaagcaattcaaatttggcacaacgacaaaatgatcagcagtttgccattgctgaagctgatccatccgcgacaactgtttcttctccgcattgcccaagctgttcggataagtcatctgcttctacgatggcacaaaacggtgcttatccaaccacggaagacagaacgaaagagttttggacaactgatggtacggtagggtgaatagaattcgcgtttaattgagttgatccacgattctcgaccttttctggcctgcttccaaacacagtacccgacctgtcccacctgacgatcccgacctcgacattttttccctatcgggcgcttcggtattacctagggacgaatttcgtgcccccagaaaatctcggaattcgaaattccaagcgcaaaagtgacggaattcggaagcctgaagtaaatcttttcgacttcatggttgtataaaaattgcgtaatttgctttaaaaattacaaatttttccataatcccttaatgagaaaagttaacaggctttcagcgttcaaaaagacttttttttttgcttttgtgggtttttggcagagccagctatttgttttaaaatagacaaaatactcaaaaagattttgaccccataagaattttcttaaaaagccgagcgacgaatttttggtatttgtaggttttgtcacccctttgaaatttttttcataattttttctaggacgatttatgtgctgatcacgtgtcctatctcgaaccccagacccgaactcgaacaaaaagtctcaaaagattcgtacataatataagtaatttctga

SEQ ID NO: 55742 - DNA, 1232 bp, Heterodera glycines
  Genomic contig location: Contig_ID=SeqID_25006; Location=683..1914; Strand=+
  SCN-specific regions: Sequence locations=1-213,235-1232
atgggaaaattgaaaaatgagagaagtcttaacttcatggtcaagaaaagtgagttgagaagctaattgagatgtggtgacaagactgtcagcacttctctttgaacgaggttgatccgtgggaagaaattgaacggcaaaattttgatatgagagagagagagtttgattacagtcctcgatcaaagttttggtttggggaaaggaaagagcaagatcattttcttctgcaacccaaatgtttgacagaaaagttcctaaaaattttccgaggttaatgaattgacagagtttcttaggagagggaagccacataaggatggatttgtcgtcgaggcggcaattctctgctgtatatttacaatttgggtgtcctagagatgttcggatatgatcttcggaatgatgcacaaaaatctcagtttgaaaagcgaaacaatttgtggaattgtgtgctttccaggaccagccaaggaagggataccgtttttcatagctgattggattattggagaaaaggagctccccactttggattagaatcccttcggaacatgacttttcctgaaccatttgcttacattcatctaataatactgggagattttcggacgggagttgcttaatgattacatcattccatggattggtgtactcaatcagggatttctttaccttcctgcacacccatgccttggatttttgttcgaatgggttcggtcggaaaaggcgaataggttgtttgataggggtgtcagaaggagtatgctttaattttggacatggtagccaaatgggtagagaccaaattgtgccctcaacgtgtgtctgacaaaccatagggaggatttttaaggatgattgactgtgagaggatgagaccaaagaagcacttagagaaagagtaatgatacaaaggataaaattgaaacgagttagaaagggagctattgaaaaatttgagctgcgcgggtgtgattcccaatttgtgacaataggagtggggggaacaggctttggttcggattttaaagcatccgtgagatttggttgcttatcagcagagccagagcacacgagctgttctttgatttgagatggtgaggcagtaacgggttgttggatttggtcagataatgtaagagtgttaaatgaagggtggggaccattatcagacattgaaagattttggattgagtctggggggaagggaatcatagggtgttaaggga

SEQ ID NO: 55743 - DNA, 1054 bp, Heterodera glycines
  Genomic contig location: Contig_ID=SeqID_25007; Location=8..1061; Strand=-
  SCN-specific regions: Sequence locations=1-1054
atgcgggatcagctcgccattgtgcccgagtgcggctacgacactacaaacacgcaaagccttatagcgctcaaattcttggattggtacgccaaaaagaacggggtgagcatccagacggcacactcgcccgacggagagaaaaaaattggacaatacactgtggacggatacattgcgtcgaccgacaccgtgattgaggtcaacggctgccactggcacgcgcacgaccacccgcgtcaccgctttcagccccaaacagtgatggcgaacgggaaaacggcgcagcggatacgggaggacgatgcgagacggatggtcttcatcacatctcaggtgcaacaagtgctcgtattttgggagtgcgaaatcaacgcggagaagcgcaacaacgacgaaatgaagcgcgcctttgctcagtacaaggacagcggcccaattcgtttgaaggactgctaccatggaggacgtgtgggtccacaacgactacactacgaggtgccggaggggtggcggatgaaatattacgacgttcgttcgctctacccccacacgaatgctgtgacagcatatcctgtgggccacccaacacgagtgaacatcattggtgaggcagagcaggcggttgactggcgacgcgccgaccaggtgccgatccgaggcattctcaaagtgttcgttgtgccgccccatcacgttgatgtgcctgttctgcccgtgaaatttgatcagcggcttcttttcccgctgtgccgtacgtgcgctctgcaacatccgcatggatccgtcaatgaagactacgagtgcacgcatcgcgaggatgatgagcgggggtgggtgtccactgtgacgtcaatcgagttggaggaggcgcttcgcaacgggtaccggtgtacggcctattatcgctccgtcgagtgggacgatacgcagtggagcgaccgcgtttttcgaggctacgttgccgaattcatggccatgaaaacgcatgccagcggcttcccggacgaaattggcacaacaaaggaagatcagcagcaattcatagaggaat

SEQ ID NO: 55744 - DNA, 231 bp, Heterodera glycines
  Genomic contig location: Contig_ID=SeqID_25008; Location=1058..1288; Strand=+
  SCN-specific regions: Sequence locations=1-57,123-231
atgccattgaatcagcaaatgaaaaattacaacagtaatcatttgacgaaatatttggagaaaaatgggaagaaaaagaagaaaaacaaaatgaagagaaaatcaagcaaaaaggaagaaaatattcatgaaaagaatggcaacaaaattatgccgaaatttgcaaaaaaattggggacaaatcgaacgaaaatttataaatggattaaagaatttggtctttaaaaacaa

SEQ ID NO: 55745 - DNA, 1636 bp, Heterodera glycines
  Genomic contig location: Contig_ID=SeqID_25010; Location=34..1669; Strand=+
  SCN-specific regions: Sequence locations=1-102,131-355,413-775,843 -1086,1108-1481,1505-1636
atgcgccaaaacgggggctatttgaatccgaatgattgcacaaaatgccattgtccggacggatacggtggccaatactgtgacgcactggaagagagtgagtaaaaaaataaatcaaaattaaaaaaatcaacatttgaatgttacgaaaaatgactttgatcaaagcatattcgatcaaatgggaaataaagtgtccagataaatgttctcccaatttattagatcagaactgcaaaattttggctgatgagtcgagggaattgaaatctgatcagaccgctaaagtgttgaaaccggtgatcggatgcacttctgccggcaaagaatgccgttgccattggcgaattacggcaatttttattttgttataaaaagataattatagtgttaataattaacaatataaaatgagtgaaaaagattttagcccatgtctggcaaaaaagtgcaaattcaattcaaaagcttgaacaattcgctcatctgctcacacccatgcacaccaccgtacgtcgagatcaaataccgtaccgacaaaagggcacaaggcaaaaaaattaatgaactaattaattattacttagcaaaatgatggctcattaaggtgccaaactttgctgtccccgtgcacttactgatctgaacggtaatgaatacaaaaattggattgaggcggaaaagccggacatggacattgtcatttccgcgcacctttcaccaaattggaccgtaccatctaccgtattcgaactgacatttgaatcaggcaaggaaaaattgtaaaataaattttatttgttttttaaattaaaaaaaattttaaatttgtattttaaaatgctttacatatctaatggaaaattgttctaaaaatctgttaaggcaacgtcaaactcataaattcgagcaaatgcgtgaaaatcgaaaatttgtatgccgagaaaaggaaccccggcaccggcactttgcgttgttataacccgacaaagaatcaatattataactgctcctgtaacggtgataagaaatgcctcgctgaagaaaaatgggcacacgaccgctttctttgtccaataatacaggtaattaattaattaattaatttgttattaatgccaaaagacactgccacagaaacatttcatataatattggcaatttaattttttggctgtaaaaattaccatttttgtatcaaaaagcggaaataaggacaaatgagaacataaatgaaaaaaatgccatctatttaataatttgtaaattcaaggtcaatggaattcaaatccaaatagattatcggtacaattggactcgtcttgatgttgattgttatgtgagttgggttttcctaatttctcaaaccctttttaattgactaattttacagaaggccgaaggaggtaccgtaagcttttggggctacagtaagcccgagaccaaagaaatcattcgtgtggacgaaatccactgtttgacttttgaagctgctggagtaacaccaccgtcacagaaacggttcaagagtttgcaagtcgaggaacatctgtcgatgaaattgaatccaagtacattattgggcaatgcttcatcacttatccatgtgttcgtgccatttgttggccatccatga

SEQ ID NO: 55746 - DNA, 520 bp, Heterodera glycines
  Genomic contig location: Contig_ID=SeqID_25011; Location=147..666; Strand=-
  SCN-specific regions: Sequence locations=1-177,199-520
atgcaaacaaccaacgatgaaagaaaagcgaaaactcaacaatggaagtcgacgaattcatgcagtttaaggtacgcaagaattacgtttttttagaaagggcagccttttttataaatttggagatgagtggtttaaccatgagttaccggttaaaaaatttttaggagaaatccaaaggcacttgcattgtttaggtgcttcagtggtggcccgatgaaaaaccataggagatgattagacagggatgggccaccgatgataacatttttatactggaaaattcaggattttcaaccaatttcttgacaaaaagtgcaggcaaaaaagaggccccgaatgatttttgtcggacctctagtggagtaaccaaaccaaacaaaaaaaatttgtccagtgtaataatatggtttaaattttcactgtcgtgggaaaaccatgggagggaagtacgtgcctcaccccttctatacggacctgatactgtttaattttactcgagcgtcgatcattcaataaa

SEQ ID NO: 55747 - DNA, 2583 bp, Heterodera glycines
  Genomic contig location: Contig_ID=SeqID_4795; Location=936..3518; Strand=+
  SCN-specific regions: Sequence locations=1-748,772-1729,1752 -1788,1810-2029,2054-2318,2341-2583
atggcgagtaaggaggagttgaaaacaatattggaggcgcaacaaaaacaatttttggagttaatgaaaactctcatgtccaaaaatgaggctccagcccattctgacttattttcaaaattgaattcacaaattccggattttcggtatgatccggaaaatgactcaacattttcattatggtatgaacgatacggtcagtttgttgaaaaggatggtcaagccctttccgacgacatgaaggtccggttagttttaggtaaactttcggccactgatttcattcgttatgagcaacaagtgctccccaaaaaaactgccgaattaagttttcaggaaacaatcaccaatcttaaggctttattttcagacacaaagtcagtgtttgttcgacgatttgagtgtttccagctcacgtgttctcctggacaggacgttctcgactttggggcaaccgtgaatgccaaatgcgagcgtgccgacatgaatttgtccaaggaggaaatcaaatgtctcatatttgtcacaggtttgggtgaaatgcaccgggacctccgtcaagaatgtcttcgacaaatggagaaggcacggaaagtgacaccgccacgcgacatcaaattggaggcattgttggaagaatgccgttcaattcaatcattgcaacactcagctgcggcgctcgcaaatcctggtcaagttcacgcaattcctagtaagccaaagattttgagtgatggtagagccaaaaattggcaatcaaattccaagaattggccgtcaaaaccaattcaatttcaaaaattttcgggcaacaattcttatggaagaaataatggttttcaaaataaacttgttaaaccacaggataaaaatgttgagcagcagaaatgtaagcgctgcgggcgtgctcatttgcttaaggaatgccgttatccagtggatgttcagtgctttggttgtggacagagaggacacatcaagacgaattgcccatcatccgcaaagtcaaattcaatcggagttgcctcaattttcagtgtcgctaactcgaaacgaggatggatttggactgaacttgtggtcaatggccatcctatcaatttggcagctgattcgtgttcggatttgacaatcattcagcgtcctgtttggataagtttgggtgaaccaaaacttgaaggtgctggacggttggtcggctcattttcagggcataagctaaaacttttgggtggtttcaagtgtaaggttgtattcagaggtgtcgaattaaatctgttttgttcagttgccgacacagacgctccaagcataatgggcctcgactggattgaaccttttgaaagacacactcaaatgcccatcgcgacaacattaaaggtcgtatctgccggcaattctgggcccgtctcatgcacaatccaatcgtcggatccaacgcagctggccaaggaagtcagggcaaaatttccaaaagtttttcagccaggacttggacggtgcaccaaaatgcgagcaaaattacatctcaaagaaaatgcaaagtcggtgttctgccgcgcccgtccggtacctcatggagttcaagaagcagttgatcgcgaaattgaccgccttctggaaatcgatgcaattcgcccgattgatttttcgaagtgggcagcgccggtgcttgcggttcggaagaaaaatggagctgttcggatttgtatcgatttcacgaccggtttgaatgaagccttggaacttaaccggcacccgcttccaagaaccgacgacattttccattcccttaggggttcaaaaatattttcccaattggatctcagggacgcttatttgcaattggaactcgatgatgaatccaaaactttggtcggaattaacactcatcgtggattattccaatatcaacgacttccatttggtgtcaagtcagcgccatccatttttcaaaaagtcatggatcaactcacgtccggtattagtggtgtttttgtgtatttggacgatttgatcatcgcttcgccgaacatggctgaacatttattggttttagaaaaattgttttcccgaattcaagattatggcttccgaattcaactcgacaagtgccattttgttcaacgcgaactcaaatttcttggccatattgtttccgcggacggcatacgacctgacccgagtaggtcagcggcaattcgtgaaatgccgcctccgcatgaccttggcacattacgctcatttttgggagcaattaattactatggtcgttttattaaggaaatgagagccatccgtgctcctttggatttgttgttaaagaaggaaaccccttgggattggggtccaacacaacaaaacgcttttgaacaggcaaaacgtcttttgcagtcggaacttcttctgacccactatgatccggagaaaccgatcattgttgctgcggatgccagtcaacatggaattggtgcgacgatcagtcacaaatttccggatggatcagaaaaagttgttgaacatgcgtgtcgttcgttaacttcagcggagaggaattattcgcaaattgaacgcgaagcgtag

SEQ ID NO: 55748 - DNA, 138 bp, Heterodera glycines
  Genomic contig location: Contig_ID=SeqID_25013; Location=1..138; Strand=-
  SCN-specific regions: Sequence locations=1-57,101-138
tcagaatgccatctcttcggatttgccccttcaatttccccaccaattcccttctaatttccgtccttttgcttcttttctgtctccaattctttcctctcaatgcccttcatcagtgagttcgcttttcttttctct

SEQ ID NO: 55749 - DNA, 424 bp, Heterodera glycines
  Genomic contig location: Contig_ID=SeqID_25016; Location=1029..1452; Strand=-
  SCN-specific regions: Sequence locations=1-424
gtgacgaatttggcggaatggaagaaaattgtgtaatggagggaccgggattgggatttaactgtggaggaattgaaggtgacgaatttggcggaatggaagaaaattgtgtaatggagggaccgggattgggatttaactgtggaggaattgaaggtgacgaatttggcggaatggaggccaattgtgtaagggaggaagtgggaatggcatttgaatgggaaggaattgaagatgaagaatttggcggaagggatgccaattgtgtaagggaggaagtgggaatggcatttgaatgggaaggaattgaagatgaagaatttggcggaagggatgccaattgtgtaaggaagggagtgggaatgaaatttaaaggaggaggaattgaagatgaagaatttggcagaagagaagaagaaggcag

SEQ ID NO: 55750 - DNA, 294 bp, Heterodera glycines
  Genomic contig location: Contig_ID=SeqID_25021; Location=1815..2108; Strand=+
  SCN-specific regions: Sequence locations=1-294
atgacattccaatcgctgggactcaacccaccagcatttcaatctctaggactcaattctcctgcatttcaatcactgggactcaattctcctgcatttcaatcactggcactcaacccaccaacattccaatcactgggactcaaatctccggcattacaaacactgggactcaacccaccaactttcaatgacattccaatcgctgggactcaacccaccagcatttcaatctctgggactcaattctcctgcatttcaatcactgggactcaacccaccaactttcaatga

SEQ ID NO: 55751 - DNA, 1960 bp, Heterodera glycines
  Genomic contig location: Contig_ID=SeqID_4796; Location=1832..3791; Strand=+
  SCN-specific regions: Sequence locations=1-50,73-234,256-380,402 -698,720-747,786-851,887-906,928-1125,1147-1302,1324-1960
atgtgcccggtgttgcaccgccaggcccacccggacgtgccggcgaggtcggaccccctggcccacctggaccgcccggagagaaaggtccgtgagaatcctcttggatatatcaaagcgttcatgcacctgtcttcaactacaggcaaacttggcgagtcgggcccacaaggtccacagggagaccagggcaacccgggaccgtatggaaagccgggcgcgctgggcgctcagggcccgcccggacagcccggagcggtcggatcgtgcggtaagtgtgccgtccgtccgtacggatcccgttatgtcgaaattactatatttttttctttttgtaagaccattgcccaaaaccgcgaacaccccccggctactgaagcgttgtgccttttccctgacgacagcagcagaagacgagatcagatcaccgttactactaattgtcacattattattgctatacagtagtgtacagtaaccccttccattgtgaaaaattggatagatggaaaacaaaatataaaaaaacacatttggccaacagaacattgtgccaatcaatcatcacagaaataaattgtttataaataagactcgaaattatatgcaccgaaaattgcaaaaaaaaaaaaaaaaaagtgaaaaatttgcttataaaccttgccaaatgaaggtggaaatttctcaatttcacatattccattaaatgtaaggtaaaaatcttgaaaatagataaatatgtatggtatgcaaaaacaatacaaaacaaagctaaaatttattaattctgaagaaaattgagtaaaatcggatttccattttgggcttacataatttttggaataatttccatttttttaacaatttatattttttaaaattttatcgataaaataccgaaaaaattaactttttgtgaaaaattttcgctccttaaaaaccaaaagggccgctttaatagagtgaaccgtttaatagaggattttgcatatatttcgagccctgtttataaaaacttctcaatcagtgtccgtttctgacaatgtcctttttgtccgtcactggatgcagatgttccaccgggattggcacaccttgggactcgtccactgcttgggcaatgtactgcttgaattcttgattggggaaacatgggttatcagacgcgcaattacatgggcaatataataattgccatgaaagttgattttgttgtctccgttgaggtcagcatttttcagcacactgatcagaaagcgcaagtgcgatttgtacgcgggatcaacatggttgtgctgaagcaattggttaaagaacaaattccatcaaactgcatcactttcttcgcattcaacagcatgcaaatcagatcctcgcgcccaatgtgcccattcatgtccttgtcctaattttgggaataatcatagttggtatggtatcggattactgtattctaaattaacgcgctcactcgccccctcccctaaccaaagcatagcctcccttttgagcgaggggtgtgaagaatttggcaacgttcgagtcagtaatttgaaaaactgcggacccggatttccgagtcggattcggacagggtcccggacaaaaaatcctgctttaacaggactctggctccttttgaattttcaaaaaaaaaatacagacctgaactagggccctggaaaaatactgtacaggatcctggtaaaagcaataagcttgaaaaagcgtcagaatttttccatattttgaatttctcgaaacagtcgaactcactaccaagagtgtgttacacaaatcaaccaaaccatatgtatgtatgcattattgtatacctgttctacgaacatctcgcgcagtttatgttctgtgaaatggacaaaaaatgctgcgtgaaaattaagaccaaaaaaccgaccccaattggccatatttgaaggcaaaatagacaagtaaatta

SEQ ID NO: 55752 - DNA, 388 bp, Heterodera glycines
  Genomic contig location: Contig_ID=SeqID_25023; Location=45..432; Strand=+
  SCN-specific regions: Sequence locations=1-66,89-222,244-317,339-388
atgaattttcgagcggttttttgtttttcggtgagtattttttgcgtaaattattgtaattcaatatatcttcttggaggaggaggtgccgaaggcgccaccagagaaattgacgattttaagaagattttcagaggtttttggtccaaaaaattttgaaaaatagaaaataaacgggaaataaaaaaagagtcataggcaaaatgtcaaaatattaaaaattttcataatctaaacattttacatgcaggaaaatgccaatatcttttattacctcatcattattttcggcatttgagctgctgctcggatgactcaaacattcattgataaaagccaaaagtgtcggctcaaaccttgaaaatttccaattaattgagcgaattca

SEQ ID NO: 55753 - DNA, 1234 bp, Heterodera glycines
  Genomic contig location: Contig_ID=SeqID_25024; Location=122..1355; Strand=+
  SCN-specific regions: Sequence locations=1-518,549-797,819-862,884 -1062,1084-1234
atgtctcacaatcaaccaaagaaagcaaaatatgagcaagcccaagagaaggaggataaagcaccacttacggacgacgcagagaaaaaggaggctaaagcggataaagcatcacttacggacgacgcagaggaaaaaaaacagaaaatgacggaaaaggaaattactgtactgagtgagtttttatgagtgatggtctaatttttccctatagtttaatcagatgatcaaccaaaatttaggattttctgacaaattgaaccgtttttgtatgaaaagaaagaaatgatagaattttttggtccttttgtgatttaagagcattaattccaggactccatatgtatttttttaaaaaggtacgcacgaagctctacactgttattatgcgcaccaatcaactgttgcaacaccaacagaaatgtttatgtcgcaagatggcaccggttttgtaagtttttagcttttgtaccatttataaatcatgggaaatagaattttgcgcctttctttaatggaatttgtcattttaaaagaaggttccattaccatttgatgcgggatgaagaagaaaacatcttcgacattgaggtggcactagccgccatcattggagaagaaaaaatttttggacaccattttgatgggtcagaaagcgatatcgaacaagcgacgagagtaagcaattaattaaaaatcagtttttgtgctgcttagtttatgttgattttttcatgtcttttttattttaatttttggttgttgacctgggacgagaaacgaaactgaacattgaattttttaagaaaatttgaatgtacatgatttttttaaatttgatttgaaaattggtcgcttggattttatgcattcataaagttttcccttttgcttcagaatctgaaagcaatgatcgaagaagagggatcgaacaattttggatgtatgcgggacttcagcgtaaatttttctcattaaaacaacaccaaaaaacggaaaaaaaactattttggtgttttggcacataaaacatatcacacatatttagggtttggcacatattttggcagttttgagaaaaatctgtaagaaaatacaaaaaaaaaattcaatttgcattttaaaattcactgctgaaatttatcatatttcgggatttttagcacataaaaatgcggtctttactaatcgtactcacttttaaaggttctcacgcccagaccagaaaatcaaa

SEQ ID NO: 55754 - DNA, 416 bp, Heterodera glycines
  Genomic contig location: Contig_ID=SeqID_25025; Location=1..416; Strand=+
  SCN-specific regions: Sequence locations=1-43,72-206,236-367,400-416
caggtttgatgatagttttggtaagccaaaaaaaatcctcacctttattaatctataaaaaatttaaaaatgagaattcatgctagattttctggaaataagcttaatatggcatagttaagctgtaaaaaaatttggggcgatttgaatgagaatagaaagagccaggttcgatgaagttttggtaagccaaaaaaaatccaaacatttaaaaatctataaaaaatttaaaaatgagaattcatgcgagattttctggaaataagcttaatatggcatagttaagctgtaaaaaaatttggggcgatttgaatgagaatagaaagagccaggttcgatgaagttttggtaagccaaaaaaatatccaaatatttaaaaatctataaaaatttaaaaatgagaattcatgcgagat

SEQ ID NO: 55755 - DNA, 418 bp, Heterodera glycines
  Genomic contig location: Contig_ID=SeqID_25025; Location=558..975; Strand=-
  SCN-specific regions: Sequence locations=1-418
gtttgagtaccccaaacggacttttgaaaaattcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccaaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatgggga

SEQ ID NO: 55756 - DNA, 180 bp, Heterodera glycines
  Genomic contig location: Contig_ID=SeqID_25026; Location=264..443; Strand=+
  SCN-specific regions: Sequence locations=1-1,24-180
aaaatctataaaaaatttaaaaatgagaattcatgcgagattttctggaaataagcttaatatggcatagttaagctgtaaaaaaatttggggcgatttgaatgagaatagaaagagccaggttcgatgaagttttggtaagccaaaaaaaaatccaaacatttaaaaatctataaaaaa

SEQ ID NO: 55757 - DNA, 466 bp, Heterodera glycines
  Genomic contig location: Contig_ID=SeqID_25026; Location=1163..1628; Strand=+
  SCN-specific regions: Sequence locations=1-91,120-466
aaaattttattcatcttcctttttgatactaaagcatccgagtgctaaaattaacttgtaaataaaatttggtgcgctttagagcactttctaaaaaaatatttatgaaataaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccg

SEQ ID NO: 55758 - DNA, 523 bp, Heterodera glycines
  Genomic contig location: Contig_ID=SeqID_25027; Location=578..1100; Strand=+
  SCN-specific regions: Sequence locations=1-169,191-523
atgggtcgacacaggcgttatccgatgaaaaaaacagcaaagaatacaaaccaagcccaaaaaatagaacgattgtcctttgacactgatcagacgcctcttcaaacaccaaaggacagcaggaaaaacaagttttctattctcgaacatagagaccttgaaaagtcaccttataggaatatgaacaaaaagccatccaattcgatgttggaggaacagccaacaacatggaaagagcaaatgttgaagaaactgacagacgaagttgcacaacaaaaaaataaaatacagaaaaggaacaaaaagccaaagaatcgacttttgggtaagagacaaaaataaaaaatttgcggaatttttgattgttaattcagaagaaacgcagaaattgggttatcatcacatgccctgggaaagtgcaaaaacactgatttaccgaattcagcaagaccaaaacaaggctataaatgaagaacttttaaaggtcggaaattggattttttgcttttatccttctttttaa

SEQ ID NO: 55759 - DNA, 346 bp, Heterodera glycines
  Genomic contig location: Contig_ID=SeqID_25028; Location=414..759; Strand=+
  SCN-specific regions: Sequence locations=1-346
atggactcagcggaccgtcgctcacctacccccgacatggagctttgcgaattgtcatcctggtacgacattttgcaggatgacgatgacaacgtaaaaaatgttttttcatttttcattttcaaaaattattattccagattttaaattggttcacaccggtgacggctcgcgacgtttgccaggaggtgttagcatttgcacaagagcgccgcatgccgtttgaaaagattgttaaatggaagcaaattttggacaaaatttgtgctcagatcgcccaaaataagtgatcgttttgtgatcgaattcatttttaaattgatgcgctttttttggcactgttaaa

SEQ ID NO: 55760 - DNA, 271 bp, Heterodera glycines
  Genomic contig location: Contig_ID=SeqID_25029; Location=18..288; Strand=-
  SCN-specific regions: Sequence locations=1-271
atgacgagggcaaatgacttattaattatttgtttaataatttttgtagttcccactggcgtgttggacgctgacgacgcgttgagcgtgttcgtttcgtattcgaattcgggctatacaaatgcaaaattctcaattcatccgagagttatgcaaaacactggcggttcaagaggccggctcacgttggacatcgaaaattttgaagattttttgatggaagatgaaggaaaacgagaaagtgtgataagagtcatcagaggacttcctt

SEQ ID NO: 55761 - DNA, 556 bp, Heterodera glycines
  Genomic contig location: Contig_ID=SeqID_25029; Location=408..963; Strand=-
  SCN-specific regions: Sequence locations=1-122,148-308,330-333,356-556
atgagcgaacttgtcgccgaatgtctgcaatttgacttctccgaaattcccaacatttttgctgtgtattccgaatgtctcaagctgaaaggacctaatgtgcgttgctatatataagcaaatatttataaaactcattttacattaagaaaggattaattgtattttgaattaactcgctaattaggggaaaggagcgtttcggcgccagcccaaatttttgtgctataattttttttagtttcaacgaaatcaaaccttctaaacatgctatgagttagaatgatgccaaaagattgttgattcattgaaattaaaaataataatagcccaaaaacttgggatggccccgaaacgacccagctaataattgtttttatttagttcgaacattttgcgcagaactgtctccgttgacgtttggaaggcggtaatcatatgacaattgaaactaattgcatctttattttattgttaggcaattcgttgggcgcaaaatcagtgccaagaaaaagaggatgaacaaaatgcttcgcattggatctccgcagaatga

SEQ ID NO: 55762 - DNA, 771 bp, Heterodera glycines
  Genomic contig location: Contig_ID=SeqID_25029; Location=1092..1862; Strand=+
  SCN-specific regions: Sequence locations=1-370,392-771
atggcattgaacacgtcaaatttaatgtttttgattgccacgggttttgttggaggtttgtctaaaaagctattcgtctttataagattcacatttttggcacgacctttgttcgcatcatctgaaattagacgatcgaacgcaccagaaatgccccacaaaatttgcctgtgggctcggacatgcttaaaggtaaaaatgttatgcttcgaaattctgaattctatctgaagtttatgccttggtttcgccaccctcgtcaaatacaaacaccaaatcagcaacggacccagtcaataataaatttttaaaacgagttgacacggaagacatttcaaaattaattgtattttaaaatatgtttgctcctattagaaaattgcaaaagaaattagaaggaacaggcaattgcaaaataatgaataaatagagagaaataacaaatagaacagagaatgaatgactgaccccaatgaaagggtcaaaaattgaaaaagggcagagtgaaaaataaagtggggaggggcggggggattgaacggacgtgggaaaggcaatttgcaatcgatgagaagtttattaatcattcgtattttttaatctatgcatgcatatgctttatgtgcctgcgtcattttttttattcaaggagtatgtgcatcaacggaacgaaaagggtcttttcacatgaatttaccgtattggtaggatggcattctaatgcccaaagattgggcagagcttacctaaatattgccactttattttaaa

SEQ ID NO: 55763 - DNA, 333 bp, Heterodera glycines
  Genomic contig location: Contig_ID=SeqID_25030; Location=224..556; Strand=+
  SCN-specific regions: Sequence locations=1-333
atgcgactcgatttggccccaaatgcccacggcaacgattggccttacgctgagcttaagtccgccgtctcctcggccaattttctcgagaggccacggccaacaaagcgtgccattagcgatgccattatcagtgccattccgacgacttctttcctcagcagtccctctgcctttgatgctggcttattgttatcgcctctgccggtcactaatcgaattggccatttgctgagggaattttcggacagacaaaaggccatttgtgcccaacactttggcattggcactgtgcttggcaataaggttggatcgattgtcattgacaattga

SEQ ID NO: 55764 - DNA, 116 bp, Heterodera glycines
  Genomic contig location: Contig_ID=SeqID_25031; Location=554..669; Strand=+
  SCN-specific regions: Sequence locations=1-33,63-116
atgattttatctatgatttttcatcaagtacttggttttttccaaaattttaaaaaattaaacgagcgtaaaaactcatggaccgatggtggagagaattgcatattattatccag

SEQ ID NO: 55765 - DNA, 1040 bp, Heterodera glycines
  Genomic contig location: Contig_ID=SeqID_4799; Location=467..1506; Strand=-
  SCN-specific regions: Sequence locations=1-402,426-579,609-1040
atgtcaagcagtcttgacgtcttcaaactgacggacgatgacgcaatgaaatttttgttgtgcgaatcgcacatcggcaccaaaaaagatggactaccaaatggagcattatgtgtggaagcgtcgatcagacggtttattttttcacttgcacaataaatttttttaaaatgtaatgcaaagcaaaacttgccgtttttttcatattcaaaaccagtaaatttttcattttcgacccatgataaaaagttggaattttttttcgaaaggtacatttttctgggtaaaagcttcgaattcatttaacaactatttattctgatcaaaataatgcttcaactattaattgcataaaaaatatgcaatttacgccaaaattagatcgattttaacgcgtatttgaaaaaaaaatatttaaattttttgttccaattcgggtccggggttcggaattgagcaaacccgagtccagattcgtaatcagaaccctcgaaaaccaccggaaactgattttaagcctaaaataaaaaaaagttaaattagggacccccattctttacaattgccatgccgagcacaaaatcttataaatttttagaaaaataaaccacccaccgcgttaaggcattcacatcatcaacattcgcaaaacgtgggagaaactgttgttcgccgcccgtgccatcgcggccattgaaaatccgtccgatgtgtggttgtctctgcccagccgtacgcccaacgcgctgtgctcaaggttttccttattccatggttccggggtcgtgctgattgtgatttttttttttatttcggtccccttaatatgcagcggttaacccgttacaaatgcattacatggaaaagtttagtttggttttccaaggtaaatgaaaacacagagttgaagcgggtccctcttttttgtttaactgaatcgatggcaataacctttctataataagttttcttcatgtttcagttcgccgctcacatcggtgccacgccaatcgttggccgtttcacgcccggctctttga

SEQ ID NO: 55766 - DNA, 149 bp, Heterodera glycines
  Genomic contig location: Contig_ID=SeqID_4799; Location=2209..2357; Strand=-
  SCN-specific regions: Sequence locations=1-60,82-149
ggtaaatattgatcataggccccaaactcaaaaatgcttaaaaacagtcagaatcgatgtaaaaaggtttgaaatgtgttggaaaaatagaattaggggcgcgcttgccctttttcaggatgaaaagtgccgaaaatggagtgccaaac

SEQ ID NO: 55767 - DNA, 229 bp, Heterodera glycines
  Genomic contig location: Contig_ID=SeqID_4801; Location=1082..1310; Strand=+
  SCN-specific regions: Sequence locations=1-172,194-229
atgcaaaaatgtaaaaagaaactagtaaaaataaaaaatggaaaatgtaaaaatattttaaaaaggtaaattttttcgtacatttcaaaaagtttgaccattttctctcctgcgaattttaggcaaaaagaaaatcttgttgacgataaaccagggctcggatctgtcctgatttgtcagatttgtttctgatttggaggtagcgaccaaagttgtcctgatttcttaa

SEQ ID NO: 55768 - DNA, 2482 bp, Heterodera glycines
  Genomic contig location: Contig_ID=SeqID_25034; Location=95..2576; Strand=+
  SCN-specific regions: Sequence locations=1-32,62-67,106-137,167 -209,260-275,314-371,429-471,497-530,555-746,768-794,826-1119,1191 -1369,1392-1559,1591-1778,1800-1877,1900-1918,1942-1950,1980 -1985,2024-2055,2085-2127,...
  SCN-specific regions: Sequence locations=...2178-2193,2232-2335,2362 -2382,2404-2482
atgcgcgccattctcttccttgcaatggtttgcttggtgatggctgttattcttgagacaggtggccaaaattaattaaaaaattaaaaatattttattattttagccaactcaaaggcagtgaaaaataagaaaggtataaataaattgataataaataataattggaatatgcttttaaaggaacaattacaacgccagcaaaaggaaaagcggcgccgaaaggagcagcgaaaggaggtaaagcagaaaagagagagggactaattaatacaaattaattgattaactaattaattaattaaggaattaaaaaagacgcaaaatcaaagggaaaaggaaaaaaggacgccaaaggcaaaaagggtaagaattttaagtttatttttaatgttattaattttcacaaaatctataaaaaaaaaattccgttgtgttggcaattcaccgaaattaataaataaggattttgatattttttaaagttttaaacaattgttaccattccgaatcagtcatcaagctaaatgtagttgtcttatttttaattaaaatcaactaataggctttgaaaaatgctataaatattttagaccaaccaacttattttgtgattaataggagggcttcctttttaggctcaaaaaatagcaaaatagacgttaataggcactaaaataggcaaataaattttttattaacgctttttaggtagcaaatggtaaatatttctaattgtatgtggaattaataaatattttaaagttttttcgaataagcacaaactttaaaccataattttttataaagaaaaataattaaattgtagaggatcaatttttctaaaaaaaatttgggtcgtttcttagaggtgtatttaagagttttccgaaaatcctgaaaataggcgccaaaaatggataaataggcacaaaattaggcattataaaagacatcgttgactccccaaaaccagtttttcgtgcttatctgagcgtatcaagcgcgcagaaattcttattcagttccaattaatttttctacaaaatgtaaaaaaagaaatgaattaaaattgtttgtattgtacgatggattaacaaaaattaagtgctacgcatgcggcaggattcgaacctgcgaaggaaatatccctttgcgatgtaaacgcaacgccttaaccactcggccacacatgcggtaatgtcattcaatactccaatgcgttaaaaacattcaatcaggcaacgctccgggtttagcgctaaacccgagttgacttgtgttgatccggattaacctttttatatcgcggtgtgtctctaggttaaatgtttcttaacccgtgtttaataaataatctcgggttaacagcgtcagtgtcctcgtctttggattcttaaccgggttatccgttaactcgggttttgttaactcggatttaccaacttttaacccgggtttatctccgtgaacccgggtttaaaataaatttgtgtgctcgtttaaccttgtttattttcttaaggatttttaaccctgagtttaggcattgttaacacattttaaacaaataaataatttaaatataaagaactcggtttaacggcttaacttgatttatttagataaggataatcgaactgactaaaatcacatttttgcaggttttaatgcttttgtgatctcataattatttttatatatcgataaattgtcaaattaacgaattgaacatagacaaatcaatgaaaaaaaaggttggcattggcataatttccgggcaaaaaattttggaaaaacatttccaatttcaatgaaaataaaagattttggaggaatataaaagctaaaagaaagccaagcgaaaaacatattcgaatattttaatttaattaatttgcttttattatccttcaaaatgcgcgccgttctcttccttgcaatggtttgcttggtgatggctgttattcttgagacaggtggccaaaattaattaaaaaattaaaaatattttattattttagccaattcaaaggcagtgaaaaataagaaaggtataaataaattgataataaatattaattggaatatgcttttaaaggagcagttgcaacgccagcaaaaggaaaagcggcgccgaaaggagcagcgaaaggaggtaaagcagaaaagagagagggactaattaatacaaattaattggttaactaattaattaattaaggaattaaaaaagacgcaaaatcaaagggaaaaggaaaaaaggacgccaaaggcaaaaagggtaaggattttaatataaagcgaaatttaaacagttaatttttgaattttagacaaaaaagctaagccagccaaagggaaaggagtgcctaaaaatggtaattattattaattttaaatgctaattaaaattgaatgaatttagacaataaatccccagcggcaaaagccaatgacaaaaagagcccaagtaaataat

SEQ ID NO: 55769 - DNA, 521 bp, Heterodera glycines
  Genomic contig location: Contig_ID=SeqID_25036; Location=737..1257; Strand=-
  SCN-specific regions: Sequence locations=1-521
atgtcaatcatcgacagcttcgttgtgccatatcctatcagcagtggaatattagtgaatcagttcctattggtatgtatggcaaataatttgaaaattgtgtgccgtggcatgtttttggactaaaattaaattttacaaatttttaggcactttgattggtcgtgtcaacattttggacaatgtcaccgatagtgcaacacataaattttcgtttgtcaatgcaaatgcaacgccaaattttcgagtcgacgaatttgacggcaatatttacattcagaaaacattggatcgaaatttggtgcatgcaaaatttgatttaaatttgaatttttgtttcttgcttttaaagcattcccttgtcttgttgatggaggtcagtaaaatggaggattatggtgggactacagtaacccgatgtgccattcgcgtcaatgtccaaatcgacgacactgaccaatggtcgtccaatgcaacgaaaagaaatgccattcactttcttaggtgtggtccaaaataaa

SEQ ID NO: 55770 - DNA, 647 bp, Heterodera glycines
  Genomic contig location: Contig_ID=SeqID_25037; Location=10..656; Strand=-
  SCN-specific regions: Sequence locations=1-66,90-91,113-647
atggaaaaagttgacgtagacacacaaacggatgatggaacagaaggaatggaaattacagacgatgaaaaaataatattaagtgggttgcatttcattcatttcaattttaaaaattatcaaaaacttttttatacccgccttttatcaatttttccatttttagccgtaaaggaagcgtcacgcgctgttgttgcgcatgagtccgtgtggagcgaccccgttgaaatggcttacgcacgtaatgggaaaggagaagtgagttttaaaaaaagtttttttttgctgaaattgtgtacaaatttcaaaaaatttttattaaaaaaccttgatcactgaaaaaagccctagttaatttgtgttatagacaagaagacgaaaacactgcgaaaaattgggtggaaagcaccagcaattggaagatgttgagttttgtttggctgccaaattgggagttgaaatcgttctcaagaggaccatcgctagcgatgaagacatcaccgaagcgacaaatgtacgtaaaaaataaaaacaaaaaagtgattgttctgtttcagacagttggtacatggtcaaaagatcaggcgcatatcgcaaggaaacaggaattcgtagtagggacggtaatgatggttttttgggtataa

SEQ ID NO: 55771 - DNA, 656 bp, Heterodera glycines
  Genomic contig location: Contig_ID=SeqID_25040; Location=334..989; Strand=-
  SCN-specific regions: Sequence locations=1-9,31-123,164-415,437-656
atgtttatgaattgtttaaaatgttggtttcattgtttgattacaaaaatcaaatgtatgtcaaaatgatccaatagactagaatagagcgggaccgggaattcccggtcctccgaggtcccgaattttaaaaatttatttcccggtcccggtagggcaaccgagaaaaacaagcactggtatgaagggggtctgagtgaaaatttaatgctgaaaattggagttaaaggcaaaatttaaaaaaaaattgatatagtctaaaagtaacactaaaaattgtgcaaatggcttagtggctaatcttcttgattttctacttctttccccaggttcaatccctctacagaaattgaattatatttaattttcttttcgtatactcatatgtagggcccggattcttagttttttaactattttttctgcggctttattttgattagaaatgcacgaaaaacacatttttagttcggaaattattcgttttaacgccactattcatcactaggaatcactattttggagcttcgccactaaaaaaaactattttggaagttggccactaaaataattttttgccactattttggcgtttcgtcattatttttgccactattttggcattttttggaaaatttcccaaaaaatgcaataaa

SEQ ID NO: 55772 - DNA, 364 bp, Heterodera glycines
  Genomic contig location: Contig_ID=SeqID_25040; Location=1109..1472; Strand=+
  SCN-specific regions: Sequence locations=1-296,320-364
atggcatccgttcgtcacagaaatcccatggctgtactggttgttgttctttcatcgtcgctgttttcccccgcttttgcgcttgctccacttcggcagtgcgccgcgtcgttggaatgtgccacgggcggtcgcctcgcgacgctgcacaatggcggtgaaccggcgcttgttgcgtgccaacagttccgtgtccgccatcagctcctccaccattgtgcgcttccgttgccgtcttggaacccgcgcggcgtagaagtcgaccttggattcgtcgatgtggccaatttgggggagaaaacaataatttatggaaaaaatagattttttttctctattgcacagtttaatcgatcataaaaaa

SEQ ID NO: 55773 - DNA, 241 bp, Heterodera glycines
  Genomic contig location: Contig_ID=SeqID_4802; Location=186..426; Strand=-
  SCN-specific regions: Sequence locations=1-110,175-175,199-241
atgaattatgatgaattgagtattttgaaggaagaaactgttgttaagacaaacggtgaatcattcactgatgggcaacaaatgaaggtgaacaaaacatagaaatttggaaatatttataatttattaaaattataattataatataatttttaatgcaatattttatttttaggaacttagagaaaaatttgaaaaaatggaattgatattgaaaaataccaaattggagctcaaaaat

SEQ ID NO: 55774 - DNA, 1968 bp, Heterodera glycines
  Genomic contig location: Contig_ID=SeqID_4802; Location=499..2466; Strand=-
  SCN-specific regions: Sequence locations=1-87,109-594,623-888,930 -930,952-1043,1065-1276,1336-1439,1461-1514,1537-1811,1834-1968
atggctccctggcatagcaaaatgcgtaaacattgtgaatggaaaaatgtgaatggtccaaagtttgaattaacaaaacaaagagaaaaatggggaaaaatcggaaaagaatcggagaaggccggaggggaagtgtcggccaaaatgaagacaaaggtgaattcaaaaataaatggcaaagcggcggggcaaaagggtaagagcagacgcagatgtgaaaaaagggagaaaaagggtcaaaattgaaatacgacaaattgaataaaattacgatagcaaaatattgagaaaattgggataaaaaaggtgaaaaatagagaaaattgggaagaaaaggcaaattccgatcattttcttgacgcctctcgctctgtccctcaattgcgacgggaagtgctcccgttcgaccacttgtttctcttctaaacgcagcagataaaagtgaacagcagggcgcgaaagcattgactaaacacaccgggggtcctctgccccccggcgcctctctctcccccccccccccctgcccccgctcaatgttgataaaaaagtcgaataggggcagcgaaaattcgtccaaatcaacccccccccaccgccaccaccatcaccagcagcagcaaaaacatataggggcagccaaatgttgtgcagcaaaaggtgcagcaaaaaaagtcaagtaggggcagtaaagtgtgcgcgctatatctactaatatccaaacttaatcaaatcccattatcaaatccaatttgacagttataaaaaatctgaagagaagaaaatttcaatttcaacagattcaacaaatagtgaagatttttcgtctgatgattgtgataatgagaaaaggggaaacggtagaaaataaaatttgggaaacagtagaaaattaatataattaaaaataaataaaatgaaataaaaatgcttttctttttagaaatgaattatgatgaattgagtattttgaaggaagaaactgttgttaagacaaacggtgaatcattcactgattgaggatttttgtacatattttagcattttttatacatattttatttacataattcgcaaatattcttacataaaattagcagccctattaataatgcagaaatgcaaaaatgaatggataaatgagtcaattataatattttcgttttgctcttctccaattgttgagtcatcattttgccctaaattattgttgattgacctcgataaatacattaacataagcaacagcagtcagcaaatgttcatttattactacaatttttaaaatatcatatttctttattattattattatttattttttaattaaaaattcactttatttgtccaaaaaatggctctattgcactttatgagtccaatcgactttttatgaaaccaaaggtatttaatgaatccaatcaattaacaatacctggtttttataaaataattttgttcatgtttgaacaaaccctatctttttgatgtcattcgaaagtagaaagcctaaagaagtttaaatatataaaattttagcgtttaggccatgtcaaaaaaagatttgattaattaaaaaattgttgatattttcgtttgtaattaactgttagaattatcttgttttctcgtattattacattattcggactttgtgctttcgaatgatacctaaaatatagggtttgttcgaacataaacaaaacaaaattattctaaaaaaccacaggtgttgtttgttaattgattggactcataaagtgcaatagataccaaaaaaatttcaaaaggcttgttacatacaaacagtactcaaacttctctccatttctcatcatcaaacccaatttgacaattataaaaaaattgaacagaaggaaatgtcaatttcaaacgattcaacaaatagtgacgatttttcgtctgatgattgtgataacgagaaaaggggaaacggtagaaaataaa

SEQ ID NO: 55775 - DNA, 93 bp, Heterodera glycines
  Genomic contig location: Contig_ID=SeqID_4803; Location=1929..2021; Strand=+
  SCN-specific regions: Sequence locations=1-93
gcaaaagattgcgttgttttcgccaccgaaaacaaacactccgtcctcacacagcccgtcaacaaaatctccaagttgtccgaccatattgca

SEQ ID NO: 55776 - DNA, 379 bp, Heterodera glycines
  Genomic contig location: Contig_ID=SeqID_4803; Location=1637..2015; Strand=-
  SCN-specific regions: Sequence locations=1-379
atggtcggacaacttggagattttgttgacgggctgtgtgaggacggagtgtttgttttcggtggcgaaaacaacgcaatcttttgctgcaaaaatgaaagaatttgttgggttaaaaaaaggctgttttcaggagtatcgaagtcattgaacaggaaatggcatcatttttcggaaaaactcttgaaactgaactcaatttggaaccaaaagttgtgttgaaaagtcaacccgcgacttaaaaggaggtaaaattgaaaaaaatcatcatttgttttccggatgtcagataaacaattgtatatcccaccaattgcggtttatgtttatttttgaaaaaagggatttgaaacttcaaaattggccaattttaaataaa

SEQ ID NO: 55777 - DNA, 126 bp, Heterodera glycines
  Genomic contig location: Contig_ID=SeqID_25043; Location=593..718; Strand=+
  SCN-specific regions: Sequence locations=1-126
atgagagagtgctggatctcagtcccagtcatacaaaacatttttgatgaaggaggtagagaaaacaatttcaataaagagcgcaatgggaagggagttcatgtctcttcttcgctgattcttttg

SEQ ID NO: 55778 - DNA, 869 bp, Heterodera glycines
  Genomic contig location: Contig_ID=SeqID_25044; Location=376..1244; Strand=-
  SCN-specific regions: Sequence locations=1-526,548-869
atgtggataacggttagaaccccaaattcttttgggaataagagaattttggagatttgtcctgggaaattcacccaggccttttccgaatcgacactgtatggaaggtatgacgttggttgaccgtggaggccggaggcagagaccatttgtctaataatttttcactcgcctgttcccgtctgatggaatgcccctaaaattaagggtcaacaccgaattcgagaataatatcaagcgacaattttggaacaattgaccgggaattataaagccggcggtttgttcaggggcaagggagcattttatacaacatcatgaggttcgaacccccaaaaattgcgagttgtctatgataactccgcgcaggaaaaatggaaggcttcactgaacgatttactcctccctgacccaaatttggtccggaattagcgggaatttagctacgtttccagtcctctacctttcctgtacattgcagacattaagaaggctttcttggccgtcggtcttcgggcggaagaccgggaagtggccaaatttatttagatagagacccttcccaatccttaatccctgaaaatttagtgattttcgcttcaaacgaattgcattcggcttcaattcttcgccatttctgcttgcttctgttctccgtcagcattggttttcgattttgtacaccccttggggatggcaaaaacctttacggtgataatctattaatttgcagtgaatccgccgaagaagtcgctgctgcaactcaaattgcccgctaaacaatcgccgatgctctttgagttttcgaggtcactgattacgagtccggcattcatttcatccgaaccccggaccagaatttgaataaa

SEQ ID NO: 55779 - DNA, 352 bp, Heterodera glycines; identical to SEQ ID NO: 55331
  Genomic contig location: Contig_ID=SeqID_25046; Location=228..579; Strand=-
  SCN-specific regions: Sequence locations=66-66,98-104,133-294,325-352

SEQ ID NO: 55780 - DNA, 836 bp, Heterodera glycines
  Genomic contig location: Contig_ID=SeqID_25047; Location=853..1688; Strand=+
  SCN-specific regions: Sequence locations=1-194,230-727,760-836
atgaattgggtgctgctccgtgccggcttcccgcccgtctccatccccgtggagcagcgccaccgctactaccacgtgctgcgcgaggccaacgacggcgacctgcgcccgttcatccgcttcattgccgagctcaccgaccgcacgttggaggtgggtgggtcatgagacatgaatgactttttaaatcgcccaaaaaatttttcaaaatttttttcataaaaaaaatcggggcggttgggatttgaaaattagggtttcataaaaaaaaggtcctccattttttcaaaaagtagctaataaaaaacaatgcttggtccaatgtctgctgatataccaatcgaaaaaagccctctgacatatgggaatttttgtttttttggaaattttgatttgaaaattttatgggaatttagcgcagcccggcaccgcctgggaaaaattttgaatttttaatgaatttgttgaaaaaaaatttgtgtaaaactattgtacccgctgttgtgttgcggctatgtcaatgaaatttgttgacattttagcccaaaaaggacaccagaaatatttttcagaaattttaatttctgttttttacacgaaaattttgttcatttttctaaattccttccatttttcacatttcggtaatttcaaaatgaccctccattttttacagtcgctgatcgccggctcagtgtcctcggtgtgcgaaattggtgacgactgttcagcatcatcatcatcgtcatcatcatcatccgccggtggtggcgacgcaattgatgccaccactaatgggccgaaggagggcgaggaagaagcattggatgccaatc

SEQ ID NO: 55781 - DNA, 609 bp, Heterodera glycines
  Genomic contig location: Contig_ID=SeqID_25049; Location=154..762; Strand=+
  SCN-specific regions: Sequence locations=1-282,305-311,347-407,435 -570,592-609
aaggcagaactatctgaacattacaaattcaatttaactcgattaacggacattgacgtcattgcgaagaaagactacccatttagtgtttcttttaataggttaaacacatcaaattttaagaaagcaagtgtgccaagttgggccgtcaattttattcgggtaaatgccaaaaaaaaatcgcataaaaaataaaccaaatttttttacagttaaagggtgagcacatcaaattgctagaccggccatctgtactgaacgaagaaaagaaggtaattttggaaattttttggcaccaaaaattccgattgaataaattgaaatttttaattttaaaagattttttgggtcaatttttaaatttttttagcaaattttatgggggtatgctaaacaattgagcatgactatagttgttgttgttgtttttgtcgtatattcatcatttatcatcactcctttcataaagaaaaataataatttaaaccttaccgcatcattggatacggtgcttaactacggtgacgaagttttcctgtgataaaaatgcccaagggtcgttccgataaatttctacttaaaaaatgattttctattttattttcaaaa

SEQ ID NO: 55782 - DNA, 1101 bp, Heterodera glycines
  Genomic contig location: Contig_ID=SeqID_25049; Location=1352..2452; Strand=+
  SCN-specific regions: Sequence locations=1-135,158-288,442-531,565 -630,657-1101
atgccgaaatgtgcagtttcggcgcaaaaaagtgccgaaatcacagaagcggaatgtaccggaattcacaattttaaaataatttttcaatttttgtattatccaaaaacaattatttttgacagatttggtaacaaaaattggcatttttcaattttaagcattttttttgaataaatataataaactcagaattttgccggaatttttcacttaaaaaaatgccgaaatgcgcaattccggctctaaaacgcattttagacccatgatcaattgtggggcaattcgtatttatttaacaatatttttgatttattcaatttaattttacaaaaaatgttttctaaaacaattttttaaataaaactcgataaaaaaggcatagaaatttaataataatttaaaaaacaaaataattaatttatttttttaatttaaattctcattttcagttggtgacactttgttattgttggaatttgatctttcgaagccaaatattagttgcaaaaattatctgcacgaggtgggaaaataaaaaaaattttaatttaatttatttttgggattacagtattaaaggaatttgaatgcgaaaactttggacatacagtatcacaaataaaccaccattaaagcaaaacaaacaaaattaaatgcaaatatcatcggggcttattaatttgataaagtaaaaaggtacaaaactgtctgcttattaactgaatactgtaaccaaaccataccaaaaaagtggaaaaaaatcatgaatacagtaaccagatcgtatcaaatgacggcttattgataaatgaatagagagaaacaaaaccgtatcagaaatatagagctacaattaaatgccgaatactgtatcaccacgtattacagaaccacgacttttcaattggtcctgaaagcacgcacaagctgaacaaatatggccaacatttccatttgctgatcaatgcgacggccaaacattttgcgatcagaattgatcaagtcggctttcaactggattgcaaatatggaatttcgaaaaaattctcatatgataaatactacatatacccaccatgggcagtggataaaattcaa

SEQ ID NO: 55783 - DNA, 382 bp, Heterodera glycines
  Genomic contig location: Contig_ID=SeqID_25050; Location=1671..2052; Strand=-
  SCN-specific regions: Sequence locations=1-114,138-167,190-358
atggagtttctgaatgaaattcatgggatatcttggcctctgtttgaactaaatggacttggacgcctagatatagtgctttttccttcggtaagggacaatggtatttcgaataaaaaatacaaatttatttaaaacttacaagaatttttaccggtaatttttgcaaatatttataaaaataatatacataccaaatagacgagtcaaggctaagaaaaatagaattagtccgaataaaattttagtcatttagaggttgggatggaagtgaatgttaaaaatacgttacaattgtattatgtaagtccattattgaaaggtgtttcatacaattacacgtgaaataatgaaatagatttatttaaaatataaaaataaa

SEQ ID NO: 55784 - DNA, 678 bp, Heterodera glycines
  Genomic contig location: Contig_ID=SeqID_4804; Location=587..1264; Strand=-
  SCN-specific regions: Sequence locations=1-303,325-429,451-575,597-678
  Gene Ontology: Mol. function=dipeptidyl-peptidase IV activity; Cellular component=integral to membrane; Biological process =proteolysis and peptidolysis
atgactctcctcaaacacaaattttcccaatcaccgcaattgaaggaattgtccgttgccagtccgcaggagcgcaattggcgtggcattgcaacagcgcttctcgtcatcgtcgcaatgtgttccatcattgcacttgccgtgcttgtgcttacgccccgtgcgtttgcattttgcttttccttacttttggcactcgtaaattgactctcattcatcagacgcatttcaaattcggcatttgaatgtcaacgaaaagccaaaaatacactttcacgatttttgcgactttattcgaatttgtaataatttttaatttttattctaaattgcccttggctttgtcatattcgtctgaatgtatgtcaaatttgtgattgtggtccaaaaatatactcacaaattggggactactgattttcatggcatagtttttaaaaatgcaattctctcaaataatttgcagctcttttggacgctgaccaaccgcagaagcgcgtcactttggccgatgtgctcactcatcgctttctgaactcggtggagtcgttggaatggttggacagtcggcgactgctcgtcaaagaggcggagagtgtccgcgtgttggaactgaacgaaggggcggagaacggaggcccaattgggtggacatggaaaacgttgcctggcgatttg

SEQ ID NO: 55785 - DNA, 1216 bp, Heterodera glycines
  Genomic contig location: Contig_ID=SeqID_4806; Location=15..1230; Strand=-
  SCN-specific regions: Sequence locations=1-95,117-336,358-861,883 -996,1018-1216
  Gene Ontology: Mol. function=RNA binding; Cellular component=polar granule; Biological process=pole plasm RNA localization
atggtagcagggcgagaggaggcggaggaacgacgagttgtggttttggaagaggggccaatgcagttggtcggttatttaagtgtggttatttggattattttcaatttcatcccacagaactcggtccaggagaccgtcgcggttttggacatggtgccaatacagttggtctgtcattcccgtaaatttgagagtaattgtggtcatttttattctaatagaactcaattcttcgaatgatccgccgagcattggcactattttgcgtggtggtggacggggccgtggtcgtggcatgaactccgaaggttcccccccccccccccgtcgttcttttgcattatttattttattcccaaatttttaggtcaaaatggtggtttgggcaatgcccggccaaatgccgaaaacaacggacgcggaagagagagttacggagaccgtaggggcggtggtcgcggaagcgaaggagacggcggagaacgtttcgggcgcggcagaggcgtaagaggacgacccgaatttggcgaaagaccgccgaatcacagtcagcgaggaccattcgcaaatggcggagacgaacgctttccacgggatggtaacgaatggagctaaagcatttatgacgaactaaaaaaccaaatttagagcaagggctgagccgaccaagacacacttacaaaaaaaggtccatcgagtgcctttacgaagaggactttctcgtcagcgaacgctacgtggacatccgtgacgaagacgaagacttggctgtttttggacacaatgaaaaattcacatcgtatgagtaagcgattcatccgattaatggaagttgaatttcgtctgttttaaggacttggaaggacttcaatctggagccaaagctagtcgacaacatcaatcggtgtaagtacgtgttgccccggaagatccaatcgtacacttttccgctgataagagacggtgcgacacatttagccggcgtttttacgttgttttgaagaactttgtttaggctacgacgtgaaggcacacgcggagacgagcagcgggaaaagtgcggcatttttgctgccaatcatcgacagaattatgaagctgaagaaggaatgcgctttcaagtcgaaacggggctgtccgtacgccctcattttgtcgtcggcccgtgagctggtcatccaagtgtacgaacaagcgaggaaattgtgcgatg

SEQ ID NO: 55786 - DNA, 2266 bp, Heterodera glycines
  Genomic contig location: Contig_ID=SeqID_4807; Location=374..2639; Strand=+
  SCN-specific regions: Sequence locations=1-99,122-766,795-889,917 -970,992-1045,1068-1928,1950-2266
atggatccacctccctcacacccaaaaaatcagcaaacccagtccgccaacgctttctccgcaaatgctgcaccggctccactgctgacgtatgggagaggcatttttgggtttatttttgtgcgtaaaattggatttgcatccaatttcagcacatcgtccgcctctggtgtccaaccgctgcttttgccgtcctcttcaaccggcgccggtgttccttatcaccagtgcgtccgccacggctttgacagttatccttcgtctgcgaacgaaacggtggcaatgtacgggcagccaggggccggtgcagcggtgtattcgtcgtttcagcaacaggtcggagcccacaaaattccgctgtcgaaactccgccggacgaaactgaatcaaagtattcaaaaatttttcaaaaaaattcgttggtggaaaactgaatttttttcaaaagttttctaaggttttttcttggaaataagtgaaaattttttgtctcggtggagtttcgtcggcggagtgcgttttgggggtaccggcaacaggtgtatggagaatggtagaacgatgttgaccccttaccgaaaaatttatctgtttttttgtccacaatgtgttaggcatattgtctaccacatttttttccctaatgtgtcaattttcatcggttggttttcagcacgccgaagttgtcgatcagcagtgctaccaacaacagtccgctgattctgtgggttacggtccgttggtgccggccgccttcgtgtcagtccctcttgaacaacagcagcaggcatcacaaaagggtgccgtcacttcgtcggcggcaaaaccgctgccccaacaacactttgtgcccccgccgccctccttttacacggccggcaaccgttcgtccaacgccgccgccgccgcactgcttggcgttgtgccaccgcctccgatgcttccgccgtcggtcggcggctcggcggtggttggcccaccgccgcccaccgcttacgcgacacagcagcaacagtcgatcaatgccgtcacttcgtcatcggcaaaactgctgccccagcagcccccgcagcctttttacgcggccggcaactattcgtccaaagccgccgccgcttcaatgtttggcgttatgccacgacctccgatgctttgcccgtggggcggcggctcagcggtgattggcccaccgttgcccgctgcttacgcggcacaacagcaacagccgatcgaccccatgccgtcattatcgtcgacattggattatggccaacagcagcactcatcattccaacaccagcaggtaaaaaacttgtgtttgagagaggaggtggtggatgggtagccccaatcaaagaatattaatattttagatggtgggtcccacttcatcaacggcagatttgcaccaaaagctgttcgttccgactgccgaagatctttctgacagcatgatatacccatttgatgtgacgcatttgttctgcagagaaaaaacttcggagattttggacccccaggttagcaaatacctaatcattaagagaggagggggtggatgggtagcaccactcaaggaatattaatatttagatggcgggccccacttcatcaacggcagatttgaacccaacgttgttcgttccgactgccaaagttttggaccccgaattggttagcaaataatcattaatttgaattagggaagttacttagacacaggagggcattagttttgcatattcaaaaatgaagcctcttaatttttgtgagtgaaattatggatgacttataaaactgtatcaaaattaaatggttgtggtactcatttgggtggtgcagaagatgacccatattgatttgttcaacaaaagtaatggtcattttcgatttgcatctctttatatcatggaaatgttttctctaaatttgcttttttccttcccaatctccgctcttttcggttttagaatgtattaccctaaaatgattaggcttccgtctgaacttatttccgaattggcgagtgctcttccccttgacccccgctgggccgtcatccgtgtgtcctcggcctttgattttttcgtttatacaaaacagataatttataggaaaataaatagccaggaatttaaatttgtcttacattattttaattgttcccacttttagttggatgaagggcttaaaaaagcaaagcaacaagtttcgtcagttgccaatgctcagtccagtgacgaacaacgacgaaaactgctcacag

SEQ ID NO: 55787 - DNA, 742 bp, Heterodera glycines
  Genomic contig location: Contig_ID=SeqID_25054; Location=1..742; Strand=+
  SCN-specific regions: Sequence locations=1-64,86-290,315-476,499-742
ccgtactgaaatgaccccatccctctgaaagtctctcactgatatttttgtcacttcgtcctagcacctgtccattcacttttcccttcccaaggcattcatgtccaatcacttgtccaaatggcgtgcgattcgcggcttttggacgccgattcgcggcagagggcgatgcaaacaatcgccacaaatgtcgaagaagcattgcacgtcaaacaccaggcaaaatgctattagatgttagggttgctgagcatgattatgtcattttggactgttatgattttgtcttttttaaattttcccaacaaaaatgtcccccttttgcttccgactttgccctctttcagttgggcggcaatcgcttcagaatgctgaacatgatcatctgcacgaggagcagcggtgcggccgtcacattcctttacatttccgtcaaaatgctttataccgtaatgcggcatttattaattgctcgcccgttaattataaaaagggaattaggcaattaattaattgcttccttaattaggtgaacattgttggccaaatctttctgctgaacacttttctgggcaacagaagtcgttggtacgggctgcaggtgctgaacgatctgatgaatgggcacgagtgggaggagagcggacacttccctcgggtcactctgtgcgatttcgaagtcaaagtgttgggcaatgttcacagacacacggtgcaatgtgtgctgatgataaacatgtca

SEQ ID NO: 55788 - DNA, 657 bp, Heterodera glycines
  Genomic contig location: Contig_ID=SeqID_25055; Location=1..657; Strand=+
  SCN-specific regions: Sequence locations=1-347,369-500,527-611,649-657
ccgaaaacaaaaaaatcgattttttcaagtgtccgtttggggtactcaaacaattatgggggagcaaaaatccaaagcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcagggggactgccccgaaaacccaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttatgaattaattttgcaaataaataaaaacgaaagact

SEQ ID NO: 55789 - DNA, 135 bp, Heterodera glycines
  Genomic contig location: Contig_ID=SeqID_25057; Location=1419..1553; Strand=-
  SCN-specific regions: Sequence locations=1-135
gtcagtggcccttacggagagaagttccaaatcagcgtgaataagggacaacttttgttggctgccgcgcactcttttggtgacactttgtctctgctcggcgagggcgacattatccgttttgtggcctttttc

SEQ ID NO: 55790 - DNA, 927 bp, Heterodera glycines
  Genomic contig location: Contig_ID=SeqID_25059; Location=277..1203; Strand=+
  SCN-specific regions: Sequence locations=1-121,171-201,240-255,279 -286,337-396,466-545,617-829,876-927
atgattgtggtgacaattcggacgaaattgatgaggagtgcggtggaacatcacgaccatgttccgagtccgagtttcgctgcaacgacgggcgctgtattccgcactccaaggtgggaagaattttaatcaaatttaaattccatttttaaattaatattttaaaaatagtaaattcccatttcaatgatttcgtatcataaataaatctgtttataatattttaaatgtctttgaataaacaaaaaatcgtcataaattatttaagtttaaattatgccggtacaaaatttttatttaaatttaaaatatcagttaatattttgaaaaaattaacaattgcgagttaaaattcttaaaataatgaaaaattgaaactttattattcaatcaaggaaaaaatatttaaaaaaaaataaattaaaaaatccaaattgtatttttttttaattattattttaattaggtctgcgatgggaccatccaatgctctgacggacttgacgaatcggagtgcaccacgcgcaaatgtgtggacgggtaagtaaaaaaaaaaatatatttttaatttaattttcatttaaatattttatatttttcctatttaaatattaaagcatgcgccaatgtgaggacggcacatgcattccggaccacaaatggtgcgatcgtcgccgcgactgtgccaatgcgtcggacgagcgcaactgctccaaccatccgaaccgtcgccagtgctcccagtacgaatttgagtgcaccaacagtgtgtgcattccgcgcaagttcatgtgggttttaattataatttatttgcttgtttaaaaggattttttattattattattatttattttaatttaattttattttatcgagcaaaccaaaggcacattagtgctcttatatggtgccaaaaacaaacaa

SEQ ID NO: 55791 - DNA, 1102 bp, Heterodera glycines
  Genomic contig location: Contig_ID=SeqID_25060; Location=102..1203; Strand=-
  SCN-specific regions: Sequence locations=1-269,291-319,341-435,458 -567,589-804,828-940,963-1102
atgcagcagcatccgatgcatcatcacccccattatcagcaaccgcaatttgcctatccgcctccgccgctgtctgcgcccaacgcaggcaccggagcacatatgcagcagcagccgactccgccaccacaggcggcacaacttcacgccatggcggcgtccgctacgcccaccggactgttcatttacgctaccaatttcggcacctttcagcaggcggcggcggcgatggggccggtgggcgaaccgccgcatcagcaggtttattttcgttcacttccttaaactgcacttaggttgcatttcagtcggattttgcaaggcaaaaactgccataaaaatccggaaatatttttatatggcaatttcatattaaacctatttacctactcaacatttacactttcacagcccaatgaactgatcggcccaatgcccggacagcatcagcaacatccgatgcatcatcatcctcactatcagcaaccgtcgttcgcttatccgccgccaccgctctcggcgcccactgtcagcaccggaggagcgcacatgcagcagcaacagacaccgccgccgcagacggcaccgccgacgcaccaccaacacgtcatgcccaccgcactgttcggctacaatcccaacatcggaccattccatccgccaccggcgatgggaccaacagtcgagcagccgcatcagcaggttttctttttttcattctcccgaattcaaaataaatgttttgaagaaaaaaacaaaaaaaatttgaaaacagccgaatgaactgattggccaaatgcctgtgcgacatcagcaacagcagcatccgatgcatcaccacccccactatcagcagccgcactttgcctacccaacgccgtcgttgtccgcgcccaccaccagcagcggagtgcacatgcagcggcagcagacaccgcctccgcagacggcaccgccggcgcaccatcacaatgccatggccgcggcgcttttcggttgtccgcccaacatcggaccattccatccgccaccggcgatgggaccaacagtcgagcagccgcatcagcaacaggttttgtcatttatgttggttcgtaataaa

SEQ ID NO: 55792 - DNA, 397 bp, Heterodera glycines
  Genomic contig location: Contig_ID=SeqID_25061; Location=455..851; Strand=+
  SCN-specific regions: Sequence locations=1-117,139-397
atggcactttcctcactgatcgaattgggtaaaaatcggcaacaaactcagcgagacgaggctgaaaatggcattgacaatgagtaggcaaagattggcttacaattagcgtttaattgtcatttatcttttcttaattaattgcagcgattgccgtttcgatgggtccgtcgccgtttcgtcgccttcggtcatttcgtcgacttttgcggcaacaccagcgaactgttctgccgaaacattccaatcgcacgccaacggcacacacaatgtgacgacaatcaaaacggaggacaacgaatcgggcgacgaattgccaccgcaaggcaatgcgaaaaaacaaacgaacgaaggcattttaaatgccaagcaaaaaattcgaatacctttattttaa

SEQ ID NO: 55793 - DNA, 810 bp, Heterodera glycines
  Genomic contig location: Contig_ID=SeqID_25062; Location=620..1429; Strand=-
  SCN-specific regions: Sequence locations=1-13,36-57,113-154,224 -473,511-810
atgggtcatgttgtttttataaataaatttgaaaaatagtaagggaaaatttgatggttaattaaaattaaataaaagaaatttacatatataaaaattatttgaataaaatgctgcgcttaggaatatattaaagtgacctcattcaaatgacattattatattgttttattgaattctttttgtataatataagaatttttatttttgtatataataaaaagggcaatattagccaaatttttattaaagtgatcaataacatagacatatattttatttttgccgctttttacgtaacatatacatatattttatttttgcagctttttacgaaaaaattttaagctcaaacttggtagcggattacaatggctactcgatttttgaggatttgcaacttggggacccgacatttaaggacccgacttttgaaacaaattcaatgacaatcaatcaaggggatttatgggtaaaaaataatttaaaaagttatttaatatttatttagccaaatttgataaacaaaatcacacaaattggcgaattgtaccgcagtgccaaattgtttgagaatccttccgctgtaacacaacaattatttgcaaagctaaatttgccaaatggaaattggaatcctggcagcaaggattggtggacacgctattcgggagtgatcttgaacattctcgacatatggggcacacatggaatgcctgaaattgcctgcctattaggcgtaagtgtgacaatttaattaacaaaatgaggcacgcaatcattcagttaattataaaaaatttgaataaa

SEQ ID NO: 55794 - DNA, 361 bp, Heterodera glycines
  Genomic contig location: Contig_ID=SeqID_25062; Location=1617..1977; Strand=+
  SCN-specific regions: Sequence locations=1-140,164-253,294-306,330-361
atgtgcaaatttgcctcgtttttagttattttttttgctgtttttctgctttttgcaaaaggtgacgcaatgaaattaaaatccaccaaagattggataaagaaaaaattctcttcaacttcttcaccattttcatcacaatcagtatcatcttcatcctttcataatccattaatagaatcatcattttcctttaatcctccagaagaaaaaggtaaacaattcataaatttaaaatggagaaaaaacttgatacatttattaaaaacaacaataattaatattctaagcaatcactgcagcgcactttttccaaaaacttttgggaacagggacagacatcatctgcgactcccgataa

SEQ ID NO: 55795 - DNA, 1455 bp, Heterodera glycines
  Genomic contig location: Contig_ID=SeqID_4809; Location=1836..3290; Strand=+
  SCN-specific regions: Sequence locations=1-251,325-366,435-467,511 -526,589-589,648-654,714-756,778-931,953-981,1014-1045,1067-1079,1101- 1305,1327-1378,1453-1455
atggtcatcgcactcctcctgtcatccgcactccgcttgttgtccatgcttcgcgtgcttacactgccgttccgtttgttgagcgcgaatctgccgtctgaatgtgagttttttttgccctaaaaccgagtcataaaccctttcttcaaactctttttctcattttcccattttgaaatttcttgatttactttccatttattttgcctctgatcacataatttttctcagatcaaatcagtcacatcacttaccgtatttcctcgattataagccccggggcttctattgttcaacccccctccaaagggggcttatattcgagggggggggcttccaatcgagggggggcttttattgttcaacccctttccctatataaattcttaaaattttttgctttctgcataatggtacaatttaaatcttaatctaaatttttgaattgaaaagatttttcattttttggcccttggaaatttaggcgaatgtttgaaaattcataattcacttctaaatgaatcaataaagtgcaaaaaagcattaaaaatagagaaaaatctggagcattttatacttttttagaatattctatcttcaaaatgaagaagttattacataaattttggaaaaattcgttttttgagaaaaaaattaatagcgctgttctgaaaaggttttttgaaaaacacgaaattcttcctctataagcttctgtttattctatatttttataagacttttgaaaaaaagtacaaaaataaactgattttggaattcgggatcatagattgaagcaaatggtttttttgggccatgggttcagatccacttgcctgtaaaaatgttttttagggtttttgggaccactaatcaagaacttggcatccattttgcccaattccaaagccttgatccgaactcgaaaccccaaaaataattttataaatgttgcaggcatgtggatttgaacccatggccaaaaaccccatttttaacaaaacaaaaaatatattgggtataatatttctatatttgcttgaaaattttttagtgattttcatcaaaatcttttccagtgcaatttattaacagaaattttttctaagctattgcttcgctattagacaatttccaaaaaagttatacatgaaaattgcgaaaagtcgaaaattttgaagttttttcgtaataaaattattccaggcttgaaaatcttttcgcttttggtaaggctaatagagcatgttaagagctttcgagtgataccaacaatgttgtatttggatgtcaaagaaaaaagctatcgtggaaaaagagctggcgccgaaacgcaagcgccgaaacgcgtgggtcccgtttgtacatttagtctttctaaaatattttatgaattttaaaaaaatactattttttcagaaaatttttgtgttttaaaagtatttaaaataacaa

SEQ ID NO: 55796 - DNA, 1872 bp, Heterodera glycines
  Genomic contig location: Contig_ID=SeqID_25063; Location=1..1872; Strand=+
  SCN-specific regions: Sequence locations=1-41,64-109,131-222,245 -1104,1128-1206,1228-1409,1451-1488,1518-1711,1733-1872
  Gene Ontology: Mol. function=endopeptidase activity; Cellular component=proteasome regulatory particle (sensu Eukarya); Biological process=embryonic cleavage
atttcattattgcactaaaattaatgctttttcattatggcatgacaaatttataagaaaaacattatcacagtatttctttctttccttgagcgctggcattcaatcgaaaactttttcacatattattaattagaaaattttatactctttccttgattatttttagaatccgaaaattttgaaaaaatcagcatatttgggaatactgatttatattcataccaaataaatgaaaacctgcaaatacacaatacgctcctctataattcagaatgacattctgatcaacgaagtcatcaaacgctttaccccgaaccccgtgctggtcataatccaagcttctcaaggccgacaggatttggcactgccgacggatgcttatgtggaagtccaggaagtgcacaatgtgtgttttgattgaatggtaacaacaagctgacaagtcaattttaggatggttctcccccggtgaaaacctttgaacacgttcccagtgaaatcggagcagaagaagcggaagaggtcggagtggagcacttgctcaggcatgttcatattgcatatttgtgctttggtagtaattttaatgaccaaacgcaattttcagagacatcaaaaatcaaacagccggcaccctctcgcaacgaattgctaaatcagttgacggaattcgtggtctcgagaaccatttggctggttttacgagctatttgcatcgtgttgcgagtcgagaattgcccatcaaccacgctatcatatttctaatacaagtcgctgggaaattttgaaattgttcttttaaagccctacgttgtttttatattcctctgcttctcaaacacccatttcgttcttatgaatccctttcgcaggaaatgctcaatttgttgccggaggtcctctcaccggactttgtcgacgcgcacaatgtgcagacgaacgaccatttgatgtgcgtttacatcggttcgatggtgcggacgataatcgcattgcacaatctgatcgacaataaggtgaaggaagggggatgaagccgtggaagagaaacagaaaagcatatacatttactatagtcaacccccccccccccccaaaaacggaaaaattttccaaaaaatttcgctacgcccgaagggaggggtacccacccgcaaccccaaatcctgggaccgtccctggttcctcgagacgtatcgatttgtatataattgtagaacttaacctggacctggatccaggcctggtttttttttctggattcggcaaactggatttttgtccaggtcaaatacgaaaatccaggtcctggcaaaacacgaaggaaactggaattactggacagcattttagaatttattctttcaagtgaccgatgtttttttcaagttttcaaaaaatgattaattgatttaaaaaccgattattattgaaaatagatatttttagatgtttccaagtaattaattgattttttcaaaaaatttgttggctttttaaaagaaatttcaaaaaatccaggcctaggtccaggtctcgaggagcctggattttcctggatgtttgtccagaaaatctaggcccagctccaacatagagtccaggtcctggcttttttcaaaatcgagttcatataatttgtgccattttttctggggggctgactatagttcagccataaacgagaaagtttgtttaatggacagattaagagatatttttgctctcacaattaaacagttaacgctgcaaaaagtggcagaaaaaagtgcgaaggaaaagacggtcaaagagacggaaaagaatgaagcaaatgacaaagagattgtcaaaaacaccaaataattgtatgaccattttgctggaaaa

SEQ ID NO: 55797 - DNA, 510 bp, Heterodera glycines
  Genomic contig location: Contig_ID=SeqID_25064; Location=154..663; Strand=+
  SCN-specific regions: Sequence locations=1-135,169-173,195-255,292 -310,333-510
atggttgatgaattaacatctagtacaaagattgacagaaacaaaaactcttatggaattgaggatttaatcgtaattcaaaattattttgatactaaattcccgaatagattcttaattgtggctttttctaggtaaaataaataatttattttaatgaattttttaggaacatgggttaaaaccaatttttaaaggacaaggccatagagaacatttgatatgcgtctttaacgaaaacggacattgggatggtaaaaaaaattatttttaaaagaatcaaaaattttaggtttaaaaagcatcaaacaattttttaatgttaaatataagtattgtgtttattgtgaacaaactttccaaagcacaactaaacattcaattaaatgtatcataaaatgcagccgatgtggatcgtggggtaaaatattcaaattaaattcatctattttgaaaatttaggaaatgattttccgtgtaaaaatagtctaattaaaccagaagaatgta

SEQ ID NO: 55798 - DNA, 654 bp, Heterodera glycines
  Genomic contig location: Contig_ID=SeqID_25065; Location=542..1195; Strand=-
  SCN-specific regions: Sequence locations=1-92,114-654
aactttattttatatttgtatcaactgatgcattttctacaaaaattcgggattacgactgggatcccacaaaagaccgggattgcaactgggatcccgaaaaatccagggattacgacggggatccttaaatccccgaaattacgactgggatcccacaaaagaccgggattgcaactgggatcccgcaaaatccagggattacgacggggatccttaaatccccgaaattacgactgggatcccacaaaagaccgggattgcaactgggatcccgcaaaatccagggattacgacggggatccttaaatccccgaaattacgactgggatcccgcgaaaaccactcgtgggatttcccgtcccgctccaggctttatgtgagactataatgaaaatgaaataatttagttactgatgagcaagcaaaaggattggtacaaccgggaggaggacatgatgactttgcgtgtcgatatgctcattggcgaaccatatgatgacattacatttaaattttaaaaaaactaaatacaatttgttgggttcgaggcgtgcccagacatttgcgcctcggacatttgcgcctatgtctaaaatggggttcaagtctgacttttttcaacccctaatagcctaattagcattaaataaa

SEQ ID NO: 55799 - DNA, 1477 bp, Heterodera glycines
  misc_feature (1224)..(1225): n is a, c, g, or t
  Genomic contig location: Contig_ID=SeqID_25066; Location=174..1650; Strand=+
  SCN-specific regions: Sequence locations=1-1,39-477,520-541,563 -1286,1326-1339,1385-1397,1432-1477
cttatatttttaaaaataatgatatttgatttttatttcttcgtccggaaaatgagaattcggaccaacaaaatataaaatgtgtgggtaagtgcatgtttttgtaagatagtaaagggaaaactggtgcttaggttcaagtccgcagcacgacacaaatatttttatttgcttatttttgaagcaattgaacaattcttgatgtcattcgaagacgcttaatgaggagaaactttttcaaaacaaaagttaggaacttgaagcaccaaaaaaaaattatgagtcttttagaaagggtttctaccagggatggcacggaattccgatttccgacttccgatttccgacatttttgtggtcggaattccgatttccgacttccgatttccgacatttttgtggtcggaattccgatttccgacttccgaaaaaattttggacgtcggaattccgatttccgaaatttttgataaaaagtcggaaattttcggaaatttctttttttttaaatttatttttcaaattacataaaacgttttgccaattcaaaagatttatttttcggtgtcaaattattaatttttatatgcattttctattttttttgttttcaaatgaaataaactagagtgaagcgagaccgcccacaatacatgttagtctcctcaagaaattgctggtgccttcgccggtgttgcttgtgatgcagcgtacgactactagctaattggaccgtaacctgccatcgaaagctgaaattatatctctcttagctgtacgttcccgtatggcataagatcatgccctacgcaggaattttctcggtgcagaccgttgccttgctatgtatatgcgtccaagagatactatcaccatggtaggtggttactgttccgatattcgtgagagctgataaaacatgtggttgctatgtccacgctcactagatattcggtgaggtacgctgaatgagaaaccgtgtccagtgtctgagcattgctcctttagagctcatgaccatatttctagaacttgcttggaagatttctacggtgttaactccacctcgtatcattgtacaggatgctggctactaggtgacatgtcatgtatctcgttgaaagctgtccagttactggctccgacgagtgaaaagagtactactccacgtacaccaatgagcgaaaacctggccagctatccgccgcttacatgacatgccannccgtcactcaaatactctgacgatagaacaggctgacgataagcaatccaatctcatgcacaattctattgtataaatctcgctctaaaggccgaaaaaagcacgctcgacacagactcattgtcaccacccgtcacctaaaatctactcagcgtcggggaagggagccatggggttctagcaactaacttacctgttgaaattcggacaccccaacaacttgttatatctattccaaaggaatgcaaattg

SEQ ID NO: 55800 - DNA, 211 bp, Heterodera glycines
  Genomic contig location: Contig_ID=SeqID_25071; Location=518..728; Strand=-
  SCN-specific regions: Sequence locations=1-211
atgttaacaatctttgcaaggcaaggaccaacaattttaacagaaaagtcagttttcaaggacaatcccttgccatttatagacagttaagaaattcccgttcgagaataccatccgctttttcttcctcgttcccagttctcgtgaattttctcaaaaaatgggaagaagtgcactagtaaaaatggatgtctgagatttgatcattaaa

SEQ ID NO: 55801 - DNA, 1015 bp, Heterodera glycines
  Genomic contig location: Contig_ID=SeqID_25072; Location=26..1040; Strand=-
  SCN-specific regions: Sequence locations=1-6,34-174,205-348,370 -899,921-1015
atggccataaaattggcctccttttgcccaatttttctttttctgcttctgctccccattttgtccactttttcactttctccaaagcttaattcttccgttgccgatgccgttgtttcctgtggcgtccctccgctgaacaaaaatttcactcgatttgattatttggtatagaaaaaaaatgttaattaaatttaatttaatccttttcattgcttgcttaattagtagggttgtaaattatatggattaacatattttttctgcgcatatgctatgaagaaaggggcttaaaaatagcatttctgcgttaaaattttttgatttggtgaaggttttagtccatataaatccatattttgggggttttcgggaataaatccatatttcgccatttttgggtttttagtccatattttggccattttttggaaattttcacaagaaaaatgaaaaaaaaaacgaaaaatacacccctaaagatcaactttttggaaatttttaaaaattacaccccacaaaacacgaaaaatttgagttttcgtcgtcattttggcattttcaataaatattttcgtcatttttttgcgaacatttcttttttttaatgagaattttttcgaaatttggcaaacttggaggtgtttttgatacaacgaacaacaataaaaaatatgcatttttaagttttaaaccccattttttggttgtttattgtactttttaggtttatttaagcaaatattaaatatgcacaccttttttgggatttttgggggtttacaacatatattttggcattttttatccatattttggtccatatttggccatttttgtcctttttagtccatatttcgggcttttttagtccatatttaatgtccatatttcgcgttttttagtccatataatttacaaccctattaattagtaaaaaaaaaggaaagcaaatttcggtgccatccatcgcccgatttggttaacatttgccattaaattgccaaaaaataaa

SEQ ID NO: 55802 - DNA, 106 bp, Heterodera glycines
  Genomic contig location: Contig_ID=SeqID_25072; Location=1725..1830; Strand=+
  SCN-specific regions: Sequence locations=1-106
atggacaagcaaatgagtttaataattgtaagaatactgaatcgcaatatttgaggccgaattattcaattttttcaggatggagagaaaaaggacacttttgggg

SEQ ID NO: 55803 - DNA, 896 bp, Heterodera glycines
  Genomic contig location: Contig_ID=SeqID_4812; Location=1..896; Strand=+
  SCN-specific regions: Sequence locations=1-46,70-102,237-280,339 -350,451-544,587-896
  Gene Ontology: Mol. function=structural constituent of cytoskeleton; Cellular component=membrane; Biological process=mechanosensory behavior
ggtcgtactccgttacatgaagtggccaaattgggggacgaaaaaatgctgaaaattatgtggaaaatgaacgccgatgcgaacattcgggacaaagtcggcaaaaaatagaaaataataaaaatgttaaaatatacaatatatttcgaataaattgtaaaaattatattttttatttaattcttcatctaaatttaattaattataaaattttaaataatttaaaaatattaaatgcaaaactaactagaaaaataataattaaatagaaaacagtcacattaaaaatagaataataaatttgatttgtaaatatattttctttttgtttaatttaagaaactgaactgtatttattttcttaaataatgtaattaaaaatgtttaaatattcgaataatcgaaaaaattttaaatttaaaagttaattgaattttaacttaaaaaattgaaacgttaattaaggaagataaaacgcctttgcatgtggcagcggaaagaggtcacacccaagtggtggagactttgatcgacaaatttgggcaaaatttatttaaattttatattaaataaatttaaattattacattttgcattttttattaaagttcctcaattcgcgcccggacaaaggacggcagcactttgttgcaccttgtttcagcggaaggtgcttcacatttttcaattttttgttaatttattttcaaaatgtattcttcaggtcatgctgacacggcactcgcttttctgagtaagtgcaaaatgccataaatttcaaaaaaaatgaaaattccaatattcaagagcgtggcgttccgttgtatatgccgaacaaaagtggcgcggtcagcctgcacaaggcggctgctgccggatacaacgaagtggtcaag

SEQ ID NO: 55804 - DNA, 3958 bp, Heterodera glycines
  Genomic contig location: Contig_ID=SeqID_4813; Location=254..4211; Strand=+
  SCN-specific regions: Sequence locations=1-171,248-304,361-387,409 -459,487-503,576-615,640-655,719-904,952-985,1170-1234,1354-1419,1488- 1657,1679-1691,1734-1869,1934-2037,2059-2200,2231-2252,2275-2336,2377- 2380,...
  SCN-specific regions: Sequence locations=...2406-2491,2521-2650,2693 -2793,2817-2864,3173-3222,3244-3248,3270-3469,3495-3588,3615 -3709,3761-3958
  Gene Ontology: Mol. function=structural constituent of cytoskeleton; Cellular component=actin cytoskeleton; Biological process =mechanosensory behavior
atactaattaaccgtggcaccaaagtggacatcccaacccgggacaattacacggcactgaccgtcgccgtccgatcgggccaagcttcggttgtcgagacactgctcggctttggcgccgatgtgcacataacaaatggccaaattggcgaggtcttcaggccaaaaattaataaattaaaatcgaataaataaattaaaaacaaaaaaaataaattataataaattttaaataataaatttaaattttatatgagggaaacactcaaaaattaaattcattcaaaaatttaatgggcatttgaaaaattcaattttaaaaattattatattttttaaattcttaattttaattttattctactctactttaattccaatttaatggacgaaataaagaaagaaaatatgaatttttgtttaaatgttgatcttttcactcttatgaattttctttccaaaattttattaattttattaaaatttgcgggtcaattgctaaggactccgtggcgcaatggtagcgcgtctgactccagatcagaaggttgcgtgttcaagtcacgtcggggtcaattaattttttccattttttaaattgccatttttaattgctaaataattttaatttaattttatgtggttttagtattgcttaattaattttgacaaaattaaatagaattaaaatataaattccaaaaaatattttaaaaaacacttttgcacacagactgcactgcatgtcgctgcaggtttgccctgcggggacattgaatgcgctcagatgctgttggtccgtgtaaattccaaaaatgatgttctgcttgcgtttttcagaaaagtggcgcgcagcccaacgtacagcgtgtgcaggacgggcgcacgccgttgcatattgcggtaaataaattatgtttttttttttaattttaaaattttgattttaaaggctgcggttggtcattgcgcaatgtgaggaaggaattttttaattttaatttaattatctccaaaatttttataaataaatttttaacgagaaaaaaattaattaggaaatttattgtgtaataattttaatcatttttaattctttaatatttttaaataattttcccattttattatttatttatattgtttaattactatcatttttttaaattcttaggtgccgtttgttattggctgagggggccgacgctcaactgaaatcgaaggtgaatttgacaattataatacaaatgattataaaaattcgaatatattttaattttattaacgagaaaaaagtcatattattattaatttaattaataaaataaaaatatatttaaacatttaattaatgcctttctctctactcattttttaatcaattaacttggtaattaaataaatttcatcaaaaacaactaataatcattaaaaaagttaattagttttttatatttggaattaaaattaattaatgaaaataaattgcggaataaaatgccgtaattaatttaaaccgttaattacgaaattattttctcgcaaagaatggcgaaacggcgctgcatttggcggccaaacattgtcatttcccagtggttcaactgctattggaccatttgagcagcagcaaagacgcggacagcagcagagtgcgcagctttgtcaatgccataacagaggtaaaaaggaaatttaaaatataaaatttaaattatttaaatttaaaataaggatggccaaacctgtcttcactatgccagccaaattgggccagagcaagtccatttcaaggacgaggatgccaaaattgtgtcactgctcatcgacaacgggggagactccgagctgcaggcactcagtgtaagcaattttaattttttagaaatttttttgacaaatttaaattttgaattttacaattttaatttttggaaattttcttgactctgtttaaatttcagaatcttgaaactgcgatgcacatgtgcgcacggacgggcaacgaaagcatccttttggcaatggtaggagaggattgaaaatgagggaaaatggggggacgaaaaacaaaaaaaaagtgcatttattgaaattttgaggaaaagcctcgacctggattcaatgttgggcctggatttctttgacaaaagtcaggaaaacccaggtccaggaaaaattcaggcatgccatggcatggacttgaatttttgttttaaaaagataacatatatttattcttttctggaccaaaatccaggggccagaagaaggccgagttctattttataccataaatttaaaaaagaaaaattacaattattatacgaaattttatatgaaaattgaataactttttaaggaaatgaccacttccgcatattattattattattattattatttggtttaataatgcgtctttgattattaggtcaacaaaattgggcctggcgctgttcagattgtacagaataagaagtcgaaggtgtttttaatttttaaattatttttatttttgcttggcgttctgttcagaatggctggtccccgctgttggaggcgtgcgcgcgtggccatgtgggcgtttcacgcattttgcttcaacaccacgcacgcattgacgtgttcgacgatgcgggaaggacggtaaaaaatttattgaaatttttaaaattttcaattatttaaaggcccttcacttagcgtcagcaaacggacacatcgaattaaccaaacttttgctaaaatacaaagcatttgtgaacaggtctggccatatgtgaagcacactaaatttaattttaacaattacatttcaaaataaccattgttattgcaaattattaagtttttaactttacaaatatattttttataattaaatattaagtttttaagtataattaattaatttaaataatttatttaaaaataaaattaatttatcgctttttcatttgcttaattagaaactttttttttcaaatagtaaataatttctctttgataattttagtaaataaaaattaaattgaatcaataaaataatcaattattatataacaaatctttaatatgatcaaatttgaataagtaaaaccgaaaaaaaaatcaaaataagtaattttttataaataatttttagtattttttaaattaaaataattaagcaaagccaagccaagaaaaccaccctccccccccaattaataaaaagcatccattttaaaattcttaattttttaagcaaagccaagaatggtgaagcgccgctccatttggcagcccaatacgggcaccctcgggtagtcagtatgctcgtccaagagcacggggccagtctcgaagtgaataaatttcaaattaaattgaaaaataatttcgaaatgccaaccaaggccatcactttggacaaccaaacggcactgcacttttcggccaaatatggccaattggtggtgtcgcagacgctgctggcgctgggcgcaaatccaaacgcgcgggacgacaaaggccaaacgccgcttcatttggcggcagaggtgtgatgacgagagaaataattttgtaaatgatgagtagggatttgacaaatattttttaaaaaccccgatatattgagaaaataaagaaaaatgaaaaaatttgggtgtaaaaataattaattgctctatactaccaaaacatttcttcattaattacattgaatataattaaatttttcaaaataattaaaattacaaaaatcaaaaattttggcaagtaaaaaacaaatattcaaaaaaatatttgtcccgtccataatgatgagtgtttaaccaatcagcgttgactccgccccttgcgcaattaatgctgaccaatcagcattgacccccccacgctcctttcttttgtctatacgagggtagcgcaatgcctctgcagagacgctgcagtgaaggcactctctcgc

SEQ ID NO: 55805 - DNA, 961 bp, Heterodera glycines; identical to SEQ ID NO: 4814
  Genomic contig location: Contig_ID=SeqID_4814; Location=1..961; Strand=+
  SCN-specific regions: Sequence locations=1-82,135-330,352-659,682 -798,840-902,939-961
  Gene Ontology: Biological process=mechanosensory behavior

SEQ ID NO: 55806 - DNA, 674 bp, Heterodera glycines
  Genomic contig location: Contig_ID=SeqID_25074; Location=143..816; Strand=+
  SCN-specific regions: Sequence locations=1-294,317-452,474-526,562-674
aaggagctggccgatcggcacgttctgatcagttcgcagaatgagaaaatttctcagctggataatgccattgccaagcagcaacaactgcggcatctgtttttgtacgagaacggtggtcaaaatgagagagttgttggagaagcagagaagacgagagagtgcatggctggcgaagacagtggaggagcagagaagcagacgcaacaacaacagcacaatgaattggatcggacacggcacgagatggacagactgttggagagagtgcgcgagttggagagggaaaagcgacagagacaacaacggcaacaacacgtgggcggaatgacaacagcagaaaccgtagacactggagatgttggaaaaatgccgtcggaggacaccgcatcaaatggcattgacgagcaaacggatgctttaaagcatcggtatgacgagaggcgtcacctgggaaaattctttgaaattttggccaattccaaaggaggcaactgctctcgacccattaaattgaaatctgtccaaataaaattaaaatattttaaatgttttaattatgcttaagcattcacgagttggaggaagcacttcgggagtccgtcggcatcacatcggagcgggaaaaggcgttggcggagcagaaaaaagtcaaccaaaaattgtctgatcag

SEQ ID NO: 55807 - DNA, 542 bp, Heterodera glycines
  Genomic contig location: Contig_ID=SeqID_25077; Location=5..546; Strand=+
  SCN-specific regions: Sequence locations=1-542
atgctttcttctgactctaaaagttcaccatcaacccggttatttaacgaaacatttcgattttgtgtgttagcggtgttattcggcctgcttaaattccctacaactccgttttgctgttgctgtaatgccgccgcatctcgagctcgttgtctggtgaatggtggagagcggttaatcatctttttaaaacaacacgagttttattggagaatcttgaagagcacaacacgagtgctttattggagaatcttgaagagcacaacacgagtgctttattggagaatcttgaagagcacaacacgagtgctttattggagaatcttgaagagcacaacacgagtgctttataattcggtgggatgcatgaagagtccaacacgaggacagaaaaatgataatgtcgatatatgataatgtcgataaaatccaaaatccaacacgaggattatcgcaacttatatggccgatgtaaaagttttccgtttagtcgtcactaagcaagccaaccttttgttgcaggagcgccaagttgaaaaaga

SEQ ID NO: 55808 - DNA, 74 bp, Heterodera glycines
  Genomic contig location: Contig_ID=SeqID_25082; Location=677..750; Strand=-
  SCN-specific regions: Sequence locations=1-74
acaacttggcttaacgcgtccgatttaccaaaggacggcggagaatggacactttggcaacgacgaattcccat

SEQ ID NO: 55809 - DNA, 883 bp, Heterodera glycines
  Genomic contig location: Contig_ID=SeqID_539; Location=664..1546; Strand=+
  SCN-specific regions: Sequence locations=1-229,252-322,355-498,527 -686,730-786,808-883
atgggacgaagcaaattgcttcgaaaagcaattcatttgggagcacaatttttggcttcatttttaatgggaaaatgcaaaattattattatttggtcagcatttttagtaattaggaaactgatgattcattatgttgataaggtaattaggctgggaaattttaattagggctttgcgcgatggacgtgccattcttatctatctatgcctatgccatctcttcggcctctctgcccagccccttcaaaaatgtgacaaaattccccaggaaaacgaataaacatttttttggtcaacaaaaacaaacaaaattattggcattttttagaaaaaataattatttaattaataggcaattaggggagaatttatttagcaaaatgtgagaaaataaatgtgtgacaatgagtttgtttaaagcgtataattaagataaagaaagcgcatagataagaagactttgattaagaatatgatggaagaaatattttggagaaatataataaaaaaaattactataaatgtgtaaatccgtgcaacatcagacgaagttgtttagcattgacaattataaaattaatgatttgtggtgacaacgaattaaattagtgcttttttgttcatctcaaaattgcataatttttaattaaatcatttcgaattttgaacaattaatttggttgatttaataaataaattaacttatttaaattaatcataatttttgcgatatttttgcgataaaatcggcggccaacaaaatatttgaatttcatagaaacaaaattcattcaagtgattttttaggacgagaatggataaattggcacataaaatgccaaaataggcaaattaaaaaaatgttcaacaagatatctta

SEQ ID NO: 55810 - DNA, 1114 bp, Heterodera glycines
  Genomic contig location: Contig_ID=SeqID_539; Location=3233..4346; Strand=-
  SCN-specific regions: Sequence locations=1-89,114-280,323-370,404 -431,533-543,579-814,836-868,890-1114
atgaaattcatgaaaattatgcaaggtaattaattgaaactaattaaaggcatttattaattaacttgctttaattaatctaattaagtttttcattgtgttacaaaagtgaattattatttggcaacaaaagtttccatggaaattggcgaaaagatttaaatttgacaaaacattcactgaaaagacaaatgcagaagaatgtgccaggaaaattcaattttcactttccaacggaaaagaaataattgaaaatggcaatttattatcggcgtaagtgaaattatttaacaatctaaattatatataaaaactaatattagtttacaaaaaaatcaccaaaaaattcaataacttttgtaatttttcgaataataaaataaattaaatttcaaaattttatgaacgatttttcattgaaaaaacaacagaaaaaaataattaaagattaaaaaatgtttaaacaaaaatatttttaaaatatttttcttattttcaacaaaggaaaaatttttaaaaatttttaaaaaaaccgaaaaattacaaatggtttaaaatgatattcattcattttttatttctcgacatatttatgacaaaaattcttttattctttaggaattcatcagctgaagatatttttcgcgcattgccaattttggaattaaaatttacaaattcgaacaaaacattcataattaacacaggtattttatttattgccctcattaaatgccaaaaataatttcacattaaatttagtgtcgccaaaacaaatgaaattgcgctcagaatttttcgccgaatcaaagcttgcccatttttggaagaatttgccggcctttggcttttgccagcagacatttggccaaagtttggccaaatgccaacaaaatttgtgtttatggtggcgaatggatgccaattaattcgtgtcgatggcccacctcaaaaatgcgcaacttttgatcatttggcatttgaaaagccacgtgccattcgccaacaaatcattaagccactcgtaggaattaattgaattgtttgtttattttttaacgaaaaattatcctaaattatggtctcttttaaatctataaacattaaaaataaa

SEQ ID NO: 55811 - DNA, 2735 bp, Heterodera glycines
  Genomic contig location: Contig_ID=SeqID_540; Location=304..3038; Strand=+
  SCN-specific regions: Sequence locations=1-502,526-646,672-820,873 -980,1027-1191,1213-1424,1472-1543,1580-1699,1721-1758,1796-1968,2008- 2078,2108-2120,2205-2295,2321-2342,2392-2701,2723-2735
aaaattttacctccacggcactgctcacctggggctgtagtgatgaagcggataaaaatgtctgcgaagaattcttcatgaacgcgtccaacaccgcgctgcgctcgacgaagcagcgctgcgagtgccaatttggggaccagggaaaagacatggccaatgagcacgtgaaactgcccgaggcggagaagcccggcccaattccgaccattccgccatcggcactgaacaaaagtgggcgcaaatgccaaaaaatgttgcataaaaattacagggaattgtggcacaaaaataatgagaaaaataatgtcaacggaaaatggatggggggatggcacgtgaattgtgccatggaaaatgagggaaacagtgtcaagaattgcataaatgtcacgaatattctgccataaatgagcaaaatgtatttgagcaatgccaaaaaaaatttgttatgaaaattacagggaattatggcacaaatagtcagggaaagaatgccaacggaagatggatggggggacgtgggtgccatgaaaattgaggaaataaaatggcacgagtattatgccataaaagatttgaccaaaataagcttttctgacataaaagaatcacaaatttcataaagccaagcttgagaaatatgagaatattttaaaatttgttcatttgaaaggcatactctgcaaaattggcacttatcatgggaatggatacggtgggactgcggcgcgggaatgtcaaggcggcgagcactgttacgcggtcagctgcgtatccggtaaatatgtgataagtgataaaacactaattgttatccatttttaatcaatttatttttgaatattttttatattcttaataataattaacatttgtataatcgagcaatttttctatcgatcaatcaatcaatatatttagttggctattcaaaaattttactaattaacacggtaattgaggcaattattactgatattgaccgattgattgattgatcggttgatcatttattgattaattttatccattctctccgctttcacaggctctgacaaaatcagcttttttggctgtcacgataacacggaatgtgagccgctccgcaaattcattgcttatggccaggattgccagtgccgatttggccccaagggcgagaatatgtccaatgttaattatgacctgccaaactatgttccaaaaattggcataggttagaaggggaaatagaatttaatagaccagaattattgggggaaaatggccaaaatttcgccgcccaaatcttttttttttaaatttgcaaacagaaattttacaagaaaaaaatcaaatttttttctataagactacaagaaaaaatattgttagtttttagcgatttttgtaaaattttatgataagttactaatttcgtgaaaatttttcaaatttttttcttataaaatttctaaaaaaaaattttcttgaaaaaatttctaagtttgaaatttttaggcggcgagatttcgagaggcaattttttttgggtgcacccaaattattaattaattatgaaatttatcataaaaatctcaaaattggacaaacagtaaatttcatagtacagaatttaaaattagagagcaaaaaattaaatcaatggcaattctttgattaatcaaaaataaggtcagataatctgtgatctcgagattataacttcttttttgtgcaaaaaatgccctttctcgggacacggatattgaaaagaataaatcattaaaaaataaattaaaattttaaatttggacagacattgtcttcagtgaacttccgatcccgaccgggtacagtacccgtgcaaatgcctaccttttggttgccttctcttcaattccaattggtgcctaatgaacatttgattaattaataatggaaaatatcaaaaatgctattatttctcaataaacaatcgataacttttattttatttataaattaattattatttatttatttgttttaaggttttttgaccaaattccttctccgcgcaatggtgcgtgttcatgaatgaacggcagaagcttaggaaggaagaagaaaggagaagaaatgataaagcggccaagaatttataattaattttggattaaattaattttcattttttaatttgataatttaaatttttaattatttttatttaatttaatatttttaatatttgaatcacccattttcctaatgattattttagcctatcaaaacattgcacagaaaatgaaatctgtcctcccattgtcactcttcttcttcttctactgcctcgcctttccatgcatttgttacggtaatttagaaaatttaaaaataattaaaaataaattttcaaattaatttcgcagggatccattgcaagactggaatgtacgacacgtcgggaaatgctgctattgtcatctctgaatgcgcagcggatcaccacttctgttctgcaattggttgcgcaatcggtgggccactaattacctaattaaccaaaatttgattatttaattgtcacgctttaggcactgaacagatcactgttttgtggtcttgtgagaagcaaaatgataccaaagtgctcgtcaagagagtatctttcgagaaccacacttgcatggctcagattggccagaaggatgccaacatgtccaatgaagagttcggttttcccgaattggtccaattggtcttgaagg

SEQ ID NO: 55812 - DNA, 115 bp, Heterodera glycines
  Genomic contig location: Contig_ID=SeqID_541; Location=662..776; Strand=-
  SCN-specific regions: Sequence locations=1-115
gcggaacgggccaactccgtctgagccaactttgagtcaatataactcttgaagttattgaccgaatcaaacaatcttgatatcattcgaaagctcttcacaggctctattagcc

SEQ ID NO: 55813 - DNA, 829 bp, Heterodera glycines
  Genomic contig location: Contig_ID=SeqID_542; Location=160..988; Strand=+
  SCN-specific regions: Sequence locations=1-135,166-297,320-391,413-829
atgtctcgacaattgcccctaatcatgttcgtaattgccctccaaattgggtttgccgagggcggctttttctcagccgtcaccgacttcttcgacaatgtaagttcggcacttttttaaatgttttcattcggaaatattcattaattttgtaaaagaatttttgggttcaatttttggacaaatttaggtcgcttcatcatgcatctgacatatttttcctataattcgaaccctgccccaaggccgaaactcaatcaaattcaaatttcacttttacattaaagtgtggcacataaaataaacagggacacactgattcgtgatcagcagcgagactcgcttgattaatttttgtttattttttgcggaaaacacaaattttgcgtgaaatacaacaattaaaaaatgccgtaaatgtttgatgtttcctaaatttgagaccggcattttgaaaaaggcatgggcctggacctggattccgtgttcgatctgggcctgagcttccttgataaaaacccatgtccagaggccgatctctaatttaaatcattcaagcgatcgcttcttccgctttgcgttaaaaacggggacataacggcaccacccccctcactttcaggttggccagtcacttgaaaaggcctggaacgatatcaaagaacccatgctggatgccggggctctttatctggcaccactcagctccttactgccggtgacaagttttggtgcattagttgcacttgtgatcgagaaaggggtggataacccacacggaacgggcacagaattcgcatgcggcccgaacaccaacgccattttcaaa

SEQ ID NO: 55814 - DNA, 1060 bp, Heterodera glycines
  Genomic contig location: Contig_ID=SeqID_543; Location=113..1172; Strand=+
  SCN-specific regions: Sequence locations=1-984,1018-1060
  Gene Ontology: Cellular component=cytoplasm; Biological process =negative regulation of cell growth
atgacattccaatcgctgggactcaacccaccagcatttcaatctctgggactcaaatctccggcattccaaacactgggactcaacccaccaactttcaatgacattccaatcgctgggactcaacccaccagcatttcaatctctgggactcaattctcaggctttccaatcactgggactcaattcttatgctttccaatcactgggactcaaatctccggcactccaatctctgggactcaattctcaggctttccaatcactgggactcaattcttatgctttccaatcactgggactcaaatctccggcactccaatctctgggactcaattctcaggctttccaatcactgggactcaattctccggcattccaatcactgggactcaattcttatgctttccaatcactgggactcaattcttatgctttccaatcactgggactcaaatctccggcactctaatctctgggactcaattctcaggctttccaatcactgggactcaattcttcttatgcataccaatcactgggactcaattcttatgctttccaatcactgggactcaaatctccggcactccaatctctgggactcaattctcaggctttccaatcactgggactcaattcttatgctttccaatcactgggactcaattctcaggctttccaatcactgggactcaattcttatgctttccaatcactgggactcaaatctccggcactccaatctctgggactcaattctcaggctttccaatcactgggactcaaatctccggcactccaatctctgggactcaattctcaggctttccaatcactgggactcaaatctccggcactccaatctctgggatcaattctcaggctttccaatcactgggactcaaatctgcggcattctaaacattgggactcaacccaccaactttcaattcatatggtcagacatttcttcttaatatttaatgacaaaacaattttaaaacttacttggcaaacgttaatacaaaaataagtgtaaacaaatagtcatttatta

SEQ ID NO: 55815 - DNA, 2338 bp, Heterodera glycines
  misc_feature (2331)..(2332): n is a, c, g, or t
  Genomic contig location: Contig_ID=SeqID_543; Location=2909..5246; Strand=-
  SCN-specific regions: Sequence locations=1-178,200-517,540-541,563 -641,663-685,707-872,894-1067,1089-1125,1149-1342,1434-1475,1497 -1517,1541-1544,1587-1778,1803-1862,1885-1921,1943-2338
atgtatggattgaaggttagggtcgagatttgtgctggtggaagcgtccggtgtcgtgaatgactccgaaaatggccaaaatgccggggttgatggttgggtagtgatgctcaagactgaatttcctgagactcgagaccgagactgaggccgacaccaaaaaatccgaaaccccaagacttttttcaaaaattttcttatacgcataaaatttaaaacttcttttttgagtcttttcttaagcaattttttaattcgataaaacttttaattcaaaatacttaaggggtttttgagtcagttaaaaaatagatagaattttggagatctggcactgatgattagggctgtgatttttaggcaaatgcttaaaatttttgcgcacttaatacgaacagataagcacgaaaaaagcattttccgcttggtttgggatgtctacgatgccttttataatgcctaactttgcctatttttgtgcctatttcgccatttttggcgccttttcagcattttcgggaaaatccttaataaaaatgcaatcaaaatgaaaaatacacccctaagaatcgacatggaaaattttcagaaaatacaccactaagaattgaaaaagattttcattaatccccagaatttagttaaaatttttggtttaaaaattgttcttatccgaaaactttaaaacaaatgaaatataagcaaatgttttgcttaagtttttacgtgttttgctacctaaaaagcgttaaaaaaaatttttttgcctatttttgtgcctacttaatgcctattttgcgatttttatgcctttttaggtgcctattttgcgatttttgtgcctaaaaatcccagccctactgatgatagtgaaaattttgaaaatttcagcgttcttagtcaacagatttaatcaaaaaatgacaacattttgcgatttagaccaatttttaagaaaaattcagggagaggcgccgatgagtgaaaatgtgtgtaattttttggccttatttattaaaagatttacattacaccataaatcaacgcaaaaataatgaataaaaccaacatcacagcccaccggaccaggaatgttggaaaaaggaaaagaaacaaaaaataaccaaaaattattaattttaaatataccaaaagccaatcattagggggtgtaaaaaatgtctcgttctcggaagtctcgatgaccgagactgaacacccgagactgtgaccaaaatatccgagacctttctcgagtcgatactcgagaacgagactctcgaactttgaagcgtatggtgccgggaagaatcccaaaaaatggctaaagatgccgggcttgttttttaatattatttttttcccaattattttatttgtaaatgttaattgattgaatattaataataataataatataattattaatttttccaaattactacctgccccgcgtcgaatgcttttttcccgagttctctcaccaaaacacaaaatgaccgtgccgtggggccgcattggaaaaaacttgtgctttcctacagtttttttaatcattttttaatttttgaacaattaaaaaatatgaacatacaatgaggcacttgcagaagacttcgtcgcagttttgctgcgattcaccgcagataccgtagcagctaaatggaacagaaaaactaattaaaaaatcagaaaaatcaatttataaataataattacaactcattagttaattacaccaataattgccgtatacttcatgcgttgtatacatagacaattattattattataataattatgtcatcaattaattgacaaactcacgcatcgtgcgttacacagcattggtgcagaacatctaattaatttaaattaaaatttggttaaaaaattgatgaatacgacggacaaaaaacttaaaaatctttcgaatatttaagtgatttttttttgaatttatgctttattctacagacatcttcataggtcatggacaaatactaaatttagaaaaattgttgctttttgacttcaatgaatttgaaacgaactaatataataatgttttggtatatatttttgttgcatttttatggtcattttatcatataaatcaatttttgaaataataatcattaacaaaataacatgtgagtgcataggccattttaggtggtcatcatagaatttttttcgcaaaatttcccaattttcagtgtatccgtcactatgaaggagtgatatgtgagcaagtttctgcaaaaggcttttttcggttagcatcaaaagttagcttagcaggaatttttcataatttttggtcataannaataaa

SEQ ID NO: 55816 - DNA, 1252 bp, Heterodera glycines
  Genomic contig location: Contig_ID=SeqID_544; Location=42..1293; Strand=+
  SCN-specific regions: Sequence locations=1-154,176-257,279-664,717 -1036,1073-1126,1168-1252
atgtcccccaacaaattcgcgcttcttcttttgttgatttgcttcaacatttctgcggccaatggatttaaaagcccattctccgagctcaaaaaattctttgagactgtgagaaagaaaatttgtgagagcttagccaagaaaatgaattagcaaatgtcaaatccaagaaaatcgggcatttaattagaaaaattcacagaattatccaaattttaattgggcacgaaaacaacgaaattagtatagaattttcgaaaatcttgctatagtcaattttttcaaatcattagtgccaaataatttgaccgaaaaagctcaatgatcagagcaaagaaaatttcgggttttcattaaacaaaaagggttctctaaggtcccattttcctcacacttttccccctaatttatgcttggctaagctttcactgatcagaaaggatttcctgatcaaagtctcattctctgtaggcggtctctttggtggccgagaaggccaaagaagcggttgaatttgtgaaatgcactatttgggtaagaaatccacgaccataacaaatcagagatatcgtattaactcattaaaattacacagcattttaacaaaatctcgagaatttctcgagtcaagaatcggtcgagtcgatgataaatattttgaaaaatttttttttttaatttttcattttcatttacaattttattttattttatttaaggaggaagcgtgccagaaattgtgcgaaggttcgtgccttgacccgcaaaaggcgtaagttttgagttgtaatgccaacataaattcaaattttaatgactgaaaagatcataaatggaactttaattatttattcaaatgaattcatttagctgttactcgaaatgcggcaacacgaagcaacaatgtgatgatgagtgcaccaaatgcgcagtaatttttgaaatttaatacattagaacaattttatcaaatcccgggtccactcatcagactataattgtgctaaagaaatttccaaaaaataacatcgtattgtaaaaattactatttttaaaatattgttattttattgcttgaaaaatcaaaaatgttaataataatatgctaattaaggtaattaaggacttttattatttaaatatctattaaaatgaaaatattttatagaatggtccgctatccaaatgtaagggcaaatccgccgatttgtgcttcccgagtgggcatgagaaggcattcaaagatgcacag

SEQ ID NO: 55817 - DNA, 1177 bp, Heterodera glycines
  Genomic contig location: Contig_ID=SeqID_545; Location=1475..2651; Strand=+
  SCN-specific regions: Sequence locations=1-124,150-365,390-425,462 -462,488-628,667-795,818-876,898-1058,1080-1177
atgggctggcgcgtgtgtgggccagtagttgtcttttcaatgcatgcaaatcaaatgcacgccgaatacgaggtgcaattctctaagaagttttccattgtgatgattttttcctgctgttttgtaattctttaaaactttattttttcaatgtagaaaagatgcgagcagcagaagaagaccttcaaacaaattccagccgatgaattattggttggtttcaattagattcaattagagttgtacggcacatgggtctcggtctggattgtgcccggaaccccggctttttcgggtcgatattctgggcccgctctttccaaaaaattcttaaaaagattaatcattttgtgcaaattttcttagcatttcaataaaatattttttaagcctgccaagaaaccacataaattggcaattttggtgcaaaattgaacatattttttaatgttaaaatgatgcttaaaaattaatattttttattaatcacggaaatacccgatcccggcttttctggtttcggtttcgatcccagtcccgggttttccccggaattccgatccaatgttagggatggtcttggatagcagagtttaatttttcaaaaattttcattaactgtatcgaaatttttaaatattttctttttaaaagcaattgtaatattgcaataatgaaaaaccttttctttcattcaaaccatttacttttcacctttaggagaagcccgaaaatggtcagatggagaagaacgcgggaatgaactcctctgatggtgaaattagatttttaaataatcaatcctttaaaattttatattagtcactttaaaaattagaaattagctttgcatataaaattacgaaacatggccgtaaaaaatagccaaaatccatggatatccaaaaacttggacttaaattttgtataatgccaaaatatggtaataaatcttgaaaaatttaagtctataagcttctaaccaagctaagaactttttatcataccttcgacagtttaaaaaaaagtgggaggattacaaataattttcggttttatattaattagccatttaaaataaataataaacatttatgtgtaaattatatttcagtgccgccaaataccaccactaattcttgatgccattccgttcccctcaagcggaggagaatga

SEQ ID NO: 55818 - DNA, 2712 bp, Heterodera glycines
  Genomic contig location: Contig_ID=SeqID_4815; Location=66..2777; Strand=-
  SCN-specific regions: Sequence locations=1-93,133-154,178-288,310 -518,540-818,847-1066,1089-1153,1175-1251,1276-1309,1331-1603,1631 -1632,1654-1846,1868-2075,2111-2581,2603-2712
atgttgccgcagaatgtgtcgccgtcggcgccgttcggcaacgcgacggggacgacagctgctgcggtgccatcggcagaggcattggacagaaacaacaacaacagcagcagcacaaacatcaacaacaacggcaccatcagtgcaatgagccaacagcagcaaaagcagcaacaggcgcccgccgttggtacggtgccaacgtcggcgagacggacaacaattgcagcaacgacatcaacaacaattgtaaataggaagggtggggaattcaaatgattaggcattttataaaagatacaaataatttatccgattaaaacattttaaggatcaccagcagcaccggcaaagtgagtgagtgagagaatgtcatgtgttgttgttatggtgttggtgttcgttcgtcttttgatcgttgcttagcttttgtcctatttcgcttttaccataacaattctattagcggtttttaggtacagaaaaatcggaaaaaactaagaattttttagtccatccatttttcttttcccacaaaaatctctaagtcgtcaaccccacaatgcttaattaaccgctaattaaccgcagcacaatcaaatagcaattttttttgtctttgtcctctgctgacattttcatcgctttgcacacacttagaaagcactcacaacaaagattttgctgaccattcgaccgaatttgcacaccgcactctgcaggcgaacattgtgctgcgcgagttggactatggccgtagccaactgttatggaagtgcagcattgacgaaatccaaggcatggagacagaaattgggcaacagaaacaacaacaacgacgacaggcggaggacaagcagaaacagcagcaattggtgatgaacaacagttgcgcaacggaacacgacgacgacgaacatggcgatggaaaacaacaacagcaacgacttggacatggtgtaatggacgagcaacaacagctttatttgcatcacaaactcgagcagttggagcacgacgtgcccacatgccgtgccaccattctgactgtgcctccgtcgacaatggcggcggcggccgctgaagcggtaccccaggcgatgacactgatgaccgcaacgcatgtcatcgtgcgatccgctcgcttcaccaccaaatggcgacgcaacacattgttggcacgggaaaggatggcacgcgagacgtcctcctcgtcactgatgtcgtccattgacggaagacagttgatgcaagagaagcaggaggaggtgaacagtactgacgacacgccgaaaggaaaagcggcgaaagatgaagctgaagcggcggcacaagttaaggacgcactgcaccgaatgaaggaagggtcgaccgagtcgcggacggcgagcagggaaagcgaccattgcgacaacgctaacggtaggtgcagtcgcaaatgctcctccgtgttgggttctgcccgtgccgtgcccaggcgccgtcgtccctcctcccttgacgcatccattgactcatcaacaacatgcggcgccgcttcagagacggcacataattccgaagccgttccattgttcggcggaactgcagcacctttttctgagaggccttcagcttcttctgcagctggtgctgacctggttgaactggtctgctcaacggattgcggcggggcatcggcagttaatcgtcatgacagcatcatccgcttcattgacgcgcacagtccaccgatcagcccgttgtcgcctactgctgtcgccggtggtgacgaacgaacagcgcgacgccgctcatcaatttttcgggatatgataatgctcggcacgggcggagggagtgaccggagaaagtctgtggccaagtgtgagcagcagcaacaacagggccctttggcggcacaaccattggaagctgtgccaaaaaagacgacaccactgctcgccgatcaaccgaccacttctgcttcctcctctgtcacttcaatgtcttcatattttaagtcatttttccgacggacaagcaaaacgccgctacaggaacaaacgcaggcacagaatgccgcgcaggaaaataatgccaaaacaaacaacaacggcacaacgacggagcggcgatcatcgtcgtcatgccgcatgtcaattgtaccgtcaaacactgaacagtcgaatgttgtacaattagaacaacatgatcaggacaaattggaacagatcccaaccaatacatcctcaaaagcttccgcatcgatcggacgaaggggttggttggttttggcactgtttgcttacttttattgctttttatgtccgttgtccttagcacaaattaacaaaaaacaaaattaaagaagctttgcttgttttggatttttgtgtttgctaactatatcattctctaacttatattggaattccacagtttttaatgcatttttacagaatccgcaatgacgagaaataatgaccatcagcaggaagagagaaggcgagtgaaagccaagctaaatataaattcatcattttcataatcatcccaacattctctcatgatttaaaaaaaccatttttggtttatagaattggctccctcattttcccctccgatgagtgccatgccaatggccaaccgtcggtggaccgtgcgcgaacaaagagttgcgtttcggcggacgaaacagcgtcaaccaccagcaaatcggaggcggccaca

SEQ ID NO: 55819 - DNA, 313 bp, Heterodera glycines
  Genomic contig location: Contig_ID=SeqID_4815; Location=2638..2950; Strand=+
  SCN-specific regions: Sequence locations=1-8,48-313
atggtgccgttgttgttgatgtttgtgctgctgctgttgttgttgtttctgtccaatgcctctgccgatggcaccgcagcagctgtcgtccccgtcgcgttgccgaacggcgccgacggcgacacattctgcggcaacattcgcccagtgggcgtgacaaaggcaatttcaacctgcgcaatgcggaaacccagtttaaaagaaaatataggtccatttggtctaactaatagtcaccaattaatttatgcattataaatgtcctgatcacttttcgtttacacaccgactcaaaaaaacgagagatgaacca

SEQ ID NO: 55820 - DNA, 1418 bp, Heterodera glycines
  Genomic contig location: Contig_ID=SeqID_25084; Location=1..1418; Strand=-
  SCN-specific regions: Sequence locations=1-82,104-571,593-883,905 -1356,1385-1418
  Gene Ontology: Mol. function=ATP binding; Cellular component=nucleus; Biological process=signal transduction
acgccaaaggcagccactgcagcggtacttaagctccaaaacgcgatgtatgaggagaagaagctgatgtaagtgtaaggcattttattggggagggaaatggcagaacaaataaagtaaaaaaagaaggaataaacaaaggttgatcactcattctgatcattcattccgatcacttcaaaaattgtccaattgaacttcagagttttgtgtctgccaaacgttcagcagcacatgatccctgccgacgtggagcctttgctggtgctggtcaacgtcaaaagtggcgggtgccaaggcaccgaacttttgtcagcctttcgtcgcttgctcaaccctttccaagtgttcgacgttctcaaaggcggtcctctggtcggactttacgtgttccgcaacatctccaagtatcgcattttggctgctgggggcgacggcaccgttgggtgggtgctgcaatgtcttgacatagcaaaacaggtacagcttggccaattgaccaactcctttgctgtttcaacctttgtcatgcttcaggatgccgcttgtttctcacctccgtgcgccgttttgccgctcggcaccggcaacgatttggcacgggtgcttaggtggggaggcggctacacgggggaagagagtgcggcggacatcctaaaggaagtgatcgaggcggaagaggtccgcctggaccggtgggccatcgtttttcacgaagaggaacggtcacagccttcggccgcggggatggacgagggacagaacgaagcgcaagtgatgagcaacccggaggaccagaccagcatgataatcatgtgagtgctggtccagccaagagggtcaatagcagttcgtacaataaaaatttttacaaaataaagcctaagcccaagcaagcctaagcttaagccgaaggcttatgcttattctaagcctttataaaaactgcctattgtacgaaactccattgtacgaaatgtatacattgtacgaactgccatgacctcagcgaggatggccaacggcactttaggaacaattatttcggcattggcattgatgctgacgtttgtcttcgcttccacaacaaaagagacgccaacccggagaagttcagctcacgccttttcaacaaagtgacgaaatctttcgaagacggacgaatgacaattttgtgccttttccaatgtcagactcaatatgtgaagatcggacttcagaaggctttcgaacgaaactgtaaggatttatggaaacgaattgaattggaagtggacggaaggccggtggaattggcccaatgcgagggaatcattgtgctgaaccttttgagttgggggagtggggcgaacccttgggggacggccagggaagagggcggctttcagaagcccactcattacgacggacttttggag

SEQ ID NO: 55821 - DNA, 1064 bp, Heterodera glycines
  Genomic contig location: Contig_ID=SeqID_25086; Location=95..1158; Strand=+
  SCN-specific regions: Sequence locations=1-18,41-405,427-596,654 -783,805-1064
atgagaattgaggagcggtgtggggtaagattgtgtttacacaggatatgcatgtaggcgtataatattactacatatgtacaaataatgctcacgggtttagcactttcgcttcctaaaaacacattttttaagtgcaaattccgcatttgcataaaatgggacattttttgcgaaggaaattctttttttagacggaatcataattgatgaaaatgattacttatgtatatattcgacttactttagcaaaccacacaactttcatcaaccatttttgatttttgcagaggagtcagattttttatttttggaaatttgtcgagtaatatctatcaatcatcaccatcacctattcttgcctttttatttgcccaaatattgcataattagtggagcaattgtaaaattattttattaccaaactccaacaacactcagcaaaagtcattcaaatccgatgggacaacgtccgtcaatgcagcagagcgaagtcgcggtaagcaccggaaacgagacaaatgctaaattttttgtaatccgggatttagcgagtctataacggcaaaattaattaggtatctgtcaaaaataggattaaaaaatattttatgatttaaaatttttttttggcaatttcctttttctattggtacctcaaagtttaaatttgcttagaacataaaatggaggaaaccgtttttggcggttgttgtaaaattgccattcttttattttatagcggcgtcctcgtgccggttctgaacttggcagcagcgcacaaaccacgggcagcagcagtgcaacggcacacattcacaaccatcggagagcgaatggaacgcgcagcagacagccgcagaatgacacggtttaatttcacatttcttggtacatttgtgtacaaaattatagcgtttggctagaaaatttcaaatcgggttaagtacatatttgggcgctatttacaaagctttacattttgaaattttttttacttttttggtcaattttttttttttgtttattttgatgtagaacttaatattcattattatatgtaa

SEQ ID NO: 55822 - DNA, 215 bp, Heterodera glycines
  Genomic contig location: Contig_ID=SeqID_25087; Location=256..470; Strand=-
  SCN-specific regions: Sequence locations=1-107,131-215
atgcacatccgtaacttcaatgttcaatccctggccaattgctttgattgcttggctttcctgctcaaattgacttttcaaattgtgccattctgtgccggtgcccgcatggccagcagcagcagcggccaagtcgaacatggcacgggcgaagcccaaattgtacggacactcgtcctcataagtgatcttcattttcataaaggcttaataag

SEQ ID NO: 55823 - DNA, 842 bp, Heterodera glycines
  Genomic contig location: Contig_ID=SeqID_25087; Location=569..1410; Strand=+
  SCN-specific regions: Sequence locations=1-174,214-232,261-473,517 -548,570-728,752-763,785-842
atgtgccgagtccgagccatgtgattaccaaccctggccaacaaagttcggttggccatggaaaggaagacgaaccgttgtcatccgatttcgacctttgagggcatagaaaaaaggaattaattagaaggaaaattcatagtacagaaaacattttgttgattatttatgaagaatatttatttgttttgaataattataatattaaaaattgtctagcataaatattcacaatatttttaattttcaataaaaaatatgacgagaaaaatctatttaagcaattttacccgtttttaatttaaaaccttttaatatttaaaatccgattttttcataaaattcgctaataataatagaattctccttttttataattcatttaaaaggatcaaaaaaattctttacattttcctataaatataagtatttcttttaccacgtatcatttaattcttatcaagataaattcgttaattttttattaaaatattttagacaattttttaaaaaaatgtttgccaaatttatgttatttttattctgctatataattggcaaaaaattttcattatgcgaacaaattttgtcgccagcaatacaagattattcggaatgcggagtttcgaattttgacccattcaacgaacgaagcgcggaggacacggaaattagtcatgcaattaagcggggaatcaattatcattagatattgaaataatgaatgcatattttaatttaatatttaattgtttgttaattaggtcgtaataggacacccgttgatgatgaccgggcattgccatggatggccacattgcaaatcctcaatggtcttttta

SEQ ID NO: 55824 - DNA, 526 bp, Heterodera glycines
  Genomic contig location: Contig_ID=SeqID_25088; Location=346..871; Strand=-
  SCN-specific regions: Sequence locations=1-13,35-286,308-526
atgtccaggtgtggcctcatcagctgcagttcctcctctctgctggcctccgtttggtgtacggccaaaaggatggcggtgaagccacaatttgctttgatgccgaccagcgaaattggggcagcagaagtgccattggcggaggcgaaggtgcggcacagccgtgccaagatgggctgaagcggtcgcacgagattctgaagaaatggtggaagaattggcaacgcattgaaaggatggaaattgtgagtaataataagtgatacctaaaatttctgtagctggctcatttatttaattttgggaaattagcgttaatggatgagggaaaacgcatttataggaaaaagtatatatgttgttctatcagtgttaagtgttccgtaatgtaaaagcgtatttaaagccgagaatacggtattgaaaatgatcggtaattaaccaaagtaattaaattaaatgttgttgagttttttcagaagagtcaattataattcactcattacggtgtttatacagtaataaa

SEQ ID NO: 55825 - DNA, 605 bp, Heterodera glycines
  Genomic contig location: Contig_ID=SeqID_25089; Location=334..938; Strand=+
  SCN-specific regions: Sequence locations=1-95,117-188,228-341,363-605
atgcaaaatgaagcagtgttattaaatggctctgataaaggaggagcctcatttgaatttgatgacggatcagcgtcatcggacacaactgatgccattgatgatgaatttgttgtccccaattcgaccgatgaaagtgatgaaacttgtgacaccttttccgaatttaacgaagcgcacacttcgtcaagaaaacaaaagaaaggaaaagccaaaagaagggaaaaacggtcaaaggcgttaaggacgacggggaagaggcttattatatgcaacggattaggtaatgaataataccaaagaagcacttggccaatcccaatttcagagagcatcgttcactccaagaattggccaaattgaagggcgaaccttttgatgacccaaatgacttccaaacactgtgcaatgactgcccatttcaaattccatttggaacagactttacaggttataaaagaatgatcgattgtactagtttaaatttggagtcatttgtttgatttttttgttgtttaaaacaaacgatttttataggtaccaaaaaacaagcgttcgatggctctacgaattgcattttcaatacgtcggagggtaatggatga

SEQ ID NO: 55826 - DNA, 654 bp, Heterodera glycines
  misc_feature (26)..(26): n is a, c, g, or t
  Genomic contig location: Contig_ID=SeqID_25091; Location=1..654; Strand=+
  SCN-specific regions: Sequence locations=1-654
aaatcgattttttcaagtgtccgttntggggtactcaaacaattatgggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgcccccaaaac

SEQ ID NO: 55827 - DNA, 324 bp, Heterodera glycines
  Genomic contig location: Contig_ID=SeqID_4816; Location=2374..2697; Strand=+
  SCN-specific regions: Sequence locations=1-324
tttaacgaaatttatcgaacgagatatgttttgacgtataataaaaatgcaaaggcaaaataaaaaatcgtcataaaaacatatcacagtgtaaaggaggataatgcggaaagcatctgggtaatgattaagatctggaaaaaataaacggaaaataaatgttaattgtaaaacttacaatgaggacccagactcgaaattactcaaaactataaatttagcagtaaaaaatgaaatatatggaagaatttcctttattgcgctttttgagtctgggcctcacattaatatttaccaagtaatgaaaaatgccttaagataact

SEQ ID NO: 55828 - DNA, 1511 bp, Heterodera glycines
  Genomic contig location: Contig_ID=SeqID_4817; Location=3586..5096; Strand=-
  SCN-specific regions: Sequence locations=1-437,459-1133,1158 -1334,1356-1511
  Gene Ontology: Mol. function=kinase activity; Cellular component =plasma membrane; Biological process=zygotic determination of dorsal/ventral axis
atgcccgcaacaaattccccacattcatcaaatctggcggaaaaagcaacggactctctgctcaacgggctgcagaacactccggctgtgacttacgaggatttaactgtcgcgactgacggattcagtcccaacaaaatcgtcggcaggggcggctacggcgtggtctatcgcggagtgtggaaacacacgccggtgaagacacattctttcgcactgttggacacgtttttttcaggtggccatcaaacgaattcaggggaaatgcggaagtgacgaaagggtatgttgagcagaaatgcagcagttagggttttagagaaaaatagcgaatcttccaaaataaaaaaagctgtggaaaacccaattaaactgttacattggaaatcccatttattgcagcagcaaagggagcgaattcgtcagagtttacaagaattgaagactttggcaaagtttcgacatgacaacgttctctcactgtatggttattcgctggacgggcccgagccttgccttgtgtaccaattcatgtccaatggtacgcttgaggaccgtttgctatgccgggtaacttacaacggaaaccatttgtaatttttgcgtttaaaaaatcgaattgactgctgctcattgtcagcatttcaatctttcctttttcgaatgggacggagccactcggttgggccaaaaagctgtccatttgcgggggcgtttgtcgcggcctgcactttctgcacaccatcaaccaaatgccaatcattcacggcgacgttaaatccgctaacattctgctggacaagcattttgagccaaaacttggcgattttgggctcagcagatatggacaggtgatctaaaaggacagttggtccacgaaaatggccaaatcccaacgatggaaagtctcattgtcaggttgaactcgacacgggcgacaagcggccgatgatcgcttctcatgtgaagggaactctcgcttatttggctcccgaattcttgaccaggttcctcgtgtttggtaatattatttagctgtttaattcagtcgtattttgaccaccaaactcgacgtgtttagctttggtgttgtccttcttgaagtgtccaccggtgaagcaaatttctacaaaagttatgatttttcattttatttttaggacaacgcgctttttctgccagtcgcaacccacaaggaattgtcgaatttgtccttaaaatgtgcaccgaagcaaaacataaagatgatactaacttcaaaaacaaatgttattttgaattagcggacaaacgaacgcccaaaacggacgacggtttgttttgtttgattggtctttctatttgaacacaaaaatagaacaattcccgtctacttaaattcagaaagaagtctgcttattttcaacaaattactttctgttggtatttcgtgcaccgaaaaggatcggtttgcaaggccaattttctcggagatttttgcccgattgaatgacgaagaattggaggattaa

SEQ ID NO: 55829 - DNA, 351 bp, Heterodera glycines
  Genomic contig location: Contig_ID=SeqID_4817; Location=5847..6197; Strand=+
  SCN-specific regions: Sequence locations=1-257,280-351
atgttagagatagctattttagattctaaaaaggtaagcaatgatagtctgcgtttttttgatagcaagtgaatttgacagtaattgattccatcaaatatccgtccgaggcaaaaaagacgggaacgggattcccgggttttcgagcgggaatcccattcctacccggtctctaacctatgcgtcgtcgcacacccacgccgatgtgttgtgcatataaacactaacacttctatttttttttaaattccgaaatgaaatttaaataatttttttatagttaactaaaatagtgagtaaaaatccaaaaatagtgaagaaatagtgacaaaaagtccgaaatagtgacga

SEQ ID NO: 55830 - DNA, 518 bp, Heterodera glycines
  Genomic contig location: Contig_ID=SeqID_4817; Location=6660..7177; Strand=+
  SCN-specific regions: Sequence locations=1-388,410-411,433-518
cagtttagtcgtcgtctttggattggtgggacgccgctactgccgcccacggttggcggagtggggcgagagcagtagacaatcagggcttagccaccatcagcagcagaggggagtagcgaacgacctgcgcgcgcaagaagtttatgcgcagtagaatgacaatcgaaacacatcgaaaacgaaaacggatcaggacagcggaaattccgctgctttttggtggccaaggaatgagacgccgtcggcaatagcagaaccaagcaaaggtgaggcgatccatcgtttatcatctcagcaacaaaagcaagcgcatatggacgttggcggcaacgcttatttgttagtcgattttggtcaaataatggctattttactttgaacaattgaaacaaaagcaaacggaagatcccataaatccctcacagaaaggtctgcaattgaaacaaaaagcgtgcagaaactgcacagagtgtgccacgacaaaaagcagcgaaagagtggacagactttccaag

SEQ ID NO: 55831 - DNA, 787 bp, Heterodera glycines
  Genomic contig location: Contig_ID=SeqID_25095; Location=368..1154; Strand=+
  SCN-specific regions: Sequence locations=1-141,163-787
atgcccgcaacaacaacttgcatcccaaatgacaatgctgacacggtcgaagaacggcaaattgacgaaagagagacccaatttgacctagagactgatatggacagtgagcaggggcgtcattcgaaagtgacgtatgaagttctttattttatgtgtaattttatctgtttttgttaagccaatgattgctccaattgacagtgttttggaacccgtttttggcgtccctccgaagaaacgagaacttggcgtgcggaagcccggacctttggaaaatatttccgagagacaattttaccgctaccgttttgcaatgcgagaaaacagcaggggcgcctttcattggctttggtttgcccgtcgtttggctgaatattttgtcaacgctgttcttaatcgaattgagcgcaatgagatggagcatatcaaggcaatccagcaacggaagaactaccgccaaactcttgctcgagattacatcaaagccattgagcaaggactccagcagcaggggcgcaatgccaaattaggcaatacgtgtaggatccactgtattttgtaaatacttaggaattttaaaaagacacccaataagtaaaagtggtgtttataaattcggttttattcttaaagattaatgaagcaatatctgatgataatgtttcatcatccttacgaattaatgaagtattatcttgccattaaataagagcacatattaaatcattgatttaataataatacaccctatcattttcaataattataatgcttgatgacatta

SEQ ID NO: 55832 - DNA, 660 bp, Heterodera glycines
  Genomic contig location: Contig_ID=SeqID_25097; Location=357..1016; Strand=+
  SCN-specific regions: Sequence locations=1-660
aaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcagggggactgccccgaaaac

SEQ ID NO: 55833 - DNA, 499 bp, Heterodera glycines
  Genomic contig location: Contig_ID=SeqID_25099; Location=207..705; Strand=-
  SCN-specific regions: Sequence locations=1-196,232-256,296-499
atgccatctttgaattccagcgaaatctctccgaaaaatgtgaaaaagtgctatgaagaggaaaaagttataagtagaaagaaaacggaagaaatttttgctcagtaatgaagcaaaatttcatgcagaaagaaaagcggaaggattttcaaaagatgtcagggctaaggtgctccaaaatattgaccaattaagcttacaattaattaaattttttcaagactttccaaatttaacaccaggcaaaacaactcaaagaagaaaggagtcaaaaagaagaagcacaagaagaagccatcaaacagcaacaactcaaagaagcaatgaaaaagcgattgaggacaaacaattttacagaaatcgagctcttcaatatcttggagaagttgaagaaacggaggcaaaaaaatcggtcttgaataaggcactttgtgattggaagcggaaacgccaaacgcaagaaggtaaactatggcagtgggattggcacaatggttag

SEQ ID NO: 55834 - DNA, 940 bp, Heterodera glycines
  Genomic contig location: Contig_ID=SeqID_25099; Location=1074..2013; Strand=+
  SCN-specific regions: Sequence locations=1-612,636-940
atgtgcgcactttcaagggttaggcatttaagtcatgagcttaccacaaagttgaaatgattttgtaaatgtcaaaatgtaaaactttgcaaaaaaataaaacaacgatctgcttaaaattcaaaatttttcaatcacttataaattttttgaaaatatccatttttaaagcatgaaaaatcaaatcatggcagtgccgagggaattttcaacttgtaaaaaggtgcgattttatgaaatttatatgagattttgcagactgattgtcattgtattaacgtatttttcaagtcattctgactactaaaaacaatttaaaaaatcaatttttcataatatgatttaaattcccaaccctgccggtcgcgacattggtttttgttgcaactcgggttaggaactcggaattggttttctaatggatgattagtgcacccgaaacacaccggaattgcaaaccaaaaggacgaccccacctaatttatttttttcatgattttcaaaaaaaaatttgaaatgaataggaaacaaattttgtaaagggcatacattattacggagacccattatttctaagaagggaaaacttttcaaaaaatcaattaatgtgggtgaatttattaataaaaaattagagaccgggcaagagggtcggtcgaacggtttcggttaaaaaccgaaaccgaaaaaaaccgaaaaactcaaaaaattctcggtcgaacggtttcggttaaaaaaccgaaaaaaaccgaaccgaaaaaaaccgaagaaaaattttcggtataccgtttcggtttcggtttttttttgaatttttatattttttccaaaaaaagcaataaaacatttttattaacagaaaaagctaaagatcacctctgaactaaattgtaaagctattgaagctctattgaatggtgtactaaagtttggaaaatga

SEQ ID NO: 55835 - DNA, 277 bp, Heterodera glycines
  Genomic contig location: Contig_ID=SeqID_25100; Location=87..363; Strand=-
  SCN-specific regions: Sequence locations=1-126,151-277
atgagagcatgttcaccaatattaaaggacgatgtaatttaacaaatatattcgaactagcggaaatttattggcacccgaaccaagaaggtatattcagtggatgagcttgtgaataagctacaaggacaaatcaaattttgagagtttaaggccaccaattcaatgggcaagtccgaaattggctcagttcgtggctatggatggtgctgattctgcggcgcattttccctgggaggaattggcatggcaattaggccctagaaacagtttaatg

SEQ ID NO: 55836 - DNA, 248 bp, Heterodera glycines
  Genomic contig location: Contig_ID=SeqID_25100; Location=1..248; Strand=+
  SCN-specific regions: Sequence locations=1-213,238-248
tcctccgctgtcgcatgagtctgatgagtttgttcatgaacatcggcgcagttcaagttagccgtttcttttttaaagcttgttaccattaaactgtttctagggcctaattgccatgccaattcctcccagggaaaatgcgccgcagaatcagcaccatccatagccacgaactgagccaatttcggacttgcccattgaattggtggccttaaactctcaaaatttgatttgtccttgtagcttat

SEQ ID NO: 55837 - DNA, 589 bp, Heterodera glycines
  Genomic contig location: Contig_ID=SeqID_25100; Location=1522..2110; Strand=+
  SCN-specific regions: Sequence locations=1-40,62-381,418-589
atggcatggctctctttgctttgggctctttttgccggcactttgtcttttgtctttgtgccattattcagcacgttttctttggtggtatgtttttttcattgtttatacttttttattattttcatattccaaattttttagtccgtttttctcgctttggtcaccaatttgccaataattgtgttcgatttgcttgggaaacggtcccatcgcatttatttgccattccttctgattaatgtgggacttcgaattaattaaaaataacaattaatttcacttccttcagggcatttgtattcttttcggtctttcgcacattgtttatctcattttgcactcagttttcatgtttaaagtgcctcacttctttgagagtaaaatatttacttttaaaattaatcaaatttaaaagtaaaatgcaaatggttcttttttattcggcattcatttaagtgcaccaaaaaaatgaaattagagttaaagctgaggctattcaaaaattgactaatgccaatttttggagcggagggaggggaaggaaatgcaaggtttgacgaagtacgagaaagtgcaagtgatcaaa

SEQ ID NO: 55838 - DNA, 1841 bp, Heterodera glycines
  Genomic contig location: Contig_ID=SeqID_25103; Location=1..1841; Strand=-
  SCN-specific regions: Sequence locations=1-13,35-275,298-302,326 -350,373-651,688-1133,1155-1187,1209-1611,1633-1724,1748-1794,1816 -1841
  Gene Ontology: Mol. function=protein binding; Cellular component =basolateral plasma membrane; Biological process=establishment and/or maintenance of epithelial cell polarity
ctttagtaaaaataagcaaaaatgataataaatactagtatcaagattgggaattaatagaaagtaaaaaaagcttgaaatcggcccttaggcctaaaatttcgtttttgaggcctcataactttttgattccctcctatgggggcgtaatattaaaaatttccaatagaaggcgaccctgctctatcgaatggtatatcacacatacctatgcactttccgacttacagttcgggtggttcccttgttagcgaaatccatgcaaagcctatcggcaccgccggaccgcccgccacccccttccccaaaagttttttggaaaaaacgcgccgcaaaaaaaaggtgcctgaatacaaaaaaagatcgccagaaaaatttggtatgaatagcaacaaaaaaaaaatgtcgtcgtctgagaaaattttggaccttcgtatgaaaaatcggtcccgagacaccgcctggctcaatcgtacggcccttggcctgagacaccccttgcacatgtatggttggctaaatattttaaaattgttttgtcattcatttgctcatcaaatcgcgtgctttttaggcacttcccggctacgacgcgtacgaacagcgttttactgcgacacgccgcagacttttctgattgtgcgaaatgagaaaataattataaatttcaagataatttttatttttgtaccaaaatgtttttaaagacatttggtggctgccgtcaaaatttttgattacagattctttcttttcaatataatcttttaaatctgtcgttattttacttttttttcatatcattttttatctttttttaaaccttaatcgataaaaaacttcctgaacccaatcctgccctgacaacaaaagggtccgatttttcatttttcagatatttaatccatttattggtcctttattttcgttcttgttgtctgctgattatgggcaatgaacactcaaatcgctcaaagggtcatccgtcatcttcgtcttcctcaaaaaaggatagtccggcgactcgccttcaaaaagcgctgccgtccgcgctaaaattcggctcaaatgatctctcgtcgagtgccttacgacgccttttggaacagtcgaagaaaagtcgaagtttgcaactgaaaggggccggcatcaaaagagtgccgtcgggaattgtcgaggaggtaattaattcattttttacttaaaatggtcgataatttggggttcatgaaaaataaggtccaaattttcaaatttcaggtccattctttgctcagaattttggagctgtcgtcgaacaaattgcgcgaattgccttcgactatcggcactttcaccatgctcaaacagttgtacatcgccaacaaccgtctgaccaatttgcccgacgaaattggctgtttgaagacattggaattgctcgatgtttctggtttgccttttttttttttgtttccaattgagtaaatttctaacaataagaattacaaaactaatttttttattttttcccgacttaattttcctaaaattgaaggcaatcagctcactgaactgcccgacccattggccgcgtgcaattcgctgacccaaatgaacgcgtccaacaacaaattcagcacatttccctccgtcgtgacgcgactggtgcggttggaggtcatcgacttgtcggagaaatcgatccctgaacttccggacgaagggaattgcataattaaattaacccaaacttttcccatcaaaaatcccaattaaaaaaatgcggttaatgaccttggaaaatttctaatacttcccttcccttccttccccaaaaaaaaggaaatttttctttaagg

SEQ ID NO: 55839 - DNA, 3664 bp, Heterodera glycines
  Genomic contig location: Contig_ID=SeqID_4818; Location=884..4547; Strand=+
  SCN-specific regions: Sequence locations=1-118,140-964,986-1401,1423 -1629,1651-1911,1961-2344,2366-2423,2448-2854,2879-3027,3049 -3404,3426-3534,3556-3664
atgttccctgatgacgatgggtacgaatcggaagatgatgaaattctcctgccacctccgccgatccccccgcaacttggccaccctccaccaaatgtgccggtaatttcggtctcgcttttcgttgcttttctcaaatttccgagtggttttttcaggcagttcgtgttcagccaatgcatgttgggcagcagcggctgccgctgagagacttgccacaattcgaggaccatccgcaaaatgtgccggtaattttgggttgattttcgctgcgttttctcaaatttctgcgtgcttttttcaggctgttcgggtccaaccgatgcaacaaccattgccgctgagagacctgccgcaaattttccaccctccaccaaatgtgccggtaattttgggtctttctttcgattgctttttctcaattcccgagtgcatttttcaggcaattcgtgttcaaccaatgcagcaacccgtaccaatgagagccgtgccacaattcctccaccctccgccaaatgcgccggtaatcttgagtctcgttttcggttgctttttcaaaatcccgagtgcattgtttttcaggaaattggtgtgggaccaattcatgatgggcaacaaccactaccactaagagcgttgccacaattcgcccaacctccaccaaatgtgccggtaattttggctcgcttttgttactttttttcaagatcccgaatgtttttttcaggccgttcgtgtccaaccagttcaacaaccgataccactgagagacgttccgctatttgtcaacccgccaccaaatgtgccggtaattttggctcgcttttgttacttttttttcaagatcccgaatgcatttttttaggtaattcgtgtccaaccaatgcctcaaccgctgccgctgagagacatgccgcaaattcaccatccaccgcgaaatgtgacttcaatttggatcaaattgtggttgctttttctcagtctctgggtgtttcttcagggaattcatgttcgacaaattcaacgggaatacgcagtaccgcaatttgcccatccgccgccaaacttgccgtatcatccaccagaaaacgttccggtagttgggtcttgtttttcgtgcgtttctcatattttcggatgcgtattcaggcaatccaaccacggcaacgaccgcgccagctgagagacgtgccactattcgaccacccactgccaaacggacaggtaatttcagaccctgtcttttacctaacaccgaaacatcttttcttaagcaaatgtatgccaaccccccgagagtgctggaagtgatccgacggctggacgagtggagaggaagaccaagggacccaagacgtccgcctcaatgaatgaatagaatttggattttgataaaatttgttgttttaatttttgaattgataagggttaaatcccgttacctaaattgtttgaaaattattaaaattttaagaaattagatgctaaacctaacctttgacaaagattatgaaaaaatgaaaagaaatgacgaaatttttggaatgttccttctttttattatctatagattttttttcatgtgcattattttggtgctagtaagatattgtcgaatgaattaattggttttttctcttcattttaaaacatttcacgtccccatgccctgtccacttcccgcggaattgatcaaggaaataattgacgctctcccccctccaaaaacacatcggcttttgtgcgtaaattttgttttggcatactttgttaaatgtcggttttattccatgatgagaagattgtttcgcccagagcatatatcaataccaatggcccgaagaactggaatgtatttctttttcgatgtccatactccccctatttattttccactttaccaataataccatttaaataaatttataaatttttattttttaatttgataatttttaatcgatatttctgataattaaacaaaattgtatttttcccaaaagaattttctcgcagtagcaactcatcggcttttttactcccttcataaaatgtctcgcttttgccccctcgcccaaatcaaggaatcgggtcggcttaacaccccaaaggggaaattgagtgagttccaaatcctgtaaatcccacacaaatttgaaatctattacttgagtttaggccttttttatgccctcgaattcgctcgcaactaccaactgatcgagcatggaatttctaggaaggctttccgttatttaatggaaactgagaaaaaacaaagagcattagtctttgatcttatggaaaaggcagggataagcacagatgacaaaacttttggtacccaacaccttgaggcggtacaaaaatactgggacagggaatttccgggcatgttccgagccgttgttttcgataaggttaataaataaaaacacaaaaaaatcttttctattttttttagaaatttggacttaagccaattttcaagggccaaggcgttcgtaagaatgaagtgtgtgtgataagagagggagaccattgggatgggatcaaatccgcttcctggttttttggtgttcgctacttttgtgtgggttgcgaggttacgtacgatcgccctgaaagacaccggatggaatgcaaagagcgctgcaaaaaatgttgccggatgggattcgggttcccatgtgcggatgtgtgtgttaagattcactgcgaggaatgcaaccgcaacttctataacaacgaatgttttgaagcgcacaagaaggtggcttgtaatgagtacaagaaatgtgaaaaatgcgcagaagtctaccaaacacgttcgaaacacgtttgcggggaaaagttttgcaaactttgcaaagtttgccacccagggaggcaatgtttcatcaaaaaaattcaagtgcgaccgcagaaagcctacagaattgtggcctacgatctggagacgacagtagatgggggagaacaccggcctaatcttgtttgtgctgcacgtacttgtaacatttgtgcgggagaagagcgggaatgtgagatttgtgaaggccccagtaaaatcacatggtctgtagcggatggttttgacccaatgagcgagtttgtcgtttggataatgagttttcaacgatttgaaacgattgctttcgcgcattatgctgggagattcgattcccactttgtcttgtctgaactaacgaagaaggaaatcgcgacggaactgatgatggcagatttgaaaatttatcagataaaggcgggacgagtgatttttcgtgacttttggatgctcagtcagaataaattggcggaccttccaaaaacgttgggattaaacattacggaaaaattgtattttccccacaaatacaataagaatgagaactttgggaggagattgcccaacctgccacctttggaagactattgcccggacaatatgaaagaggaagaagccgtaaaattggaaaaatggtataacgagaattatcaaacggaatttgaactaggtagacagaaaaaatatgggtttttaaattatattggatttaggggaacagctgaagatatattgcgaaaacgacgtggaaattctgttgcaatcagttttgaagtttcgacaattgtttttggaaataacaggggattttga

SEQ ID NO: 55840 - DNA, 566 bp, Heterodera glycines
  Genomic contig location: Contig_ID=SeqID_25105; Location=1142..1707; Strand=-
  SCN-specific regions: Sequence locations=1-206,234-566
atcaatcttgctcgaaatttcgagaggctctgcgcactaaggaagttaccgtgtggcgaattgttcatccagttcgggttcatccagttcgggttcgaagatgaactggaagacgccaaatatttcgccgactttttggcgtatctatcttttggacgatctggccccaccgctacgacgagagtcgtgacttattccatggtaagaaaacaaacaaatataagaaatattattaatatttagccaattaaaattggagagctgttcggcgcaattctgatttatgtcttgggaagcgcaaacccgctgaccatgaagaagcggactgcaggcggttatttgatgcggcagcattttccgcggcttctccaattcccggtaacagaaatggcgtcacatggccttggtcaactggtccgcgccgatgggatggaactttaccgattgatgaatccgcatcacaaaggagatgttggttatttgatgattattgaaacaactcaacaccctggttcctactattttaatttttcaatcgaataagttttttttcgtaattgaataaa

SEQ ID NO: 55841 - DNA, 63 bp, Heterodera glycines
  Genomic contig location: Contig_ID=SeqID_25112; Location=132..194; Strand=+
  SCN-specific regions: Sequence locations=1-63
ggtcgcgtggacgatgtcaatggagaagtcattgatccggccaccgggcttggaaagtccatt

SEQ ID NO: 55842 - DNA, 852 bp, Heterodera glycines
  Genomic contig location: Contig_ID=SeqID_25113; Location=596..1447; Strand=+
  SCN-specific regions: Sequence locations=1-226,253-288,310-521,552 -568,590-852
atgcttttttcgttttttctattccaattttattctgttgtctgctcaatagcgtcaaagagaagtcctgaaccatggggggatacactgaaatcgattgacgacaatgccagagatttcaaatggcctgaccgacacgaaaagggtacatgggcagcagtcgccgcaaccggggaaggctccagggctaaagctgaaaccggtgtcaatcgagaggaaggcagtggtatggaggaggaggaggacagccatattgtaagagcggaagcgttgagtgaacgtgaaggcggtgttgcagttgctgcagccaacaaagggcaaacccaaaagacgagtgatgatgataatgattatcatgatggcgcgcaccagcaagtcgtcgtaatggcacgtggaggtgaagacgcccgtgcaaaagctgaagcaagcggaggtccaagaagtgtcgttgaaacacgaattagtgataaccaacgagggggagaaagattagctttgggttcggccattattcatagacaaggaagaagaagaggaggaggaggaggaggtcgaaacagaaaaccgtcagagaggcaaagaagaacaagggcgaggacgaagaccctattgccaacgataaatttcacccccgcccccccgcaatatatggagctaaacaatcgtcaaaaaggaaattgaacaagtcacactcaacaacaatgtgcacacaatgagccctgtcagttacccatatttgttgagaaaaaaagttgaaagaaattgttttgaacctgctgatttaaccttggctttcagttttgccaatttccttctccacttatcaatttttgactcaaaatgaaaaactta

SEQ ID NO: 55843 - DNA, 918 bp, Heterodera glycines
  Genomic contig location: Contig_ID=SeqID_4820; Location=1270..2187; Strand=+
  SCN-specific regions: Sequence locations=1-661,695-820,843-881,905-918
atgcgaatgtgagaactgttgctgctgcaaaaagtgccggaaattcgttgcaatgtgcgggtgccccactgaagcaaagactgccaaacattgaaaagggtggtcatttttaggggtttagtgcagcaaataatttgaatttgccaattttggcaatgcgtcgtgcattaactctttaaaattcatatgagacagaaaaaaagcaaggaacatattctatggatttccagggaatgagaaaaaaattgaaatggaaattgcccaatcctaaaaatgcggagaacataagaaattcctaagtttttgcagcaaatattcggagtttgtcttagtctcgaagatagatttctcaagacatttggtccacgagcacatgtatacttcatcaaagatgcaagctgatactcgaaaaatcggtatcaggacttgaattagataaaaaaaattttggggttcggcatttcgccgccccaaaaatgatgggattggatccttgggatcggctcgaatcttagttccaccattacggaaatcctttttcagaagtaaacaaatggatcatttattatttgaatttgccttccgccggagcgctgcgccgaatgattttttcgcaaatttttcgcttgctttaaatagggggggggggggagacagcagctgtttgttgccactgctgctgctgctgataaagcaatcagtcatcattcaatgtgaattcattcatctcgtcaatttccattattattaatcatcggtcggtgtcagttgaaaatgacaaaaaatggcaaaaatattataatggggcggcggcgggcgaattgttttgttttgttaaaaagcatcaaaatacgcgctcaaagggcacagaatagcgcacaaaaccaattttaaacaattttttcagtcacaacgcca

SEQ ID NO: 55844 - DNA, 372 bp, Heterodera glycines
  Genomic contig location: Contig_ID=SeqID_4820; Location=6022..6393; Strand=-
  SCN-specific regions: Sequence locations=1-372
atgtcccatcgtcgttcacatgctgataatgtggaaacaatggtaagtacctaaaatgtatggtggcatttttgtgttaaaaaatctgccgaataaaaataattttttcctattttttggtcaaaaaattctttttcaaccattttgaaacttttaattgtcatttaggctctaaagtactttataaattgaagattgccaattttccaggcccaactcatcgccggccttttgcctccgttggcgttggaagcgcggatcagtggagggaatgcgctcggcaaccaattggtcacgcagttgggactgtccgtccaagcggcacagaatgtggacatggccattttgggtagggccaaattaaaaatttga

SEQ ID NO: 55845 - DNA, 691 bp, Heterodera glycines
  Genomic contig location: Contig_ID=SeqID_25114; Location=788..1478; Strand=+
  SCN-specific regions: Sequence locations=1-97,119-212,234-248,270 -290,326-340,364-511,551-691
atgtccaacacaaaggcagccggccaaagcgccgccggcgcatcggaaattgcggaccaagttgagcaaaaacacaatgctatgaaggtgagaaacaattttaaatgatattgaaaattatttaattgtctataaatcaggtgacggtccccaagattttcgacttgggttttaaggggcgggggggggggggtgggtattacaatgaaatagatcggtctgctgtttagttttatcgcatttggcatggttttttggaatcccaaaaattagttatcaaactctttcccaaattaaattttttttttctttatttttaatttatgaaactcctaatgcctattataattaattttttaatttcagtccacctatgacaaagtgttagctttattggaagagaaagaaggcggaaatgaggagcggaaacagcgggcggaagagttgcgcaagcgcacaaccgaattgttggcaaagattaagcggagtcgggaagagaaaatttgtgagctattttttattaatttattttttgttttttaattttttagccctgattgaacgtgctgattcattagacgtggaactgaacaattttcacacctcaattgaggaactcagtgatcagattgatcaggtgaccagcgaaattgatcgacgcgttgagttccatgccacatgcgatgcctaa

SEQ ID NO: 55846 - DNA, 216 bp, Heterodera glycines
  Genomic contig location: Contig_ID=SeqID_25116; Location=432..647; Strand=-
  SCN-specific regions: Sequence locations=1-64,94-216
atttgaaagagaatagaaagaaccaggttcgatgaagttttggtaagccaaaaaaaatgcaaacatttaaaaatctataaaaaatttaaaaatgagaattcatgcgagattttctggaaataagcttaatagggcctagttaagctgtaaaaaaaaatttggggcgatttgaaagagaatagaaagaaccaggttcgatgaagttttggtaagcca

SEQ ID NO: 55847 - DNA, 427 bp, Heterodera glycines
  Genomic contig location: Contig_ID=SeqID_25117; Location=10..436; Strand=-
  SCN-specific regions: Sequence locations=1-427
atgtgggacgagcagcagccgatgacgagccaaggaacacgacgacgaatttcgcactttgctaacagtttatggacaacgccagcgattggagggaacgcggtgaatggaaaccgacggacggacgaaactgtgagaaattgaggagaaatttacaaggcctcgtacctatactatgatttaaacccctctcaattacaatcaattttatcgtattcagtctgtagattttatgtttagtctcacaaccaattccgaaccgcccgaatggacgatgattcggtgcaaaccctcgacgacagtgacgtgtaagtgggcaacggaccaccagtttcatacgaaatgcatttagacaaatggtagaagaatctgacagaaaagcggcgccaccaccaaaagcagagaggggtccgcttcttctgacggc

SEQ ID NO: 55848 - DNA, 554 bp, Heterodera glycines
  Genomic contig location: Contig_ID=SeqID_25118; Location=377..930; Strand=-
  SCN-specific regions: Sequence locations=1-168,190-258,280-554
atgtttctaggggtttataggtacgttgagcacgaatctgacatccatttcgaccaatcccgaaccccggacccgaattcgaacaaaaagtcgaaaattcatttttcatcaaaattcacattcatgcaactaaagcaatacaaatgcacgaaaagacgcataaagatatattttgcattctcttttatgtttccagcttattaattaatatggctgcgttggaagcgtttcggaatttctcgtgtcgaatcaatgtggaagaaattgaaaagaaattttaaacagcagtttggcaacaaaactgagacatacgactagggatgcgatttttagttaaatacctaaaatttttgcgcacttgtaacgttgagataagcataaaaaacgagtttttagcttggtttggagcttctacacccacttttataatacctatttttacctatttcgggatttttctactattacctaggtacctatttttatacctatttcggcattttggttacctattttaaggattttcaaaaaattcttaacaaaaatgcaataaa

SEQ ID NO: 55849 - DNA, 290 bp, Heterodera glycines
  Genomic contig location: Contig_ID=SeqID_25119; Location=1587..1876; Strand=+
  SCN-specific regions: Sequence locations=1-290
acttggtggaggacatctctgatcagtacgacgattctgagcaaccaacaatcatccaccacgaaccggcaacaccaacaacaatgtttgacaactatggtccgattgagaagattgttgtggtcggcaccggcctcatgggcagtggcattgcgcaaattgcggttgagtcgggcgtcaaagtgtgcctggtgggccgtagtcaagaaaagtgtgatcagacccggctgaagatcaacacgggagtgcaaaagtcgatcaagaagcgcatggcaaatgaaactgccgag

SEQ ID NO: 55850 - DNA, 363 bp, Heterodera glycines
  Genomic contig location: Contig_ID=SeqID_25121; Location=811..1173; Strand=+
  SCN-specific regions: Sequence locations=1-289,311-363
atgctggccaaacgaaagcaacacgtcggcgaaagcttggacgaatttgctcaagagattaggactttggtagcgaaggcgtacccggatacgtcgcttgaaatgaacttcgaggcattggcattgggcgacatggaagacgatgtgaagagggaacacgaagaacgcctacacaaatttagagctggaattgcaaaggactttttccgcgcaaacatgacggcatcaatcaaagaaaaaattctcttcatggatgaacctccgacatttgaggatgcgatcacacaagcaaaaagagttcaacaaatgcagggagcgttggcagaagacctctgcaaacaaacgcaaggaacaaaagctgaa

SEQ ID NO: 55851 - DNA, 483 bp, Heterodera glycines
  Genomic contig location: Contig_ID=SeqID_25123; Location=6..488; Strand=+
  SCN-specific regions: Sequence locations=1-108,459-483
  Gene Ontology: Biological process=N-linked glycosylation
aaagtgaaagagaaagtggaagaggaagagaaagtggaagagaaacagaaagtggaagagaaacagaaagtggaagaggaacagaaagtggaagaggaacagaaagtggaagagaaagtggaagaggaacagaaagtggaagagaaagtggaagagaaacagaaagtggaagagaaagtggaagaagaacagaaagtggaagaggaaggaaagaggaagagaacgagaaataggaagagaacgagaaagaggaagaaaagaggaaggaaaaggggaacagcaaatggaagaggaacagaaagcggaagagaagaagagcaacagaaagtggaagaggagcagaaagtggaagaggaacagaaagtggaagagaaagtggaagaggaacagaaagtgaaagagaaagtggaagaggaagagaaagtggaagagaaacagaaagtggaagagaaacagaacgtggaagagaaacagaaagtgtaa

SEQ ID NO: 55852 - DNA, 1278 bp, Heterodera glycines
  Genomic contig location: Contig_ID=SeqID_4823; Location=1958..3235; Strand=+
  SCN-specific regions: Sequence locations=1-155,184-425,448-681,703 -709,731-989,1013-1206,1228-1278
tgatccgaatgtggtgaacgaccagcaacaacagcagaaacacattttaccgcttcctccacaacagaacgaacaaaacgaagtcaaatcgacgactggtctgacacctgctgaagctgttcggcgttcgcagatctctgcattggtggaaccgaaacaaccacaacaacagcaacaagaaatcaacaacggcgccggcgacgaacatggcggagtgcttcgcaggcaaaaaaaaaaaaaattcagtaccaatttgtgactcaccattttccccttttcaggtcaatttcggtgctcagtgataattggtacgattgggttgaaggcaatcagacggacaaagctgggtaaactccatgttttaagcaattttgatcgattctttccccacgcacagtttaagcaatcaacaacaaaatgtcatcgtccatcagtcagtcaacagcaccatcaacgcggatgagcatggcatatctgatgaagccagcccggtcgcctcactatccacaatcgaccttggccgtgtgtacaccactgttggcactgtgatggaatcgctgctggttaactttgcgcacctgtggcaatatcgggtgagcaaccagagcggcaaatataccaattaacacggggacggacgatgaattaatttgtctcccccgcttccgtttttcagcttttccgttttgccttcgtccttctgtccatctacttctgtctgggcttcttggaacagtgtgctgtcgcgatgaccgccgcatgcgtccgctgggcttggccaccggtgcacttcatgctcggttcgtcacggggaacgctgttctatttgactgactggttcgacttcttgtcaagttgggtgtgcgacatggccaattctatgcataacacttcattttttctttaaacctgactgtacaccccccccccccctcatttactcaacgctttcatcctcctttttgatctcgattttgaaccttcaaaatttattcctaattcaatttccaaattcagttttcatttttatggatctaaatcattcaaggaagattacgatgatgatttctttgaatcaacatgtattgaagtgattgcgccgccagagcacgaaatcatttatggaccatctgcttttgttgctatttttgtagccatttatgccttggcgacgggacgtaaagttcaaaaggcaacagcattaacgggggaactgctgcgcaacaaatcggttgtaaaaattggtggactgcgtcagaaagtgaaggcggcagcgaa

SEQ ID NO: 55853 - DNA, 1117 bp, Heterodera glycines
  Genomic contig location: Contig_ID=SeqID_25124; Location=232..1348; Strand=-
  SCN-specific regions: Sequence locations=1-408,430-846,868-882,921 -1117
  Gene Ontology: Mol. function=ATP binding; Cellular component=integral to membrane; Biological process=glucose transport
atgttctattcagctgacattttcaagaatgccggacttcaagggcaatgtaaatttaatacgggaaaaattacttattaaaattattacggaatatttagggccaactgtggccactatcgcaatgggaaccgtgaatgtgctaatgacttttgtgtctgtcgttttggttcggttttttgaaactaattcttttcaaggacacgatgcttatggcttcagaggcgcccttaaaatttgtctttattcaaggaaaaccacccaatcttcaagatctgaattgtagactttgggtatttcagtgaaaaatataccctttgcgtccttgagaaaggctctgtttttccgtgtccgatggcccattaacgccttaattagaccggcactaatgatgcccttgaattctgtgtccttgaaaaggggcttcatttttccaagcctgctagccttaattaagaattaattacccccaactgaatttcaggtggaacgccttggacgtcggactttgcatattactggcctcgtgggcgtgcttttgtcgagcgcttttatcgcaatttcactgcttaattcagtgggtttttttgtttcaaaaaataaaacaaatttcgctaattgcttttcagtcagttcaatgggtttcatatctttcgattttatttgttctgctgtttgtcatttcgtttgcaactgggccaggtaattaattaattatcagtcaaatatgagaccggatttgcggcaataaaaaactaaacgcacttaattattaaaaaattagagaccgggtctcatgagaatttattaaatttttgtgaggtaatttggaaataaatttacaggcttttttaccatttaagttaaaatgctttgaaaaactaaaataataaaaaaaataaaatgaaattcaaaaaaaacaacaacaatttcgtaattacatataataattagaaatattttaggctcgattccatggctttttgttaatgaaatctttccatcgaatgctcgtggcaatgccaattcaattgcggtcctttccaattggggctcaaatgccattgttggctactcctttccaatgcttaatgtatgtttatgtacagtagactaa

SEQ ID NO: 55854 - DNA, 530 bp, Heterodera glycines
  Genomic contig location: Contig_ID=SeqID_25125; Location=400..929; Strand=-
  SCN-specific regions: Sequence locations=1-194,216-273,302-307,329 -478,505-530
atgttttttgaagcaacgataactttcgctttcgtttctatatgggaccgacccccattcttcattgttcgtgattgcgtaccacaatttcgtctcccttttacagaaagaactctggaagaaattgaaagagttgagaaaggacaccaaattggccatggaacaacaaaagttggcaaacgaattgcgcatttccaagttggaagccgaattggaacgacaaaaattcgaattcaaggaacaactcatgaagatggaaatcgaacgcgtaagttttattttaatttatttaaataattatgagaaaattgaatctaacaattgttttaacatttaaaatgatgtgaattaagttgaaggaacgactcatgaagaccggtggtacggtagcctatccccccttttccaactattacactttgttttttaggtgaaaaaaatgatgatgagtgagtgattgaatgaaaatttgtgggagtattttttttaattaattaattttttcgtcgttttttccttttattaataaa

SEQ ID NO: 55855 - DNA, 260 bp, Heterodera glycines
  Genomic contig location: Contig_ID=SeqID_25128; Location=617..876; Strand=-
  SCN-specific regions: Sequence locations=1-58,80-207,230-260
atggctagaagggctgccaaaaatatgtgcaaaaaatggtcaaaatatgtgcataaacataaatatataaaaaaaaatagcgatatatgtatataaaacccaaaatatgcaccaattatgtaaatacaatttttaaaactggttaatttttagaaaaatttcttcgtaaagggtgaaataggatttaaatggcttattgttagaatcatttttattataaatattatttgggcattttttagtggtacattttaaataaa

SEQ ID NO: 55856 - DNA, 382 bp, Heterodera glycines
  Genomic contig location: Contig_ID=SeqID_25128; Location=892..1273; Strand=-
  SCN-specific regions: Sequence locations=1-62,85-101,127-382
cgacgaaatttgttctattcccgtcataacccctctccaactttgctcataaactgccccaaccacctgctcctcctccctgttgctgtactgctccagcctgttgttgttgttgttgttgctgtttctgctgccagtgcacaatttcagtcagttgcaactccatcttctgcatggtcatgtggatgttcgtctgcgcctcgtagatcagccgcaactcgcgctgctgtgcgtcctcatagtatttggcctggtcgtcctcctcgtccgatttcgccttctccggatgctgctccttgaacctggacgggcaaaatgggaaatggtaaaatgattttgaattcgaaaaaccttcatagagaaatatgccaaatagaataaa

SEQ ID NO: 55857 - DNA, 844 bp, Heterodera glycines
  Genomic contig location: Contig_ID=SeqID_25129; Location=173..1016; Strand=-
  SCN-specific regions: Sequence locations=1-659,687-844
  Gene Ontology: Mol. function=calcium-transporting ATPase activity; Cellular component=integral to membrane; Biological process=hearing
atgctttggcttaatctcatcatggacactttggcttcgttggcacttgccactgaaatgccaaccgaggaactgttggaacgcaaaccatacggccgcaaaaagtcgcttatctctcgcacaatgatccgcaacattttttgccatgccgtctatcaattcaccattttgatggttttgctcttcaaaggtcggttatcgcgtttttaaacacgagtgattaccttgaatcccttgtttctcattctaacacctgcaaattaggccctgaattgctgaatgtcgccagtggcatcggtgcctccatttactctcctccatctgagcatttcaccatcattttcaattcattcgttttaatggtgcgttaacgtaagcagctcgtttcctccccccgcccaccgattttatcattatttttttgataactttctaattttgaaaatttgaaaaaaataatgataaaatcggtgggcgaacggtggagaaacggcgagaggggggaacgaaatgcacccgagtttatctattaaaatgttttaatttttgcccgtcagacccttttcaacgaaataaactcgcgcaaagtccacggagaacgaaatgtgttcaaagtgagtgtaataatatggcttttgcatttcgtctgatgattggccattcattttgttcagcatctttcttctaatcacatgttctgcatcatttggctgtccacttttcttgcccaatttctcatcgttcattttggccataaatggtcagttgttactttttttaattagttcgattaattgttttaatgaccaatcaaatatttccaggttttcaaccgctcgtctga

SEQ ID NO: 55858 - DNA, 204 bp, Heterodera glycines
  Genomic contig location: Contig_ID=SeqID_25132; Location=871..1074; Strand=-
  SCN-specific regions: Sequence locations=1-204
aaatcgattttttcaagtgtccgtgtggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaaca

SEQ ID NO: 55859 - DNA, 1020 bp, Heterodera glycines
  Genomic contig location: Contig_ID=SeqID_4824; Location=1493..2512; Strand=+
  SCN-specific regions: Sequence locations=1-58,84-264,311-401,423 -774,890-1020
atgtcgctgctgcccatcagtcgctgctcctcccttttccatgccgcccgttctttggcgtgccgtcgtcctcctcccctggcgtcgtgtcattgtttgctctcagtgccatccacggcaccgttttcgtcccatttgtcgtcgtcgtcgccagtcgtcctccacagcctcacaactccgggtttgtcaaaaataaacatttgcccgcattcatttattttcatggctttgcatttttttagagtgtcaaccttctaaaaacccaaaaaaaaaatttatattctgtttttttttattaacttttaattttccctcaaaaagtggagcgagcaaagcctcaaaattgcagtgctaaagcgttaaaaattggggtgcgctttactaattcatttaacaattcggatgcctttttagaataaaatttagaaaaatagttagtgaggcgtcatcggagcgatttaccatttttattccaattaaagcgatttttcatgccccctctctttaagtgacctccactcactggtgccatcgtcctgcatttgcctctcaatcgacgccatccgcaccggtgccaaattcgacaaacaatactccggctgctgctggcggtggtggcattgggttgtatcagcgctacgagcaatggttgcagaactatccggccctgtacaaattgcatcgactcactgttgacggttcgaattcaaaaaataccactgaataatgaatgaatgagtcgacgattatttcgcttttttcgccctaattcagaaaaatttaaaaacagaaattttttaaagaaaaatcatagaatttttataagaaaaaaacgatttaaaaattcttttatttttaatttttctgatttatttaaattcaaatatttcttttgtgtaggctccaaatggtgttactccgatctcaaaacgttcttttggttggcctacggactgcgcaaagggcgcatcacactgaacgatctcaacgcgcgcgaactgttcatctacatccaggctg

SEQ ID NO: 55860 - DNA, 376 bp, Heterodera glycines
  Genomic contig location: Contig_ID=SeqID_4825; Location=826..1201; Strand=+
  SCN-specific regions: Sequence locations=1-168,227-248,271-334,365-376
atggacgacctgcggcgcaacgagcgcaaactgttcccccgcattgtggacgcgttgcggcagcacaacccatcgtcagcggtgagtgatgacacaaccctggcaggagacagaaagagcggttgctaatttgtgtgcattatgttggctccgccgaaacgtcgccgcaaaaaaatataaaaatttttcaaaaaaaattctgaaaattaattgttttaaattttttggaaacctaagtaactatacaaaatttgcttattttccagaaaattcaatttttttcgtattagactatgtaactaaaaattatttatatgtcaattgacgaaaatcgaaattaattttaaatttttcaaaattttttctaactaaaaaa

SEQ ID NO: 55861 - DNA, 356 bp, Heterodera glycines
  Genomic contig location: Contig_ID=SeqID_25135; Location=594..949; Strand=-
  SCN-specific regions: Sequence locations=1-118,148-204,226-356
atgaaagcaaatggacaaaatgggaagaagaagcgattcgctgtgaaattgatgagctatggaacaaaatttacattcaaattcatgatgagagttttgttacggggactggtaagtgaaattttttttcaaaaattaaattttattgcgtttcgttttttaggcttctcaacgcattggacggcccaaattagtgcgcagatgaatgtatgaattgttcagaatttgaccgatcgatttaattgaattattatggaattattgacgtgctcataataattgttcttttttaatggggatgatcaatttggatttgtgttatgtcattatggtattttgtggttttctgaaataaa

SEQ ID NO: 55862 - DNA, 939 bp, Heterodera glycines
  Genomic contig location: Contig_ID=SeqID_25136; Location=1060..1998; Strand=+
  SCN-specific regions: Sequence locations=1-882,904-939
tggcttttcgccgtctttcgtctcctccaattgcctttctgctcgccttttaactgtcccccaccacaaaagtggggcccgggcccccctcagaattgtccgtcgcccaccgacccaaacaaccgaccgccgttagttttgctttgccctttgctttggctctgatcgttcgtttttgccaaggtccgctctcgagcgttggttcacaaaagcgatgttcgaagtgagtggcacaaataaacgccgaaatttaatcgccccgaaggatttgtttccgtttgccaacctcggctggggccccgaccgatgctttccctattcatacgaaagttttgcaatcgctgcgcgttatttcccccgttttgggaccgaaagtcccaaagagaacggactgagtcggacggagaacgaacggagggatttggcggcattctttgcccacgccattcaggagacgggacagaatgacatttcgctttaccaaaggtcacccatccgacattcttttctcggcaaaagtttcccccttctccttcacattttgaaaatgctttaaatgggaattggtcattttgcttttggcactcattttcagtattcccaaccaatccgcggctgatgcctgcttctaccgtggcggactgttcaattggtttgagggtgggcccgtgtcagcatttttggactccaatttgccgggctttcgtcccaccgatggagcgaaatgtttgagcaacggaaggttcgatgggatttgaaaatgggcgtttcgatgattgattgaataatagcttgcttgataatttgctcgtttgggtgattggttgttcaggtactgctcgccctcccttttctttccttgtgccaatggcacttccgacgatgggcgtttcttcaaaagctgctactttggcagagggacaattcaaatttcgtaca

SEQ ID NO: 55863 - DNA, 1349 bp, Heterodera glycines
  misc_feature (53)..(53): n is a, c, g, or t
  Genomic contig location: Contig_ID=SeqID_25139; Location=326..1674; Strand=-
  SCN-specific regions: Sequence locations=1-107,134-143,192-402,424 -554,620-665,708-1349
  Gene Ontology: Mol. function=extracellular matrix structural constituent; Cellular component=extracellular; Biological process =cell-cell signaling
gaattttgaggagtgcgaatggcaattccgttatcatcgatggaactgctcancaccacaagagctgaaggacacatttgttccaatacataagaaaggtgaatttgttaaaatttaataattaaaataaaatgtccgcgttcataatttcaataaatttaattttaatttcaaaattttataaaattaatgaacttattatgcccacttaaaggaactcgtgaagcggctttcacatatgcaattctttctgccggtgtcacacatgaaattggacgccgttgtcgtcttggctttctgcgaagttgtggctgttcagaaagtgataatgcgccaaatcgcgtgggcttttaacaaaaattgcacctaatcaaaatcatctgcatttgatagttattattctggttttaaatttatattttggcagatttaatcgaaaaactggcaaatatctaataaactcttgtgggacagaaaatttgggtactcttgaaattgggtgtgtccaaaagtgtttgactataaacgcaatcgaaaaatttcaaagaatttgcaaaaaaaaaaaatttttttttgaattttaattttatccaattattttaattaatttaatatatttctctgtgagtgtaattttaatgagcaaataatgaattttatcattgggaaaatgtgatttggcactcatgatgatgatgaagatggatattctatgtttttccacattcagcaacaaagccgtggtgttaatgaggattggacttggagtggttgtggcgataacatcgattatggctaccgattctcgcggtgagcagctgattgtgagacaattactgagtcgggattttcgcccaaactcagaaagctttcaatgaaattctcgaaaatatcttccttattatcattaggacttgtcaaatattagcaaaaaccggggattttagagaaaagtataactgaaaattctgcttttgaaaatcccaaaaatcccgggttggcgctcacaatcagcaattgtcaaaactgggattttttgccgtgctgtttgttgcccgccgccgttttccttcaaaataatttgtacggctgggagtggaaaaaatttcgccctgtttttgatatttttattttttcctgaattttttgagttttttttcgaaattcctactcaataccgaaatctcgattccgggctcaagagacaatacaatgacaaattaaatttaatgaagagcaatttaagcgatttcattgatgtacgtgaaaaggaggagagcaataagcgatccgcggaatggcatggacgatcgttgatgaaccgatggaacaacgaagttggcaggaag

SEQ ID NO: 55864 - DNA, 379 bp, Heterodera glycines
  Genomic contig location: Contig_ID=SeqID_25140; Location=57..435; Strand=-
  SCN-specific regions: Sequence locations=1-65,87-180,203-343,365-379
atggatgcaaattcatcgacagacgttgatttgcgtaaacaacattctaatggtaacggaaatgtacgtcaacaagctgaaaataatggaactgaacagcagcagaataacggcagaaatttcttacaagcgcctacatcatttcatgacgttgttttgggttattgaaccttttcaattcattttatgtttccattcctttccaggtgttcttacacaactctcccgcaaatacctcttcatcgatgcgcaaaagaaggcattgttttatttggctatggtcatcgttttatctttgctttcgcatgccatcaatttgcctagcggttatttgacgcaggttttggattttatatttaaaatatttgtaagactgtag

SEQ ID NO: 55865 - DNA, 434 bp, Heterodera glycines
  Genomic contig location: Contig_ID=SeqID_25140; Location=1038..1471; Strand=-
  SCN-specific regions: Sequence locations=1-43,77-434
atgtcactttccccaacattggacagcaacaataaaaatgaggcaaaaaccgaggaagaagaagcagcagcaaaagttgaagtcgtcatccatcaaaggcatgcatttcagggtaaattagagttaagatggtagcccctattttttggcggaaattttcaaaatttaaaaagtcgttctaaaaagtttccaggggttttcggggtgtcgttgatcaagattctggcatccatttcgtccaatttcgaatcccgaacccgatttcggacaaaaagcgaaacttcatattttttttcgaatgaaaagggtttaatgatcttttattgcaatattcgtggttttcaaaatgtttccatgtgttttaaatcatttttaggcgaaaaaacgaaatttgaagtttcgactttttatttatttatttattcgtgaataaa

SEQ ID NO: 55866 - DNA, 799 bp, Heterodera glycines
  misc_feature (618)..(618): n is a, c, g, or t
  misc_feature (667)..(668): n is a, c, g, or t
  misc_feature (681)..(681): n is a, c, g, or t
  Genomic contig location: Contig_ID=SeqID_25141; Location=292..1090; Strand=+
  SCN-specific regions: Sequence locations=1-140,170-308,332-405,428 -635,684-799
gtccaggcctggatccagatctcaagaagcctggatttttcctggacctggattttcctggattttgtccaggaaatcaaggtccaggtccaacatggaatccaggtccaggtccaggcttttttcaaaatgtcgatctctattatttttaaaattgtttaaatattaaggttcaatgaattggactataagccttggtaccacgctgaacgatggtcggaaggcaaaccgtacattttgataagaaaaagcaaaaaattttccggttattttcttcataaatatgaatattaaatagtgttgctgagttatttcgtaattataaaaaagtttcaaaaattatttaagttacttcaaaatgattatggatttattttctatcattgaattgttaaatttggttccaattatgacaattttaatttttatgaaacgatataactcatttaataagcaatgaacaatagtttaataatccatttttatcgttcttttattttaggatattcggacaataatattgaaaatgtgaacaggcgttcgctgatttatttgtcggaaaagtcatttagcacggagcataatgtcaacacatcacgcggattaatcatggaacanttagtcaaatttatgggtaaaaattatctaaataagaataaaaaaattnnaattattaatttntaggctttcgtgaagagtttctccgtgccgacgcgtcgagttatattcagccaattacagccaataaacgaccaccgggtccttcttcgccaccagttttttccaatgaacaattaat

SEQ ID NO: 55867 - DNA, 904 bp, Heterodera glycines
  Genomic contig location: Contig_ID=SeqID_25143; Location=976..1879; Strand=+
  SCN-specific regions: Sequence locations=1-13,36-186,212-365,388 -510,533-778,808-824,883-904
atggcgaaaatggagggagaagaaagtgaggaggacatgaggaggaagttgcgaatggggaggacttgccaatctgacaaatttttttatcacttaattcgatgatcagggacattcatttttttctgcccaaattctcattttctttgcattaattatgctttaattttaaatgctttcaatcatttaaattgttaaattctatttctcatttcctctcctattatctccgacacatatctcttgcaaattgacggcggtctcatccgccatatttaagccattcattctttcccatcacttctcacatcattcacttaaaaaattgtttttaatcgacaattccgcttttttgcaattctcatcaatttttaaattaaatttcttcattggaattttattgaaatttgtgttttgcaaccagcaaaccggaggttttctgagcaagtttaccgccacacaaaactaaactgcctaatttcaaattgtggcagaaaaccggttccagcctaaattatttttaattaattttgtgtcatcaaaatttcataattgttttccccttttttacaggtgaaaagtatctgacattggacaattggaaattggacgagctgaacaaattggacattggacgcactgaacatttggacatttgacattgtgtgcaccgtctcggagcgtgtctcatcgcgcaggccagtctcaattctcaagacgcgccccggacagttacacatattccttaatttttccacaatttcatattcaaaaggtttagaaaaaataattaatttgttaattttacatctattactctcctgttatatatatatttaaaagtttttatatttatgaaaaattgaatatttgttttttattgcttttggtattttaatttaaa

SEQ ID NO: 55868 - DNA, 1087 bp, Heterodera glycines; identical to SEQ ID NO: 4827
  Genomic contig location: Contig_ID=SeqID_4827; Location=1..1087; Strand=+
  SCN-specific regions: Sequence locations=1-492,515-633,655-698,720 -1001,1026-1029,1051-1064
  Gene Ontology: Mol. function=cation-transporting ATPase activity; Cellular component=integral to membrane; Biological process =aminophospholipid transport

SEQ ID NO: 55869 - DNA, 702 bp, Heterodera glycines
  Genomic contig location: Contig_ID=SeqID_4829; Location=1249..1950; Strand=-
  SCN-specific regions: Sequence locations=1-255,278-381,406-702
atgtacacgtaccaaacttcggaaattgaacgaaagctgaagcactgcggtgttcgtgcactcacagttgatgcctatcaggcacaggagtgcgatgtcatcataatagtgacaacaagatcaaaatactccgaggtgggatccggaaagacggacaacatgcacttctttgaagacgatcaacgggctactgttgctctttcaagagctcgccacgctgtcttcatcattggagacttggtctcaataagtgcaggacaagtgtggaaacgtttcatcgaaatggcgataacaagaacaagcgtagttcgagccgaatacgttttggcacttttaggacgaacactcatgaggtctccgacatgcctatttgattcggccaaaagagaatctgtggaggatgaaagctttcttgaaagctgggcgctgaagcatggtttgcgcctggaccgaacgaatgcctttgcacaacaatcgcagcagccgagagctccctcattccaattccaaaatcgccaatttcctgcactacagacgacagggtcttcagaccgtgccggtccatctggcaacggtggtgaacaaagaggtgcgcctactttggcgccacagtatggaagaggtcaaggaagacgtggcccggacaatcagtggatgcactacggtggaaacccgaaacgacagaagggtggcagacgctga

SEQ ID NO: 55870 - DNA, 340 bp, Heterodera glycines
  Genomic contig location: Contig_ID=SeqID_25144; Location=376..715; Strand=-
  SCN-specific regions: Sequence locations=1-340
atggcatatgcaacagaggtgaataggaagaaatggcacgataacattggaaatgagatggataggattggcttgggatgggatgaacagatggataagtttacgacgggattgggtcgggagaaagtagggcaatgtacattatgcacaaaatatgaaattttgaatgctgcggatacagcaattttcaaaaaatttgctagcaaaaaaattcaattgcctccatagttttctttaccaaatttggtttttcatctttgagtgttttttgccgagtagttatcatttcaacaatttttcgatcactcatttttgtttttcttttttatttgccaataaa

SEQ ID NO: 55871 - DNA, 268 bp, Heterodera glycines
  Genomic contig location: Contig_ID=SeqID_25145; Location=154..421; Strand=-
  SCN-specific regions: Sequence locations=1-268
atgctgaagcccccgtcccaagtgggcactgacaagcggcacaacgaacgtgtcgaacggcttccgttgcgcgccttcaaaaagatcggtcgcgttggcactttgcctgccctcgcgcacacttccgccgcttcggcggccattcagtcggtgatgagcagcggagaggaagcgacgacgccggcactgaccagcggagggggcgctagcagtacacggacggcgggcggaggcagcgcattccaacgatggggaggcaatcggagag

SEQ ID NO: 55872 - DNA, 999 bp, Heterodera glycines
  Genomic contig location: Contig_ID=SeqID_25146; Location=193..1191; Strand=-
  SCN-specific regions: Sequence locations=1-405,435-507,529-999
atgggctccctcaaggtggaccgacttggtgttctgatcgacttgaatggtgatttgttgtccgcctggagcaacatgaagcgcaaagggactgacgccatttcttcactgttattggcccgagtgagggcccgtttttcatcattgcctgaccaacagcagccgctttggatggtggccgaaatgctcgaaattgccaaaatgcgagtcgacacggaaagcaaacgacaaacgctggaagagccaaaagtaacggaaggaaattgcgagacgaaaaacagcccacgcaaaaaggaggacggacggatcagcagcgagttccaattgcacgaacatttcagcaaaatcactgtgcaggtggcggcgatttgcttaaaaattacgacttttttttatttgtgccagtattaattaaatttgatttaatttaaaatgactaacggttaaatttttaaaaatgacaatgaaatcggacattctatagtatgttctaaattataagaaccgtctttttattctgcttttataacttaccgtgaaccgattaagctaaaatttattgtactataagtagtaattccgcattattaagttaaagaattccttccacattttttttctgaataaaattattttctattaggacggtgcttttggtgcgccaattagctccacgagacaccaaaaacttttgcaaaaatgcaacaacatcgcctcacactcacaagcgcccacacccacaccaaatggcatgacctccttttcttcaaaagaagtgccgtcgccagcggtggtgccaatagcaaatgcaatggtaaaactcggaaaagccattgaaacggtggagagcagcaaaggcattcaaccgacgcagcagcaaaagcaatcgttcgaagggattgtgatgtttacacacacaaaaggggatgagatgtattggttgttctacgacgaacagacgaggcgcttcacgcgaatggcatctgcaaaaggcagcaa

SEQ ID NO: 55873 - DNA, 528 bp, Heterodera glycines
  Genomic contig location: Contig_ID=SeqID_25147; Location=10..537; Strand=-
  SCN-specific regions: Sequence locations=1-176,198-483,505-528
gctgtcgtccgtccttcacgtccttcgggcccgaccaaaccactcaaatcaaccgcagtgagcacagcgtggcgctttttccaataatttttgcatttgtttgattgcccccatcataagatctctccggtgggccttccgcatccgaaaaagggcgttagcgcgggaatagtgagttttgttttgcgcttttcctttttaaattcctattattaatacgtttcaggatgttccaacttctctgtattcagcggacccaattgattgtgcaaaaacaaccaaagggagaaaagtgcgttgtttcttgtttttcgtcttgtcttcatatttgcttccgcttccttaattaaggctgtttcgcgtcctccgccgccgtcatcgggcaaaaaagcggatgcaaaaaccaaagtgagattcactgacgaagattctttttgccgttgttgttttcgaatccacgaactttttttctttaaggctgtctctcgtcctccaccaccaccggccaagaaaacagataaaggcaaa

SEQ ID NO: 55874 - DNA, 271 bp, Heterodera glycines
  Genomic contig location: Contig_ID=SeqID_25149; Location=1093..1363; Strand=+
  SCN-specific regions: Sequence locations=1-158,181-271
atgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcgggttgttttttgcataattaattcataaatatttttttcagaaagggttctgaaacgcaccaaattttatttacatgttagtttaggcactctgatgctttttctatcaaaaagggagatga

SEQ ID NO: 55875 - DNA, 735 bp, Heterodera glycines
  Genomic contig location: Contig_ID=SeqID_25150; Location=109..843; Strand=-
  SCN-specific regions: Sequence locations=1-735
atgagtttcccagcagagcagaactgtactctcccgactgagacgcagccaatcatgaacaaatcaattctctacatacccatacgaattccgcgttcatttccagtattcaaatgctggaatgttacgacagtggcatgtaccgaatcattcttacgcgtggttactcttgatcatccgccgaagaaattcgaatcggaaacatcactggacgattgtcaaaattctttaaattatcgtccaatgaacagaataagcgagaagcgctgggaaagttttaaatcaattaggaaggagtacggctggtacggagtgaactgttataacaatgtccaaacagttatcgaagaagggaacggaggaattttagacggggaaatgctcgtcacatcatggggggattccctaaaaatcgaacaattcacgatcggaaaggatgattgggttcgcctgccaggagcagttgaacttttgatgtggcgcattccctcgggagaatattgggacacgcatttctctatgggaccagtaacaactgagacatggcccggacaggccatagtagtccacgaacttcagtacacatttccgataagtaaagatcaagacagaaaaaaccaagtgattggagtaccaagagaagcaataaaatcgcaaaataatgtcttaaatcactacgttggagaggtcgaaagaggacaaatctcaagtgaaacaacgcaattccaccaataa

SEQ ID NO: 55876 - DNA, 1376 bp, Heterodera glycines
  Genomic contig location: Contig_ID=SeqID_25151; Location=1..1376; Strand=+
  SCN-specific regions: Sequence locations=1-747,770-923,945-1172,1194 -1292,1314-1376
  Gene Ontology: Mol. function=ubiquitin conjugating enzyme activity; Cellular component=endoplasmic reticulum; Biological process =establishment and/or maintenance of chromatin architecture
tgggcccgccaaattcgccataaaaatgtttcatccatgcgcgaattttttgatcgttactttggttcagcgagggcggtaacttccgtggaaaactccctttccctaaagactatccgctgaggccgccgacgatgcgatttgcgtcgaggatagtgcacccgaacagtgagcggactaccgaatgaatggattgacggcattggtgacattaaaacttgtcctcaacatttagttgaccgagacgggaatgtgtgcatttcgattcttcatggtattttcatctttttgtggggcggtggcggtggacaaatgttccattaaatgccgcagtttggttgagagtgccaaatataatcgatcaaatagcgtatttgaaaaggcaatcaacataaacattgacttgtaacttctttattgccattttcaagaaaaatacactaatttttcaaatcattcctttaccattgtttttgggttatgagtttggactttcgattctttcgtgatcatatttccaaccatttcccatgcctctactaatccctccaattgtcccattttttttacaattctggcccggttcggttgtcaagcattttctctttagagcctggcgatgaccgatttggctacgaaaaggcgtccgagcgttggctgcccgtccacacgggtcaatcgatacgaaaacattgcgaattgccaaaaatcgtttcttttcagttgagaccattctgatttcggtcatttcgatgctttccgacccgaactttgacagtccggcaaatgttgacgcagcggtaagcgaaggcggggagagacgatagatattttcaaattatgcaggaaaatagagaacatttagggcaatagaatgatttcaaatccattcaattcgggcacacttgaaaggagttatacccaaaaacggggccgacgcccaattgtcctttttcgaccccccaacctccgaatttttttaaaattcttattttactatgtttttttggcaaaattccctgagagttttttttttaatttcgactagaggaaacgatgcggggacggcagggggggaactgtttctctttttagggacggaacaaaaagcgcgagtctcttaatgaaaatatcgaattacagatttttagcgcattttaggattgatgcgataaataattttaaactgatattgacgtacgctaaaaacaaatacttcagaaaacgcaccgcgagaatccgacggagtacaggcgtcaggtgtttattcatttcatttttcctaaatactcgtacaaaatgtttcatgaaaattgttcctttttgttgttcaggtcgcgcggtgtgtgcgggaaacggaagagcaataggcaaat

SEQ ID NO: 55877 - DNA, 420 bp, Heterodera glycines
  Genomic contig location: Contig_ID=SeqID_25153; Location=207..626; Strand=-
  SCN-specific regions: Sequence locations=1-44,80-187,209-420
atggtctttaaatctttaaaatttagaagtcgtcggcattttacaagtgatgtcctgaggaatttgtatgtgaatgtgaaagctcgcgtaaaagaggacattcggaaaacagacttcatttctcttacaatcgatggctggagttctcacgaaggaaaacattcgttattaagtgtcacagttcattacattggcagtaatatggaaccgacttttcgcgtgatggaagcagttccaattaaggttcggttaaggggtttttacttaacaattttgcagacatttagggcagtcatactggcgaaaaaatgtgtggtttgctgagccaagttcttaatgattatggtgtgaacgctgaaaaagtgcaccttattgttcgtgacaacgaaagtgcaatgcaaaaagcgactcgtattgctg

SEQ ID NO: 55878 - DNA, 414 bp, Heterodera glycines
  Genomic contig location: Contig_ID=SeqID_25153; Location=748..1161; Strand=-
  SCN-specific regions: Sequence locations=1-15,41-414
atgccaccacaaagcaaatatattaaatattttaaaatttctcatggaacagcgaaatgtttgagctgtagttattcttacggctcaaagtctacaacttttccgaagacgtgtctacgagaacatttgcagcgacatcatccggacaaatatgaagaattgttgaaggaagaggaaaaagcaaaagtgaaaccaaatggccaacaatcaattcaaagtcttttgttggcaagtacaagtactgctcgcttgtgcttgagcccaacacctgccaaaatgccaagaaatgagtcgccgttctcttcttcacagccaaaaatcgtcaaaagcttttgtaattatttggatatttcaaaatttcaaagtcgattaagcacaatggagttcggatggagaaatgacaaaaagggttga

SEQ ID NO: 55879 - DNA, 500 bp, Heterodera glycines
  Genomic contig location: Contig_ID=SeqID_4830; Location=146..645; Strand=-
  SCN-specific regions: Sequence locations=1-3,43-136,197-282,388-436
atgatttatttaaaaataaattttttatttacttttttatttgtcaatctttgttttgtcattgccatggataacgacgaactcacaaaattagtgaaatcttcgaacaaagcgacaaagaataaacaaaaagtggtaaaaaaaattaacaaaaatttttgaaaatttaattttttaaattaaattttattaattagacaacagctagtcaatcaaatgacagtgattcttccaaaagatcaacgcagaacattgatcaactgacgacggctatttgtcttgaattttttttattaaaatattaattataaaaacaaaccgaaaaatgataaatttaattaaaaaataaataaatttaggaaaaagagaataattaaaataaaattattctcttaaagtaatttccagaaccatgtgatcctttaagagtaccatgaaaaaaaaatttttttttttaagattgttaaaataataattttataaaaatataatttaataaa

SEQ ID NO: 55880 - DNA, 1556 bp, Heterodera glycines
  Genomic contig location: Contig_ID=SeqID_4831; Location=487..2042; Strand=+
  SCN-specific regions: Sequence locations=1-113,349-453,499-522,590 -597,625-645,668-893,915-1356,1378-1474,1496-1556
atgaaaggatttatcagccatcatcctggtgtgccaccacgtgaacttttggcgatcaactgctcggatgaaaagggggaaaatgtgtgctacggggccaaatgcgttgaaggttaaaaattgttttaataaaaattgatattaaatataaaatttaatatgaaaatattttaataatgaattatttgatttaattgtttgaatatttagtaaaaatttatattagtattaaattcgatgctgaaaataatttaaaaattgatgtcgatattaaatgatatggagaaattttattatttattatatagtgatattttaattaaaaaatatattcattattattttaaagacaagaatggacaggagaacaatgccaccatttacgtatacgattgtgaggctgatcgtaatccgtgccatctgcccaacggaattgaaccgtaaattatcgtcaaaaatttttgaatttgaatttaaaaattttaatgaaatttaaaaggtgggaaatttttaactccattcaataaaaaaaattttttaatttttttttcaaatattcatttttaacgaataaataaaaaataatttacatacgcattaatatttttatacttttaaaatcccattaattattttaggtggattagcagcgaaacggggctgaaatggcactgtcagtgcatgatttgcaagggcacggacaaatgcaatgaaaatttcttcccaaatgaaacaatcaaagatttgctgccgccatgccatggacaggaaaacagaaccaaccgaacgaatttttcttcatggctgagtgatgaaccggcaaaagatgagaatggcattgtgagttggcaactgttgcgcaaatgaaaagggtattattggcactatgtattgataggtgggacaaaacggcacaaccaatgacggtacaaccgatgaaggcacaaccgatgacggcacaaatgtgacggatgggacagaaactagcacaacttctacaccggaaagcatcaccattccgactgttgagcaaaaacctagccaccctcttagcacggtaggcaataaaaatttggcgttttttttcgtcagtaattcaaaaacccaccatttaagactgaacaaagcaacaacacgtcccagaagtctgagcaaaaacggaaaagtaaatttgtttgaacaaaaacacggaatatttgggaatgtccaagaacgcgctgcggatgagccgaacggaactggcactgatcagggaaaggagcaacagcatggcgctgaacatggacatgaatcattggaaagcagcattgatcagggagctgcgcagaaggaaaacggaatcgatcaggcaaaagaatccttaattaaaaataaatgatcagagtgtacagcaggcaactggagctaagccggatgccattgaccagggcaatgatcaaggctctgaacagaagctgagaggcgctgaacatggacctgaaaagatgcaaaacaacgttgatcagggagctgtgcccaagcaaaacggcactgatcaggcaaaagaatcataataa

SEQ ID NO: 55881 - DNA, 899 bp, Heterodera glycines
  Genomic contig location: Contig_ID=SeqID_4832; Location=937..1835; Strand=+
  SCN-specific regions: Sequence locations=1-26,48-75,114-338,361 -370,399-480,633-671,695-805,827-899
atgcgttattcaacatctttttttgcttttatttttattatttttatccaacatattcaatgttagtggagaaagttaaaaaattaaatgcttattttaaaattattttaaatgttcttactaatggtaattaagaaaaccaattaaaaaaattatctcatttgtgtgctaactttgttattaaggttttcctccgacaaatgaccgaagtccctcagcttctccttggcgcttaataaaatttctttcgcgagcattcagtcacgaaaaacatggaagtaagtgttaaaaaataattcattttaagccaataaataacctggatttagtcaattacatattttttaggatttaaaatatttaagttgacttaaaaaatatatttagatatttatttaggttcatcatcaacaccgacttcaaatgctgcaaatccagctcgggcttctagtgctccagttcaagccccaactccaagtcctgcagttgcagctcaagcttcaactgctgcagttccagcttcaagtgctgctgttccagcttcaactgctgcagttccagcttcaagtgctgctgttccagcttcaactgctgcagttccagcttcaagtgctgctgttccagcttctacttcaagtggtacaacagttcagcaaaattctgcgtcaatcaaaggaaaagaaattgatgaagcacagagttcgccggaatgctcaatttgtcttgagaaacttaatgaaggcaatcagtctgaagcattgccttgtgccgtgagtatctttttaatagacaatttagtatcttgaataattttttttaaattttagcacgtgtttcatcagcactgtttgtctaaatggtatttagcgtttagctttatgagtttgtcaatggcatga

SEQ ID NO: 55882 - DNA, 353 bp, Heterodera glycines
  Genomic contig location: Contig_ID=SeqID_4834; Location=444..796; Strand=-
  SCN-specific regions: Sequence locations=1-75,97-199,234-290,312-353
atggcccaaaaaaaaattttggtactcgttgaagcttgtcagtttgagaatgaatatttaattgaatatttgaccaaaaatcaaattttcataattgttgatgcatcatttccaaaacaacagtccagcgatgatgaacaaaatgttagcaatgaaaagcagcatgatgaaggtgaaaaagtagcaaaaggtaaagccgtaaatttttaatatttattaattaaattttatttgattacagtaatcgctaaaagatagccgccgagggctttatttttcatcccctgaaacggggggattttatttcagggggagctctaatttatcaagggggggggggggatcctaataaa

SEQ ID NO: 55883 - DNA, 80 bp, Heterodera glycines; identical to SEQ ID NO: 51817
  Genomic contig location: Contig_ID=SeqID_4834; Location=162..241; Strand=+
  SCN-specific regions: Sequence locations=69-80

SEQ ID NO: 55884 - DNA, 993 bp, Heterodera glycines
  Genomic contig location: Contig_ID=SeqID_25155; Location=93..1085; Strand=-
  SCN-specific regions: Sequence locations=1-257,282-469,500-627,650-993
  Gene Ontology: Cellular component=integral to plasma membrane; Biological process=transport
atgacacccatgcctgtcactttctgcttcataaatcagcaaaatatgaatgtgtgcaccactggcttcccaatgggttgttatgtgacaaaggaggggaagcccaaagatgcctgcgttttggatgtaactatttcttcgagtattcttttggttctattgactacatatttttagggacgttaccgacagcaggacagtttttacctgttcaaccacgtagatattaagattgagtacaggttgtgtctaatacaattatactttaaataaaatttcctcgaacagagacatgtctgatgatccaaatttcctcgatgagaaaattggtggccgtataattcggatcaaagtgcagccaagaaggtggaaatttttaaattgcgagggattatcggctctattgcagtttacacgatcataaaataatttgacaactttaagctaacatttagatgttttttctaggaaaaatattaaatttatttttcaataaaaacctctaacaataagaatgatatgaagctagaaaattaacggttttttatccgaggggcacagatgcgagggagggggagaattactcccgaattttggctagattaagtacctgatttttggatatatttcattcttaatttttattttagcatcaaacatgaaagcaaaggtggaatgaattgcggaatggaagccgctccccagcccattggagcgggagaaaaggagttcaaagtgatttactcgtattcaattgtttgggaaccaactgatgtgaaatggtcttcccgttgggactatattctcgactcaatgcctcatacaaacattcaatggttttccattatgaactcactcgtcatcgtcattttcctttccgggatggtgattttttcattttttttttctctatcatttccattaaaggttggaatgattctcctcagaactctccatcgtgatattgctcgctacaaccgtcttgacgaagag

SEQ ID NO: 55885 - DNA, 797 bp, Heterodera glycines
  Genomic contig location: Contig_ID=SeqID_25157; Location=331..1127; Strand=-
  SCN-specific regions: Sequence locations=1-68,100-111,133-205,227 -326,376-623,653-701,737-797
atgactcatattcacaaaaaggaaaggtgagtttctaattcactttttaatgtgattttttaattcactttttaattatgaattttaaattttttatttcatttatcgtgtaaagcaaaagtgtactgtaatgtacaataagtaaagcaaaggtgtactgtgattgacgtaaaatgcgatgaaaattgtattaaaaatgaaagtgtaaataaaattataaaataatccattttcattttgttcttctaatttgcaattttctcttatcaattctctttttttattctttgagctctatctatcgccttactaatttgtgcttttgctttaattatttatttatagaattttaaatagtaatttaataaaaaaaaagtcaaaagtttttacccctgggcctttattagaatatgctcaagcatgtgaaaatctcacaaaaaaattaattaatatgaatgatgtgtttggctccacattactttagttgatgtatcgcctcgattcaattctttttggcataaattacacagattttgtctaaagaatgaccaaatttaaggattataaattatgccagaatagtcaatttttatgggtgtttttgtcaattaatccagggtttctatctcaaaattttcaaaataacaaaggccaaaaaataagactatggttaaaaataagaacattttgcaaaattgcttcaaatatttttacattttattcaaccaaaaatgtattctattattatatatatcataaatttcagagcattcgggatcactaaatcagatttttaa

SEQ ID NO: 55886 - DNA, 351 bp, Heterodera glycines
  Genomic contig location: Contig_ID=SeqID_25157; Location=1392..1742; Strand=+
  SCN-specific regions: Sequence locations=1-122,144-351
atgtcagttccatcaaatcccctgccggatcagtccgcctccattggcaatctgagcattgggccgggtgcaaaatacgcagaaattgtcgatggcagcggcggttccgcactgaatctgttgctgttgatcacactggccaagtcgatcagttccgcgggcaaagtgtcaaaactgagtgacaccgtactccgcatggactacgagcaccgtaaccgacccgtgcagctgacggtcaattgggacgcggtgacgcacgacaaattggacttttaccacttccattggacaaagccggaggacgaagtgttggatcatttggaggtcgaagcattcattttcattttgtaa

SEQ ID NO: 55887 - DNA, 640 bp, Heterodera glycines
  Genomic contig location: Contig_ID=SeqID_25158; Location=214..853; Strand=-
  SCN-specific regions: Sequence locations=1-81,142-425,447-640
atgtcttttaaacgcgtgaactccttccaacccgccgtcccattggccaaaaaatgggatttccgatcaatcgggtaagtgatttttaataaattaaataaaaaaaaataatttcttaaacaattataaatacaattataagataataccctttaagaattatttcaaaaaaattttttttgttcagaaataattttgctgaagaaatggaaaattataaattgatggattaccaatcgacaacttgcgaaaaatttggatttacgaaaaatattacggaatttcgtgtcaacccggatgtggagcgccccgatgaagcgatgaaggacgcaatcgacaacatgataaaggtggctttaaaaactacggaagaaaaaatgaagcgaaaagtgcggatgtttggagtggcaattacgggtgctgggcttgcttcccctgtttgggtgccgtatcgggcgtacccccagaataatgcggatgttatcatgcaggagattaataagctggggcagagcggggacggggatgaaaatgcttttccgattactatgaaaattacatgcgttacaatgcccagtggagaggggccgaggaatgtccacaaatttgactttggattcaaggaacaccagcggatagg

SEQ ID NO: 55888 - DNA, 825 bp, Heterodera glycines
  Genomic contig location: Contig_ID=SeqID_25159; Location=1..825; Strand=-
  SCN-specific regions: Sequence locations=1-578,659-825
cacatttatggcccaatttttcagctccgttctgtgcgtcacgccttttttggtgttggccatcggtgttgacgatgcctatctgatgatggcatgtttttcgtttttggcacaaatcgctttaaaattcgttgattaatcgattgatcgatcactttttgaagcatgcttggcaacggatcactgatcagatgcgacgaaagcgcaaactgatgctatcggcaacatcagcagatgcagcaagcggcggatcaacagccgggggagaggagcaaacattgctcagccaacgattggcattggtaatgattaatcaaaagtgcggcagggtattcgagatcgaaattctcgagactcatggaccgacatttgatcccaggacagcgacaagagattgagcgcctaaaataataagaaactctcgagagtcgaaaccaatatttggtcacaggatggttccaaaactggggattgagtcccgaaaaaatcagaaattctcggaaccggtatttggtcttatgacccgactcgagactcttggatagaaagtctatcctatcatttgagagagcggattcaattttaaataaatttatatttaaatttatttcgtttttaatttaatttaacaaaaataaaaaaaataaatttaattattgtgcccaaggtgctggtcgagactgggccggccgtgctgatctcggcactgacaaacatttgcgcggatgcggtcggctcgttcaccggatcacccgaaatcacgctgctctgtgttggcaacatggccgccattgctgtggacttcatctaccagatcacttttta

SEQ ID NO: 55889 - DNA, 783 bp, Heterodera glycines
  Genomic contig location: Contig_ID=SeqID_25160; Location=391..1173; Strand=+
  SCN-specific regions: Sequence locations=1-355,378-382,405-783
atgcacgcgttttgcgctcgagctatttatcatcgggcttgtcaatccaaagcgaaacaacaaagatgctgttttgaacgaataaagggcataggttattttgaagaagtgtcaaagaacatgcagcaataagcctgcaaaatctaataagtggaaaatacatgagtatagaatttattttcagaaagtgtcaacagacttttggaaaaatatatttgcaatttatcaacaattttgagaagtgagttagaaatgataaacttcacgattcaaaccaattttcgttgctctaattaaccgcgataaaaacattcgaatcaattaaatagcttctgagataataaggtttatcataaaatttcatttaaaaataaaccctcaattattggtatgaacgatactttccaaacatgcacgcgttttgcgctcgagctatttatcatcgggcttgtcaatccaaagcgaaacaacaaagatgctgttttgaacgaataaagggcataggttattttgaagaagtgtcaaagaacatgcagcaataagcctgcaaaatctaataagtggaaaatacatgagtatagaatttattttcagaaagtgtccacagacttttggaaaaatatatttgcaatttatccacaattttgagaagtgaggttagaaatgataaacttcacgattccaaccaatttttcgtgctctaattaaccgcgataaaaacattcgaatcaattaaatagcttctgagataataagggttattcataaaatttcattttaaaa

SEQ ID NO: 55890 - DNA, 697 bp, Heterodera glycines
  Genomic contig location: Contig_ID=SeqID_25162; Location=859..1555; Strand=+
  SCN-specific regions: Sequence locations=1-206,229-622,644-672,695-697
agcaacgaatacataaatacatcagttcgatgtctacaaatgatgttacgaaaggaaaagtatcgacgaaaattcgttgagtatgacggcgttaaaagcattcttttggcattgaatggtcgtgccaattttcaacttcaataccaactcattttttgcctttggtcggttgggttttttcgcacttttaactcaaaaataatcctggaaaaagtttgttaatttaatttccccatttccttccgaaatttgttggagaaaattgacaacagagagatggtgcgcgaatcggcactgcaaatggtccaatgcaaaacgctgaaaacccttgaattgatggacgccaaaaagtttgacgacccggacttggtgagagactgcataacttttggcaattttggatgggaaattaaatcaaattcaggtggacgacattgaatgataaagtggattattactttttataaagcttataaataacaaacaaattctcagaatactcatcaaaattctcgagaccagcagcgacccattgccgctcagtgttgctgctcatgacattggcgaatacgtccggcattaccatcgcggaaaaacgtttatcctaccgcaaaatttcagaataacaaaacaatttcattttatttataattgtcgaacaatacccaagcaaacaaacaatgatgaagatgttgag

SEQ ID NO: 55891 - DNA, 820 bp, Heterodera glycines
  Genomic contig location: Contig_ID=SeqID_25163; Location=772..1591; Strand=+
  SCN-specific regions: Sequence locations=1-89,111-126,174-398,420 -423,446-820
atggaattaggcttacaaagccttgaaaaaagtatatatgaaaaaagaaaaacatttgaaagtgatccgaacttatttgaggatttgaagaaaattgttgagccaattttggaactgcacaaaggcaatttttataattttttaaattcaattagtaaattttttttaatttactggtaataaatacctatttcatgtttttagtcgcaatccatggcgacataaaaccggataactttatgtatgtcaaaaaagtgggcgaaaacgaaactctgaaactgatcgattatgacggtgccactttcataccagttgggctatttgaaaacccgagaagactggcaaataaagttgtgccacgtgagttttatgtggccaccccaacttatgcagcaatcgaatattatgaggagaatatgatggtaaaaatgaattataaacaattaaaatgccttttcaaataaacattgattaaaccattaaagctcacaactaaaatggacatgtgggcacttggaataataatttacgaactcatattagtacaagcgaccttcaatgagcgaattagcatggtaggttttaaaatgctaattagtaaacaattaaaattaaaattaatgggatcaagggaaaaatcacgcaaatactgctgggaattggcaacatttacttgggcatgcaaagaaacagcagaggaataaaactaacggaagaaagtttatttgaaaatgactcgtgggcgaaaaataattgcgcaagtttattgaccattttgaatgtgtggcaaaagtacccgaaaactgcccttataataacg

SEQ ID NO: 55892 - DNA, 88 bp, Heterodera glycines
  Genomic contig location: Contig_ID=SeqID_4835; Location=37..124; Strand=-
  SCN-specific regions: Sequence locations=1-88
atgctgatcaaaaaaggtagcaacaccaagttgatcagatcactccttcatggtgatctgatcagcccattttggctgggaacgaggg

SEQ ID NO: 55893 - DNA, 613 bp, Heterodera glycines
  Genomic contig location: Contig_ID=SeqID_4835; Location=314..926; Strand=+
  SCN-specific regions: Sequence locations=1-174,196-223,245-613
agaaatataaaacatatatacacaatatagtcatattgagattttataatcaatttaaattaaatttggtagaaaattttgagtgttcctaaacatatgaccatgactgtatcatctttttcaattctaaggtcgtttttgtcgcattttgtgctgattggtgtccttttagtagaaaattgaagccagtttttgaaggtgggatttgttgatttgataaatcaaattaattttaaaatttttagaagcagcaatcaaatggcacgataataacccaaacacgtaatgtctcgcttatcatttggattcgttttttagtatgataatttatattttagcagtgtcgtttgggctttcgttgattcagtgaaacaagcggatgttgcggataaatattttgtgaataaatacccaacaatgaaggcatgttaagcattaccagaattggtgcattagtccaatgtttaggtttttattaacggtgagttgatcaaaaatgaatacaggtattcaacatgaaattaatgattcaaaaaatacttaaattcgttaggagtacgagatcagtggaggcgttgacagattttgtcaagaaacagctcgaggtcagcat

SEQ ID NO: 55894 - DNA, 2251 bp, Heterodera glycines
  Genomic contig location: Contig_ID=SeqID_4836; Location=167..2417; Strand=+
  SCN-specific regions: Sequence locations=1-558,602-1075,1097 -1145,1169-1204,1226-1262,1300-1539,1562-1742,1770-1996,2019-2251
atggatatgcattctggagaattgcacaaaaaattccatgaaactttggacgagaaaattgcagagctgcagaaaaaagcgttggagcagctcgatgcggaatttggagaagcaccggccggtagcaacagtggcgaagggcgggcgcctgcggcgatgccgaaagtggacacaacgccagtgccatccattttcaaggaactcaaaccatcggttggttgttcattaatccaatcattgtgattggaaaagaccaatttccttttgtttcaaggagaagcgttatactattctgcaaaagacggaattgtgacacttttggcactgtgataatggactaatcaattggacactaattgctcgctttcctccttttttcgcagcttgggtattcaactcgatttaattcgttcaaattttctagtttttattttttacttttttattgttaaaaagttcggttccggttcattgtcagtggcacttattatttatatttattgttcaatgtgattgtgaggcataatgttgttaaattaaaatgtgaaatgatgaagcaaaaaaaattatttatttgttttattttttcattattttttaacttgtggtcaaagttttagaaagtatgccctctcggcatgctcctaaagcgaaacaagttggccttgctgacaatgaggatcatcagccactgaatcggcagcaatcactgtcgccgaaggatgaacaattacaacaaactcaacagttaatggaccgaatttcggacaaggtaatgttaaggtgcgcaattcacaaattcaggttgtatttaatatgttttaagctcgagcgtgtccagccaaagcatcaaaaggtcgccgagtccattcgtgcaattcgttctcagggcgttcgtctgatgggccctggttccaaaatgagtcaaaacgtcaaggcaaaaatggtcgcattgtatcaaacagctcaaaaacagtgcgagtcggaacattcgtatttggaacaagttttggctgatatccaagtaagttgctcatggtatttttaataaattaacatggcgtgacatttgactaggttttcaaaaaatcaggggattgaatatatttgttatatagattctcttttattttccctggatatatgaaattttttaaatctcaaattttataagtaaaaaaaaatcaaaccctatctaaagccgtaatttaaaaaataaagaagtaagcagcaaatgggggaatttgttgaaaatgctttaatcaaatggctaacatttaaaaaatgcttttaaatttctttttggcagcgtgtgcggcagcttcatttgagacagcgaatggccgacaaactttcgcgtggttctctaatggttcttctggcccaacatgctgccggactccccctttacatcggatccatcgacggtcatccaccgccactcgtaatttattttcttattcatttactttcctgtttatcttctttgactcatttttaattgaaaaccaaagtttttggacctaattgtaacattggttttcccttttggcttttcaggttggcgccattccacaaaatccaggcgattgcatttcggaaggtgagtttgtcgctgcttttgttgaagaaatctggattctggctgaagttagggtacaatttcagttttcgcctttatctaaagcatatttaatttggtctcagaagcaaatctccgccagcaaatacgaggtgaaggacgtggatgatgatgacgatgatggtgagaagctgcaagttgtgcctccaactcgtctgattccgctgccccattttcgtgccgatccgaggcgccatgcccacgctcttttccccgtcggtgccattgtccttgccctttacccccagacgacctgtttctacaaaggcattgtggagagttctccgacgggtccaaacgatgattatatgtgagtccacaaattgtcattttgagaaatatcattttaacactttgttttaggattgcatttgaagataacacttttccgtccgggtattcgccaactttgccagttccgcaactttatgtgttaacgcattgtgaagtgacgccgcagcaccgaaagcgcaaaaaatccccattatccgatttgactgatgaagcatcgtcagactgatgacacccatattttgattcgttctcaacttcccacttttatcttccattgccaaattgtcccttttacaatatggaactataatttaa

SEQ ID NO: 55895 - DNA, 1759 bp, Heterodera glycines
  Genomic contig location: Contig_ID=SeqID_4836; Location=3600..5358; Strand=-
  SCN-specific regions: Sequence locations=1-100,122-137,159-613,636 -703,733-879,901-1239,1261-1628,1652-1759
ttcaaccggacaaggagattcatgatttggtatcaagcattttcggaccatggaattacgccaccagaaaatcgaagcgtcaactctattggatgccaaaactcaaacacacaaacaagtgggatggaaattaaaacattttattttatcttttctttggttttaaaggtatttggaccgaagggtcgtggaacacaaaaagttggagggcgtggaattggcacagatagcgctgaaaatgatgtgccgagattcgggaacacaaatatcaagtttcaaagtgagtcgtacaaatgtcagattaatactgactagtaatttactccaggcatatttcgctgaaaaagggcccgaacatcacaattggattgtgagcgggcaaagtccgctgcagaagaggataattgccaatttgccggaccaaagcacttgccacgtggatgggccgagccgagtttgggtccaggatcacatggcaagttgtggtgatatatagggctgggacttttaatgacgaaaaatctcgaaataattaactaaaatagtgaataaaaatgccaaaatagtggcaaaaagtccaaaatagtgacgaatagtgacataattttcagccaaaaattgagcaaaaataatttttattcactgattgcattccaaatgagtagggctgggatttttaagggcaaaaaaacaaaataggtacataaaaaaataatttttaaaattaaaattcttgccacgaaaatacctctttgagaaaatttttttcatttcttaggagtgctttttgaatttttttgtcgattcttaggtgtgtattttttggttttattgcatttttgttaaggaatttcccaaaaaatgtcgaaatagtgacaaaactccaaaatagtgatttttaactattttagtgacgaagtagccaaaatagtggtttctagtgacagatagtgacatcagaatcgaaaaatttaaatctaggtcagttttgtttttttcttatcgggtcgtcgagtccatttacataatttttttatctttttattatctgttgaaaacaccttacactttttaaaaaattattccggttgaaaatattatgagaatttaaatttttatcaaccctgaaactggttccggtcacggcaatttggaaattgggtttgaccagcaggccggacccggaaaccagctgcttttgaatatgtcaacccggcccggatgatttgaaaatctcggtttctgttttagcaactgttagtatgttggtcgcattaaacagcctcactctgcatttttgaattaagtctcatttttcattttctctcttattttatacatttttttcaatattttttccatcaataattttttctcattgtcagttgaattacgtcgttttgagcagtgctgcatcggttgagcgggacgaggaaataaccgaattggtcaaagcgaattattattatttattcgcggaattcggacgtttaacttttattttcttttttagtgtgtttcttctcacaaaatcttcaccgaggatgagcttcacaaaaggctgtgggaaggccattccgattaccgcacgaatttgcaccaacagtccgaccaaaccattctcgcgatggccatttttggggtgaattccaacgacttcgcttcttcttggctgaatcacttgcaagaggacaacccgcggctcggccaactcagtgttttgatcagactgaaggaattgagacggagtttggaaaaa

SEQ ID NO: 55896 - DNA, 405 bp, Heterodera glycines
  Genomic contig location: Contig_ID=SeqID_4837; Location=93..497; Strand=-
  SCN-specific regions: Sequence locations=1-19,41-405
atgtttattcgtgcacaaagtctgtcagaaagtgtttttcctttggttcgttccttcgcttcctcgtcaagcagtgctgatggttttaggaatacttataatccaagacagccgataatatggaaagaaaacttccgcaaaatgccaagaaatgagaagaccaaagaagcctttttgaagcaaatcggtcggttctttcactgaatcatgtctttataattttacaaaggaattttagaaatatttcaaaaatcgcgcggaaagagaggcgttggacacgtcgagtttattgaggcagcactgaaaaacatcaaagaatataatcttcacaaggaccttgacatttacaaggcgttgctcaatattttcccaaaaggcgatttgctaccgacgaatataattcag

SEQ ID NO: 55897 - DNA, 312 bp, Heterodera glycines
  Genomic contig location: Contig_ID=SeqID_4837; Location=1234..1545; Strand=+
  SCN-specific regions: Sequence locations=1-63,115-312
atgtacaagcaaagaaaggcaataaaaattgcaaacctaaatgctatgtacaaattttcttccaaatttatattatataaatttaatttaagttatattatatatctatatataggtattttatatggttaacaacgagaaaatctgtcacgagtttcgtgacaaatgcagggttgactcagtcgtacggtgttcggggagatgtgacatcgaattgggagaggtgaccaagcacaatgtcatggtgatttttcattttcaaatatgaatttttttttttgttaaacagtcttaatctatcaaatttagcaa

SEQ ID NO: 55898 - DNA, 832 bp, Heterodera glycines
  Genomic contig location: Contig_ID=SeqID_25164; Location=197..1028; Strand=-
  SCN-specific regions: Sequence locations=1-519,541-672,699-781,824-832
aaaaaaaaaaattgatttttttcaagttttccgtttgggggttcctcaaccaattttaggggaaccaaaaatccaacgccagaattaaagttcaggcttttagggaagttattcccgaaggattcggtctccccataaatttggggcgcatcggttcgggggggactcccccgaaaacaaaaaaaatcgatttttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagact

SEQ ID NO: 55899 - DNA, 860 bp, Heterodera glycines
  Genomic contig location: Contig_ID=SeqID_25171; Location=15..874; Strand=+
  SCN-specific regions: Sequence locations=1-159,182-278,301-338,361 -427,450-517,539-860
atgactcaaccctccaacattcaattattgggactccacccaccagcattccaatctctgggactcaacccacagcatttcaatcactctgcgactcaatccacagcatttcaatcgccgggactcatgcaaccagcattccaatcactgggactcaacccaccagcattccaatcactgggactcaacccaccaacattccaatcaacaggactcaaccctccagcattcaatcaacaggactcaacccaccatcgttccaatcaccgggactcaacccaccagcattccaatcactgggactcaatccatcatcgttccaatcgccgggactcaacccaccagcattccaatcactgggactcaacccatagcatttcaatcgccaggactcaagcaaccatcgttccaatcgccgggactcaacccaccagcattccaatcactgggactcaaccctccagcattccaatcgccgggactcaacccaccagcattcaaatcactgggactcaacccacagcatttcaatcaaaaggactcaatccaccgcattcaatcactgggactcaacccaccaacattccaatcactgggacccaatccaccaacattccaatcagtgggactcaacccaccaacattccaatcaacaggactcaaccctccagcattcaatcactgggactcaacccaccaacattccaatcaacaggactcaactctccagcatttcaatcagtgggactcaatccaccaacattccaatcaacaggactcaaccctccagcattcaatcactgggactcaacccaccaacattccaatcaacaggactcaaccctccagcatttcaatca

SEQ ID NO: 55900 - DNA, 1142 bp, Heterodera glycines
  Genomic contig location: Contig_ID=SeqID_25172; Location=207..1348; Strand=-
  SCN-specific regions: Sequence locations=1-30,57-693,715-829,851 -982,1009-1091,1134-1142
accaaaagcaaaacgatataaccaaaatataaggaaaaccttcccaaaaaattttttctccatcttcctttttgatactaacagcatcagagtgctaaaattaagttgtaaataaaatttggtgcgctttagagcactttctgaaaaaaatatttatgaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttgttgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagact

SEQ ID NO: 55901 - DNA, 501 bp, Heterodera glycines
  Genomic contig location: Contig_ID=SeqID_4838; Location=250..750; Strand=+
  SCN-specific regions: Sequence locations=1-501
atgacttgctgttcggacgagcgtcaggcggacgcggacgttggcgaccacttctcgcgctgctgtttcgaacattttgtggacggggaagtgagttggccatacggtagtgggcaaatgtgtcggtgtacagtattttgataacaaaggatccctgctgccccagggcatatgccgctgagcaatggcgttccgttcacgagctgtgcctgcccaacgtggagatggacttgaccggggtcaaagtgccgtcgccgctcgttggcaccactttaattgtcggttttttcggggaaaacttggcattttgcctgccaattagggttaaactctcggcttggccctctttttcagactgagttcgacttcagcaaaacggacagatggcgcttcgagtgccgttacggttcccacgtgcaacagtacagtttcttcgaagcatccgccagtgcagagaacagtgaccaacagcagcaacggaacgaagcggaggacgaataa

SEQ ID NO: 55902 - DNA, 809 bp, Heterodera glycines
  Genomic contig location: Contig_ID=SeqID_4838; Location=901..1709; Strand=-
  SCN-specific regions: Sequence locations=1-453,476-809
atggtttacgtcaatggccaaaagggagtcgcgccggggacaccgaatgtgccgaacggagcgcgagccgagccgaagacaaactttggagagactctgctcaagtactatgaatactatgaatttgtgccgtccgttttaagttggtattcccattttagcactttgagtgtttgcaaagatttttcggttcatcacaaagcgttggaatactgcaaggaaacgaaggcatctggtgagcaacacaattcactgcttgaaaaactacgaaatccaaaatgcttaagccattggcgaggtgaagcaattgaacgaacggattttctcgtccgacagaattctccgcgaaacttcggaaaaaagcgcaaaatttatggcagcagcgcttttccacaaggcaaatgccggtgagaaaagggggctttgtaaaattaaaatggtaaaacttttcccaaaaaacagatgaaaagcttttcatgaaggcagccgaggagatcaacgaactgtgttcacttttggaagaggcaacgaaacgggtgaaagcgatggtcaaaaatgggaaaaaggaacatttttcttgggacgggatttaattgtgccgctgttttgtgcttaattaattgtctctgtttttggctctttattctcacccgctccgttttcagaaggcggccgaacgcgcgagggtcgaagcggcgactgcgacaatcgttggcctgcagaacgaattcgacgtgatgacttattgatgccccaaatgtttgctgcaatacttttgactacgaactgtagaaaccatacataataaa

SEQ ID NO: 55903 - DNA, 602 bp, Heterodera glycines
  Genomic contig location: Contig_ID=SeqID_4839; Location=2272..2873; Strand=-
  SCN-specific regions: Sequence locations=1-602
  Gene Ontology: Mol. function=RNA binding; Cellular component=nucleus
atgtcgggctacggtagcgggtacggctcaacgggttacggtcagcagcagtacagcccgtacagcagcaggtgagtaaatgcaaataaagttagctatcaattcccacacattctcagctacggttctggcggctacggtacttctgggtacggcggctacggtcaacaacagtacagcccctacggaagcaggtaattggacaaagaaaaggcagacactgtcagccaataaattatttgtccagtatgagtcgattggttaattaaccatgcttaaagggctaatgaactaattagccatcgttgcaccgtttcagtggttatggaagctcgggctacggtggatatggcagctcgggctacggtcagcaacagtacagtctgccatcatcgtacggagggtggggaaggatcaaagccatccgtcaaacatttggccattttgaacagttacggctcatcgggttacggtggctatggccaacaggcagcctacggtacatcgagcatttgctgagaaacggcgaaaagaagagagacagaggcaaaacgacacaaaagttataacttcgaattgaactgttctaatcaatcaataaa

SEQ ID NO: 55904 - DNA, 913 bp, Heterodera glycines
  Genomic contig location: Contig_ID=SeqID_25174; Location=8..920; Strand=-
  SCN-specific regions: Sequence locations=1-325,347-739,761-913
ggcaggacaagaaaagaatgaagttgatgcctcatgaaactcggaattggttatgttttgtcgaaaatatccttacataatactcataaaaaatacaaataattcaacccacctattctatgaccacattctgaaaaaaatcccagaaatacgaggaaagatatgcttggtcacaataaaataaaaaatggctagtatgtaaaaatttgcggtcacaaataaaataaaaaatggctaatatgtaaaattggcgtccagaaatttttagactaatccgaagcaaagcacgaatgaattaaagaggcgaaagaattcacagtatcgtttctaatagggaaatattgacagaatattcggctaaaaacgggtttgatcatttttagcgcatttttaggtatacatttgagacaattgggcaggacaagaaaagaatgaagttgatgcctcatgaaactcggaattggttatgttttgtcgaaaatattcttacataatactcataaaaaatacaaataattcaacccacctattctatgaccacattctgaaaaaaatcccagaaatacgaggaaagatatgcttggtcacaataaaataaaaaatggctagtatgtaaaaatttgcggtcacaaataaaataaaaaatggctaatatgtaaaattggcgtccagaaatttttagactaatccgaagcaaagcacgaatgaattaaagaggcgaaagaattcacagtatcgtttctaatagggaaatattgacaggatattcggctaaaaacgggtttgatcatttttagcgcatttttaggtatacatttgagacaattgggcaggacaagaaaagaatgaagttgatgcctcatgaaactcggaattggttatgttttgtcgaaaatatccttacataatactc

SEQ ID NO: 55905 - DNA, 1047 bp, Heterodera glycines
  Genomic contig location: Contig_ID=SeqID_25175; Location=1314..2360; Strand=-
  SCN-specific regions: Sequence locations=1-16,38-893,918-1047
gacggctgccaagctgaccatgttgggctggtgtgcccgccccagaagaccgactacggtattcgcgtcaccgtggagtcattccgttaccagaccaccacccaaatacagtacacctgtctggtgcgcatttgcccatttgcaccatgccctcaggcgagttctattcattaccccaaactaattaattaattgccaattagatgggtaatttattgcacttcttcagaccacctgtccgccagtggacggttgccctggtgacgacattatgtcgcgcacgcttggccttagcagccgcgcccggcgtggcaccgccgacggcactccggcacccgccgagctgaccctggagcaaatccgtgccgcactgattgccaacccacagctgcagcgacagctcggcggccttttgtcgcagcagtcgtcgcttggcgccggtggcgcaaacccgcccggcgacgaccccgccgacgcagccgcacgcgcaccagcagatggcccagtcgccccatcgacggctgccggacgcgccggtggtcagcgcagcaccgacgctgcgcatgaacaccggtgtggcacatacacttctaaaaaaaatttgtggtttttatgcgacaaattttcaaccgaagcaccgaatttagaccctcgataaattcaaaattttgggtaaaattacagcattcggtgttaattatgttaattaactccgaagtaattttaaagtagttttgatattgtcttgattcttcattttccattaactttacatttcccgcattataatttggagttgtcaaattgatttgtcttttaattgggtccaatttctaataattttctttaaaatttttcgacactttttgaagttagactcaaattaaatactcaaaaatatttaaaattatttttttcattgttttcccctttttagcactccaacaacagcggatcgtgcttggtggtgatacgattgtgcggcgccgacttgtggtggtcaactcggaggaggagctgcgctactacgtgaagaccggggaagtg

SEQ ID NO: 55906 - DNA, 560 bp, Heterodera glycines
  Genomic contig location: Contig_ID=SeqID_25176; Location=239..798; Strand=-
  SCN-specific regions: Sequence locations=1-312,334-367,463-470,492-560
atgaaccagcagcaagtaattaaaacaaaacgaaataatgataaattggtgcatgatggtgcactttatgtgttttacaaattcagtaacgatggacttaagaaattttggcggtgtgagtttcatggcccgtcagaccaatgcaagggtatgctaatttacaagcgcactgagattgatgaggaacaatttctattggcggacaccggcgtttttcaaattcaaggacaaaatggacctcaacggtgagacatcatttatactttaaatgtgatcattgaactttcgaagtaacttttttgaataaccggccagaattttcaagttttcccacggcacgtcagttgggccctcacgtttgggccccaataaattttttcaaaattacaaaaaattctttattgaaactaataaaattttcaaaaatattatcaatattaaaaaaacaaattagttataattgaatcaaattttgttatcaaaattttatgttttaacgtttttaaagataataatatcattcttacagtatgcaacagcaaattaacacaaaagaatag

SEQ ID NO: 55907 - DNA, 587 bp, Heterodera glycines
  Genomic contig location: Contig_ID=SeqID_25177; Location=263..849; Strand=-
  SCN-specific regions: Sequence locations=1-130,152-247,269-587
atgggaaggtaagcaaattcattcattctcgattctcgacactttcgtattttttgtttttgtttacgccaaccgccaaaacagcgcgcctttggctcgccaaattgagcacagagccaacggaaagcgattttatacgaatgaatgaatggaaaagagagaagggggaatttcgcaataatatcgcacacaacgccaaaacatcaaagaccaacgggcggcaaaatttgttttcggcgggaaaagcatttaatttttgaatgtataatcaatcaaagaaaaagatacataaataataaatgatcgtgattaattataataattcgtattaattaattaaatgcagttttttctttggcagagttaaacgagaaatgcttcttccagtgcttcttctcagggttgtcgcccgagtccgtcccgattctcggcgtgaaaagccgacccgaacgaatcccggttccttcccatcccgcggcaagcctgctccaaatggaaaattgaaaagaatttcataaaaaaccttcacagagaaaataatatttttttgaattgtgaaaaatgaaaaatttttgagaagaaataaa

SEQ ID NO: 55908 - DNA, 69 bp, Heterodera glycines
  Genomic contig location: Contig_ID=SeqID_25177; Location=1626..1694; Strand=+
  SCN-specific regions: Sequence locations=1-26,48-69
atgcttttctacccaatttctgtttctttgattttgttcaccttttttgccggaagcgctgaagcgcag

SEQ ID NO: 55909 - DNA, 728 bp, Heterodera glycines
  Genomic contig location: Contig_ID=SeqID_25180; Location=250..977; Strand=+
  SCN-specific regions: Sequence locations=1-324,346-728
atggaaatacaaaagttggaggaggaaaggaatgggctcagaacggagagagaaaggcttggcgaggagttcaaagggaaactgtgccgagcggagagtttattcgaaatggaactgacggcggcgaaaatgctttacatgcgcgaactgcaagcacttcgagaacacgaagaagcattaaaggacgaattggcagcaaggtaagagaagggatgaaagaagagagaaaaaggcagggaaaatgccgaaaaaatgggagaaaatggcaaaagaaatggcaaaggcataggaagaaaaacaatgagaggggggggggggagggaaattgaacaaattaaaaacaacggcagaatttgaggcaggaggaatttcacgacagagttgtcgagatgcaattccagtcgagacagtccaaagatgagattatccactgcagagaagagattactcagctggagaaagcacttggacaaaaagcggaagagatacaaaggctatccaaagaagtgagagacaatttgaaaaggaggaaatttaataattatttggaaatgagctttaaacttaaaaagttggcaatcgcacgccgaaaaaccgaagaaacgatttaccaacttgtccaagtcaagtcggaggcggaagaagcggcacgagaactgtcggcacagagagaaagagcgaaacggctcaatggggcagaggaggcgagagagcgtttggaggagaca

SEQ ID NO: 55910 - DNA, 1482 bp, Heterodera glycines
  misc_feature (1366)..(1366): n is a, c, g, or t
  Genomic contig location: Contig_ID=SeqID_25182; Location=69..1550; Strand=+
  SCN-specific regions: Sequence locations=1-303,325-1260,1304 -1312,1336-1383,1406-1419,1441-1482
  Gene Ontology: Mol. function=calcium ion binding; Cellular component =extracellular space; Biological process=glucose catabolism
gtctggtcttcgcccattggtgaatgatccgaacaaaaaggacacaaaatcattggcccgaaaccacatcattgaagtgtccaagtccaatcttattacaattgcgggtggcaaatggaccacctaccgacacatggccgaggaagcagtggacgcgtgtgtgaaggcgtgcaatttgaagccaaaaaatgggtgcatgacgcccggattaatgttggaaggtgagggtgaggcgtaagcatggaaataatatgggggggaaggcgggactaatactattcagtaatgaaataaatccgagcggctctcaactttgtttaccaataaaaacccaattcgtacttgggcacgttatgccaaagccatctaaatctcaacgcggcacaaataaccgacaaattggctaaaaaaaaattcagcgggtaccccgtccaaaaaaatctttaaattcttgaaccatcgctggcgctttcccgctttccgcttcccttaataattaggtaattagtatgctttaggtgcccacgattggtacccattgttgtacatcaatttggtgcaagactacggcattgaggtggacgtggcgcagcatttggccaacacatacggagaccgagcatttgtggtggcgcggatgtgcaaaatgaccggcaaacgatgttaagaatagttttaattctcttaaaaatgcattatttgcattcagggccaattgttggcaaccgattgcacgaagaattcccttatttggatgctgaggtgctctttttaaagtttcacattattgccactttatttggttaataagttcgcgaacattggaataaattaggcccacatccagcgaaaatttctattttccagaatttgatattttaattcggttaaccggcacaatttacggttcccctttttcgtcaaggtcagctacgcgatcaaagagtacgcgtgcactgccgtagatgtaatcgcgcgacggcttcggctcagttttttgaacacttacgcagcacacgaagtgctgaaccaagtggtgatgatcatggccagggagttggcatggtcacgccaggaaacggaggtgggaataaaccccaaactcaaaggaacagttgggcaaaaattgaatgttcagaaacagctgaaagttgccagggattttatcaacaacgaaatgggccaagaggcgcgaatgcaatgggtttcagatgttccgctgaatctgaccaaggaggtggacgagtttcttctcacattttcattaaatgaaatggttcaggaaatgcaaatggccaaagaacggtaagcggcgaagggaaagggaggaaaaagtgacaaattggaggaattgcaaaaatgaggngagaaatgatcagtcaattccttttgttaatttagttttaaccagttggacaaggacaaaaagggacacattacggtcaatgacatccgccgacactttcgggtttggtgtcatct

SEQ ID NO: 55911 - DNA, 686 bp, Heterodera glycines
  Genomic contig location: Contig_ID=SeqID_25184; Location=515..1200; Strand=+
  SCN-specific regions: Sequence locations=1-180,202-234,259-327,383 -490,512-686
atgagcaccgacaacggagcagcagcaaatgttcagccggaacaggacgagaagctcattgcccagcccgaacagacggctgggaagacagcgtcgccggtgaaaaaggcgacggagagcgatttggggacaggcgagtggagaggggagaaacatttcaaaaaaagggttgggtgagcgaaaaaggggaaagaaagccttgaaagtcggcggttttgaaggccaacggaggggctaacaacaacaaacccaaaacaacaatcaatttgcatatgtgtcaggtgaggaatcgcgcgactctgtccaatccgtgggccaagagagtgcggaaggggacgaagaggaggacgaagcgggcgacgaggaggagacggacgaggagcacccggcccagcagacggaagagaagggcatcaacggacacgaaaaggcggagaagagcgtaaacggacacgagaaagtgggggagaagacggccgtcaacggagttgagaaggcggaggagaaaggagtcaacggacacgagaaggccgaggtgagagggaggggggcaagggacagaggaccaaagggtcggaacggaatgcaatttgaaatgtttttagccgcgaaagcgcatcaacaacgaaggcccagaagaagcggacactgaaagttcccagcagaagaagcagcgaatggacggc

SEQ ID NO: 55912 - DNA, 764 bp, Heterodera glycines
  Genomic contig location: Contig_ID=SeqID_25185; Location=135..898; Strand=-
  SCN-specific regions: Sequence locations=1-32,86-155,178-300,322 -475,500-764
atgtcttcctggttttcatacattcggtaggctttatttctttaaaatattttcatatatattttaaaattaattaaataatttagaagctcaattattggtgatgaattgccttcaacttctgaagccgacgttgttgatcaaattggaccaacggaagatgacattttgccaaggacaggacaatctgtcgacactttgtcgtcatgtttagcatcagctgcttcacaacaaaaactcgattatggacaggaggatagcataacaccaagccatggcaacagttcattgccagcagcactgagccaggaacagcaggagcacatcaaaaatgtaaatttaaatgatttaagggttaatttgaaattgtaaatttttggcaggttctgcgcagagccgaacgttccggacggcatgccaaagtggtggttgatttgcggcatttgaaacggggccgtcactcgaccgcagcagcacaaacagcaacaataacaacaacgccatgtgccccctcaattggaacacaacaacaactagaacggcacgaacagcagcagctgaagaggaatgaagatgaggaggaacagcaacaggaaggccaattcatcgtccaaatggattcgttgccggaaggcaagtgacaaattttgactgacagttttatttatgatagatcattgatcagtgactttattccgacaatttatgatgccaaattatgacactagtcagattcatttttgcggagtttttatccgattaaa

SEQ ID NO: 55913 - DNA, 566 bp, Heterodera glycines
  Genomic contig location: Contig_ID=SeqID_547; Location=1006..1571; Strand=-
  SCN-specific regions: Sequence locations=1-376,419-566
atgaatttttattctacggcatataatattttggtgttcagtccgacattaagtcgaagtcatatgatttcgaacggacgcgtggccgacgcattggcaagcgacgggcacgacgtggtcagttgtgtgtttgatggaacgattaattaattccaattttagacctttattgaaattgagtacgctgtgccaattggggcgctaaatgcgacaaaattggccaatctttggcaaattcctggcaaatttttcaatgtgaattttggcggaaaaagccttttcaaagtgctcgccgacagtgcctttgagaagccttcgttggtcgacatctttttctcgtctaaaatattccaagcttctctgaatgacgcatgtgaaggtctttgccaaaataggataataataataaatgtccttttgttctaagcattgatcagaacgcaatcgcaacaatttgagctgcttaagaagcgcaacttcgacgtgatcatttccgagcagctcaacttttgcggcgcgggcattggccatttgctggacattcccgtgaacattgtgctcagcag

SEQ ID NO: 55914 - DNA, 238 bp, Heterodera glycines
  Genomic contig location: Contig_ID=SeqID_547; Location=2781..3018; Strand=-
  SCN-specific regions: Sequence locations=1-24,59-238
gtaattcttactttttcattgtacaaagaatgagattgtgattgactctgtgccatctttttcttctgtttgtattttgggtgggcttttaaggaaatatggcatagaaaaatcagtgcagaatctttgtgtcgaatggatgacaaaagtcccgccgcaatttttgctcgagaatttgagcatcgtcaagcgcgcgatgtcgacgagttgcgcaggatattccacaggttgatgcgga

SEQ ID NO: 55915 - DNA, 1179 bp, Heterodera glycines
  Genomic contig location: Contig_ID=SeqID_548; Location=68..1246; Strand=-
  SCN-specific regions: Sequence locations=1-1094,1116-1179
atgtggtctggagttggtccaccgattgtcagaaggcctttgatcaggtcattcagattctgcaaacgcatgaaaaatctcgctcgtcagtatgtctactggcccggaattgacgatcaaattgaagaaatagtccgttcctgccaaacatgtgcttcggaggcaaaagcaccagtaaagactacccttcattcatggacaaaatccgatggcccatggaagcgtgttcacatggactatgcgggaccattctttgggaagatgttcctcgtcattgtagacgcatactccaagtggccagaaatcttcgaaatgaattccaccggttcagccgccacgattggtaaattgcgctatctttgcgcacggcatggacttccggaaacgttggtcaccgataacggtacccaattttcgtcgaaggaattcaaggaattcacccgactcaacggcataaaccatttgttttcggcaccttattgtccgatgtcaaacggacaagcagaacggttcgttgacacattcaaacggacgtgtcgcaaattaaagaaggaaggaattaccgaaatgttggacacatttttagccacataccgtgtcacgccgaatgagtctttgcctgaatgcaaaagcccagcggaactgttcctgcagaggaaaatccgatcgaaattggaccttttgaaaccaaaaaaacgtccaatcgtcatccgcgatgaagcaatggagcgtaagttcaatcgacgccatggcgcgaggccgagatcgttcgacttagacgatatggtctacgcccggcatcgactgtcgcaggattggcgacccgggcacatcactcagaaaaaaggtgtgatgtacgacgtcacttttcaggacggatcagttggacgattccatgcgaaccaacttatggttcgacattctgatgttgatgaggaagattccctcgacatcttgaatgatgcctttggacttccattggcacaggccaatcaacaacttggcgatgttgtggcacaaccagctggaggagtgattgagatagcgccaccatctccgcatcccgatcagccacagcagccaaacgaggtcaatgaagaacgtgccgttcaacagaatgttcaaaacgaacgacccaagcgaaaccgtcgtccacctgatcgttattcgcgcggatga

SEQ ID NO: 55916 - DNA, 659 bp, Heterodera glycines
  Genomic contig location: Contig_ID=SeqID_548; Location=1865..2523; Strand=+
  SCN-specific regions: Sequence locations=1-307,486-486,538-659
  Gene Ontology: Mol. function=protein binding; Cellular component =axoneme; Biological process=eye photoreceptor cell development
atgtccgctttcgctttgcgcttcgcttcgttcctctccctcacggcactgctcgtcgtccgatgctccgccgatgagtcatcgtcgtctgaggaagagcaaaagcgtcccattagcgatgccgccgtgccatcgtcaagcaatgaaatgccgcaagttgtacctgctgcggttgctcgtcgaaagcgaagcattttcggtaatttctttgcggggcttttccatcgcaacaatgagacttcgacggaaggtcgtcgcccgtcgaacggcacagagtcagcggaagaagcggaaaaggtaaaggaaaaggaggaggagaaggaggaggaggaaaaggaggaggagaagaaggagaaggaggaggaagaaaaggaggagaagaaggaggaggaggaaaaggaggaggagaaggaggaggaggaaaaggaggagaagaagaaggagaaggaggaggaagaaaaggaggagaagaaggaggaggaagaaaaggaggaggagaaggaggaggatgaggaaaaggaggaggaaaaggagaagcacaatgcgactgatcagtccgccgttgggcgcgagaagcgcagcccatttggcattttcatgaaatacaaaaagaacggaaagcaattgagcattggtcaacacgcaacaaattaaaagga

SEQ ID NO: 55917 - DNA, 311 bp, Heterodera glycines
  Genomic contig location: Contig_ID=SeqID_549; Location=31..341; Strand=+
  SCN-specific regions: Sequence locations=1-69,192-311
atgagatgtcgacggaaggtcgtcgcccgtcgaacggcacagagtcagcggaagaagcggaaaaggcaaaggaaaaggaggaggagaaggaggaggaagaaaaggaggagaagaatgagtaggagaaggaggagaagaaggaggaggaggaaaggaggaggaggaaaggaggaggaggaaaaggagaaggacaatgcgactgatcagtccgccgttgggcgcgagaagcgcagcccatttggcattttcatgaaatacaaaaagaacggaaagcaattgagcattggtcaacacgcaacaaattaaaagga

SEQ ID NO: 55918 - DNA, 711 bp, Heterodera glycines
  Genomic contig location: Contig_ID=SeqID_549; Location=1092..1802; Strand=+
  SCN-specific regions: Sequence locations=1-342,365-561,583-711
atgccaaaaacatcacacatccttctgatttgcttgcttttcttcaccacttttctagtaaaaacagaagcaaaaattgaagagacaattgaattggaacgaaatccatcggcggaaaggacagaagggtaaaatggcaaataatatcaaaaaaacaaaacgagtgggctttcttattagctgaatagatcgttaccttctgattgccattttttggcattccgtgcatatttcatcaaaaaaaaaagtttttttaaagaaagcccatttaataacctatttcagcaaaccctcgacgagaagaaagcgccatggctggggatacggcgggtacattatttgttttttattaaacttttatttacatataaatccctcctcagctgttgttgctgcggcggttggggatacggtggctatggcggatacggtggatatagcggatacggcggttatggtgggtacggtggctacggcccatttggagtcggattggtaggccttaccggaggactgcttttcggaggatggggcaaatagagaagctcatgatcgctaacacttttaaaaatataatcgttgaaaagaaaaccttctgctttatgtgacaatggaggatgattggttatttgttagtctctacgacttttataatttaccgtatttcttgagttagaattccccctgaattagaacccctccctccttgaa

SEQ ID NO: 55919 - DNA, 1072 bp, Heterodera glycines
  Genomic contig location: Contig_ID=SeqID_549; Location=2455..3526; Strand=-
  SCN-specific regions: Sequence locations=1-134,167-217,239-251,286 -335,362-576,605-913,935-1051
atgccaataattacgccaacattcccggaacaaaacgttggcgccaatttgaacggggcaacggccaaagtcattttgaacgaactgagaattggtgaatgtttggttaaatgcatgattaacattaatattctttcttttaaatttttcatttattttagcatttcaacagattcgaaatgaccaaaatttcaattcaccgcttaaaagcaaaaagtttaacgaaaaagtattttatgaaatggaaggagtatttaatataaatattaattaatgaaataaataccttaatctgctaactaataaattatatggcctaatataaaaagcgctaattgtcttaaaaaattttaattcttttggtttcagtatgcccatttcattttggtcgtttgttccgggcatcaaattaatcttgccaaattcacgccatttgttgggaaaagcattcgctatgaattgcataattttctacaaaattcttctctgttgtcaaagcgagtggactttttccacgtttacccaaaagcattctcagtgaatggttcttcttctggcgagcacagcaacaggtaaaaacacaaataattaaataaacaaataattaatgaccaactaatgaactaattaaccgtttttgttagggtaattagccaatggcttgtcggaattgagcttcttcccgggaaaattgtggattccgagctcagaagcgaattgagtcaaatgttgggcaatttcgatgcaaaagttaaaaatgcttttaattatttccttttccatgctgtggaccttttctcagaatatgttgagaaaaatgaactcaaattacggtaaaaatcatttttatttagaatttaattgaagtgacactttttcaggcgatttgactaagaaatattttctgaatttcttttcacaaaaaaggggtgttcgtccggctattgcccaaatccaattcaatgtgatattttatttcttttttttaatgtaattcaatctgtttgtttaattaatgagcttgcaaaaggttaaaacgagcattttgattcattttttctatgaaaataaa

SEQ ID NO: 55920 - DNA, 925 bp, Heterodera glycines
  Genomic contig location: Contig_ID=SeqID_549; Location=3716..4640; Strand=-
  SCN-specific regions: Sequence locations=1-58,80-172,194-201,315 -336,358-389,411-531,570-925
atgccaaacattggccaattaccgccaggaaaatataattggcgagaatttgaaaaattacaaaaagaaattggaaacaaaatagaacatctgataaaaaatgaccaattcgatatgggaatgtgcagatatgacttgaaagacagggcgaagagaagggcagaaatggagaagaaaatgcaaatggaaatttcaagtgggaaaaaataatgaaaaaaattaacaaaatatttttaaaaaacattagtatgtacctatttaacaataagaaataaaaaaaacatttaaaaaaaataggtaatttaaatttttttgtttttgtgaaattatgacttattttttacaaagtctaaaagtggcacctaaacaattaagtgtcaaatcatgaaatgagttcattttattcaaaaacaatcgaaaaaatggatgaaatttgtaattttctggtaaaaaagaaaagaaagacactaaaagacagaaatttggtacaagaattgaaagtgatgctccaaacattagcaggcaatttaaatttaacacaaaacaaacaaaaagaaaggaaattgcaatttagattattcattttatgcaaaaattgagggggaatatttaaatgggaattggacggacgaaaaggaaaaggaaaaggaaaaggaagggccaaaaaaggtggacaaattccggcaaattctcgcctatttggaattgtgggcaaaaagtaatgaattcattaataattaattgagtattagagaaaaggtattatttaaatacatatttagacaaccaaattttggacgatttgatgggatttttgaacacgaaaatgcttttgacaatgctaaccaaaatattccttttgtacccaaatgggtcaatgccttttttggtcgagaaattcttcttgacttattccacctggtga

SEQ ID NO: 55921 - DNA, 1203 bp, Heterodera glycines
  misc_feature (77)..(77): n is a, c, g, or t
  Genomic contig location: Contig_ID=SeqID_549; Location=5254..6456; Strand=-
  SCN-specific regions: Sequence locations=1-228,251-321,343-942,964 -967,990-1030,1052-1055,1086-1137,1161-1203
atgatagaacagattcatgcagctgatcaatatgaaagtaggacaaatgatcaaacattagggagtgacgaaagggncgacaaatggtaacaaaataattggaaatcgaggagaaaaagcggaagaaaaaaggaaaacaaaagaagaagaactgagctcaaaagtaaaagacaatttgaagagaaatttaaacgaattaaaaagtgagagaaaagcgaactacgaatcagaagaagaagaagaagaagaaaattgcaatggcaaaatgccaaaatttgatggcaaagtgccgaacagaaatgaacaggaaatggcaaattgggaaacaaaaagtgaagaaaattcggaagaagaggacaaattggaccaaaatgaattgcttcatctgaaaatcgggcatttttcagacgataatttgctgagtttgaaatatggcgaactgttttgggcagtaagcaaagaaagttgggaaaatgacgaggaaaacgatgctttaacagtcaaaactttgtgttggacgctccatcttggagtttatgccaacgaaatttcgaatcggattggactttttggcactttggaggaattgaaaataattggcaaaaacgaaaaattggaaattgaaaagcaatgggaaaagcttaaaatggttgaattaagcaagataattagcagatgcgagaggaacaaattgatggccaaattgcatttgttgctgaagaaaattgtggcctcaatggacggattttgtgcggaaaacggcacaaatttatgggcagagattagggagacgaaaagtcagctgcactcgagaaaattggccaagacaatggccaagagcgaaacggaacgccaattaaagcgcaaaatggacaaagtgattttggcactaattcaaacggaaaacaatgggcgcgaggacggaatgccaaagcaccgagcggaattcgaagagcaattaaaggccgtcaaacactttgatgggcagagaaaattaggcaattaaattactaattggattttatttaatttactttttggccaaattcaatgatttttgaattaaaaataatttttagaccaaacattgtttaacgaattgaccaaagaagcgaatttgattgaaatggttgaggaaaaagaacgtgagaaattccgattgacgaaattggcacaatttccggaaggatggcaagaaataaa

SEQ ID NO: 55922 - DNA, 3543 bp, Heterodera glycines
  Genomic contig location: Contig_ID=SeqID_4842; Location=60..3602; Strand=+
  SCN-specific regions: Sequence locations=1-232,258-444,466-884,906 -954,978-1077,1099-1804,1835-1915,1969-1982,2016-2063,2085-2430,2467 -3400,3455-3493,3515-3521
atgcccaccgtcgatttcttgtgccaggcttcgtcattgagccgtatcaatggcactgttggattagagccgattcttcattggattagtcaacagcaaggattcatcaaatacttcaccatgtatccttccgctggagggactcaaatctcagaagtggatttcagccactttctgctggtaatcaacattaaatgtgtcatgttcaagagcgtagtctgaccactaacttcggcggcgcgggggggggggggggctaaattcacacccctcaattttttatctcatgcctcaattaaatttaccgcgctcttatccacaaaattttttttttaaagtattagtccggcagtgccgatagcaccccggtgaaaaaatttgaaatttgtcgctcggtggtgccaatgggcgccaccgagataaaattttttgagaattgaattgaaatttgtttagaaaaacatatttttttcaaaattttcggcttaacagggctataattacctctgaccgccatcccttggctatttgttgtttgatctttttccgtagaaatccaaaattttcgacaatttttcaaaatttacttcttttttgctttaattttcatttttccttaaagcattttacactttgtacatctttatcagagattcttcaattctcgcggtgccccacctgcaagttacaacgccatgttcaaacacggtgttgttgctgacgatgtcaacgaattttccatcgaaaaatgcgagcattccctgaagttgaaggcctgcgtgactgcagatggtaccacggattgggctctgaagagcttatctgcctacgatgaagctttatcgaatgtgctcgtaatcgtccaagcgtgccccgtcaaaagaaaaataattttggaggaaagcgaaaacctttgattttgttgatatgtcctgcaaggacggatgatgatgcgtatttaaatgtttttaaaaatttgattttcacattcacattatgttttttttgatttctctattcaattttgttgtcactttaattaggcgaaggaatgcgtaaaaataagagacctttgccgtttttcttggtgtaattaataggactgcttggcacatttttttgtcatttcattacttttgttttctcgaaattgttttttaagtaaacttttcggattaggcttgctaacgaattggcaatggtcaagaatttcgattacgaaggccacacttttttacgaatttatgaatgctagtcgcaacgaaaaaatcgaaattttggttgaaaaatttatatgggaggggaggggcgaattgggggtgtggagggaatagcggccattttaaacaattaatctttttatattacctaattgaaatactgtatcactgacgcatttttaccatctaaagcatactgtatcactgactcattttctattgcaccgctcggatatttgacagaaatgaaatgtgactattttacaaatatttttatgattattttctcatttttaagggcattggatcgaccttttttggataaaatttacaaatttagggggagagtagtgattttggtgctcagtgcatggcgctcagtcggccgttgtccgccaaaatgacacaaatttttgtttcattttttggtgtcattcccttgcccatcgtccgttcttttcttcaccattatctccaattttcctcccatccattaaaagtggccattattatgtcatttttatcgagtcggaggaacgcctcgggggaaaatgtcggagggcggggagagaattaatcgcctcgggggaaatgaaaaagggaaaagaattaatagtgccaaggcaaaacggcgaaggcttgcccaacaacagaagggcaaaagtcatgttttgttgtgcttatggcgtcatttctttttttaattaataatttttatatttatttaataaataatagaatattttttctccatccgatttcttttaattttatttatataatattcattaaaaaggtaatatttttagtatagattaaatggatagtcaaatttctgaggacaaattaatgctttttaatttacgcattaattggaaaaaatttgatgatcagacaagggaaagtatcagatcagtgatcgaaaaggcattgagcttaacgcaaagacaaaggtgagctaattgaccaatttgtaatgcattaatcactgcccgggggttatttaagggaatcactttattattgaatttatcgatgctcgattttaaatgattgatcagaaagcgaaattcaatgcaactggcgaatcactagaataataaaatcgggcagcagatgtcgtttccttcaaatgagaattttgattttataaagcctaaaatgttaaatatatattaaaacgcgcaattctgctcaactttttttgggctattttaaaatttattaataaaatttagttttatttgcaacgacatttggttcgatgtttttgagttcttcggccgtgccgaactcggccttctgctgatcgcacggctcagcaaacggttcaatgcgttggtggacagtcacttttcgatgacattgtcagggaatgggcataaatatttaaatttaagcataattgcttaaggatccctcatttgacatttgattatgcgatgattcttcgtgcggaggacggcaccggtgccatatttaaagtgcggcacaaaggaagtaatttgcgtgatgaaatggaagaggtgccaatggacagcattccgtttaggaaaatcattaagaaaatccacaaaattgccatttggtatgttttgtctaacgagcaaaaaaatttttaattggcctaatttgaaattggccagttggaaagggtccgccgcccaacctcaattagcaattactgttaaatatcaaacaattagcatctcattaaggccttgccatgaatttggcaatgcccgatagcgcttgtttttgaattcaaaaaggtttgacacattataatgcgctgattattgtggccataacttttttgaaacttggccatttactttaaaatttctatgataattaacggcgggacgaactgggccccgctaattgggcccataatttaatttagtaaatgtgtaaatctcaaatgtttacaaagtcaaaatggggttaagaaataagcccccgggggatagatttcccccctacccaaaaaacggataagtaccgattatggtttcaaatccgccccaatccgttcagttacactgatcgctctgtgttcacttttttgcgagccattaaacatgcgtttgactcgcgcactcaatttgaagtgtgcgcggtaattgagcaaagttgggacataatcataaaagaactttggccgctagtgtaagtgcaaatttaaaaattataaattttcagaatatcattaaaataaataaataaataatgcattttcaggccaatgtttcttggctgcatcagtatttcttggaaaggcatcccaaaaattgagtgtttgacatttgaggccaactga

SEQ ID NO: 55923 - DNA, 638 bp, Heterodera glycines
  Genomic contig location: Contig_ID=SeqID_4843; Location=1696..2333; Strand=+
  SCN-specific regions: Sequence locations=1-147,169-560,594-638
atgccaaaggacaaataccgcgcatcggaggatgaaagccttaacagcaacaatggcttttccattgtgaatgagaaaacgcaagaattgctgcaatttggacaattttggtgcaaccgttggatgttaattcggaatcaaattagttgggactgggcgggttttgtcatgaaaatatttaatgatgacgtctcgtcctactacaaagatcgtttcatatttgcactgaatgatgagcagtatgatgatcccgaatgaatcaaaatgacattaattgagcaattttggattattaaacacccttttcaccgtggttttatttgaattgaattttgtctcacattaacttttgctgaccaaaacttccgaattgaatctgattatgagcgtgagaaaaagttttactttctaaacggggtcaattaatataaaaagattattccacaatgtattgtatcaatacggtcacgatatacttaaaaaactgtttgattgagacatgggatggaaaattggagttaattaatggtgaacaaatgaacggacgatgggcgtgttagtttttttaattaaaattgttttttatttttattgttacgctttatcttttgaaagcttttgatagtccattccaaaga

SEQ ID NO: 55924 - DNA, 1251 bp, Heterodera glycines
  Genomic contig location: Contig_ID=SeqID_25186; Location=450..1700; Strand=-
  SCN-specific regions: Sequence locations=1-92,114-260,297-371,422 -443,469-486,526-546,572-601,623-837,865-964,1010-1120,1143-1229
atggttatgacaaagacagaatgcaactacggggcacccgaatatgttacgaaatttgtgatgattcgttgtccgatgtgccgcgatgagaacaaatgggccaaatgggagaaggaagcagagggatgggagcaccgcatgggccagcgaaatcgaaacctaattgacatttacgtcgatgaggaaaatttggatgttgggtcagtaaaatatatttgtaattcggtgctaggacgaggtgacaaaaatatcagtgttcgtaataattaaatttaattattatttaaattttatttgctaaataataaagcataacttagcttaaacttaatcaaatttattcatcttggtattagaatgtagctaaattcaaaaaaaaatatatatattctctactatttttataatttttaaaaaattagcaaaaatttacaaaagttgtgaccaaaaatttccaaaaaatttagactcaacaattttgaccctaacttttttgaaattcaattttgaaatttaattgtagaatagagaaatctttgggctatctaattatataaataatattaaaattggttctttctgaaaaaaagtaaagaaggaattaataaggttatgtttttatggtcatccaaaaaatgtaaggtcgtttaaatgcatgaaaatcgttcaaacattcagttaatcacactacatttgatatgaaaagatagcccaaagatttctctattattcagttaaatttcgaaaaattttattgaatttcaaaaagtatggtcaaaattgttgagtctatattttttttgcaagtttttggtcacaactttttgtaaacttttactaattttttaaaaattataagttgtagagaatatgtagagctgcgattctaataccgaagactgaataacatttcgacttacagtggtaaagtctatagcttataggatgtaatgtcatattatgcataaatatagaatttatatatataataattataattttaattattctcgtacaattgtctactgtttgtcatcttcaggctcaaccaacggtattatatagacatatgagtattttatggctatttttccgtatcatttactatatgaacatcaaactgttggaaaagaaaaggaattgagccggggttttcttcttttgcacttccaaattttgcgaacaaagggacaattgtctgtgaaattaggcaacacctgcttttaaaatcaaacaccaaaacaaaataaa

SEQ ID NO: 55925 - DNA, 910 bp, Heterodera glycines
  Genomic contig location: Contig_ID=SeqID_25187; Location=174..1083; Strand=-
  SCN-specific regions: Sequence locations=1-210,247-486,605-623,646 -783,805-859,888-910
atgaactcaaattttcaaaaaattctcccgccggcacctgtgtacaaaaatttttttcggaaaaagtgcgtcacaaaaaagcatgttttttcctttttgactaaaatttccaaagtgctgattttgactccaaatgatgattcttgttggctaaatgctggttttgaaaattttcagttagcatccctgtttttacaatgtaaaaagccgttttttatcttatttttgtggccaaatcttcgttttaacctcgttttgttcttagtttataatgggagactaaaaatataaaatttgatagcattttgatcaaataaattgtaaaaatttactgatttgaaaaaatgttgctaatgttattatttttgtccctaaaatcttatttttcggccttggtgttcgtcgggtcggggcataggtccaaaaaacgtctcgggtcgggtcggggggctcggggtcggggcttaaccctatttgaaactattcatttaaaatataaataaatttttttaaaaacacatttttaaatgttctttaatgcatatttattttttaaatttaaaatgatcagaaattcctataatattttaataaatttaataaactcatatttattgaaagcgaaatttggggacccgactttcccgacatttggggacccgacttttggggatcccgacatttggggatcccgacatttggggaccagacttttggggatccgacttttggggatcccgacatttggggacctgacatttggggaccgaacgacattgagcaaaagacacttaagaaaaccgcggacatttggcaacccgacatttagggtcccgacatttggggatttcaatcaaacaaaaaaaaattaaaaatttaattttaatcctcaaaattagacaaaaataaa

SEQ ID NO: 55926 - DNA, 833 bp, Heterodera glycines
  Genomic contig location: Contig_ID=SeqID_25188; Location=970..1802; Strand=+
  SCN-specific regions: Sequence locations=1-10,54-120,147-262,296 -481,614-621,643-785,808-833
atgtgtcctttgccacttcactttctgaaggaattaaacacacatttaaaaacggtgagtttaaactaattagtttaattgaccgtttatttgatcggttgagttaattaagaattggccaatttttaattaaaattttattaattgaatttctcatttaataaagaaagcaaaaatcacattgaagaagaagcgcaattggccaatatcatctgcgaaattaacaaaaattatctcattttggaaacatttttgaccgaagtaataaatatttataaatataattaaatattttgcttctttaaagaaccctttaaatcattcaaatggacatttttctgtggatgaatacaattccctccaaaagcgtatcacattaattaatctcaatgatccgcctttgagccaagtgatgggcactttaattgttacactaatgagccttaaaaaggcaatggaatcgggtaaaaagcgaaaaaggaaaatatttattttaaacaaaaaattcctattattttgataaatttctatataaactttaatttaaaatatttttttattataaaaaccaatttaaattaaaaaaaaattttttacataaatataattaattccctcatattaaaatttaggaaattttggcgattctctgattaaaatgggcaatcagcgtttaaaatttgcactaaaatttgttgcaaaacgtcatggaattgaatttgatgaacgaaacaattttagtttatggccaaaaaatagtcaaaagctttatttttcgaaatgggttatattatattaaataaattagttttactttttagacataattttaa

SEQ ID NO: 55927 - DNA, 516 bp, Heterodera glycines
  Genomic contig location: Contig_ID=SeqID_25189; Location=1047..1562; Strand=+
  SCN-specific regions: Sequence locations=1-61,89-122,145-154,176 -215,237-459,486-516
atgccttggtattggcatagtgatttgccaagatgcgtgagcagaaggatggcacaacaggtaaaaaataattaaatttttaaaataagagccttaatggttggggccgggggataaattcttttaaaaatttctttaaattggtcaatctcagtattaaaatttttaaaatatgaattatggtaattaatttcttaatcgaattttttctgtggaataaaaattattttatttgcttatctgtcagctaatatgtcttgatttttttagcgccacccctatcaacagccaaacctgcatgtgcctatgcattatggttataacgaagcgtattttccgggtaattttgtgcatagtcgggctactgacttcccctgagaatggtaaaactgagcgcaggagaccaattattctctggcgcgaatcgccgggggaggggtgggggggattccagcactggttgaaaacaattaaaaaacagttactgggggatttttctcataaaaaaaaaagaaa

SEQ ID NO: 55928 - DNA, 511 bp, Heterodera glycines
  Genomic contig location: Contig_ID=SeqID_25190; Location=320..830; Strand=-
  SCN-specific regions: Sequence locations=1-363,386-465,487-490
atgcgtgccattttcagcgcgtgcgatgccgacgaattgaagcgtttgctgggagctgagcagaatggcgcgactttgctgcacgtagcggcacaaaatgacaaagcggatgtgatcaaacttttggtaggaaaaaaaagaaaaaaaaaattcttttttttcgtaattttatcaaaatgaaaaaccatttccgtattaccacaactttttccgtttagacgataccaaaaacctttgataattaaggcctattggtttttttaaacacagcaatttttcaacaaaaaaatcttagaaacaaaaaatttttttctccggcggtgacctttaatattattttttgtccttctcattgattatcatttgttttttacattttcagattgaaaacggcgccgttgctccaaccgatgacaccaattccgttacaattcagttcacgtgtggcgatggccatttgccagttggtcagtttttgaaaagttcggtctttattttttgtaaactataa

SEQ ID NO: 55929 - DNA, 657 bp, Heterodera glycines
  Genomic contig location: Contig_ID=SeqID_25191; Location=256..912; Strand=+
  SCN-specific regions: Sequence locations=1-657
caaaaaaatcgattttttcaagtgtccgtttggggtactcaaacaattatggggagcaaaaatccaacgcataattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaac

SEQ ID NO: 55930 - DNA, 189 bp, Heterodera glycines
  Genomic contig location: Contig_ID=SeqID_25192; Location=79..267; Strand=-
  SCN-specific regions: Sequence locations=1-189
atgaacacagaggaagcgcaccttcttggcatcttttttgacacattgaccagagcaattaagcacggcattttgttggaacgaattcgtttgttggatggtcaaatgctgcgactgatcaacgaattctgccaaattgacgtggcatatttgctaacccaaattgatgtggtccaagaactgtatgag

SEQ ID NO: 55931 - DNA, 280 bp, Heterodera glycines
  Genomic contig location: Contig_ID=SeqID_25193; Location=343..622; Strand=-
  SCN-specific regions: Sequence locations=1-280
aaccggacgaagcgggctttgtgaccaacggattatttgccaattggacgacgatggatgtgagaagagaaagcgattcataaatagcaaaatgcaaattccgggaaaagtgccaacaatttgtgccattctttttgagggtcggcactccttccaacgaatgttcggtgaccaggacgacggcgaattcattaacgatgcacgcattgattgggtgatgacgcaagacatcgtggaaagcgtgatggcattcactctgccgacacaggcaattaatgca

SEQ ID NO: 55932 - DNA, 1112 bp, Heterodera glycines
  Genomic contig location: Contig_ID=SeqID_25194; Location=826..1937; Strand=-
  SCN-specific regions: Sequence locations=1-22,62-382,404-630,652 -836,883-943,994-1013,1060-1112
atgatagatataaaattgctggtaaaatttaaaaattataaaaataatatcaaaaaaaaaaccaacactccacacaaaccaatgcttctcgacagtctcggtctcgagttgcaaaaaagaagtttcttggtctttgtgtttcaagtctcgtgtcggtctcggattttcgttctctgaaaattctattttccattttcgagacaaaatatttttgaagaaaaagcctcggtttatttttcgagaaatatgattcgaattttgcttaaaagtaaacaaaattttacattttcttggtattattcgattgcccggttttttctctattagcctgcaaaattagaaccaaattttaaataagttatggcagaaataggcatttgtttttgtacaactttttcaaaaattaatcaattttttttttaatgttgcaagctaatagagaaaaacctggcctatcgaatgatagcaagaatggaaaaatatgttttgctattaatcaatgctaatgccattttttgccaaacaaaattagctaaaatggaattaattttactcaatgacccgttcacataaaattacccattttcaattttccagtcaaacttctcattttcaaggactgtcctttattttcctgccaaatttctcatttttcaaggactgtcccttattttcctgtcaatttttctctttgctgcggatcttattttaatgattctttaaatcatttttgatcactattgttgtcactaattattgtactctttttaaagtaattttttcggagattattctgcaccgattttagggctttagaagccgttgattttgtaaggaataattatttaaatttatttaaatttatttttttcattattttttcaaattcctataacagaatgggtttatcaaataacactcacaagccaaagcagcaattctgttatttaatttattaatttacattttattcaaaaaaattaattaatttttgttaagttctctgaggaaagtttttaaaaatttcaaaaaacattaaaaaattttagtttttattttgaaaactgaagttttagtaaaacaaaatttgctgaattccaacaaaaaataaa

SEQ ID NO: 55933 - DNA, 1467 bp, Heterodera glycines
  Genomic contig location: Contig_ID=SeqID_4846; Location=602..2068; Strand=-
  SCN-specific regions: Sequence locations=1-71,93-103,128-653,739 -1077,1102-1168,1190-1384,1406-1467
  Gene Ontology: Mol. function=structural constituent of muscle; Cellular component=sarcomere; Biological process=striated muscle contraction
atgcccaaatgggcattggtccttttcactcttttgccatcttttcattgccttcctctccactttttactttctccacttcagctttctccaagtgctcaacgacttcatcttgtacgtgttcgtccttccgatgccggtgttttcacttgtgttgcggtgaatgccgctggcgtggctaatgccaccttttctgtgattgtgctcggtttggtccaaacgtttcgttatattgtgaaaaaatgtgccaaaccgttcagtgcctccttcaatcgccgatcattacggcactttggaagtgttaacgggccaaacggtgcaattggagtgccaaccaaacggaattccaatgcccgagtaaacagccgaatttgaggagccaaaaagggatggcatttcagaatcaaatggacgcacgacggacaaacggtggatgcatcagaaggggggagaattcagttgctgaacaattcgacacaactgcgaatcgaaagagtgcagcggagttccgatgctggccgatattcgtgtgttgcgaccaacaaaatcggcaggacggaaatggacacttttgtggaagtgatcggtacatttatcaattttgcgaaattttaaactgatcgtatgggatggataatgtgacaggcgaaaaactcttccttgcactttctttctctctcactctcctgcgtaaactctctctttcccattctctatcgctctttatctctctctctcattgaattttaaaattctgcttcccttctgcttcatttttctgtccgtttcagaaccgccacaaattgtcgattttgccaccgaattcaaagtgatcgaggggagtgagcagcgattggaatgcaaagttttgggcacaccgacgccgaaagtgcaatggcaaaagggcggaagcgaactgctcgccaaccgcggcgttcacttcgcttttacacctccccacgcgcacaatttgcacatttacagcacgagaaaggagcacggaggaagatacacatgcaaagcgagcaacaaaggcggagaagtgcgacagaacatccaactgacagtgatgggtcagtgggaaaaaggaaaaagcgggggtgaagagaagggaattttgggaaagacgataatggcattttgggaaagacgacttaacccaatcgcattccttgtccaaaatgattccgattacccattccatcttctcctttgctcccattttgcttcagttccccccaccattaccgagggagagcgcttcattcgggtgaccgagggtgccaatttgacgttggaatgcccggccaatggagtgccaacaccacaaattacgtggcacaaaacggacgaagaaggaagatcaaaagaagaagagcgaataaaaaagacaaacacaacggaggagggaccaccggagggagggaaaatgatactgagagaattgagagagaccgacggggggag

SEQ ID NO: 55934 - DNA, 104 bp, Heterodera glycines
  Genomic contig location: Contig_ID=SeqID_4847; Location=2003..2106; Strand=+
  SCN-specific regions: Sequence locations=1-104
atgaaagagtgccattgcgacgtggaggaggacaacttttgctttttgtgctgcggcagtgcgaatgatcgttgtttgccggcacatgagcacgacattctcag

SEQ ID NO: 55935 - DNA, 352 bp, Heterodera glycines
  misc_feature (310)..(310): n is a, c, g, or t
  Genomic contig location: Contig_ID=SeqID_25196; Location=1047..1398; Strand=+
  SCN-specific regions: Sequence locations=1-137,160-165,202-204,226-352
atgagtctgtttcggaaccgatcacaattggaaactgttgcaacgaaatgcacagctatgaacacattcagcgcatttttgcggccatgtgggacaaggacaagttccaggcccattacaacaactgccgaaattggagtgacggattttggtggaaagtgtaagaaaattaattgtaaaaaaataataacaaattttattgatacgggaaataattttaaaaaacgttttctctaaaactaattaattcacagtttttttgtgaaaattaaagaaaattaattaaataacattttcagtgggtttttanatagcaaaaaaattcactgattttttaattaatatatgctaa

SEQ ID NO: 55936 - DNA, 93 bp, Heterodera glycines
  Genomic contig location: Contig_ID=SeqID_25197; Location=1217..1309; Strand=+
  SCN-specific regions: Sequence locations=1-93
atggggagcaaaaatccaacgcagaatcaaagtacaggctatagggaagctattcccgaaggattcggtctccacataaatctgggcgcatcg

SEQ ID NO: 55937 - DNA, 588 bp, Heterodera glycines
  Genomic contig location: Contig_ID=SeqID_25198; Location=564..1151; Strand=+
  SCN-specific regions: Sequence locations=1-324,349-432,501-588
atgaccgttgcagaccaacatacagccgaaagagctggcacaaatgccactcgctggacatcacaggtgaaatttgttgacgaaatgtctctttaagttagatggtggggataaaatgacgactaggtttaggggcaatttgtctacccaatatgggacaaaatgccgacacagcaaaggttttatacaagttgtcctcgagatatgacaaagtgccgacacacataggattcgggcaatatttccccaacactaaaatggacaaaccatctaaataatagccaaccaaccgaattacattcaaagattttattggcactttatcaaatttcaaatatttaaaatgtacaggaccattttccgacaatttgtcaacaaccgcaacaacaacaacaaaagttgcgcccctccgagtcattcattcgctccatacagcagcagcaacaggagttgaagcagcaacagcagaagaacacctccaacaccatccccagcaacagtcgaatgcatagacggcaaaaaaagaggtcgaaatggcatactctcgacaaatgtgtttcactagtctcgattcttgaggccaattaa

SEQ ID NO: 55938 - DNA, 533 bp, Heterodera glycines
  Genomic contig location: Contig_ID=SeqID_25199; Location=30..562; Strand=+
  SCN-specific regions: Sequence locations=1-109,141-142,260-402,450-533
atgggtactcacgcaacaaattcctccaggagacggcgttatgcccacaattggtaagtttttacttaaatttttatggatttaccctttctttaaatctttaattttctttcactgatttgtgattttgaaaattttttcgttttaaaaatgattttaaaattaatttactttttaaaattttttttgagaattttatagcttaattttacaacaaaataaattttgttgccttaattaattaaaaaattttttatttggttttatttccaaaggtgttattcacatttggaatgtctcgttaacaatggtcgctttgatcttccattgcattatgcttctaatgaacaaaattctgccaccagatttaaaatttctccccgacaatgtttgttgtaaatcatttaaataattaaaaatattagtagaattaaacatttatttatttagttttccaaattttcttcaattctgaatcgttacaagcttttcaagactgagtgcctctcaattgatccgcaacagtgcttata

SEQ ID NO: 55939 - DNA, 1051 bp, Heterodera glycines
  Genomic contig location: Contig_ID=SeqID_25199; Location=645..1695; Strand=+
  SCN-specific regions: Sequence locations=1-181,223-462,484-490,514 -661,697-743,804-806,829-870,892-893,915-983,1005-1019
atgggttttgatctgttggttgaaaataacgctgacctttctgcttccggtgatcaacgaattgcaagaaatggcggtgatgtgttgttcgaatttgatcagtccccgataattccgcccactcaacaaaatgtggataatacaacaatcattcaaatggacccaattgtgcatgaaagcggctatgaaaataaaattggcatttcaccaaccacaacggcagagcaatttgaatccgttcaattggagggtctgtttttttaaatggccaattgtggattttaagctaaatttcaaacaatatttatgtgcattttgtggtccggcagtgccattagggcaccgccagcgaaaattttgaaattttaacgaaattttttcatttttcggttatgctatgcttttccgttccataaaaatataaaaaaccaaaacatttaaggagatcgatttatacagtgcagaaacaaagaaataaattcaaggagataaaaacaatttaaataattaaacatagaatcaatcaatggttgttccattttctaattgttttcttttaaatcaagctcatgaccaagcctcgtcttcagctgctgaacagctttcaactgtgccaacaacgtccaaaaaagcattctcattaaatttgccattgttcagcggcaaaaatggaaggacaaaaaagggcataaaaactcccttttcaacgggagcagaattatttggcggcagcaacgaaattgtaaaaattaaatatttaaattaataaaaatacatttttctattctaaatttaattaaattcgctaagacactttcgaaaacaataatttgtcataggtctattgtaattataatgctttttcacaaaaattttacaaaaatttattttagctttcaagcaatgatcaattagaaagtacgaatttaaatgcgcaattggttataaaacaaatggaaggagacaatcgacccaaagaatctgtcggcggcggtgtctctgatgagaaaaacggttacaaataaaaatttaattaattaaatttatttaa

SEQ ID NO: 55940 - DNA, 1609 bp, Heterodera glycines; identical to SEQ ID NO: 25200
  Genomic contig location: Contig_ID=SeqID_25200; Location=1..1609; Strand=+
  SCN-specific regions: Sequence locations=1-681,709-742,764-1130,1205 -1609
  Gene Ontology: Mol. function=protein kinase activity; Cellular component=cytoplasm; Biological process=regulation of cell cycle

SEQ ID NO: 55941 - DNA, 138 bp, Heterodera glycines
  Genomic contig location: Contig_ID=SeqID_25201; Location=1505..1642; Strand=+
  SCN-specific regions: Sequence locations=41-138
aaattaaatttttaaaaatttttttgaatttttaaaaattcccggttggtcccggtccaagtcccgaaaaaaatcgaggtcccggtctcggcttctcacgtccccggcaagtcccggtcccggttttgcccaaaattc

SEQ ID NO: 55942 - DNA, 1756 bp, Heterodera glycines
  Genomic contig location: Contig_ID=SeqID_25202; Location=1..1756; Strand=-
  SCN-specific regions: Sequence locations=1-482,504-620,642-754,783 -1409,1431-1756
  Gene Ontology: Mol. function=gamma-glutamyl transferase activity; Cellular component=integral to plasma membrane; Biological process =spermatogenesis
agagcagcggattagataagcctaattattaaataaatatgcataatgtgatgttatttttccatttgctttaggcggtggattcataatgactttttacgatgccaaatcgcgcagttgcaaagttttggatgcgcgagagacagcgccggcggcgagttctcgggaaatgtacggaacggacgaatgggcatcgaaatatggtgagaaaaaggcacaaaatagtgctttgttaaatgcgtgatcatccgactgtattacgctaattacctttcttaaatgagtgatcaaccaaatgaatacactaattacccatggtaattaatgatgccttaggctatcgcgcaattgcgacccctggcgaactcgcgggctattggttggcattcaaagagtacggcagcggacgagtgaattggacagacttagtgagtggggggggggataagccgatcaatcaaccaattaatcactcgtaatcattcgccctttccttttgatcagatttcgcctgccgttcggttggccaggacgggggtgcccatttcggagtatttggcctacgttttgggggtcaaagagaagcatttccgaacactcccatcgatgaagtcagtggacaaatgccttttgcatttgcactaattaattcattgccttaattggccaattaaatttgttttaggagttggataaaccccgccacaaatcggtgagtggtcaaaagatcaaaagagtggcaaacgttttaattcccgcattttttaagtgtttatgaatttggcgacgttattcgaaggcccgaattggcggatacaatggaaaggctggcgaatgcgcagaatccggtcgaattgttctacaggggacaaatggcggaaacaatcgttgcggaaattcagaaaaatggtaaatggcaaaaaaggaatgtgttaaaagcattatatggcattttgctcgataatcgattgattggcaatcaatcgatagttccttacatttctgatcaaatggccttctctgatcaggcggtctgctctccaaagacgatttggccaactacagaccaaaggtttacgactcgccgctcatttcgggtggcttccgcggcgccttgcgaatgtgcggccctccgccgccgtcgtcgttcgccgtcactcaggccattgtggcggtgatggtcggtcagtaattggcatttgttgtgccaaattttcgacttcaattcagccaaattcactaattacacgcgcttcggaaaccctaccgacggcgttttggacgacaccgaattttaccattggctgatcgaagcgcagaaatttgcatatgcccagcgaacaaaacttggggacgtcgattttgtgccggaggcaatggaattggccaggtaaacagaaaaagcggcatttggccaaaaaggagagcccttggagaataatgcccatttgtgcacagaaatatgaccagcacgcgcttccatcgcgagattctgaagcgcgtgccaccaaaagcgatgttttccgcgtattatgccgaagagccatttgtggcacaggtggacagaaggggggagggggaagacagatcgaaagcgaagggaatgagcaaaccatcgaatgtcttcagaaggaggaccacggcacttcgcacgtttctgtcctcgacgccgaagggaatggcgtttcggcgacgagcactgtgaacagatggcacgtaactgttagatatccctcattaatgcctttttttattt

SEQ ID NO: 55943 - DNA, 1055 bp, Heterodera glycines
  Genomic contig location: Contig_ID=SeqID_25203; Location=565..1619; Strand=+
  SCN-specific regions: Sequence locations=1-484,522-536,571-879,905 -1055
atgaaaattaattttgtaattatttttttcttatttgtaatcgtcgtaattgatggaaccgatgaagatttatttgatgatttgtggaaaaacgttaagctatcaaactcaaaaaacattaataaacctatatttggggaaattaatgccataaaagaagaaagaattgttaaaaatgaaaatgatgaacaaaaaaatgccaataaactccaaatggaaaacacaaagccaaacttatttcaaaaaattaaaaagaaaccattggaagaacaaaataatcatttaaaactaaaaatgccaaaaattgaaatggacaaattgagcgaagaatcatttgaaattgagtttgatgagaaagctgatcagaatgtttcgtcgactgatcatagcaattcttcagatgatgaggattacaataatatggtaacaaaaaaaacagtatcattctaggaaaaaaagtattttttgaaaattcgcttgtttctaaaaatttatattaaaaataaataaattattttttagaatgctgaaacaagaaaggaaattaaaattttaaacgagtttaatttgatgaaaaaggaattgcggtgcaattataaaacaatgccaattgttcaatttgaacgtgaaattgcaaaaaaagttgggcacatatcgtaccaaaatttataaaatgaagagaaaattagaacaaacacggaagtacacagtaaataaggacataaataaggacacaatgattcgaatgatcagaaaatttgatgaaatgaaaaaggaaaaaatttatggatttaaatatgtatgataagaacaaaatatgcaaaattgaatgtgaaattgcgaatgaattgggaattactcggcaaaaaatttatcaatggaagaagaaaattggtaagaacaaatggaataagcgaattttaataattgtctcattttaagatttatctaaaaaattttcaacgccacaaaatattgaaaaaatagagcaatttgaaaaaatcaaacaagaatttaccaaaaaattcaatttgaaaccaaattgggaaattgaa

SEQ ID NO: 55944 - DNA, 63 bp, Heterodera glycines
  Genomic contig location: Contig_ID=SeqID_25204; Location=363..425; Strand=-
  SCN-specific regions: Sequence locations=1-63
atggcgtcaaaagcgagcgggttccgagcgggtgtttaccgcacaaacccatgcctatgggag

SEQ ID NO: 55945 - DNA, 645 bp, Heterodera glycines
  Genomic contig location: Contig_ID=SeqID_4848; Location=614..1258; Strand=-
  SCN-specific regions: Sequence locations=1-645
atgcgactggtccatggcaaggacccgacccccgacgttcattatctgcacgaaaaggatgactatcactttgtgaatgcagtgcacaagtacattgtccgacatccggaactgccatgggactcgccggagttcaacccatcagcaaacattcagcaaaacattgcagagttccgggaaatctttgagagcgaagtgttcgacgaaaattatgagctgaagacaagagaggagaagaacgagctgatagagctggtcaagggattccgattctacttcgcggacgagcttggacgctttacgctaaggattttcagcgacaaaatatcacacatcactttgacggatcagctggcctacgtgttgggctacgagcagcagcaagaaattcataacgaagaccaagccaagtacgctgttgacttggccggtggtgtcagtcatctgtgcatatacctaaacagtggaatcatcgaaagcatgatttttggcaacaccttcgccaatctcctccaagtgattgcggttgagggcacgtcaggcagtgtggtagagaaggactttcagtcaccgttattccacaaaattgtggctagagaggtggacgtgctggacgttgagattcgtacgctgaccggacggtag

SEQ ID NO: 55946 - DNA, 1695 bp, Heterodera glycines
  Genomic contig location: Contig_ID=SeqID_4850; Location=152..1846; Strand=+
  SCN-specific regions: Sequence locations=1-476,579-1016,1077 -1103,1125-1270,1292-1695
atgactgaagggattaccaagaaaacgggcgtttcatgtgattgccaatttggagagaaaggcaaagaaatgggcaatcaacagttcattttgccaccaattgcaccaattgtggaaaacgtgacggacataaacgcgttgaaaaaccgtaagaaatttaggaacgcaaattatagggtgtcgtcatgacaacccgtataaaaggcactcgtacactgttgtacaaaggcaactcgtaccattgcctagcttaggtatagacttccggctctggcctaagctttagactagcctaggcttcttgggtctaggcttaggcttgcttgtctctaggtttaggcttaagcctaggctttgttttgtaaaatatgagttgccttttgtacgagttgccaatgatatagatgtcaacaacattcataagaaaatttccataaaaaatatttaccgaaaaccattttattaagattcgatagtaaataaacattaaaaaaaattaaataagaatttctagttttaaataaaaatgttttttaagattcttgaagaaaaatttattagaatttttttttaattaaccatttctttttttgatggggattatgagacgaatttatgaaactccctagcggaatttacgaatcctcattttgaggcattgatattcactttttacagggcttgaatgcaaaatcggagttttccgtgaaaacggaatcgggcagatccacatcggcttctgtggggcggacgctacgcattgcttcgcggcgagttgtaagatcggtaagggtagcagtcttcaaagaattaagttcagacttgagaattaattatgttttaaaagcaaattcatttttttaaaatgtgatcagtcaattctctgaaaccgaaatttcgaaaaattataattttttggtgaaaaggcagcgtaagaatcgtgatcagtgagtgatctgtgtgattaaagagtctcgaaaagcccatggaaccttttttgacattcttttcaagtcttaaaatatattttgttaaattttttaattctaaatttttcaaattagatataattatttgggtttttaacagattgatgcattgataaaaatttaggaacaattatttgaatgaattttttatctatcctataatttttggtatacaaattgtgccaatttttatagggtttttttggcttttatttattgatgaattctttggtaaaattaaattcattatttaattgctgttcatttaattaatgctgttcattttgttgcagccagtggtgtgatcgacacttggggctgtcagccgtccaatgactattgctcaaaagttggcaaattgtgccatttttgcaaactaggcaaaaaggacgagaaacactcgaatatgaacttcatgattccgacatttttgaaaaaaaatgcaacgcgtgtgaccaaaggcattgtaagctcgacggttttggcaccgctgccggagggcaccaccactacgacgacgacgacgacggtttctacgactactacatccacggcttccaagacgatttcgacgccctctgcgaatttggtgaccgacatttcggatgaaatgtccgaaacaacggttgacggtaaaactgagtcccggccgtttcacccccaaagttttttgttcaattaatcattttattggggcggaggagca

SEQ ID NO: 55947 - DNA, 3491 bp, Heterodera glycines
  Genomic contig location: Contig_ID=SeqID_4850; Location=2227..5717; Strand=-
  SCN-specific regions: Sequence locations=1-56,78-254,277-449,472 -619,641-804,831-1139,1177-2207,2229-3156,3178-3312,3335-3491
tccatctttccactatcgcttttcttatctctttcatccccgccccttttccgttctcttcacacttttcctttccccagcgatcagttagtcgtcggagtcatcggatttaccaccgatcgattaattcacttttctcatctcgtccgtccatggaatatttcgatcacctattttatccggagaataaattagtcttttaacactgaggcaatttgggggatttaaccatcgatcccagggcccgggatccgtcctcccaaatcgtcctccccatttattcggaagcggtgagtcgtctgggggacccacgcgcctccctcactggtagcaccggatggtttgttttgccatttcggcaaacggttcatcgacgacgacaatgaggagtgatcgacgacgacagcagctgcagtgcctgcgggcaaagtaatggcgccggaggagagaatgttttgggtacccgcctgcgggcacaatacagtcaagcgcttagtgatcacttttaaaagagactgatcagaattaaatttgagttaaagattaaaatttaattacgtgcactttaaaaatgttaatgatcagaattttaatttgagttaatcaccagagataatttacatgatttatgatcagtgtgccaaagttaaaaaaaaattcataattagagattcagaaaattgtgtaaagagtaccgaacaaattaatgcacgtgaattctttattggactgttcaaagtttctggccaatcatgagaatgccaaatttactcacttacaattttggccaaattaatgacttcgaattaattttgagttattttttgtatgagtccaatgttcggccatttcaaagttcaaagattgcaaaaattttcttgttatccgccattaattactcggccgtgggaacggaggccacggcggcgctcttcatttagcggagatgcgatcagttcacataatttacgtgagaacattggcgatgtttattacacattcattcaaaaagagcgacattcgcggaaattcttttactgctttcattggccattcatttatgatctatcgcattttcagtcagaaaggaataggcaaacatgcaatcatttattttatgagagatatttgagctcaaatatttggctaaaataatttcatttttaattttgttaagcaatcaaaagcaattaatcttactctctccacgactaaagcaatggatattcccgacaaccctaaaggggttcgtcgcagcacttctgcctgcgggcacaatacagtatatgagttgagaaatgaggaggaggtgagtgaaatgacaatttcggtcattaataggaaattttggtcgggaaaagaaaaacggcggtgaaggtctctgacttagaggccgcccataacgaattggtcaaattggaagacggaatgaaccgttccattagggttcttaaccgttgtatggacaaaaagacaaaatgggtctcggaggtcgtctcaaatgccaattccaattttgagaccgtcaaggcccaaattgaaacgttggttgaccgaatcgacgagcttgaacgagcgaatgatggaacagatgcagcagcacggtgcgcgagcaggacgactcctcacaatttgaaacgccgttgaaggataacaagggcacagaccgtggcttttcaagcacaggtggcggtacggcaacgcaaacacagaaaggcgtcgggacctcttccaacaatcctgccggcccaacccgatctttcttggcatcaacatgttgagcaactcattatcgataaattcaaatttggagttattcggagaagaatcggtatacgccttcgatgattgggccgagcgattcaaggactacttatcggtgtccgggaaaaatctgactgaaggagagaaagtcacacgtctcaaattagcactcaaggacacgccgaggacacttttcaaggagctcgaggctgaccaaatcgtgactctcaccagcgccttggaagccttgagagccaaattggattcgcctcaacgacgggaattggcgaagagaacccttgcactgtgccgacagcgtgaggatgaaacggttggccaatttttaaggcgtatgacttcgctagttgagtcatcaaatccatcactatctggggatcagcgcaaagagaaagtttgtgaggaatttttggacagactcaagccaaatatgagctttctcattcgccttgttggccttacacaagccaagaatttggaattggtcaaagcccaagcagaagagcttgaggctctatttcttgcctctaaaggagatgatgtcactcgcctctctcacctgattaatgcgctgaaggacaaatccgaaaatgagcaatcaaattcaaatccaaatgccgaaaatgatcgcaactttggaaggcagcaacgcaataacacttgggggttcaggcccttcactgctgatgatgttcagcgacaacgtgccaactacaggggaggccgaggcaacagcaatcgtgacgtgactgggcaagagggagacaggagcacatgagccagagaaattggtctaacaacccggtttgctatttctgcaatagagtcggacatttggccaacaattgcaatgcaagaaaagcccaattcctaaaccgacgtggaggaaattcaaaattttgattattcgaaaaaggaattttcggtgggggattcaaaagtcaaattttgccaccaatcttcgtttttgcttaacgacatccgaatttgtgcggatgaaaatatttgggtccccagggattcagaaataatgatcaatgccagaattgagacactttcgagcccatcaaacccattggtaatcgacagaaccgacaacagcctaatcagaaagggcatgtcagtgttgaacagcgtttcgcctgcgggcaaaatacagataaagttggcattaattaatccatcaatggaatccaaacgtctttggaaaggaatgcatttggcatatgccaatgaagtcatttgcgactcttccggacttcttagagaggccaaccaaacacaagtcattgcacttgatgatcagaataaaaccaaaatcgatccatccttcattgtgagttattcaaaaacagttgccacagatgatgaacttaagaggctgaaacttctgattgaggaatattcggacactttcagccaaagtcaatacgatttgggtatgttttcagaagcagaacatcacatcaccacaacgacagatgagccaatttcctcaccaccccggagagtgccgtacaggtacagataagaactgaaaaagcacattgaataactcctggcatccggcgtaatggttgagtccgacacaccatgggttacgcctttggtgattgttcaaaagaaagacggtggcattcgtccgtgcttggacttcaggaaactgaacgaagtaacaattccggacaggtatccgttaccaatttcag

SEQ ID NO: 55948 - DNA, 932 bp, Heterodera glycines
  Genomic contig location: Contig_ID=SeqID_25206; Location=831..1762; Strand=-
  SCN-specific regions: Sequence locations=1-255,277-593,615-932
atgaagagctttataatgataccaacaatcatggatttggatgccaaagaaaaaagttatagcgaaaaacataaaaatttttgaaaatctgcccacagataacacacaagtatctttttttttcttttggatttcacctggtttcatttttgaaaaaaatatttccaactatttttggcgttttgcctttttaacaaaatgcaataaaaaggaaaatgcacccctaggaaatgaaaaatttctcaaaaattcatttccaacatttatttattcaattttaaacaattatagcatagaattttttataagtagactttaattaaatcaaaatcagcaaattacgaatgaattctcctgtaatttcccgcggaatgcatggtttttcaactactatctccaagagattcgcatcaagcattaggtttttgaaattatgattgattctttactgttttgccttttcagcgaaggacatgccgaatattaccgagagttcaatcgacttgcttctgctggaatttgggaccagttaaacatgcgaccaaaagttttcagcactaaaactgagaaagcagcggctatgaaagtctggcaaaaaatggtttgttgttttcctatggttttcgaaataatttcgaagcacttaagcggtaatagtgtagtttgtcccctcttactggttcttatacccaaaatgttgaggcaatgtggcatcattataagcaattccgaccacgtagcggaaacactgcaaacacatttgaaagttacttccccgagtttatgtggcgcaagcattttggcgataccgttgatgttttttataatttttggtctcatgtcactgaactatacccatgtgaatgaattcaaagctttgttcttctgcaaatttgttctttcgtgcatcgtaatcgattttggacaataaa

SEQ ID NO: 55949 - DNA, 226 bp, Heterodera glycines
  Genomic contig location: Contig_ID=SeqID_25206; Location=1897..2122; Strand=+
  SCN-specific regions: Sequence locations=1-123,160-226
atgcgatttccaagtacaatcttggaaaaaagtacagttaaacttttccaagcacaaaagccgaaatccaagtatgtacttggcattcaagtaccaatccgagccctgaactattataatgcgataaatactaatattttaataataaatttaataaatcacatttaagcaattgtttaattcatattcattcattaaggattcctataatcgctgattaatttta

SEQ ID NO: 55950 - DNA, 423 bp, Heterodera glycines
  Genomic contig location: Contig_ID=SeqID_25207; Location=368..790; Strand=-
  SCN-specific regions: Sequence locations=1-203,255-384
atgcgaagagaatgggcggagaaacattacaatgagaaaaggaaaaaggtgagaaaaggataaatgtaattgaattgataatggccaatgggaaataattaaatgagggaaatgcgtctaataatccttacaataactcggcacttttcgtcgaagatttatcgttaattgcatttttatcgtctatatatttattcagatccattttattaaattaatttgtattttttcatgcatatttattaaatttaaaaccccccacctaaaaaatgtcttgcggatttatcaaaatgtaaaatacactaatgcgccaaatacaaatctgagaaaaaaacatagtagtttctatttcttaaattttattgtatttaggttatattctcgtattatatattaataaaaaaatttatagtaaaaaataaa

SEQ ID NO: 55951 - DNA, 263 bp, Heterodera glycines
  Genomic contig location: Contig_ID=SeqID_25207; Location=646..908; Strand=+
  SCN-specific regions: Sequence locations=1-263
agtgccgagttattgtaaggattattagacgcatttccctcatttaattatttcccattggccattatcaattcaattacatttatccttttctcacctttttccttttctcattgtaatgtttctccgcccattctcttcgcattttctccttccccagtgatcagtcagtcagtagtggtgatggaacagacttcaattatttattccgatttctcgcttcgtataaatccaacaacgaatgaataaagacatctttaaca

SEQ ID NO: 55952 - DNA, 332 bp, Heterodera glycines
  Genomic contig location: Contig_ID=SeqID_25208; Location=358..689; Strand=-
  SCN-specific regions: Sequence locations=1-31,53-80,102-172,194 -209,231-276
atggagattggatttggtgaacaattatttttgacaaaaaatgtaaaaatttccaaggtgtgaaagggttcgacttccaattcccaatttctttgcaatatttcgtcgctaattggtggatttttttttcgttactaaatttttcttcgtttgtcctagttggaattttatttgtgctaaaaatataaaaattgcgcatttcagaactttcattttgttgaattttcatattcatcaaaacgatcgtattttgccgaattcattttataagcagtcaaaattaaatattaaaattcattttgcaattttataaaaaaaaagattaaaataaa

SEQ ID NO: 55953 - DNA, 448 bp, Heterodera glycines
  Genomic contig location: Contig_ID=SeqID_25210; Location=1389..1836; Strand=+
  SCN-specific regions: Sequence locations=1-47,89-234,262-317,339 -411,442-448
atggcctcaattaacaccagttcaaatgatccggtattaaactttagtaataattattttatttaattaattaattatttatttaattgtttcgcccagctttatttggcctaccgtttcgccggtccatccgccgatttgattgtgccggctgttgcactcaatttggttgcgttggttggcattgtgttgaacggcacagttttggtggtcactgtcaaatccaagtaaatcattttttaattaatttaaatttattttcagttccctccgcggctccgccaattttctgatggcattgatttgtatttgtgaattggtccaccaaattgggcactctttttttctggttgttgtcatttcgggcaaggattttgtcagtttgctcactgctgacttaattatgataggaaatttaattttaaatatttttttaattttgatttaa

SEQ ID NO: 55954 - DNA, 657 bp, Heterodera glycines
  Genomic contig location: Contig_ID=SeqID_25212; Location=171..827; Strand=-
  SCN-specific regions: Sequence locations=1-657
gttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttt

SEQ ID NO: 55955 - DNA, 1795 bp, Heterodera glycines
  Genomic contig location: Contig_ID=SeqID_25214; Location=1..1795; Strand=-
  SCN-specific regions: Sequence locations=1-109,134-299,321-328,350 -427,475-551,574-593,615-716,739-909,931-968,1010-1012,1034-1049,1071- 1178,1203-1432,1458-1517,1539-1679,1701-1795
  Gene Ontology: Mol. function=ATPase activity; Cellular component =spliceosome complex; Biological process=mRNA splicing
atgtccaaagcttaagctgatttaaatgagtgccacgttggattctgcccgattccaaaattatttaaattattgtgaaatgctgataattcgaggacgcacatttccagttgacattttggtaaatttgtttgcgtgtaaaattcttcaacaacaatttcacacaataaaagcattttaattcagtattctccgacaccagtaattagctacacacatgctgcggtcgaaacagcattgcaaatccatttgactgcaaagcgtcctggggatcttttaatttttgtgactggtcaaaaagtaataatcattttatacctgaaagttgaatagaatatttaattagaattttaaggagactgaaaaggtttgtcggctaattcgctggaaatgaacgatgatatggtttcacaatttggacaattagtaataaatagttttaaatatcatatatatatataatttatttattttcccttttgtttaattacagtattgttttcctttgtatgcctcaatgccattggacaaacaacaacgtgttttccaacaatgcattccaaacaaaaaatgcacattgatcagtaataagcaataaatagtcttaaataaaatgttcacaacttttttttattagatcgtaaatgcattgtcgcaaccaatgttgccgaaacatcaattactattgatggtattgcctttgtcgttgacactggattttgcaaacaaaaaatttacaatccacaaattcgtgttgatgtaagtaggttgtttggtgtgtttgtatacatgaatttggttgtatattaattttttataacacagagccttctggttacgccaatttcacaagcctcagcaatgcaaagagcaggtcgtgctgggcggacccaacctggacaatgctatcgtttgtatactgaaaatgcatataaaacggaaatgcaaccgcatacaacacctgaagtaaagaataaataaaaatgaaaatatatacatgtataataacttaaacaaaaaatttttcattggcgggcagttcggccaggataaggcccggctggccaagctggcggccgtgttcgttgccgaaggcaagaagaaggggtggtccccacgcagcctggagagcattaagaagaaggctcagcgcctgatttgtcaggtgcgggatgagggcggggtggtaaagggcggggggccacccattaaggtggtgattcggaacaaagaagggccgagctgctcggcaacgtcggctggcgggcaaccgccggcggggaggcagctggaagatgtggtggtgccacaggatggtggcccgttgcaccaggtccaacagcatgtttacatcgattccttacttaatccgcagggccaggtggcgaaggccccgggagggacgtttgagccgctggtggggattgaagaggcgttggaggaggctgcggccgccgtgggggaggagttggagacggaagtgatggagggtttgatgagtgaagaggagctggcggccgcgcaggcggagatgtttgaggagatgggaccgtctggggacgtgtcggatgaggatgtggagctgttggagaagctgatggcgcagaaggcgccctgagcggcacgggcaggtgctccgccacatcgggactgaaactgtcaggtcggtgtggcggatactggaagggtccctcctgggtgggaggtgggggggggggttctttttttcgcagacacactgcaacgacagctcaatatggagaggttcttcgacttgcttgtcggaagctcatcg

SEQ ID NO: 55956 - DNA, 1288 bp, Heterodera glycines
  Genomic contig location: Contig_ID=SeqID_4852; Location=216..1503; Strand=+
  SCN-specific regions: Sequence locations=1-223,245-373,395-493,534 -577,599-1146,1168-1288
ttaaaattggacaaaatgaaattagagtcaattaagcaaaacaaaaaacatttgccacctcatttagcaaattatgtgctcaatcattgatgagtcacccgtcgcaattggcaatggcggcacagaaacacagctggtcagtgagtatggtggttcaacagaagaggcaatcaaaagcataagcacattcaatatacaaatacagcaaaagtgccaaataaataattaaattacccataattaaattaccgtatttttctaattatccctccggggggattattaagcaaattcagctgaatacctggcaacattttatttgacaatggtcttttaagttagctctagaggtttaaaaagaatttttttcgaaaaattaaaaattccatttatcccccagggaggataaatggagacagtgcataattagagtaaatacggtacccaaaattaaattcattttaaaatgcctgccaattacagtggaataatgatttttttaaaatataattaattcaaataaaatttattttctattttctccatcacttttacctctgacagaattattgtgcatttttaattttcaattttattcactataaaatgctaattttaataatttccccattagtcaactccattccgtggcgttttggacgtgcgctttgagcccggccaaactttgacagtgaagggaatcgtcggggagaaggcgcgccaattcagcgtcaatttgcacagtcggacggccgacttcagcggcagcgacgtgccgttgcgcgtcgcggcacgcgtcgaccgggcaaaggtcgcgccgttgggagcacccgccaaaacagaaaccaaataccgtatttcagtttttaaaccccctgaaaaggggggggggctctattttaggggtgggggtgtattgtatgtaacacgataatattcagaatatttttctcaaattttcaattatgttagctctaggaaatcgagactatggcataatttctaaaattggtgctaatttcacacactgaagagggagagagtacgctgagactgatcaatgagattggcccggttgatcgataagacagaaacaaacggacgataatcgagcggaatccgtcgagaataattattaattgtctccattttcatccgtcctctcagattggcctcaattcgatggtgaacaaaatgtgggggaaggaacagcggaaggggcactcgttgaagcccggcaagcccatcgacttgcgaatccgggcgcatgacaaggaatttcaggcgg

SEQ ID NO: 55957 - DNA, 804 bp, Heterodera glycines
  Genomic contig location: Contig_ID=SeqID_4853; Location=98..901; Strand=+
  SCN-specific regions: Sequence locations=1-476,499-543,566-676,699-804
  Gene Ontology: Mol. function=galactose binding lectin; Cellular component=cytoplasm
tgtcccacgcttacaagaaagaaaaagcctcttgcagatcataatcgacggcaaagcgttcaaacggtacgcctaccaatcgccgcttcagtccatcacccatttgtccattgacggcgacttggccatacagcatattgtgccgactttttttgaatttaattacgttttgccactttagcattggggcgggaaagtttacgtgagttataatattggattggattatgcttaattgattaatgtaacctgaatttgtccattttaattctgattttaaattgctttgagcctgtcccctatgaaacgggccttccccacggcttcccaattggcaaatgcctgaaaatgtccggcactccgtcgctgagaaagggcgggcgctttgaagtcaatttgttgcgcaaaaatggtcacattgcgttgcatttaaacgcgcgttttgacgaaaaagtctatcgaaaatgtttttttttgtgccaaaatttgaatttttgccccaggcggtggtgcgcaattcgctcgaggcaaatgaatggggaaatgaggaaagggagggcaaaatgccattcgaaaggggccattgcttcgatttggccatcacaaatgaagccaatcattttggggtacgtcgggattataatttaactttttattgtctaattaagatgattaatttaatctctttttcagattttcgtcaatgggcaacattttgccaattttgtgcatcggtcaaagcccgaagacatttttggcctgctaattcagggagacatcgaagtttgtcaagcaaaagcaatt

SEQ ID NO: 55958 - DNA, 2333 bp, Heterodera glycines
  Genomic contig location: Contig_ID=SeqID_4853; Location=1672..4004; Strand=-
  SCN-specific regions: Sequence locations=1-320,343-452,474-534,600 -1168,1190-1304,1328-1365,1405-1485,1512-1519,1541-1620,1643 -2046,2069-2333
  Gene Ontology: Mol. function=RAS small monomeric GTPase activity; Cellular component=plasma membrane; Biological process=adenylate cyclase activation
atgactcattcattcggctctgatcagttaatcaccgccacagaacattcgctgactgctgaccaccaacagaggagcaatgggtgagtcagtgaagcgaaagcggcgattattttggttggcggtgaacggaggcggaaaatggggagcgggaaaggcattgcggacgacggtgatcagaggcgacggatcaatgtcagcagcaaacaaatgctcaccccctccccatacacattattaacttgatcgagagccaattttgaatttacagtatttttaagggattatttatttattttaatgtgattcaaatgtccataaaatgaaaacagaaaatttcaagatttggtgggatattactgaccaaatttaaaatttatttggataatttaattggattattttggattaaaaagtttcaaaaatgaaaaaaatgaccaaaaaggcaaaagattctatttttatgactttatttagctaaattcgtttaataactttttgtctgcggtgaatcttaatgggaactgacagatcatttttagaattaattaaatcaaaataaattaattattcgaattttcatttaaatattaaaaaaacatattgccaacagcagccggcacttagctaattgctagctaatgccgaatatttgtttaattaaataattaatcttaatgggcattcttttcgaatttaaggcctttttaaatacttatattcaacttatcataactttgttcttgacaaaaaatggccagtggcgcgaagcgtccgcccggcactgaccaagaccagcaacttcccacttacaagtaataaacaaacgaaccaatccaatggcaccaagccaattgccgtcccaccctctctctcctttaggcttgttgtgattggcgagggcggtgttggcaaatcgtcgctgaccattcaattcttccaggcaggtgggggcataggacggacaaacggacggagagacaaattggccattgtcaggccgattttacaccatttttcgtcctttttgtcaccttttttggcctaataataccaagttttcgtccttttttcacttttttccgtaaaattttcattaaaaattgtaaaaatccctcgcaaaatctttcaattcgtttctccatttcagaagcaatttgtggattattacgacccgaccattgaggatcagtacattcaacattgcgaaattgatggccaatgggtcattctcgacggtcagttgcaaagccatttcaatttaattgctttattcattcgaatttaatttaattgaagtgcttgacactgctggacaggaggagttttccgcaatgcgagaacagtgcgtttttgcgttttctgaattttaaatacaattttttcataaattttaaatattttcagatatatgcgcaatgggcgcggctttttgttggtgtattcggtgacggacgagcaaagttttcaggcattctctttttctttttttaatttaaatttaattttttgctaaattttccgttttttcaggaggcgcgcaaattgtaccagcaagtgttgcgggtgaaggacaccagcgaatatccggtgctgttggtgggcaacaaagtgagcagagaagggaattaaaaagagaaaatgacagagggaaagggtaattaaaaagggagagggactaattagtcgtaattagtacaaaaaacaaagctaatagactaaaaccaaatgccttttgtttctttaggttgacctgatcaaccagaggaaaggtaaccaaattttgcatttgccgctttttgatttgctttttccaaatgcctaattttgttttggcatttcccccaaattttcagtcagtgaacagcagggccggcaattggctgccgagttgggcgtgccgtacatcgaaacgtcggcgaaagatccgccggtgaatgtggacgccgcgttccacgaacttgtgcgcattgtgaacacttttccgagcgaggacagcgcaacttccgaggcaaaccgaagggggggggggacggacggcggagatttggggattttgagaatttggttggggattttggtgaagttttggggtcggaatgttttgtttattgcatttacaaaagagttcttggttcaattgcactttatatgtccaatggcattttatgcgtccaaatcgggccaaccattcaattttgcatattttagctccttccgactttgtgcctaaattgaaaatttaggccaagaaaaatgggcccaatcgaatggcgtcaaaagcaaagcgtcggagcagcgccggcagcaacaaaaagtgcctaattcaatga

SEQ ID NO: 55959 - DNA, 1100 bp, Heterodera glycines
  Genomic contig location: Contig_ID=SeqID_4854; Location=342..1441; Strand=+
  SCN-specific regions: Sequence locations=1-338,365-734,756-1100
  Gene Ontology: Mol. function=structural constituent of cuticle; Cellular component=extracellular; Biological process=embryogenesis and morphogenesis
atgtccgttaacaaagcaacggtcggtgccattgctctgtccggctccaccctgttggtgtgcctgtttggcattgcgtccatttacagtgacattcaagccatttggaacgagttggacatggaggttggtccgcagcaacagatgatcaagccacctttaaaatgaccatcattaagatggaccagtttaaaatgcaagcggacgacctgtggaaggacatgctgaagatgggtgccgggacggccgcgaatcgggcacgtcgcgaggcgtatgggggctatcaggtgagatacccaaaaaaactgaactttaccgttctggagactcgagaaagggtcaacaaaaaataaataaaatgaatcagacacactttgaaatgaacatttggcatttttaggcttccggcagccaaccacaaccatcccccggcgccttgtcttcaccgcaaggagtcgaagtgccgcccgccgttatgccgggattcgccccgggcgtatcgccttcggtcaacagtgtgttctcgcccactgctggcagcaacaatgtattctccccgttcgccccgactggcagcaacagcatcaacaacgggctgccaatgccttttggccagtcaccggacggacccaacggcggtggcactttccctggcggcttcatcaccccggccggctcgggcccaggatgcagtaggattttggatttttgaatacaaattgggataccggtatagtgggaaaaggaaaggaaaagccgagaaaagtcatgggaaccgccatccaatgcttttcttaaaatggttcgggtgtgcttcgatccctcactctttcgtcgcccttcccacactttttcttggccacgaaatgcccccctttggccattgtttttgcctaacttcgaatcaccaattgatattttgttggcactttcttgacttgtttttctcagagtgcaagtcgcgaaacacgtgccctgcgggccccgctggtccgccgggcgacattggaccctcgggcgtgcccggcatcccgggaaaagacggcattcccggacaggcggccgaagactcgcaaaacgcaccgctcaaaggctgcttc

SEQ ID NO: 55960 - DNA, 802 bp, Heterodera glycines
  Genomic contig location: Contig_ID=SeqID_25216; Location=1019..1820; Strand=-
  SCN-specific regions: Sequence locations=1-341,364-653,675-719,745-802
catttcaatcactgggactcaatccaccagaatttcaatcactgggactcaacccaccagcatttcaatcactgggactcaattctgcatttcaatcactggcactcaacctaccaacatttcaatcactggtactcaacccaacagcattccaatcactggcactcaacccaccagcatttcaatcactgggacttaattcatttcaatcactggcactcaacccaccaacattccaatcactggcactcaacacaacagcatttcaatcactggcactcaacccaccagcatttcaatcactgggactcaattctgcatttcaatcactggcactcaacccaccagcattccaatcactgggactcaacccacaagcatttcaatcactccagaattcaatctcaccaattcttcgaaacccaataaccggaaatgaatgataaaaccgacagcggctcgaccgcttagcggcctcgcactcttcttttggcattttcttatggcataacagttcttccttgtttcttgacattttcttacgacacaacatttttcttctatacaaatttttcaaacaaaatctcattcattcatttaaaaacataagcaaaacaatacctttcatatcaaaatcaaatcaatttaaacacaaacaacaaagaaagaaaagatacatttttaagactgttttttacactaactgacaaaagaaaactgtaaaacaaaaacatttcatttttcaaagcatttatacaacacaacacaatgttaatattataggattttcttactgaataaa

SEQ ID NO: 55961 - DNA, 484 bp, Heterodera glycines
  Genomic contig location: Contig_ID=SeqID_25218; Location=603..1086; Strand=+
  SCN-specific regions: Sequence locations=1-49,93-403,435-484
atgataaagattttggtattgaggagcctgaacatttcgatgaaaatggtaaattaataaataaaaaagtaaaatttattttaaataaaaaagaaaatgcggctgctgaaagtacggaatgtccaatatgttgtgattatgtaacatatgatcagctctgtttctgtgatcatttaattggtgacgcaatttttggtagcagttcaaacaatgcacaaaaaggcatagcaattaaaacgaaaaatgccatttaattaataaatttaagaatcgcatgccttctgccgcgagtgccttaaaggctacacaaaagcggcactcgaaacgaaaccatttgcaagcggttggctggacactgaaatgcatgccggaaaaatgcgaaaatcctcttccatggtgtaacttttaatatatatattattaaatttttaaatcgattcattatctaataccaatatgatgtttcttacgtcacattatatta

SEQ ID NO: 55962 - DNA, 579 bp, Heterodera glycines
  Genomic contig location: Contig_ID=SeqID_25219; Location=717..1295; Strand=-
  SCN-specific regions: Sequence locations=1-95,117-509,531-579
atgctgaccacgaatctgacgtttatttttaggcataaagtgttttgtacgtgagttacgtgaaaagcgaaactagaaaaattgaaagtttcgactttttgttcgaattcgggttcaaggttcgaattgtgtcgaaatggatgtaggaaccggattctccgaccgtgaaaacacctaaaatgacttaacttcgagaaaaaaaattttgaaatttttttctaaaggggggggggggttaaaatcggcactgttatctttttaaatttttcacgtaaaatttcacttaactcactggaaacacgtcatggttaaaaacaaaaagtcagattcgtcatcagcatcaaaaatgagcctagaaaaaattcttagaaaaaaaatttcagggggtgacaaaaacctaaagtacccaacaatgaccatatacattttgcccacctgtatgaaaaagctttttggcgattcaatttgttgcttctcattgctcgcagcagaaggtgttgctgcacattggtcaacttttgactgttcagaaaagctaaattctatgatttaaaaatttccaaaaaatattgaattaaa

SEQ ID NO: 55963 - DNA, 297 bp, Heterodera glycines
  Genomic contig location: Contig_ID=SeqID_25220; Location=311..607; Strand=-
  SCN-specific regions: Sequence locations=1-297
  Gene Ontology: Mol. function=ATPase activity; Cellular component =spliceosome complex; Biological process=mRNA splicing
atgtcccacattaatcccttaaataaccgtccatactccagcaaatattttgaactgcttgaaacccgaaggcgacttcctgtagttaaatatcaacatcaatttgtccaacatctacaatcacaaaaacaatgccttttaattgttggagaaactggcagtggcaaagccactcaaattccacaatgggcaatggattttgttcacggcacagcacaaaaagttatttgcacgcagccacgaaggctggctgcgatgtgcgtggccaaccgtgttgcagaggaaatggatgtttct

SEQ ID NO: 55964 - DNA, 344 bp, Heterodera glycines
  Genomic contig location: Contig_ID=SeqID_25222; Location=1272..1615; Strand=+
  SCN-specific regions: Sequence locations=1-232,272-344
atgttctctttcgttgaagagggttggctgttctcggcactttccctcggcactctgttgggcaccattctaattggccatctgtgcactttggtcggttttcgtcgcacattcactgcctacggtattctgaacggactgggtacggtggcggtgccattggctgtcaaatttctcacaaagccattccattttgtggccatatttggcgcccgattcttccaagtgaacgttttatatttaaatttaaattttttaataaattttttaagggaattttcctttcgatgtcattggtggccattggtaatatgatgtgctgattaagtgtgataatgagcgta

SEQ ID NO: 55965 - DNA, 132 bp, Heterodera glycines
  Genomic contig location: Contig_ID=SeqID_25222; Location=1939..2070; Strand=+
  SCN-specific regions: Sequence locations=1-132
atgcctttgtccggctttttgtgcgactcttcgcttggctggccaggccgtttattatttccttggcattccgacgcttttcacattttcacttttttgtttgttttatcgggaaacgccatcacagcacag

SEQ ID NO: 55966 - DNA, 229 bp, Heterodera glycines
  Genomic contig location: Contig_ID=SeqID_25223; Location=145..373; Strand=+
  SCN-specific regions: Sequence locations=1-48,95-229
atggggatctgggtgagaaaagagaagggaattaattggtgagggatcaaaaatttttgataaaaataaattaaattatttattttcatttatagcatgtgttcgtatgcataagtggtcaagtggctaaacctttttactttcattatttgtctcttcggttcaattccctgatggaacagaaaatttttttatattttctttaccattatttaattgaatttaatta

SEQ ID NO: 55967 - DNA, 248 bp, Heterodera glycines
  Genomic contig location: Contig_ID=SeqID_25225; Location=418..665; Strand=-
  SCN-specific regions: Sequence locations=1-248
atgttcagcaacaacagttttggagctacattaattctctgttggatgggaaacaggaatcggaaaggtcgcagttttattcgtcgaaaaacaagtcaagagatcgaagataaaggggtcttcctgtttcagtcttccgactttggtatcaattacgacaagaatcgcccaaaaatggtcaaacgaagcgatgtcgaagaagttagaggacatcaattctctgatgacgagactaacccttcacaacc

SEQ ID NO: 55968 - DNA, 300 bp, Heterodera glycines
  Genomic contig location: Contig_ID=SeqID_25225; Location=1..300; Strand=+
  SCN-specific regions: Sequence locations=1-83,105-202,224-264,287-300
  Gene Ontology: Cellular component=cell; Biological process=asymmetric protein localization involved in cell fate commitment
aacgacaagtcagcttattctctgtgcactgtggcctattcagagggaaaagacaagcccatccatctttttactgggctaacaaatggacaaattgttgagccgcgagggtcgcgcgagttcggatgggacccatgcttccaagtgaattaatgcttattcaaattaatggtttttatattcatcctttagcccgatggatttcaaaaaacatttgcagaaatgaccaaggaagaaaagaatcaaatatcgcacagagcgatcgcattagggaaattgagagaatttttgcaaaatgag

SEQ ID NO: 55969 - DNA, 255 bp, Heterodera glycines
  misc_feature (43)..(43): n is a, c, g, or t
  misc_feature (70)..(71): n is a, c, g, or t
  Genomic contig location: Contig_ID=SeqID_25225; Location=1452..1706; Strand=-
  SCN-specific regions: Sequence locations=1-255
tgctctttctattgtcgtttcgctgatttcttactctgttctnccattaccaagtagcacacttttattnntctgtccttatttcatatttagcaatccttcaacgaattccgactgcttgcgatggcaatgttttgctacggtttggcattgaaataggcatgccataaatcggtcaaaggaagtgatggagcggatagcgcgctcctttcactctgtgccgctgagttgacgacactgctcagaacgaatttg

SEQ ID NO: 55970 - DNA, 564 bp, Heterodera glycines
  Genomic contig location: Contig_ID=SeqID_4855; Location=683..1246; Strand=-
  SCN-specific regions: Sequence locations=1-564
atggccaatgaatttgacccaaattggaatgacgaagaaatcagcgcacatatggggaatttaactgatcgtgaggctggaagcagattaatgcatccgagaccatcggaaagaagcctattcaaagatgacgagcacttttttgggattttgacggactatgaaatgcaaaaaaaggagataagcgaaaaggtgaatctgctctaatacttaggttttttccggatccttattttcttgatacatcttggtcgaagaaattttccgtcatataatgccaggagcttttctccgccgtttatccccatttttgaggcaatccatcttcttcacaagcatatcttgggcagtagggagccccacgcagcaggagtgtataggtcgaatgatcttctagtgcttgagaagaaaccgactgcagcgaaggaagtcccggcacaaatgaaggaattcgtgcactgggcaaacagcaatgaaaacaacggcgacatcgctcgttttgcagcgctagttcactacaagctggttaatgatagctttacttaaaaattgcaaaaaattaaa

SEQ ID NO: 55971 - DNA, 1108 bp, Heterodera glycines
  Genomic contig location: Contig_ID=SeqID_4855; Location=1735..2842; Strand=+
  SCN-specific regions: Sequence locations=1-140,167-184,222-629,653 -1108
atggaaaattcgctgagaactgatgtgctgctacctcatcacccaatttgcagttttggcccttgcccacttgcaacattcctcggtaaaagccggatgtggggtggactccatttttttgcgaaaaaaccaaaaaaatttacataaaatcttcaggcaaagaaaagacaaaaattggtatcgaaaagtttgtttattttctgtttcacactgctgctctgcatttcacttctcacaaaaacattatcatttttcatgctgtgatttcatacccattttttatgctcgaaattccgacaaatttgatttttttttttaacttacatatttaagtaaattttcgtatgttttcatttttccaaaatgtagataaagaaaattcggccctactgtcgaaatagttggaacgtcataactttttttcttcgttcatcacttttaaattggtatcatttgaaagctcttcataatctgtacaaaaaatcaaaaataagcaaaaatacattaaaaatctgaaagaaaaacgtatgtatgacgttccaaatttactgggacagagtgggcgggaaagagttggtcggatttgtagggcaactgaaacattttttattgttatttacgctcaaacctaaaaattcaaatttaacaattatatcggaattccgagcgtaatcaagcattataattacaacagaaaacagctagttttttcaagggatttttcttaaatcgagattaacttttttttcgtgtatcatcgtcaaattttattttttggcatttttaagccattttgaaactgtaatgtctgttggcataatgtccacttctgttaaagtccatttaatccagtcgcaatttgccgggattctgacaactaaacgaaatggactattttaactgaaaaaaatgaaaatttgaattttggatgaaaatttttccatctattttccgatcaatcgaaatggtttaccaaattttgctgctgctttccgggttccatccaagccgagtccaattttcttcgtccaaaattgcttttccaaaaattcggggcaccgagcgcaacatctggagcctacaaacagttcacgaaattttgttcaaa

SEQ ID NO: 55972 - DNA, 1608 bp, Heterodera glycines
  Genomic contig location: Contig_ID=SeqID_4856; Location=36..1643; Strand=-
  SCN-specific regions: Sequence locations=1-37,59-455,477-865,887 -1094,1150-1322,1351-1508,1532-1549,1575-1608
atgaatcgacggtaagcaatcattaaaaaaatgtcgcaaattttcatttcactattttttcatgtttcagttgggtgtgcaacgacgtgtggatggacattttcccatcgtttgaccgtgctcaacttggcctcaaaatggcattgctttcgccacgttttgatgcgctggtggacaaacattttgacggcaaaacgcaatttacgatttggaaagcaattgaaattcgcaaggacactgatgaaatgccaaaactttttgttgaaggcaaatcggagggatttccattgccggaccgtccgctgcccaacaaaatcatcttttccagctataagcaacttcagattcagtaaattcaaactgattgtgttatttttttcgtattccttcaacagtttccccttttcaggtacattgatcacttcgtcatcgaatttctccgttccaatcagcagatttgggacaaaggcaccaaattgaaaatcattgtttgggaaaaaaacgaagataacaagccaattttggatgatgttgtccgtgaaatatggccattttttgcgacaaacattcgccaatttggttttgacggtgccgaatttttggacaatttgcgtcgactcatttcgccaacaattctatccgatcttgatcagttgaattcaatcctacctggtgatctgtttcccgatgtgcttgctgatgatgattttgatgggccaaatgcgacttctgccggccaagcgttggccaaatggttgcacaatccgagaaaagatggccaaccaaagtcattgcattgctgggaaatgatggcatccacaaactttgaatggctcaacagtttcaaggaggtcagtttgtcgttacaatttcatatttgacaatgtacgaattttggttttttgtttaggtttttgtccgtgcccgcacttctgtcagttacactgtctactttacttttttcgtctctgcgccaattgagccatttgaattggtgaatgaacagactaaagaaaagctgacattgaagaaagaatcggatattggctcttctcattcttggctgttgaagtgatgtccaattactattgttggggaggagagggcggaggcggttcagaaacaacagcagcagcagaagaaaaaagatggaaattttgcgaacagattgatcaatgtctatttcaattttagtgcctgcaaaaattgccttgggtgagcaaaaaaaaggcaagaaaatggacctgactgggggagaggttaaatttttggcgaaaaccaaaaaagcgcactgatcaagatgtgaagttttttttattaagttgaagaaaacaaaacaaaatttatcagtagattcgtcaattaagaagatttccgaaattaaaatttttaaacaatgggattttttattttggtatcatcaaatcattttttttttcaattttgtaaatttttttctaaccctcctcctcttgtccatttagggtgacagcttttccttttgttttgaaaataatattcaaatttcattgaattttcaggcctttgtctccacctgcagcagcagcagaaaaagaagcgagtcaaagcagcgaaaagggcgtctaa

SEQ ID NO: 55973 - DNA, 1567 bp, Heterodera glycines
  Genomic contig location: Contig_ID=SeqID_4856; Location=2095..3661; Strand=-
  SCN-specific regions: Sequence locations=1-191,241-518,541-812,834 -942,964-1049,1071-1092,1119-1192,1214-1282,1304-1340,1363-1429,1452 -1461,1483-1567
atgtctttgttgagagctcagcgatttgttgttgagcgctttgatggctgttcggtttaccacactcctttgccatatgaatttgtggttacgaacttcacaaaaattgaagttgttcagtttgctccaaagcttgtggaatcttttgagaaattgataccgggttgtctttatagtaagtttaatgatttaattaattttaattgaaaaattcaaaacatgttttaaagatgttttatgacatagttagcacgagaaaagctgtcaaaaaaattttgcacattattgtgctatcatgttttgttgatcacatctgtgtgggattttgtaaacaagaatttttttagtgtatttcattgttagtttatttttatgagatgcacattatgtgtcgttaaggtttttgaaattgcatttttattaagcaatgaattgtgctctggcttcgtcgtttgcaccaatcggaaaacaacttgctgcagtggttgctgacacgaaaggaaaaagggctgacttatatgttagtggagaaaaattggtggagcaccttggttctttcagcaaaaacatgcagataaacctcgccaattttttttgttaaagtgcaaggtaaagacttttttgtctaaagatttaaatgaggtttgaatttagtctttttatagatgaatgtcttcaaattcactgcgaagttgcatctattaaaattggagttggtcgcgttaattttgaggaaatcttgacgactccagttaaacgtcgtagttcagaaacttttgaccaaattaagaagtcgcaaaaaaatgggtagtctttcgtttgttgttcgttgttttgatttgatttgcgactcagaccttttcagttacggttattatgttgattttttgtgatgcttggttatttaattatatttttgatcttcacatattatcaaatacggatattattttcttttttataatcatatttaaacatacattgaaattgtaatttgttagaaaattgttaaaatttgataaatgattgttttgggatcacaataatgtgcttctatgttattagaaacctaaacaagtgtgaaatttgttaaaaaattcatttttattgtattgctttgagatacacagtgatgtgcctctcaagttttagaaacccacacaagtgttgaattttgtcaaaaagaattctctgttgttgtattgttttgagatgcacattactgtgtctctaatgttttagaaacccacacaagtgttgaattttgtcaaaaagaattctctgttgttgtattgttttgagatgcacattagtgtgtctctaatgttttagaaacccacacaagtgttaaattttgtcaaaaagaattctccgttgttgtattgtcttgagatgcccattactgtgtctctaatgttttagagaccacacaagtgttaaattttgtcaaaaagaattctctgttgttgtattgttttgagatgcccattagtgtgtctctaatgttttagagaccactgacctaagaaatgctatgaatgttgtaccatatgaaagtgccaataaa

SEQ ID NO: 55974 - DNA, 726 bp, Heterodera glycines
  Genomic contig location: Contig_ID=SeqID_4857; Location=493..1218; Strand=+
  SCN-specific regions: Sequence locations=1-38,61-82,104-488,512 -517,558-726
atgcataaggggtgcagcaaagttccatccacctccgatgttcggtcaccatctgtgaaacggaagcgtatgatcagcaatttggagattgaagaggatgaggagattaccacctctgatgaggagcgcgaggcgactgccaatgctaacaaagagccaggttcatatttgtttagccaaaaacataaaaaattacggcacttttggtgtcggggcacccctgaaaaatgccaaaacgtgaaacccttttcattttttttaataataattcgtaaaaactttttctcttatccccgaactcataaaattcaatttttttttaaaggttcaaagtagagttgatcgggactgggaccaaaacacggacaaatgagtaccaaggtcccggttttgaccgggaccgggaaattcccggttttcccagccaaaaagtcccggttttgcccaaaattcccggtcacgctcaactctagttcaaagtaaaatgaattaaattatagtacttccaactcagaaaatgatgacgaagacgaggaggaggagagtgaagatgaggaagaaacgcctcttccggaagcgcttgcagtgacgcgctcacggcgtgcaaatgccggccgacgaatggccgaactgatggcacagcaaacgaacgaaaaggacgatttctacggcactttgtacggcggatttgaagaggtttttcttttttcgaaaaccatattttaa

SEQ ID NO: 55975 - DNA, 933 bp, Heterodera glycines
  Genomic contig location: Contig_ID=SeqID_25227; Location=1050..1982; Strand=-
  SCN-specific regions: Sequence locations=1-11,33-42,82-164,190 -262,289-343,368-604,626-786,808-933
atggggatctgggtcaaattgctgaccaaagttggaggttagaaaaatttaaaaaaaaataataaaatatttactttaaatgccactatttatctctactgatatgctttaaaaattgaatttacgtattaatttacgttatacttctatcgccaaaatagttatattctttttgtttttcatttccttctttgtccaattcgctcgcatagcgatttttaaaggatgcttttgaacaattatcccatgccgaaatattcacataaatttatataatttttaaaatttcagctcattaccccctcaaaataaactgtatcagtgtttcggaagtgacgagttgataaacacaaataatctctgatttataatgtagttaagcaaatttttacaggcgttgtggaaatatcgagttgatagcgccaataatcaattgggcccggaacccggcttctctgtgcccggcaaaacccggacccggttttaccaaatttccatttcatttttttcaaattttcattttccaatttgttgcaactttctcatctcttcttcttccaacagcaaaaaaaaaagtaatttatggcgctgttttttgaatgtgaatttttcagcttcagtaaaactcatcaatttttaagcgctgcaacaaaataacgctgaaaatagcactcacgcggacaaaagcaaattggacggacgcgaaaaatggattctttgctgctttgccgcgggcattggccaaaataagcgcaagaaatattttaattaatcggaaattaatttgagaaaaaggcaaaaacataattttaatacttaatagggtatttatttgctgggaaaagttaattaactttattatcctttgctttcccattcacctgctgttgctcacacacatttgatctctcaatttcccatttccaaaataaa

SEQ ID NO: 55976 - DNA, 1165 bp, Heterodera glycines
  Genomic contig location: Contig_ID=SeqID_25229; Location=448..1612; Strand=-
  SCN-specific regions: Sequence locations=113-210,238-319,403-415,441 -470,498-559,594-606,643-671,731-734,775-782,812-864,935-999,1098 -1098,1138-1138
atgctgaacccgttggagcgtcaattcctcgatgcagccgaaaaaggcaatcggccggtgctggaagcgtgtttggccaagcaattggtgggcatggccaagggacagcaaccgatcggagagattggaaattgagtaaaaggattttggaaaggatagcctagcaaaaaaataaattggggacaaagggcggcaatgggaatttgggacagaagcaaacaaaacaaaaaatgccaaaggaatgtgggaaaggagaagtcgaattcgatggaggaaatacccccccccccccaaaaaagtgccaaaaaataaatctcaagagaaaagcgccgctgaatatcaatgcggtggacacaatgggacggacggcgatcgaaatagcggtggacaacgaaaatttgggtaatcttttgcttaatgggaaggcaaaaaatggcactaagcagaagaacattaattaaacaatctcagaaattgtgcaacttttgctgcgacaggtgagtacggcacttttccccgcaaaagttccataataattgcacaattaattattatctctacagcccgacgttcgcatcggaaacgcccttttggtgggtgccaaattttggtttgccattcaaaaagtgacatggatggcactccaaatgaaagcaatggccattcaatgctttacctttcccccaccaaagtgtgccattcgcgagggtgtctatgaattggtcgaagtgagtgggggaacaaaagggcaaaaccaaaggaaaacccaacgaatcaaaaaggtactcgtcaaccacccgtccatcacaagtaagacaaaggcaaatcccaacacaaacatatgtacagctaagcttcgttcaggggatatgctcggcgaagggtgggccaaatatttggatccgacggagacggccacttcggagtactcgaggttggtctgctcggattgggttcgcccgggttgggttgtgttgcgggtactgcttggcccacttatctctctctccctctcttcgctctctttgtctgtctctctctctgtatatgtttctttttcagtgacatttcgcccgttattatggctgcccatttgatccaattcgaaattctgcaaatgcttctccgaaaggatgcaaacattgagaagccgcacaagcattag

SEQ ID NO: 55977 - DNA, 1318 bp, Heterodera glycines
  Genomic contig location: Contig_ID=SeqID_25230; Location=152..1469; Strand=-
  SCN-specific regions: Sequence locations=1-164,186-269,298-547,569 -598,625-665,687-799,838-1019,1042-1079,1101-1249,1273-1318
gtggtcacatggtacaacacgggctcagccgtgtcgggtcgatcggatttggacggaggacaattagccacttaccaggccatttggttgactgatcagccgggaaggttgagctacgtgatcatcaactatgataagctgggctttgatgctgctgattttcgtgccaactcgcgcagcggacgatgccgggtaagaaatgtcagagagtgaccattaggacatgtaattaaatgcacataaaatcgaaaaattttagcagcaaatgcaataattttttttaaattaaattaaattccaaaaaatttaaacctaaacctcgaaaatagctaagaaaataatatgaaaaatattaagcgaatttttattaattttgaaaaaattgagttaaaaaccgaataatttacatttttggactttctggcataaatatcctatttcgcgaaattgtacaaatatgcaaaatatatacgtaaaaagcgaaaaatatgggcataaaattttccaaaagtgagcgtaattttctccaaattcgttaaattctcgaaaatggctaatgatggcatgaaaaatcattttatgagaaaatataaattaaagctaaaatttttattttgaagaaaattgagtaaaaaaatctacgaaatttttcggatttgaacttatttttggcacaaatttctcatttgcaaaacattaaaacttagagattttatgatttataagtgcacacaaagaactataaatgatacaactaatttgaaagccaaatcattaccatttgtagtttaaaaactgcattattttttaataaaattttaataaaaaaaaaaaaatcaggcacttttcaatggtggcaatcataccggatttgttgacgtggacccaacccaactgtacaaaaattcaccaaaaattttggcacaacgctccggcgtgccgcacatggtccgcgggcgatacatgttcagggtggacgatgttgtacggcctggtggatgctccaacaaaactggcggaacatgtataagaatatttattatgaaaattatggcactactttcaaagtgttaattttgaaattaattaaaaaccaaaggtgggtggaacccttttggtttccgacttccttctaaatctggaaaaatatcattaatcgaaaaatttgaattttattatgctcggttcgggttagggcttagaaatggtcaaaatagatgtcaggtgcaggattccgaaatccctcgggaataatttttagttattatgacataataatttttcaaacaaatagggttccccatttagttataataaa

SEQ ID NO: 55978 - DNA, 304 bp, Heterodera glycines
  Genomic contig location: Contig_ID=SeqID_25231; Location=501..804; Strand=+
  SCN-specific regions: Sequence locations=1-304
aaaattccctcaaaaataaaaggtctattgcgcaccgccctccctatcatgctcgagagcatttgtatgtgtataaaatttatcaaaaaaagagatatccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatg

SEQ ID NO: 55979 - DNA, 720 bp, Heterodera glycines
  Genomic contig location: Contig_ID=SeqID_25233; Location=77..796; Strand=-
  SCN-specific regions: Sequence locations=1-234,256-682,704-720
atgatgaaaggtatcagagaggccatcgaccaaaagtacatcaaacaagcattcgtgatgatcaacgaggacaaagaggacccggacgtatcgttgtatatttcgattgcttattcccttgcattccttcaggtcgcaactgaagttttctcagtcggtttttgttacaacgaacagcacacgatgactgtcttggagtaaatcgcaaagaaatcttccattatttgcacatcactcccttttctttcagtgacaaaggcaatcgtatcgtttcatttggctacaaaggggagaaggtttttcgaatgcaagtgaagcacatcatcaagaagctcagtgtggtcactaagaatctggagccgttgaaaaaaggggccgtgccttatttgaaactcacttattacgagagtatgccgttttattaattgcatgaatgattgcacctttttagacacgccggatgactacgagccgtcaatgttcaagcattgcgagaacacttacaccttcaacaagtcgaacccgccaaccttttacaaattcggtgacatctccaacaaagaaacggcaatttcattcgtgctggagagtgtatacatcaaaggggccgacgtggccacccttgatgacttgttgtttgaccaagctgggtacaaagataacgacgaggtcaacatgttggatgtcactgcggaagggtttttcgcgtcggaggaagtg

SEQ ID NO: 55980 - DNA, 656 bp, Heterodera glycines; identical to SEQ ID NO: 53175
  Genomic contig location: Contig_ID=SeqID_25234; Location=192..847; Strand=+
  SCN-specific regions: Sequence locations=1-313,344-533,571-656

SEQ ID NO: 55981 - DNA, 1081 bp, Heterodera glycines
  Genomic contig location: Contig_ID=SeqID_4858; Location=765..1845; Strand=+
  SCN-specific regions: Sequence locations=1-1044,1067-1081
atgacattccaatctctaggattcaacccatcagcatttcaatcactgggactcaattctcctgcatttcaatcactgggactcaattctcctgcatttcaatcactggcactcaacccaccaacattccaatcactgggactcaaatctccggcattacaaacactgggactcaacccaccaactttcaatgacattccaatcgctgaaactcaacccaccagcatttcaatctctgggactcaattctcctgcatttcaatcactgggactcaattctcctgcatttcaatcactggcactcaacccaccaacattccaatcactgggactcaaatctccggcattacaaacactgggactcaacccaccaactttcaatgacattccaatcgctgggactcaacccaccagcatttcaatctctgggactcaattctcctgcatttcaatcactgggactcaaccgcagcaaatttctttagcatttttaactttttgtgtgccttgggatgttgaacagttggggagggctcggccgcttcgcggcctcgtacgggggccttcgccccccccccacaattttttgcgccaaaggtaccatcatttaatcactgggacttaacgcaccaacattccaatcactgggactcaacccaccaacattccaatcactgggactcaactctccagcattcaatcactgggacttaacccaccaacattccaatcagtgagattcaatccaccagcatttcaatcagtgggactcaatccaccaacattccaatcaacgggactcaatccaccagcatttcaatcagtgggactcaacccaccagcattccaatcagtgggactcaaccctccaacattcaatcactgggactcaaccctccagcatttcaatcactgggactcaattctcccgaattcaaatcactgaactcaatctcatcaatccttcagcaacacaattaccgggactcagttctccgacatttcaatcaccggaactcaacctcagtaacggaatacagaactatttaaaaggaatccagaaattgaaatataacccata

SEQ ID NO: 55982 - DNA, 900 bp, Heterodera glycines
  Genomic contig location: Contig_ID=SeqID_4858; Location=3039..3938; Strand=-
  SCN-specific regions: Sequence locations=1-312,334-726,748-900
acaagaaaagaatgaagttgatgcctcatgaaactcggaattggttatgttttgtcgaaaatatccttacataatactcataaaaaaaattcaacccatctattctatgaccacattctgaaaaaaatcccagaaatacgaggaaagatatgcttggtcacaataaaataaaaaatggctagtatgtaaaaatttgcggtcacaaataaaataaaaaatggctaatatgtaaaattggcgtccagaaatttttagactaatccgaagcaaagcacgaatgaattaaagaggcgaaagaattcacagtatcgtttctaatagggaaatattgacaggatattcggctaaaaacgggtttgatcatttttagcgcatttttaggtatacatttgagacaattgggcaggacaagaaaagaatgaagttgatgcctcatgaaactcggaattggttatgttttgtcgaaaatatccttacataatactcataaaaaatacaaataattcaacccacctattctatgaccacattctgaaaaaaatcccagaaatacgaggaaagatatgcttggtcacaataaaataaaaaatggctagtatgtaaaaatttgcggtcacaaataaaataaaaaatggctaatatgtaaaattggcgtccagaaatttttagactaatccgaagcaaagcacgaatgaattaaagaggcgaaagaattcacagtatcgtttctaatagggaaatattgacaggatattcggctaaaaacgggtttgatcatttttagcgcatttttaggtatacatttgagacaattgggcaggacaagaaaagaatgaagttgatgcctcatgaaactcggaattggttatgttttgtcgaaaatatccttacataatactc

SEQ ID NO: 55983 - DNA, 476 bp, Heterodera glycines
  Genomic contig location: Contig_ID=SeqID_25236; Location=140..615; Strand=+
  SCN-specific regions: Sequence locations=1-221,259-476
atgctaataacgcgtttcaagggctatgttatgataccaagattgtgcaatttggttgagtctgagaaaagttatgagttgatttactcaaaaatttagctaattttgcacttttcgtcggttgacatagcaccaaatttaccatatttttcgaaaatttgaccctcatgctcagaattctgcaatactgtaaagctttaatatgttccaaaagtcccatcaataaataaaaataatttaatcattgatttttttttagacaattcaacccagaaatttggtccgcaaatgtcggggctaacatcccctccacccgccccactgtatcgttcttgaaattttttgcttttctagctttcttagatgttttttcttgaaaaaaatctctatcttttttttcacgagatgcgacgagttttgtttaaaagttgattttattaatcatgactcatcattatgtgccattaattcacata

SEQ ID NO: 55984 - DNA, 307 bp, Heterodera glycines
  Genomic contig location: Contig_ID=SeqID_25236; Location=842..1148; Strand=+
  SCN-specific regions: Sequence locations=1-141,163-307
atgaacaaacggaccaaaatgaagacaaaaattgcactgatcatttttggcactaccatttgctggctttcggtcagggtcgttttcgtaccgccgttttcgtacgggggacattttcgtacgagttcttgtacaagcgtcaaattcaaatataaaaacttaagaactaataaaaccaaaatttatcattttttgtttcccattcataaaattttgtagaaaattcataactttataataataacaaaatccaggacaaactaggtcgcatctcataatttcggaaaatttttgatttgtaacacca

SEQ ID NO: 55985 - DNA, 686 bp, Heterodera glycines
  Genomic contig location: Contig_ID=SeqID_25237; Location=180..865; Strand=+
  SCN-specific regions: Sequence locations=1-65,107-291,314-364,396 -399,475-686
atggaatttgcgccaccgaagttcgtggagccaaaaaagccattaaataagaagactgcagggcggtaagttaaaaagaaatttaatttaaaatcatttgtccattatcgaattctcatccgattataatagtcttggataatagattaagctgaatttctcagattttggcacttgccctcgcggatggcacttctttgatcgactgtcttcggctttatttgcgtctcaaagacgacgtcttcggcccggaggcaaaagcaagccgttttggcggatacaagccggaatgccttgagaagtttttgcaagatcactttggcaagcagcgaaaaatgtccgacattcgatgtggaaaaatgaagtgagttttgaaagaaactgacaaaaaataattggttttaaatatattataaattcatttatatttttatcatttcgtttttattattgctatataattaatattttaatgattgtccaattattgtttttttgcaggattttcgtcactgccacaaaagcggagcaaattcccatcgaattggtgctgttgcgcaacttcaactgcccctttaacggctctgaccatcacgcgcctggcaatgtgtgcatttggcgggcggcgcgctattcgagtgctgcgcccacttactttcccagcatggacggactgatggacggag

SEQ ID NO: 55986 - DNA, 742 bp, Heterodera glycines
  misc_feature (15)..(15): n is a, c, g, or t
  misc_feature (58)..(58): n is a, c, g, or t
  misc_feature (111)..(111): n is a, c, g, or t
  Genomic contig location: Contig_ID=SeqID_25238; Location=1239..1980; Strand=-
  SCN-specific regions: Sequence locations=1-80,102-305,328-472,494 -586,712-742
atggctgcgagattnggcatcagattcggcttattgatgaatcttttgttggacactntggtgaaaaatcaatcaattagtttaatttaaatgtaattaaatcagggctcncaagtgtccttttttctaagatttttcctttttttttggcaacacctctttgttttgtgcttattttcaaaaactcaaaaaagcggcgatttttaatcatttgttttttttcaaaaaatcttatttttgtagtcaaaatcttagttttagcatcgtttgtcctttttttgaagaaaaaacttgggagccctgaattaaatacaaatttaatattccaaactgtgcgtttttgcagactgttgcttctgaactgcttgaaacaatggcaatggctgatatgtttttcccgtctgaccattttttttgcttccccgatgcctttgtcggcactttgttggtacatacaataatcaaaatttaggtatcaacaaacaatgcattaacatttagaatcaacagtgaaattataaatggcgccgaaaaagagagtgatcaaaaaaaacagagacgacagatacaacaaaaagagacatgcagagagagagagaggggggagcagagaaggagagagaggaagctgagaaggagagagagagagagcgatagagagagggagagcagagaaggagagagaggggggagcagagaaggagagagagaattcaatcggattttaatgtcattaaataaa

SEQ ID NO: 55987 - DNA, 57 bp, Heterodera glycines
  Genomic contig location: Contig_ID=SeqID_25239; Location=9..65; Strand=-
  SCN-specific regions: Sequence locations=1-14,36-57
atgcctatatatcgctgttaccatcatcattttgctggttcgacaagccgagctacg

SEQ ID NO: 55988 - DNA, 477 bp, Heterodera glycines
  Genomic contig location: Contig_ID=SeqID_25245; Location=250..726; Strand=-
  SCN-specific regions: Sequence locations=1-151,173-382,404-450,475-477
atgtccttgaataattgggtaaatgacgagctgcataaagtcattgggtatagtgactcatcaactgttgcctatatgattgcattggcaagaaaatccaacgattgcgacgattttcttaaacggctgcaggatgtcgttcctacgaataacctaaagacatttgctgagaaattacttgagcgtgtaccccgtgccggtatgttctttttaagaaatgctcgggaatacccatcgtctttagctgccaaaaaagttacgccaattacgaagggaccttccgagtcggagttgcaaaacttacggttgaaaaatttgagtgcaactttaaaaccattggcctacgaagtggaagagcccggaacgagcacaaaagaagcaaaaagtggaagggagaaaaagaggacgagaaacacgcggaagaggtgggaaagcagcagcagttcttcggaagacgaacaaccgaacgaagtggcg

SEQ ID NO: 55989 - DNA, 440 bp, Heterodera glycines
  Genomic contig location: Contig_ID=SeqID_4859; Location=1057..1496; Strand=+
  SCN-specific regions: Sequence locations=1-115,137-331,371-440
atgtcgggaccccaaatgtcgggatccacaaaagtcgggtccccaaatgtcgggtccccaaatgtcgggtccccaagttgcaaatccccaaaagtcgcatcacggtaggaaaagcaatgatatttaaataaattttagacgggaaagggtaaaaaaaacggaaaattaatgaaaaacgaaaaataattaacggaagcagcaaaaataaatcgtagacaaatttattaatacaatcgtaaagtaaacaaaataaggacggaactgttaagcaaatagtgaataaaattagactaaaatgaataataataaaaaagggaaaagcgtcaaagcgtaaaataaataataaaaaaagcatttttaattaaattttccagaaactcaggcggaaaacccggtacatataaaagccgaacggatttcatcctttaattgaatattca

SEQ ID NO: 55990 - DNA, 87 bp, Heterodera glycines
  Genomic contig location: Contig_ID=SeqID_4859; Location=44..130; Strand=-
  SCN-specific regions: Sequence locations=1-6,29-87
atggcatttttggaagcaaaaaatgatccaatgttggtgttcgacgaattgatgttcaaatggttggcattctcagaagcagataat

SEQ ID NO: 55991 - DNA, 119 bp, Heterodera glycines
  Genomic contig location: Contig_ID=SeqID_4861; Location=252..370; Strand=-
  SCN-specific regions: Sequence locations=1-119
acgacgacattgggccaaattttggtggaaaaagggaccggagtgacaattgacttgtacacttttcatcgaaataaggagttatggggtgacgatgctgacgaatttcgaccggaaag

SEQ ID NO: 55992 - DNA, 271 bp, Heterodera glycines
  Genomic contig location: Contig_ID=SeqID_4862; Location=168..438; Strand=+
  SCN-specific regions: Sequence locations=1-271
ggtgtcacaaaaattacagcggacaattgaaaagacgcgccaacacggcggaatcacttcgctggccgcaaagagtcacgggtcgaccgcagccggcaccgcttcgagcatttcgtttacacctgtccatgggttggaaattgtgacgccaatgcaaaaggaggaggcgtctgggaaggcttcgacttatttcactccgtccaccaatttcatcgcccccacaaagccggccattaaaaaagtgaagcaacaaatgcaaaaaatggagtga

SEQ ID NO: 55993 - DNA, 761 bp, Heterodera glycines
  Genomic contig location: Contig_ID=SeqID_4863; Location=911..1671; Strand=-
  SCN-specific regions: Sequence locations=1-200,225-587,614-672,694-761
atgacctttgatgtgattacacgcgtcgcaatgggccaacgcgagtcgcgacaattccattcggaggacgccaaatgggccgttgccgcatttctgcggttccaaaacaattggtaaatgatacggatttaccagatcataaaaaacatatctctggatgaaacagttccttaaatccgctaggggttgggtaaaaatgaattaaaaattttgcttttttcaagtggttcttcataaaaaatttaaccaaggtttgagtatttggccaccttgttcccgtggcttggtgccaaggtgatcaagccgttcattcgacagaccggcaaaatccggcatgacccgttcgcactgatggacaacaaaatcagggaagcggttaaggaacgacgtcgaacgagacaacatcaccatgaacaacaacatcaaaataatggcaacaataatcaattcgaaagtgatcagaaacgacaagtcgatttcattgatctgtttttggatgcggtcacggatgaggagaacattgagtacaagaaccagttttgcgtgttcaacaaagctgtcacaaaggtggtggggtgggccaaatgcaataaatttttatcattttttcttattggtttaaaatcagagtttttatagaagtttaacaaatacgcatatcagtgagcacatgaaaagtaaaaaatgcccattttgtgaaaaaatcaaaaaaaaaaacggaaaaatcattctaacggaaaatacaaaccattttgaataaa

SEQ ID NO: 55994 - DNA, 369 bp, Heterodera glycines
  Genomic contig location: Contig_ID=SeqID_4864; Location=349..717; Strand=-
  SCN-specific regions: Sequence locations=1-92,118-125,147-369
atgttttggttaattctattacaaatttcattcttattcttctgtttatttctcgccttttatttgtaagtcaaatattttgctcaaaaacctaattaattaaaaaattaattaattcatttgtcgatttcaagtttttggctttaccgtgccgcctattggaaacgccgaggcattccctgcccggatggaaagctgttcagtggcaatttggacgaaatgttttgggaggaaaagcttcgcttctttcaattggccaaatggacggagcaatacggaaaggtcccccccccccccctcctgggtttttatgacaagttgttgacctacagtggttcattggtttgccatcatacattaaaaaggggg

SEQ ID NO: 55995 - DNA, 163 bp, Heterodera glycines
  Genomic contig location: Contig_ID=SeqID_4864; Location=1699..1861; Strand=-
  SCN-specific regions: Sequence locations=1-7,31-118,140-163
cttaagttaaaaatttaggaaaattatattctgaaagagaacaattaaagctattgaatgataccacgaaatattaatttggttgaatttgagccaagctattaatttaattattttacccattttttgttttcaaacccattggcagttttaacaaacgcgc

SEQ ID NO: 55996 - DNA, 818 bp, Heterodera glycines
  Genomic contig location: Contig_ID=SeqID_25246; Location=896..1713; Strand=-
  SCN-specific regions: Sequence locations=1-41,63-205,227-369,391 -505,527-658,685-767,810-818
acaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagact

SEQ ID NO: 55997 - DNA, 235 bp, Heterodera glycines
  Genomic contig location: Contig_ID=SeqID_25249; Location=687..921; Strand=+
  SCN-specific regions: Sequence locations=1-204,226-235
atgcaaacatatggatgggcggagcgagtgagtaattgaaggctaattaatattgctgttcgagattctcggggtcaagtctcgttctcggaaatttttctgtagcgttactaattaaccgtaggtttgggtaaaactgcagaattgcagctcgcgccaattaaaaaaaatgcgaataaggcaatacgagatgcactactctgaattatgcattttattttaattctgcgcataa

SEQ ID NO: 55998 - DNA, 730 bp, Heterodera glycines
  Genomic contig location: Contig_ID=SeqID_25251; Location=408..1137; Strand=-
  SCN-specific regions: Sequence locations=1-70,92-110,317-385,426 -560,642-730
atgtttaaattgtcttttgtgcttttattctgtaccatttgttgtaacgcaacaaatggtacaactgctaatgaagaacaaaaagaggaaacaactgaacaattgcaaggttttttttttaaattttatatttataaataaaaaaaaattaaatattttatatatttaaaataaatattgaaaatttattagttaaaaaatcaaaaaatagcaattttcaaaaccaatcatttgtttaattaattttagaattattttttgttactaatatcattaaaaatttgatataaacataattttttttgtatttttttaacgaaatcataagtcaaaaaaactttaaaattttcgaaaaattatcactaattaggtaaatacatatttctatttatatatttaaacaatttaaaataaaataatttttagtgacaacgcctcaaccaagtacagctccaacttttgttcttgatgaagaaaatgtgcaaaccttggtggaagatgcaattgactattctcacaaagtttttctgattacaagattgcctactgcgaaagacaagtaattaaaattttaaaaaattaatttgaaattgatattttaattaatttagacaatttaaattaataatttaattaatttaggagtaacatgtccgtttttgcacccttcacactgttcccctccccgtatccgcgtgaaatgtacaaacaggctattgacgtggcaaag

SEQ ID NO: 55999 - DNA, 1366 bp, Heterodera glycines
  Genomic contig location: Contig_ID=SeqID_25254; Location=516..1881; Strand=+
  SCN-specific regions: Sequence locations=1-77,99-280,302-475,497 -551,573-592,614-627,664-1022,1044-1300,1322-1366
  Gene Ontology: Mol. function=aldehyde dehydrogenase activity; Cellular component=cytoplasm; Biological process=acetaldehyde metabolism
atgcgcgaaatgattgttcaaaacaaagacaaaatttgcgaggccatttacaaggacttgcgacgtaacaaggagacaaatatgaaaatggaggtgaatttcgtattatttgcggtattttttgttaacttttagtaaagatgtttaatcgcgcttattaattttaaaatatcatttagttttctcgtttttcaggttgatgggcctttgcaagccattgactattgtctgtctgagttggacgaatggatgaaaccccaaaaggtacattagaaaaaacggaattttgctgaaacacactgatacatttgcatattttagctggatgaccaccaattgggcaagccgttggtcatttttgagccgaagggcgttgcgttggtgatcaccgcttggaattatcctgcagccctcgcttttcaaccggccattgaagcaattgctgctggcaagaaaacttcgaaattttggaaccttacattttcaatttcaggaaacaccgtggtgatcaaaccgtcggaagtgtcgccgaacacttccaaattgttgaaggaaatgtttgatgccacttttgacaaagtgagtttgagttgaaatttaaataaaacacttacaattaaattgttcaataaatcaaataattaaaatgatatttattataatccgtagaaattcatcgccgttgtggagggggcggcccccgaaacgcaggcgcttctcgaccaacgctttgaccacattttctacaccggaagctcgtcaattgccaagctgataatgcaagcggccgccaaaaatttgactcccgtcactttggaactcggcggaaaatggttggtcgttatgcttcattctgattttacttttcaactgatttagtccggtggtcgtggagaatgacgccgacttggagaaggctgctttgcgtatcgcagaagggaagtggttgaacagcggacagacttgcctggcgccggactacgtcatgaccacggccgagatgaaaccgaagctggtgaacgcactgcagaagagcattcagacgctctacggagagaatcccaagaagagcgagcagtattcgagaatggtcaatcaacgccatttcgaccgagtgaaggcgttgctggacaagacgaatgggaaagtgctgtacaagaatggggagccggaccgagacgatgtgttcattccgccggtcttggtggatacggacttgaaggacgcactgatgcaggaagaagtgtttggacccgtgctgcccatcctcaccgtgaagggacttgacgaggcgatggacgtgatcaacgacggagaaaaggcaaatgcttcgagaccaaatatcaaaataaatttgaccctttag

SEQ ID NO: 56000 - DNA, 714 bp, Heterodera glycines
  Genomic contig location: Contig_ID=SeqID_25255; Location=55..768; Strand=+
  SCN-specific regions: Sequence locations=1-714
acactgggactcaacccaccaacatttcaatgtcattccaatctctgggactcaatccaccagcatttcaatctctgagactcaattctcaggctttccaatcgctgggactcaacccaccaacatttcaatctctgggactcaaatctccggcattccaaacactgggactcaacccaccaactttcaatggcattccaatctctgggactcaacccaccagcatttcaatctctgggactcaacccaccagcatttcaatctcggtgactcaaatctccggcattccagacactgggactcaacccaccagcatttcaatctctgggactcaattctcaggctttccaatcactggaactcaaatctctggcattccaaacactgggactcaaatctccggcattccaaacactggaactcaacccaccaactttcaatgacattccaatcactgaaaatcaagccaccagcattccaatacttggactcaacccaccagcatttcaatctctgggactcaattctccggcattccaaacaatgaaatctccggcattccagacactgggactcaacccaccagcatttcaatctctgggactcaattctcaggctttccaatcactggaactcaaatctctggcattccaaacactgggactcaaatctccggcattccaaacactgggactcaaatctgcggcattctaa

SEQ ID NO: 56001 - DNA, 998 bp, Heterodera glycines
  Genomic contig location: Contig_ID=SeqID_4866; Location=529..1526; Strand=+
  SCN-specific regions: Sequence locations=1-447,469-495,517-527,549 -640,667-998
  Gene Ontology: Mol. function=ATP binding; Cellular component=plasma membrane; Biological process=small GTPase mediated signal transduction
gaggaggatgatgtggagaaaggacgcacaaagaacccttttgatcagcgtaaggaagaagatgcagaattggatcgttagcaaatttcaaattggcaaaggattggcattatgttttagaaacgcatttgcctaaataatataattttttctaatgcctacataagaattaataattttcttagaagtgacaatttcgacgacagcgatgagtgccggtactcaaaatgcgacaggacagggccacgtgcacaaagtgataatggtcggctcaggcggcgtaggcaaatcggcactgacacttcagtttttgtacgacgaggcgagtgattttagagagaagggccaattgaatgtgtaaggagacccgagaaataatttcgaaaaaatggtagtgattggagttgttttatacagttttgatcaattgtgcttatcccttttcatttaattttggactttgatattggtgtttttcatatttacacatgccaacactccctcccccctccctccgctctgtcttcactggaataatttactttcatatcacagtttgtggagaattacgaaccgaccaaagcagatgctcacagaaagcaagttgtgttggacggggaatattgtgcggtcgacattttggacacggcgggacaggaggactattcggcgataaggtcggcaaatggttaaatagtttttcggaaattacaatcacaattactctcttttatttcttaaactaattcagggacaattactatcggtcgggagaaggtttcatctgcgtcttctccatcaccgatttggattcctttgatcaactcgtcgaatttcgggagcaaattttgcgtgtcaaaaatgccgacccaaatgtttgcattttgttagtcggtaacaagtctgatttggacgcggaaaggaaagtgcctttggagcaagcgcaacaacgtgaccaattccaccaacgatggaaaggagctcttttttgcatttag

SEQ ID NO: 56002 - DNA, 1959 bp, Heterodera glycines
  Genomic contig location: Contig_ID=SeqID_4866; Location=2227..4185; Strand=+
  SCN-specific regions: Sequence locations=1-129,151-161,186-273,295 -324,346-624,646-791,813-825,849-1003,1025-1607,1629-1959
atgaactccgacaattcgagtgctatcaacagcaaatccttcgatcaaatttcggagattggatcaatggccacggacggactgcttcaggacgacggagtgccggattatgcaaaaatcataatcaaacagcagcaggcactcattgccacgcttatgaacatgcaacagcagcagcaggaggtcattgaaacaaggaaaatttggcgtgattggttttatgagccgagattagtccggggaaatttctaccgacggcaattataatttgttgagaaataaataattgaaaatcggctgttcagtctcggtacgcgtcgaccatctcactttttcaacagcatcagccgcactttctctccaacaacgattcgtcctttccccctcctggcatccccacccatccgtctcctccgcccggcatccgtccacccgtctctcccgcgccagtgtcggcacctccgccgcctccaccgggctttcgtgcacccccaggcttcaacgtaagcgtcagttcccgcaagttcgaactcgactccaccaaatccgacaccggcggctcccacaaattcgacatcagagaggagctgaagaaggcatttgccttagacgacaccaacgaaaacgacagctcctccgccgagcagcagaatttgtcaccacgttcgcagaacattcgcgaggcacagaacgcgcgtctgcccatgtcgagcagtttctcgtccatcgaaaatttgcaaaatttcaccggtttaagccaacaggtgggcatttcacagcaaaaattacgaggaaatattacatacaaaagaaatgatagtgaacattcttccttccatttcctttgctttttaaggactcatcttcgcccgtctccgcgctcagtcggcagcccatcgccgcggccgttccgtctcctcagtccgcgtcgtcgtcggtgtgcgccttggcacttaattatgtgttggttgatcaaatggtgttgaattatgagcgagtgtacgagcaaaaggagaaaatggccagcgaaacgtatgactgacaatgagcgaatgatttgcatttttacgtggaacaatgggcgaccatttgaactttttcagtctcaccatggtggacagacagtcttcgcccgaacggagcatttaccaacgctttgccaacctcggcgccgtcctctacattttgcagcgacttcaccgactccaccccgacggcttcaccgtggcacaatatgtgcagtttgagaatgttcgtaacattggtacttttcgatttctaattccaatcaattctttgctcctttccccagtccccgttagttccacttataagcattttttgttgaaatatggggctttatttttatgccataacggtaaataatttttttgttagcgtcagaagcgagctcggccgacctctgagggcttttttttcaacaacactttgccatcggtggcttcgttgttggaatcggacgacgatttgctaagagtggacataaaggaagagaagttttacgtgtcggaggaggtcactcagacgcacctcttctgtctgagcaagaatttgtgtgagtgtttttagacttatttgatgtcatcatagcattttcaaaaattatttaaccaaaaatgcaacaaatagaaaattggtcaattcgggggttacgatcgttccttcctccgtgtggagagtaaccgccccttttgttctatttcaggctccaatttgttccgtcttttgcgtcgctgcagctccaacaatgccatccgcgtccagcatttgctcgaaatctctgtaaaacgattcgttgtgtccctccaccattccaaatgccatttcagtcccaattggtgcccatcggcgcccccatgcccaactccaacgctttggtcgacctgtgcaatcgcttcccgaccattttcaaattgcgttgttcgcctcaagacaatt

SEQ ID NO: 56003 - DNA, 495 bp, Heterodera glycines
  Genomic contig location: Contig_ID=SeqID_4866; Location=5219..5713; Strand=+
  SCN-specific regions: Sequence locations=1-495
ataggaaatgccattgaaaagcattaatgccctccaaaacggttaatgtctttgagtggcgtcccgaaacaattaaatttgccaaatgtctgccagaattcagcacgaggctttttttgaacattttggcattgtgttggacaacgccgagggcgtttacttttccggacaggaaattgccggaaaggtcggaatataaaagtcaattaatttgcccaattggccaaacttcgccttgggcaggtggtcattgagtgccgggaaccgcgccgaatcagcgaacttttgctggaagtgaagggacgggcgcggacgcattggacaaagtcacgcaaaatgtgcagcgaaaacgaaacgtacttttgcgagcagttcaacacggaatacacgcgaaagttgccaaaaacggaggccgaaaacgacgcggggggaggaacaccacgggaaggggggaggacagtggcggaacggagaagggaaagcatcaaaatgatg

SEQ ID NO: 56004 - DNA, 101 bp, Heterodera glycines
  Genomic contig location: Contig_ID=SeqID_25256; Location=27..127; Strand=+
  SCN-specific regions: Sequence locations=1-101
aaaattccctcaaaaataaaaggtaaattgcgcaccgccctccctatcatgctcgagagcatttgtatgtgtataaaatttctcaaaaaaagagatagaca

SEQ ID NO: 56005 - DNA, 304 bp, Heterodera glycines; identical to SEQ ID NO: 51570
  Genomic contig location: Contig_ID=SeqID_25256; Location=281..584; Strand=+
  SCN-specific regions: Sequence locations=1-304

SEQ ID NO: 56006 - DNA, 554 bp, Heterodera glycines
  Genomic contig location: Contig_ID=SeqID_25257; Location=68..621; Strand=-
  SCN-specific regions: Sequence locations=1-264,287-554
atgcacaatcacacttcccaaacaccggcacgcggacaaccgatgatggtcaaccgaacgcgaatcatggactcaggacgaatcgaacagctgtcttccgttaaagaatggaaggaatttgccaaactcggaaagcccgtgccgttgaaccaaattcgtttcacaacccccccttgtcccattcctccttttttggccgtctcatccaacagcccaaatggtgccaccaataccctgccgggagtgtcgcgaactgcgaacaatttccctaatttggtctgtgtccgtgtcccccttgctcccaccccattgccacaatacttggtcactctccctacacattttcccatgcaccacaatcattgaatcggccgatcctcgagatttcccacggcgataaaatttactcatttttcccgtttcacatatccgccggatggactcccccttgtcgatcactttttttccttcacttcttaaaaacacacaacaattggaaaaatgtgctccccctgcctttgattggtcccctcttaccaagcgtcagaaataaa

SEQ ID NO: 56007 - DNA, 1641 bp, Heterodera glycines
  Genomic contig location: Contig_ID=SeqID_25258; Location=409..2049; Strand=-
  SCN-specific regions: Sequence locations=1-133,155-451,477-666,688 -721,743-831,871-913,935-944,966-1315,1340-1641
atgtggcgacgaatcgttttactgtgtactgtgccgggtacggtagcgatttttttgttttttgagtttagcggggtggggtcgaattatcactgtgttttttcatttcaaaggatttgcgggtgacagcaatgcaaaaatcctggagggaccgcgtcagttcggtgccgatgctccgactcactttcatgggcctgcaaatggcacttccgctaattatcgttcccaccattgccagactcccccctatgggggccaacccaaatcagcaatgttctgagatttttgactataaaaacggcacaagtgatcagagccgaccacatttttgatgagggagtttattggaatgaccaggaatggcacgagagcgagaagaaccgaatgcacgaaaagctgaacaaagctacgggtggcaattaggaaaagcgattaatgattaacgaaccaattgtaattaattaattaattaaggagcggatgaaaaggcggaaattgtcatggaaatcgaattgctgaacggaaacagcgcaatgctttctcatgagcgcgcaatggcattagaacaacgaggaaaagtgaaggaatggactggtgccatacgaattattgccggtggggccgagccgtacagtaggagaatcgagacaaagtaccgtattcattcagactttgggatttggaagaaaatcgtggaaattttgacggatgaaacttcgcaaaaagaaaacattgaagaaaatgacagcgaaaattctgtggggaaatttcgagtcgttttgatttatttggagcagtgggcaagagtgagttaaattgaaatattaacggaattattaataaaaataaataatttaaattattaaaattgctttcctcagataagcacatttattccgaccaatttggcctgttcaatcggaaaatgcttctcgttttgctggccaaaatatttttgctttttccaaattcgtccattcccttcataatcgacaaattctttctcactttttcactttggtacatttatttccatttcattttgacttttatttgaagggattggcaaatgcccgtccaattggcgcccattgaacgaaatcggagggctgaatttttgaattggacaacgagcagagaatggttttggaagaggcaaatggcagaggaaaatgtgatgaaaagcattcgcaaggagacggcgatggttgtcataacgccaatattcccagagcaaaacgccgcttcaaaaacgaatttatccaccggaaaaatcatccgatgggaaatggccaaaggcaaaccgccaaatttgcaattcaaatttatttaaattttcagcgcgcgaaaaaatcagagaaacagcggacataaattggccaattcgagaacaaaaatttactgaaaaggtaacaaacaagaaaagacatttagaatacaaaagacttaaaaaatcaaaaatctaagttttgactccaaaaataagatttttaaaaaattaaatcgtttttgcctaaaaataattaaagtatcgatagagtagtaaaataattttggcagaccctgttcaaaaaagtcgaaaattttgcgatttttgagtcaaaattttttaaaggaaaaaattaattaaagaataataaa

SEQ ID NO: 56008 - DNA, 979 bp, Heterodera glycines
  Genomic contig location: Contig_ID=SeqID_25260; Location=498..1476; Strand=+
  SCN-specific regions: Sequence locations=1-170,193-597,619-822,845-979
atggaccaacaacacgcccacgcccaccagcaacacccgacggataacagccagcccaagcagcagtttcagccccagcagttggacctccacttggggcagatggtcgacccgtcctttctgctccaggacttccaattggcacaatccgtcacggtcggcgtcaatggccaagttggcatggtgccctttttgggctttgaccttcaacaacaactgaactcattggccacggcaccagcaactgatcaccagcagatgaatgctgtttctgtggatgtgagtcatcaacggcactttcacaattccgttgcatttcaacatttgaaatgcatgtcaaaaatgccttggctttccttccatctaatggcctcataatgtcccgttctgtcctccagcgcacttcgtccgcgcgttcttcggccgtccccgcgtcggtctctgtgattttctcggccccttccgccgtcccctgcatttcttccgccccctcctccaattgctttacaaatgcttgtccctcttccgctgaattgttgctcaacgggtacactcatcagcagcaacattcgcaggtgccttctcccccccccccccttttttctccactcattttgctctttttcagattggtccaaatgccacgcgctttttgccctcggtgacaaaagtgcaacaagaaaagaatatgtcggctgagtttgtcaacgaccggcagcacatcggctacgatttgttctgtacaacggtaaacagagggacggcggtggtcgaattggaagaattcgaagttcggaacggcgcatcactgccgacttatgggcagcaccatttcacatctgctgaccaattcggacagctcggaatcgaccaacatcgatttgtccatttgtcagcagggcaaattttggaaggcaaacaaatcaaagcggaggagcagcaacagccgccggggaccaccgtggccatgtcctactga

SEQ ID NO: 56009 - DNA, 918 bp, Heterodera glycines
  Genomic contig location: Contig_ID=SeqID_25261; Location=568..1485; Strand=+
  SCN-specific regions: Sequence locations=1-3,25-499,521-723,746 -815,838-918
atgaaatttgcaaagaaaatgttaatgattcccgaggcggaatatttggctctacggagtgcgatgaatagtggtgattatctccaaaatgaaaaagcgagtttagacgcaaaaatttctcagaatttacaagaccccgacataagcgaggacctcaaggcgaagagacatgattggctctataaagaaagacgtacggtaaaggggatacttgaaaatagaccacagaaggtagtgattgagaatcatgtacccggtccgaatgttgcaccatatctaggcctcaacactcaatccaaaccacaggagaccgatgaacaccggaaaataattattcctaggaaaagacttgaagagcaaactcctgatcctgaatcagataatgatacaataaatgagttaactccggagccccaaacaacatccacattaaaacccattccgatcaaaactattatacacccgacccttttaaacggtctttttaggtacgtgaaggaaaacaaagatttatttaaaattacggcggccggaaaggtacagtcgaacatgaatttgccgattgaaaacagtaattatagagatgttttgttgtatctcgcagggaagaaagatgaaacgccgcgcggtgcaaaatttctcaaagatcggttactgaaggatccaacagtaaaagacatggttgataaatcaaaggtcatgtggggacgtggaaggaaaaaggcaataaaatctataaaaacacccggcatagtgcgagagaagaaacccttcaaaccactaatatgggcaagactgtagagaaaattttatcgaaaatttattttaatttaaaatctccggcaagttttgctggaattcaaaaaattttaaatgaggccaaaaagattgacccgaaaattacgaccgatgacgtta

SEQ ID NO: 56010 - DNA, 314 bp, Heterodera glycines
  Genomic contig location: Contig_ID=SeqID_25263; Location=988..1301; Strand=+
  SCN-specific regions: Sequence locations=1-314
taatccgtttacgtttatcaaatgaaataaagagaattcacaataaatcactctctctcaatgtcaggaatttcgtcggctttgaatgggcggtactctcgaattcgtggattgtaccgtttgatgtaaaaccaactgccagggtgcaatttgtacttcagccgaaacattgccaaatcgtcgtcccaatgtcggttgaatcgcttgtacccagcacggtcaaattccggtatagtccgatccgggaaaagtcccgaccaatgcgcttgcatcacacaccgctcaagtcgttgttgctggtcatggcaaagacc

SEQ ID NO: 56011 - DNA, 310 bp, Heterodera glycines
  Genomic contig location: Contig_ID=SeqID_25263; Location=1062..1371; Strand=-
  SCN-specific regions: Sequence locations=1-66,88-310
ctttcttgttccgatatatgattggcattttctgttcctttggttattgtcaagcattttaccaaaaacaggtctttgccatgaccagcaacaacgacttgagcggtgtgtgatgcaagcgcattggtcgggacttttcccggatcggactataccggaatttgaccgtgctgggtacaagcgattcaaccgacattgggacgacgatttggcaatgtttcggctgaagtacaaattgcaccctggcagttggttttacatcaaacggtacaatccacgaattcgagagtaccgcccattcaaagccgac

SEQ ID NO: 56012 - DNA, 1296 bp, Heterodera glycines
  misc_feature (212)..(212): n is a, c, g, or t
  misc_feature (1030)..(1030): n is a, c, g, or t
  Genomic contig location: Contig_ID=SeqID_25264; Location=766..2061; Strand=-
  SCN-specific regions: Sequence locations=1-152,174-309,331-360,594 -846,868-1275
atgaattttgtcagtttcaatagactcacaaatttttggaaaaaaatgagaggagaaaaaaatagtgaaaaagcactttcgatgaaatgaggctgaaaaggcccaccaattcatattcattaagtggctaaaatttttaatggtccaattgtttttaaaaatgaatttccgatgcactttataagctttggccaacaaataacaatgctatngaaagagtttttgttttttaaaaaaaattttgtacaatttttgttcattgactaatttttttttttcataataatgtgatataatttgaaattttttcaatttttcaaaaatggaaactattcccaataaaaacccacaccctaaacctaattaaaagtaaaaaaaattgtgattataaaattttttttattcattttaaatattaaaaaagattcagtttgttaaactttataataaaaagaaaaaaaagtaaaaattctttttttatttaaataaacttaacaatttaatttatccaattcttcacaaaaagaaattaaagtaaattaaaaaatttttccaattcaaaaaagaaatttaaataattttaaatttttattccaacttcacaaaaatgtgtatggtacacatttcacattttatcagctgagcaacgaacacaaaacgcgcttcacattgccctgcacaaaattttatttatcatttgagccaaatggttcccacgcaaaaatttgcctttaagggataaaataacaaccccttgggaatttttcgagaagtaattgactcgagaatggcaaattggcgcattggaatgggttgggggggggaggagaagaaaagttttatgagaacaatttgaataaagaatttgtttgcgatttcactgcggctggttggtttgtggagggcacaagggtcgtcggcataccaaaattcaaagacgagacttttttgttggcacaaaaatttgtcggaagaccgtaattgttaaaaaaatggaatgcaataaacaaaaaaaaattgctttttttanattttactgtaattgaattttgaaaaaacttttttttaggtttatgataacggcgatggttggcattttgtattcacattcgggtggaaaagcccaaaaatgtgccggacttgggtagagaaaggaccggactttaaaattagtccaaatcagtgttcaaaatattaatttaaattcattgtttaaatgtcagtctgattggcattctgaaaattttggcatttaattacctttttgcatttgccttaatatataataataataaa

SEQ ID NO: 56013 - DNA, 873 bp, Heterodera glycines
  Genomic contig location: Contig_ID=SeqID_25265; Location=196..1068; Strand=-
  SCN-specific regions: Sequence locations=1-422,448-448,471-525,573 -647,684-873
atgagacagcagacaggcagagaaaattggggaggagtgggtcgatatgtcaatccattcccaagcccttcccttgcactgttttcattgcaagggtcaacgggcaccacattccttctgcatttgccgtttaatgcaaactttcctcccccccccatcaattgcttaacttttttttctctaaattgtgttattttttttttgacatgccaaactttgcgaggcgtactggtggcgcgccttgccatcaaaaaagaatggctgcgcgggtggccatccaccttgtaaaaaatgtaacttttttttttagttcaaaatttctttcaatttcgcttttttacagttttatacaccgggaggcacagaaacaacagcggcagtaaatgctcgacgaggacaaaaacgaagggtattttttcttctttttttttaaatttttaataatttcccgctcacatttaaggtgttcaagctgaaaggcaatgttgaaatgaatgaagctgatcgaacagccaacgaagtgggtttttttttgaaatttttttaaattcaaaattaaattttttttttttgaggaattggacaatgtgatcaacatcagtgccaacgccaatgccaacaatgggattaatggtgatgaggtgaggtattataattgaaatttaataatttaaaaaatttttccattttgatttaaggcggcagcggcggtgagcgacggcgatgccaatgccaacaatgaaaccaattgtcaaggggtaagtaattgtgattaatttctaaattttgattaattttcccctttgatttaaggcagcagcggggatgagcgacggcggtgccaatgccaacaatgggacaaatgccgaaacg

SEQ ID NO: 56014 - DNA, 1191 bp, Heterodera glycines
  Genomic contig location: Contig_ID=SeqID_4868; Location=1877..3067; Strand=-
  SCN-specific regions: Sequence locations=1-278,301-433,455-891,915 -1136,1158-1191
ctgacgagttatgggcccgggactcaaatgtccctctcaggccaaaaattttttctatttccgggaaaaaatcgaaaattttccgaaaaaaataccagtcgatagagctcgaaaaactgttgcttggaagtggtcttcgtttttctgggaaaattcgttaaaaaatactaaaattcaaaaacccgaaaaccgttttttaggcctagctcgaaaaattttgaaaattttcgaaattttaaaatttggaaaaatcgaactcaccgagctctacaataagtctgctggccaccctgcgctcaggtcaaagcctaatgagttattcaacggggactgaactgggcaaagttggtactaaaaagttgccaatttctgcagcccttccaagtataggtagaggcctggaattttttttgaaaattagaaaacacttcaatttaaataattctcaaatttcgcaatccatgcttggcaattttgttgaatatttctctgttgataaagccactgatgaaaacccctttgccgtaaatgcggctgactttgacgtagcgcagcttaatcagcttaatccaatgggaatgcccacccatttacttcggcttaaaacaggttctattgttgtgttgctcgtaaatttaaatacgtcaaaaggactgtgtaatggcacccgtcttcttgtcaaaaaattgactgataatttgattgaatgtgagacaataggtggaggcttctctgcaaacggaataattgttggtataccccgtaaccggcacacatacaaagacaaacgccccgacggagtaagctttgaaagattccaattccccgtccgcctcgcttttgctatgactgttgtgaaggctcaaggtcaaaccgcattccgattaggaattgattttactgaagagccatttgcacatggacaattatacacagcattgtcaagggctacgagtcgtgataatataaggatttttgctcccaataaaccacttgatgataatggaaacccattgatcaggaatattattgcttccgggcttaatttggattaatatttttatgctgtcttcctcgcagcattattagttgtttgttttgtcaaataacagccataaacaaatcgtttaattcccaatcccgggcaaacacaccccttgcttttcaagtaaggtggatggttggatggag

SEQ ID NO: 56015 - DNA, 3438 bp, Heterodera glycines
  Genomic contig location: Contig_ID=SeqID_4869; Location=234..3671; Strand=-
  SCN-specific regions: Sequence locations=1-15,37-559,581-721,743 -850,875-1865,1887-1893,1915-2017,2039-3358,3380-3438
atgatagctaaggaatttttgtctaatgaaaatgtttataattcattgttagcatttgcgtccgtttcggttggataccgtgagtcatcacttgatggaaatgtttgctatttgttaaatggtgaattcactcgtcaaataggctcaactttacccggaaaattttctccatccttttcgcaattatacattcttgaccctgttacagccttcatgcaaaggactcagaacatagcgtatggtggtgatcgagtaaacgaaaccacaattaaaaagcttgattttattattcgaaaatataaccctcttgcccaagagttggtaaacttccataaacaatatcagaatactctaaaagagaaaggcccagaggctgtacttaatttccgtttaacgctcgtcgaggctcgagatgcaccggcaagtgttcgagacgtttctattcattcgagacaagccaatttacccgatgaggggaattcattgtttgccgtttgggctgaaagtgaacagccaccctttttgaaagggatatggattaccaatgacgaaggaaaacttaaaaaattccctccacatcatccactcacagattctctttgctaccctttgatgtttccacatggtgataatggctttcaccttaaaattccatacaatccgttaaataagcccgaaaagaatgaggccatggagattgatgtcgaatctgatgagaacactggtgattcagatgctgatgcatcagatgatgacaatgagtccgttgccagttcggttgattctgttgacaaacgcggtccgcggcagtttttatctattaggtcgtatatccgctatcgtatggcgttaagaaaacacaaaaacattcacaacatttggagttccggtggcggactaagtcagaaatttacacttgattacgcggcgcgaattgatacgaatgttgcaaattatttacgtcgtcccgaattaaatttgcgtagtacacttccagaaaatgcccttcgctggctttcacgtaatgctggtcttagctccacagaagacttggggagtattgttatgttccgcagatcagagccaggcacacgagcgtatttccaacacaaattttatgatgctaccacaataatgtcacgctttaaaaaaccaggcaacgcttcattctttctcactttcacaaccaatccgcgttggcgtgaaatttctcgtaatttcctccataaaggtcagaaaactgtagatcgacccgatttaatatgtcgtatatatgaggataaacttcgccatttgcattatttgattgacaaaaaaaatattttgggtaaaatgattggacaagaatgtcgtgagttccaaaagaaatacggcggtccacatgcccatcgtgtttatcacacaagtttgcttgccatcccagagaatgttgataatataatatgggcgcatatacctgaagaaccagcgaaaaatgataaatcagattgggccaattttattcgtaaactacgtgaattattaccgaaatttcaattccatgactgtggtccccattgtcttaataaaaaaggaaaatgcaaaaagggattccccaagccgtttagtaagtttactgtccttcacgatgatcgtccagcgatctattttcgtccgagcccggaagagggcgggcaaaccttaaccgtaaagcgaggcaaagcgcaagtcatttatgataattctcgtatttcctcctataacccatatatcttggttcattttgagactcaccataatctggaatatgcatatgggcaaagcacaaatttgaaatatctgtacaaatatccattcaagggcccaagcttttcgtacgttaagacaaatgaagaaaatggaaagataagtatcgatgaacctgctttttatgcaagaatgttatatcgttcgtcgcctgaggcctacagtagaattatgtcttacaagtatgccaaattatcgcatacagttattgcattgtcacttcatttgcctggccagcaaaaagtttattataaatccggccaagaagaggcaattggacagcaacttcaggcgggcattttgccagaaactcccttgaccgcatattggaaaatgtgtgaaactaatcccgacgttaaaaaaatccttttcgaacgcatgccagagcaatactcatttaataggtccggaaaattttggaagaaacgtgtcatttctactaatccaaggcctaaaacccgtgagagaaaaccaattattgggagaatttacccagtgtcaccccgaaatcctgaattatttgctttgtatttgttaactaagcattttcctggaaaccctcagcaactaaagatcgttaatcccccgcatgtctgctccacatttcttgaggctgcccgattaagaggtcttattgatgatagtgatgtttggatccgaacgatgacagaggggtccgcctcactcggtccggcacaaatgcgccaattactggcaaacattttgatttttggagcaacagagaattgtcttatcgacggcgcactgctttgggataaatttctccatcatatgtgtgatttgcgttgtaccgatgccgaacgtcctgcgagaattgaccgtgcattggtccttttagaaaaacttttagtaagactaggaaaacagtgtaaagattatggactcccaacccctacaatttcaattatgaataatccccagctcgggcttgatgaatttttctttccacaacacgctaatgatgatgatgcaaatgatattgacacaagctcttatgagcgtggaaaattgaatattgaacagcaaaaattttttgatttggtaaagactgcatttattgactcacgatgttcaagattgttttatttgtatggtgacggtggaacaggaaaaacctatttgcttaattatatcctttatcacttgcgtagaattggcgctaaaattattcccaccgcttccactggtatggcggccacccgtttttatgctggtggcaccactgttcattctgcctttaagtttgggataaatgttgaacctggaaaattgccatccattccctttgatagtttctttggccggagaataacagagtgtgatatcataataattgacgaaatgacaatgttagagaggactgttttggaaaatattgatgctctttgtcgtcttatgtgttcgcagaaacggcacttaccttttggtggaaaatgcgtgattatttctggtgattggaagcaatcactacctgttgtaattgactcatatggaagtccagcgcaagtttccgcatgcattcaatcctccccactttactcactttttacaaaattcaaattgacccaaagcatgcgagtaaacccaaatgagatcgagttcctgaaatggcttgacgatgttggaagagga

SEQ ID NO: 56016 - DNA, 1669 bp, Heterodera glycines
  misc_feature (1392)..(1392): n is a, c, g, or t
  misc_feature (1463)..(1463): n is a, c, g, or t
  misc_feature (1482)..(1482): n is a, c, g, or t
  misc_feature (1486)..(1486): n is a, c, g, or t
  misc_feature (1502)..(1502): n is a, c, g, or t
  misc_feature (1508)..(1508): n is a, c, g, or t
  misc_feature (1511)..(1511): n is a, c, g, or t
  misc_feature (1526)..(1526): n is a, c, g, or t
  misc_feature (1555)..(1555): n is a, c, g, or t
  misc_feature (1563)..(1563): n is a, c, g, or t
  misc_feature (1577)..(1577): n is a, c, g, or t
  misc_feature (1579)..(1579): n is a, c, g, or t
  misc_feature (1582)..(1582): n is a, c, g, or t
  misc_feature (1609)..(1609): n is a, c, g, or t
  misc_feature (1616)..(1616): n is a, c, g, or t
  Genomic contig location: Contig_ID=SeqID_25267; Location=1..1669; Strand=-
  SCN-specific regions: Sequence locations=1-814,839-861,972-996,1018 -1037,1059-1669
  Gene Ontology: Cellular component=focal adhesion; Biological process =cell-substrate junction assembly
cattactcaccgtcccctcatctccaaaacggcacagcatcagcttcactgatcgcccgatcgccgggtccccactcgccctttgggcttgagccaccggcggaggacgacgagtggagactttccccgaaaacactgagtcggataaaacgacttaacgttgtgatggagacggatggaaaaggtcaaaaattgcaacaaaaaaatgccaaaggaatttgaaaagagaaatgccaaagtgctcgaggcatcaaacaaaaggaaaagcacattttctgatcggaaatgcctttcagacagttccgatgtgatccatcatcatccggtgtttgtcaaagacacctcccgctattggtacaagccgaccatcagtagggaggaaggtgagagtcctttttctgatcagtggctattaccgatcagtgattgatcggttttggtcaaaggatcatcccttaagcaatcgctatgctgaaggacaaacccccgggcactttcattgtccgcgacagcaattccttccccggcgccttcggtttggcgctgaaagtggcacaaccgccggcgggggttccatcttcaggttgtactgactaatcactggtgagaggatgtcaatcatttttacaccattcagcggatggcaatgagttggtgcggcactttctgatcgaaccgtcgccgaagggcgttcggctgaagggctgctccaacgaacccgtcttcggcactttggctgcgctcgtctaccaacattcgattacccctctcgcgctgtaatgctttactgaaatgggctgatcaatagggatggaaattattttatttaaaaaatattgaaaaaagtccgaaatactgagcaaaatatttaagaaaaatgaaaaattttccaaaattaattaaattataaaaaatcaaaaattttgatttaagaaaaaaaacttaaatgcataaatttttaaaattttaaagtcggcaaaaagatgtgatcgcatcaataaaaaatcattctttattgcatgttgaagaatttaattcaaaaaatgccaaaaggttgagaattgctttggctttacggggctttcttctcattgtttgcttttgcaatctttttcttctgtctcttaggccgtgccgtctgatccttcccgaattcgaccccgccgccacgcccgaacacctcaactccaaccattcactccttcacaatatcacaccttatctcaacatctctctacaaatcattcccaacaattcttctcttaacctttcaacttcacctatttttattccataaacaccaaatcactcaccactccctaaccattccacctctcaaccccccatttctttcaactactccaaacacattaactaaattcattatcaatncacttcaaactctcctctcattctatcactttcaccctaatttctccatatccaataaaaattaattatcnaacccattcaaaacttccnaatntcattaatatcataanaatatnttntctaatacactaatnctactaatatcatccaaatctcctcttcnccccattnccccttttcttcancnccnccctcttagaggttcttcccacaccantaaccanccaacagagcttgttgggaaatatgcctaattggataatttaaaaatattatt

SEQ ID NO: 56017 - DNA, 56 bp, Heterodera glycines; identical to SEQ ID NO: 52733
  Genomic contig location: Contig_ID=SeqID_25270; Location=698..753; Strand=+
  SCN-specific regions: Sequence locations=1-56

SEQ ID NO: 56018 - DNA, 427 bp, Heterodera glycines
  Genomic contig location: Contig_ID=SeqID_25271; Location=137..563; Strand=+
  SCN-specific regions: Sequence locations=1-94,137-427
atgctcaatcgagccaatgatcaattccttttgtggtaagtcaaaatgacagaacccccccccccctatcaacgtaaattaataattacttgacaatttttaaaattcaaatttaagtttcatattaaaaattaaagatgaagaggaataccaaagaaataaaatgagaccacatgaaattgaccagacacgtccagtagctgaagtaccccgcaccaaaaaatatttggaaaatgatcgagccatcaaaaatctgattgaacaatttgatcagcttggtcctgatcagcgtgatgatcaaagatggattacacatttacacgcactgtcatttcgacttaccacaaaaggaattcaaatgcatttatcggctggccacctgctaggctaatcaattttcaatgatttgttttcgcctcatttctca

SEQ ID NO: 56019 - DNA, 603 bp, Heterodera glycines
  Genomic contig location: Contig_ID=SeqID_25272; Location=167..769; Strand=-
  SCN-specific regions: Sequence locations=1-15,53-154,176-353,511 -540,563-603
atggccaaaatattggaggaagaagcggagggggaggagagggagagggagaaattcggggaatttttgaaaaaacgaagtaagggcaaaccagcgaattgaaaaacataatttaaggggggggggaaattcggggaatatttgccctaattaataatttaaatggaaattaattcagaacgattccttggagaattgttggatactgatggcattagaaagataaaagaactgctcaattacgaggtcatttttggaattagtaaaaagaattacagaaaattcgcacattttctctttcagaatgaatatttttcggcaagtgaaaatttgaaaagtgactcatcaacatcagaagaagaggaagaaaaagaggaggaggaagaaggagaaaaaggaaaagagaaaaaggaagaaaaagaagtcggaaaaggcgtaggaaaggaagaggaggaaggaggaggagaaaaagagaaaaggaaagaaagaggaaaaggaggaggaggaggatcgtctacagaaagcgatcaaactttcgaagaaataaatggaatatttaatgaagaaaaaaaaaataatgtcaaagaaaaaaggcaaaaatga

SEQ ID NO: 56020 - DNA, 1115 bp, Heterodera glycines
  Genomic contig location: Contig_ID=SeqID_25274; Location=209..1323; Strand=-
  SCN-specific regions: Sequence locations=1-85,257-295,543-555,595 -689,714-876,898-1115
  Gene Ontology: Biological process=N-linked glycosylation
gaaagtggaagaggaacagaaagtggaagagaaagtggaagaggaacagaaagcggaagagaaagtggatgaggaacagaaagtggaagagaaagataaagaggaagtggaagtggaagagaaagtggaagaggaacagaaagcggaagagaagaagaggaacagaaagtggaagagaaagtggaagaaacagaaagtggaagagaaagtggaagaggaacagaaagtggaagaggaacagaaagtggaagaggaacagaaagcggaagagaaagtggatgaggaacagaaagtggaagagaaagtggaagaggaacagaaagtggaagaggaacagaaagtggaagaggaacagaaagcggaagagaaagtggatgaggaacagaaagtggaagagaaagataaagaggaagagaaaaagcaacaaagggaatgaggaaggaacaaaaaaagaagagaggaagagaaagcgagagtgatgaagtgaaatgggaaggtagaaaggagggagaaaggggatgagaaagaggaaaagtaagagattttaagtgatcgtattaaaaatttgaattttaagaaaaagttaactgaattcccggccattaaaaaaatcggttgccttcttacatataaaagttttttggcgcgtagcgccctctagagacagtgttaaatagcgaagctatttcaattttaaaaaaataaattaaaatcaattactttcagtgccctacgggcactggttcgttaactaatttgaatttttaaatagtttaaaataattctgcataatccagaaagtgtcctccgcaacgagcattgactattccgaccgtaatcccatcgaaaagccaacaaaaacgacagaggacaaaagtctgagaagccaacaacagtcaaacgacgacagtgacttaacggagcagcagcagcagcagcaattgtctccgaattgtccgttgcgccgttcaacgcgcgtctccgtactgaacgccaaaaaacaaacgcaacaaaacgaacggacggaatccgaacggagcgctgacagtgccacaaaagacaacgacgacgaattggaaatggtgggaaataggagattacaacaaaatcattga

SEQ ID NO: 56021 - DNA, 179 bp, Heterodera glycines
  Genomic contig location: Contig_ID=SeqID_25275; Location=437..615; Strand=-
  SCN-specific regions: Sequence locations=1-179
atgcttgcaactcctttatttttgtttctgatcacccaactgttgctgatcggtgctgtggtcggaaatgatcagccaattgctacgacattaattgaaaaactgcgaagttttctcaaaaatatgcttgacactgtgaccgaaattgatgaggccaattctcggcaattaatagtcaa

SEQ ID NO: 56022 - DNA, 528 bp, Heterodera glycines
  Genomic contig location: Contig_ID=SeqID_4870; Location=1913..2440; Strand=-
  SCN-specific regions: Sequence locations=23-528
atggatgcagtgaaaagggaattggcagaggcaaaacaaatccgaaaaaaccgacaggaatatgacgcactcgctaaacttatcaaagtaaccactaaaacaaccgaattttttaaataagtcataaaggaaaagccgagcagagtcgaaacttcgaaaaggctgaaactgcttcaggatgagttggaagaagcatacgccaaacaaaagatgctcgaacaacgggtcggaaatccctgtcctagaatttacaacaattaaacttttcagttgattgaaaagaggaagaatatgttcgtttgcggtgctttgcgctccccttaaatcatggttaaactttgaaggtacactcttgctgttctgctggacaacctcgaggaaatgaacaaagaatccggtgagaaaaggacgggtgggggaaaaacggccaagggaaacacaatcatttgcagaggacgtgcccatgtcggaaggtgacgatgccagtccggccggagcagtcccatcgtcgtccgctgggtctttaaa

SEQ ID NO: 56023 - DNA, 3916 bp, Heterodera glycines
  Genomic contig location: Contig_ID=SeqID_4870; Location=3754..7669; Strand=+
  SCN-specific regions: Sequence locations=1-41,217-247,436-445,609 -792,846-2097,2119-2455,2487-2825,2847-3393,3415-3449,3474-3916
  Gene Ontology: Mol. function=ATP binding; Cellular component=myosin; Biological process=cytokinesis
atgggagagaagagagagaaaaagagagaaggaaaagataaagaaaaaaagagaaagaaagaaagagaagagagaagcagtgagaggtagagcgaagagagagagagagagaaaaagtgagagggtggaagagagagcagagaaagagagaagggagagaaagaaatagagagagagagaaagagagagcgacgggatagagagagagaaagaaagcaggctaagggagagagagaaaatgaaatatagagagagagagagaaagagagagctaaggggagagagaaatagtgagagaaagagaaagaaaatcgagcagtgagagagagagcaaagagagagagagagacagaaagagggagaaagcaagaaagagagagggagagagagaaaagtggagaaagagagagagcgcagagagagagcagagagagagccaaaggatagagaaagagagagaagaagaagaagaaaagagggagaggaagagatcgagagagagagagagagaaagagaaaaaaagcgagcagtgagagagagagtaaagagagagagagagtaaagagagagagagaaagagggagaaagaaagaaagaaataaagagatctaatttgcgaatcccgttgcgggattagaactcaatttttttttgcggaacgggattaactgctaattaactgtaagcatcttctcaacagcacacatttgatgtcacttggaggctttaccaactttgcgaaaaatgcgcttttaacagcccaaaagcacatcgattctgcgcttcatattgaagaggaagatgaagaagaggagcaaaatgaggaagatgtagaaaaggaagagctttctatttctgatagtgtagtgatgaaaagcatttatgccgttgaggtcggtactcattgtattgacatcgaatgattgttgtttcagaatcacgaagcagatggtatggtgagtggtggggacgcagtgccccttccgagtgcagttgctgactccccttttctcgaggtcgatttgaataggacattaactccgcaatctcaatggacaaatgagtcgactggcactatggtatgcaattaaaggtaaaaaaaattatcatttatacaaaagcatcctatcgttgacactgagccgaatccgatccgagacgcacatgagccaaatcacattttccactattcaccctcatcagtatggaattagagggatccaattttttagaaacgaatcttagcactctcccgacgacgacgaaagcagtcaaaacggacagagttcgtcctctcagtcagcgcccatcagctcagccttagacgcttccttgactaatttatacaaggaaaaggtctttgctctttctcaacggtcaattaatgttctttcaattaacaggaaaacgacgaatgtgatgatgatcggagcatgccgagaagggcgtcggagagaacgctggacagatttgaggacgtgagaacgattgcatccagtgacattgaagttattcgccaaatggacgattggtcagttgacactcattttcatccaaataactcaccaccatccgaatgaacaaaaacgggttccgaatttccttctccatttaggtcggtcacgagcagttatccgaacagctcccaccagcagagcaacacacagaaaattggacaaattcggtcaataggagaacttcagcaaagccaaacaccgccagagttaactaccaaattggacacttcagaacaatctcagcgagaaatggacgagaaaattgccatattaatggccaaattggcgcatagggaccaaaagatagaagagttgggcagggccaacgaaaacctgcggacaacgaatgcaactttagtggcgaaaagcaaacaaaagtaattggaattttatttgtcgccaaaaataattttagaaatgcggcggaagcaaaacttcaaagtcaatttgctgagaaagaaaaacaactaaccgatttgctagacgaaggtaaaattgtgtcagaaaaagtttacgattgaaaaacaattcaggacggaaattatccgaatacagcggtcgtcaagcgaaagaagttcgaaagttgaagcaacagttggaacaattggacatcgtcacggctgcgagggacagcgcagttgaggaactgcaagaagcacaccaacagctgcaagagcaagagaacgcaatggaacagttgaggggtgagggaacagagcaagtcgagacgaacaaagaaaacattgttcagacgaactcgaaaattgtgagcataaagcgaggaaactccaagcacaactcgacgacaaaatgacaaatgcgaccaatttggaggggaaagtgtgcgaacaattaaccaaagttgaggcgctaactgcggaaaagagacgaatggagaagacactccaaacaacgagcagagaacgcgaagtgcgacaaaaagggagggggaaaaggagaaacagtgggacgaatgcaacacaattcaggaattggctcaggaaaacaagaaattggcagcaaaactgatgaacagaaaggcacaggatcgaataatcggagagcgagagaggggacttgaggaagagctgagacaggaaagactcaaaagcgagtccgccaatgcgcggatccgcgagttggagcaggtctttgccgttgaatgcttttccagcttttacccaacgaattcagcgcatcgaatgcattcaggacatgaacagagacattgcagttgaatatcaaacggtgggcgaagggggtgagcggtaaaaaaggggtgatgggacagtagagataagagaagaattctaaaaatattatatttaaacaaaattccattaaaaagacaaagttttcttggctctagtgcactttatgagtccaatcaattgacaatacctggtttttatacaataactgttcatgtttgaacaaaccctatatttttggtatcattcgacaacacaaagtctaacgaagctaaaacatataaaatctcaacgtttaggcaattacgaaaaaagatcttattaattaagtaattgctgattatttaggtttgtaactttcttgaaatgttaaaattctcttgttttctcgtattattacattattcagactttatgctttcgaatgatgccaaaaagatagggtttgttcgaatatgaacaacgttattgtataaaaacccgggacataattttgcatagatttcttgctattttagcaaattcacctctgctcatcacaatttcttctttggaagagaaactgcttggattggagcgtgaaaatgacattttgacgcgttcgacgagacaaatgtccgccgaattgggggcaatgaaacggaggcacgaagccgaaatgggaacaatcgaacggagtttggaagaagtgggaatgttattttgtcagagtgaattttgttaatttcaggaaaaacaacaaaatgcacaaaaaacggaggaattggcgaaggcgttcagcgaaagagcgaatattcaaacgtaaaaaagggggggggggagaaagtgaaacgaaaatttaaaaaaaaacagcatttatcattgtcctttacgccaaataagaaaactgactgttcgccgcttttcagtcgtatagaaaaactcgaagacgaattgtcgcagtcgaaaagagagcactcggaaagggtaaaccgaatggagaagagaatggaacaattggagacggatatccaagcgaaggtgtccattaacaaaacaaaagcttactttggctattcatttgctaatttcaaatagattttcagaggaatgagttaaccgaattgcaacgtaaaaactgcgaattccaacagaaaatcattgcatcgactgtggagcgaagaaacaatgccaattcactactcatt

SEQ ID NO: 56024 - DNA, 426 bp, Heterodera glycines
  Genomic contig location: Contig_ID=SeqID_25277; Location=172..597; Strand=+
  SCN-specific regions: Sequence locations=1-300,329-426
atgtactttttgatcagcttttgttcagctcatggtcattctgacaatcattgtgtactctctgatgactccgttcgggtctttggtcggcgttctcgtcacggtgagtcataaatcataatcaacggtcatcgattgatcaaatctcaaattattgaaaaactgatcactgtagcttgtaaaccagggatcgtatttttatttttggtttggcacctaaccttttagcacctaacaaaaaaaatgcaaacatttttaaacggcggctcctaaaggcacagccgaagccgaaaataaaccaaatttataaaaattttaaacatattttgcgatttaaacgcctaaaatcaaaaaaaaaattaggtaatcttgtttcggttttcagccaaatgtgtctattttggattgattctggttcctaattga

SEQ ID NO: 56025 - DNA, 1044 bp, Heterodera glycines
  Genomic contig location: Contig_ID=SeqID_25278; Location=58..1101; Strand=+
  SCN-specific regions: Sequence locations=1-19,41-109,135-230,318 -465,487-1044
ttggtgcatcttcggattcgctgttaaacagcagacaaaattggatgtagacattcatcttgaaaagggcacttatgcatatgccaattatggctatttatgtatcaacggaaaaggaaagggaacaaatgcccaatattcctacggtgttggcgataccgtaggaattggcgtcaattcggctactcgacagatcattttcacaaaaaatggacttcgtttgggttagcaaataataaataatataattttacgattttaaattacaatttggttaattgtctattttatctaatttattttatgtttaaaataatcaaaaatcccttaaccttttcacagatacctctgattttttcgttgatccatcttttgttgatggttctttttatccattcgtttctttgttttattctggtgacaaaattgaggcgaattttgggcccaatttcaaattcgatttggcgactctctgaaggaagaattaacaattaattcactaatgttttcgatcaatttgctcgtttttatcatttttatgtttttcttcttcaattaaaatttggttttttgcattaatcggaaaattttgtcgtttcccgggtatttaagactaaaaagatgaaaatttgcaaaaaaatagggtttttttccaattatatgctaaaattcatattaaatatctgctcatatgctatgaagaaatgggctcaaaaaagcatttctacgttaaaattttgatttgatgaggttttttagtccatataaatccatatttagcgtttttagtttatatttcggccatttttaggaaagtttcacaaaattcaaatgcatcgctaagattaaaattcgcaaaacaaatcgtccttccagtgttttgacttgaaaagtgatgatgcaaaaagtgccgatgccgtcgctcggatggcatttcgaattccgtcgcctttcgccgtcgccgcgttgcaaaagtcgccgaagcaccagcaggtggactcctcgacggagctgaactggtccagacagaccaacgcgcgttgc

SEQ ID NO: 56026 - DNA, 205 bp, Heterodera glycines
  Genomic contig location: Contig_ID=SeqID_25278; Location=939..1143; Strand=-
  SCN-specific regions: Sequence locations=1-205
ctctgtctggaaattgaaaatcaacaccgaatgcaaacacacgcaacgcgcgttggtctgtctggaccagttcagctccgtcgaggagtccacctgctggtgcttcggcgacttttgcaacgcggcgacggcgaaaggcgacggaattcgaaatgccatccgagcgacggcatcggcactttttgcatcatcacttttcaagtca

SEQ ID NO: 56027 - DNA, 822 bp, Heterodera glycines
  Genomic contig location: Contig_ID=SeqID_25281; Location=473..1294; Strand=+
  SCN-specific regions: Sequence locations=1-20,42-246,269-523,545 -602,624-659,683-731,756-763,786-822
atgtcccagtcaccgtcttccatgtcatcgtcctcatcttctgcagagtcttcgcactccgcagggaacaaagggggacaacccaatgtttgtgctttggttgcaaagacggggtttcaaaaaacgggggttaattcgcccagtttttcatttgtttgtgaattagtttaaattcccaagcttcagcatgtcgaaagccatggtgaccacgtgggcaaaatgcttggcaatgtgtccgacgattctgaggagggcgaggaggaagaagcagcacaacaacaacacgcggaagtagcggtggcggcgatggacgacgcctcttccgactcaccggcgacctcatcagacgaagaaatgccaatggaacagcgccagcaaaagcaaagggacgcggaggggacggaagtgcgtggagaggtggaaatgcattggcattccccaaattattatttttttgcccaaatttgttactggacccctttgaatttttgccgccgattcccttgcaaaaatttctgtcgtcctcgtcccccgcccttttttaagtgtggttttggatttgatttaaatattttgcgtcgattaagggcaacactgaagaggcggaggaggacgacgaaggacaaattggacgtcgaaaagcccaactgcagcgaaatgagcaggatgaggaagaagacgacatggacgaaatgtttgctcgggacgacgacgtcgaaatgcatggaattgaaggggaagaagaggaaggggcacagtcgacgagtcaaagggacgcggagggcgaggaggaacggcagatggacaccacgctgggcgaag

SEQ ID NO: 56028 - DNA, 768 bp, Heterodera glycines
  Genomic contig location: Contig_ID=SeqID_25285; Location=122..889; Strand=+
  SCN-specific regions: Sequence locations=1-768
ctttatctccgccgattgttggctttgtgtcttcgaattgcttgcgccttctcaactaggcctcggaattgcgctgatcagccaccgttttgacgtttacattggcgaacacttcaagacgcgcaaatgggcactgaaatttattcaaattctactcaaaattggcgagaatggcaccaaggaaatggaaattaccaatttggatggagaaacattgccaattccaaaaattcaattgccacgcaaagtcatcggattcaaacgaatcatcatcaagtaaaattggcgattattcaaaagatttaattagacaatattcccattttcagttacatcgaccacaatgtcatctcttttctcgaccgattgagtccacttttcgcctcatttccgattaatttggcattcggcacgaacaaaatgggcattttggatttggttgtacgcaacacttggccaatgctcggaaaaaacattcatggcatcgaatcgtaccccagttttttacactgtttgcgacatttcgtcccgtcatttctcaacgaatgtccaccacttcgctttgtcttcttctgttttggcgaactattccccgaattccctgccgatgacaatgccatggcatcggaaagacaagcggtggccaaatggcttttcaccccacttcaaaacgatgtgccaaaagtgttcaaatttgaatttgtcaggaatgaatgggagaattggccgtcgaaaattgacgccttcaaagcggtgatttcgatttga

SEQ ID NO: 56029 - DNA, 2919 bp, Heterodera glycines
  Genomic contig location: Contig_ID=SeqID_550; Location=769..3687; Strand=-
  SCN-specific regions: Sequence locations=1-583,605-796,818-913,938 -1068,1094-1442,1465-2004,2031-2209,2231-2746,2817-2919
atgaaagatgagtcatccgttttcattaatttattattcgatcacaatttctgttttctgcttccaattgacgccgaatcatcaccattatccaccaccacagcagttgatgaaaatttattccatcaattagtccatcatttatttcagttcattctttttgttgtaaacggacaaaaatcaaatgggatttgtggttttatttttaaatgctcttgtttgaattgtctgttttttccatatcccaaccacagtattctctgcatcataatgtgccgaccactgctcttcctacttgtttcattgtccgctctttcgttcaaattcgccctgccccccgaactcggcatgccaaacggaccgcgaacgggcgccgcttcatcagtcaaagtggtcgagctgtcacaccccgcaaccgcacgacacggaaccggcactgggtctggcaacccgtacatggactacggtatcggtatggattcgaacaaaggcaaacgaaccaaggcaaaccatacaaaaaatgaaaaatttgatcatactgtaggcattttcccctacaaatttaagcttctgttgcacagctatcactgattacagtatttcaattttattcaatttatttttacagaagaaaatttttcactgatcggtgccattttcgttggtcagctgatcttttgcttcttggcctcatccgacaaaggtacgtcccagtcgctctctctgaatcaattaaaaatgccattttaaattaactgtgtaatttgaaaccgaactatcaattaatttgttgtgtctgtttttactttttgcttattgttagctgccttaaactttggaatgttcttccgtccgctgatcattttttgattgctgtcgcagtttatggagggtaatttcgtttaacttctactaattatataaaaaaattaattaacggcggcattttttttattaaaatttagaattcattatgaaaattgggacaaatgtgaaccgattgaaaatggcactgcaattagactggaaaaaggcggcaaaaagtgtgtaccaatttttaattttggcattttaatttaaaaaaaattaatttcatattagttatctgatctgttacccgagcaaattggccaaaaatttcggaaattggaaagccaatggacgtatgagagagttgcaaagatggacttgcaggaattgagtaagaaatgtgccgaaaatggtgggccaaatcattgcaacggcggatggcacagcttaatgatagtcaagaagagtgacgggcagttggcattccattcatccctcaggcgagtgtttttgggctaattacatattttatttagatttagcgccaatttgtccggcaatttggacaaagatttcttcagcgatgccggttttctgagagctcaatttcaccaaaggtccaatcttatcaagaatatttttaattggctacagtaaaaggtacatgtgatactatagatttatcaaattcattcctacatttttacaactaaagttaccattatgaataaaaagttaaatgtttgactttttataaatctatcaaaataataaggacggagaagaagaatacagtacccttataccgtcacagtatccccgtttttgaaaatacattatttctgaagctttttctattcccttttcagctctgatacagcaaaatgggtcactttctgcagctgaatttgaagaggcacttccgcttggctcatttatgaaagattttgacggaatggcgttgcgaattgtggcactggaacttaccaagggcattggacaaatgcacggaacgaaaatgtgcaaaacaatggtgggtactgtaatgatagtatacttacgacaatcgaattagttgatgaatgggtactgtaatccaaatggttgcttgatttcctgtaataagttagcttttctccgtccctgctaatgtcagccttttcgatatgcaggtggccgccctgaaaatttctcttaataaagttttttattttctttagcctgtgccgaaagcgtcaaacattgaccatttgggcacaaactgtacacaaattgtgtttgccgaccgtatgccacagttttggctgaatgtgtccgtttctccctattttattgcgtgcgaacaatttaaggcgccatttgatccctcgactatgttcaatcagtctcggaccagcagtgatttgtttgatgcatgtcaaaaggtgccaacaacaccgaactgcgagaagttggcacattatctgtgataaaattattttaaaaaaaccataaccaatgtacaaattcgaggactgtcattggtctttaattctatgattttaaattttcagaaattccgtccttatttttcccattatcttgaatatttaaaaaaactgttctttttggtgcaaaaaactttcaaagtgctcaaaaaattttaaggcattgaaaaaaatggaattttgtgcttttaatcatatattataatttcctatttttgccactccaattgttttttaaatatttttgccaagaacatctccaaaacgcgcgccaaaaggcgtacggatttcgcatccgtttgtgtacacatcgcgaagcggaaaagcaacggatcattttggaatccaagctggacttttcattcactgatcaaaagtacttaactaacaaatagaatcaatcacaaaaactgattggaaaattcgccgctacaatggaatcattaggctaatattaattattattttttaatatatcgattttttttctattttttgcaaatattttaatttttaaaagtgatcaaaccaaatcaattaaggacagggctaatgaaattagactaattaaattaaatgacaaattaggcatttgccgcttggcattatataattaaataaa

SEQ ID NO: 56030 - DNA, 928 bp, Heterodera glycines
  Genomic contig location: Contig_ID=SeqID_550; Location=5477..6404; Strand=-
  SCN-specific regions: Sequence locations=1-228,250-298,335-858,880-928
atggacaaacttttctgtgcaaattttgctgtaaagacgtgggaaaaggaaagcggtgcaccgattgaatgccaattcgatgtaaaaagtgtcaatgcaaaaattgacgaaacggaacagataggcaccaaatgggtattttgcatgtacgcgagtgccaacgagaaactccaaggaaagccaaacatattcgagcagccaaataaggtcgaagagattctaaagccaaaatattttatttttaatcttgaaataaaaccgacatatggaaatgattttgtattttatatgccatgtgtattaaattctataataattaacaaattttaatatagaatattgaaaagatttcaactaattttgtaaattgaatagagcggcaccggtattcttcactaaagcagatgccggtactgcgatcacctatgccgataccgtatgcaagtttacgaccggtatcgatatcaacaggacggttagttgcggtaccgccggtactgcaagattcgagccgggtagtttattttttactaaaaacaggtactggtcccgtcactgctcttgtttaattgtaaattcaatttttgaaactcaaaatatgcgcacaatgtaaaggagcagcagaaaggcggagcgatgtttggagaggcgccaattggcgggcagcacaaccaattgggacacaatgccaagcgcgtaaatgatgaacaaagtgatggcggacgaggtcagcgtcaggtcacgccgcgttgggtcgtcacaaaattggacaaaatattggtaagcagctgagacatttgtggaaaaattcggaaaggaattgtcgatgggcgacggaatggctgaggaagaagccatcattattttctttctctaaaaagcatttttttacggttacagtatgcaataatagaaaaaatgtaataaa

SEQ ID NO: 56031 - DNA, 1175 bp, Heterodera glycines
  Genomic contig location: Contig_ID=SeqID_550; Location=6781..7955; Strand=+
  SCN-specific regions: Sequence locations=1-46,68-165,207-574,603 -814,836-1108,1130-1143,1168-1175
atgaaaacttgcgttgtgtgcacatgtatcgtgtcaattgtttattcaatttacatgaattggtttccggagaggcgccctttccattgtctgattcagttgggctatttcgaaccgatgacatccatcacgaaagtgtgacgaatgctcgcttttagcttaatcattttaattatatttaaattttaattaataactatttatttcttccagtatatcaccgcaacattgccggacgcggggctttatgacgcggttcaaatcgctgaattggcttccatttgcactccctttttcctctatggcataacagtaatcaaaatggtgcacgatcacaagaagaatccctccacaagcataagtatttctttttttattgtgtggttttttggttgcgaaattattcattaattaactaattaatgaccttcggtaaatcccggtgatatcccattaacggggggggggggatgctaaagagagccagcgaaggaagaatcgtcttgtgtgggtcttttgaaaagggtcacttctcgttctcgacccaagaaatctgagaagatttattgtattgtattattcattttaattaattttatttagtccaagttgcgactgtgatgccgcgcgggagccaatcgaacggagaggagcgtgccaaatttgtcaatttgatgcaggaacgcactcggctcttctccatgtgcttgctcagccaagtgccctactatttgtcccacgcgctttaccaatcgtcccgaatatttgagctcagcgaagacaccgttcaggtggaaaaaaattggcagaccaataaaattttgaaattttcagattttggccatcctttggcaacttctcggcacaatttttcatgtccaacagcccattctgatgctgttgctcagcaaggatttgcgctcatcagtgcgcaacgatttgacaaaaatattcggcacaattttgtgacccttaagagcaattttgattataatcatatgtagatgtccatttttaatgataaaatgtgtgaaatagacaataatgaactgcaaaattgatacaaaaggctcattacagtaactttaaaatggcttgtgtaaagtgcataaattaattttcagctttttccgtcaaaatgtgatattttttttttttttttttattcagaagaa

SEQ ID NO: 56032 - DNA, 1562 bp, Heterodera glycines
  Genomic contig location: Contig_ID=SeqID_550; Location=8959..10520; Strand=-
  SCN-specific regions: Sequence locations=1-42,80-426,457-1222,1246 -1393,1415-1562
atggtgtgccgtgtttcttcttctgttggtcggctgtgccaccattcttttttggttctttttggacaatgccaaaaaacgacgacgccctcacacaaaagaaatgtaaaataaataatcataatttgaaaatttcgaaaaaattctccccaatttttcagctttatctgcggagattgttggcttttggtgttcgattttcttgcgccttctcaactcggccttggaattgcactgatcaaccgccgctttaactgcatcgtcgacgaacacttcaagacacgcaaatggaaattgggcgaaattcgaatttgctacaaaattggagagaatggcactaagcaaatgcaaattgtcaattccgatggaaatccattgccaatcccgcaaaatccgttgcccaacaaagtcatcggattcagacacattaatatattgtaaaaaattaattaatttggttaatttttcatctaattttctgcttttcagctacatcgatcaaaatgtcatcgcatttctccgccgttttcaccgttttttcgccgtttgttcaacggttttgtacattcgcactgaaaatgttcgcattttggaatttgttttgctcaacattttgccaatgtttcgccattcaatgcatctgatgttcttgaactccatcgcttttcgccgtttgcgccaattggccccgtcacttctcaacgattgtccattcctttgcgctgtcattttctatggcgacattctccctgaatttccgcccgatgaaagtgccaatgcatcggatggccaagcggtggcaaaatggttgttcacgcctcgtccggatggtctgcccaagtggctcagatgctttgagaattcaccggatcaatggtcgtcaacgatggaacaattcaaagcggtgattatccctaattgttttttttctatgattttttgtccgctttttaggcattttccaatgcttcttctccggttactttttgtatttactttccgatgtcttctctagctgacttcattgtgccatttgatcggatcaacgaagtgactggggagcaattggcactggaaatatatgcacatgattgttgcctcttccgttgtccaattgcgtgggatagaagaaaatgggacaatgtgtgggaagaaatgtatgttcgacagaacccaatttacattcggatcagagatggcggattcgacgacgggtgaataattaaaaatgcttaatgattttatgatccaatcaacaattgaacaatgtttttttcagtcttctcctcgacgccgcttctcccgggccgagtgaaaactgatcaataacagcagaacaaatgaattaattaattggtgcgattatgtgaccgaaatgatgttggcaatttgccatttaaatattgccaattgtttgtttgtatttgacctttgcttgctcgcaaatgcgaccatttccattgtattttatgtgtatgtaattaattcattatgagtgatcgttgataaaaatggctaatgataaaacggattttggttaagcagtggctcaacacaataaa

SEQ ID NO: 56033 - DNA, 1403 bp, Heterodera glycines
  Genomic contig location: Contig_ID=SeqID_550; Location=10541..11943; Strand=+
  SCN-specific regions: Sequence locations=1-102,124-317,339-465,487 -1403
atgaatgaattaataattgaagagaagggaaaagtaattaaaggatcaaagttagctagtaaatacaaatgtgaagttatagcatccaaaaaaagctaatctttcaaaattggttttgaaatttaaatgcgaaacgttagaaaaaaaaggaaataataaacgtacagaatttctgaagacatttgcagcaaaaaaatgaccgggaaatacaggaagaatacctaatgagagaatggaatgatgcggaggaggagaaaaaaacacatttttatactaaaaattttagcgtagcgccccgagttgtagcataattttcgtcaaaaagtcacaaatttttgccaatttggggtcacattttcagaaaaggaaaaaaattttggaaattttaatgatgtatgcccatcaaaattcgctttaaggagcttcggataaagcaattttatacttttgtatatattaaagcaatttttatatttcttcagttacatcgaccattccgtgatcacatttttgagttccaaccagcaaatttgggacagaagtggcaccaaattggaattgtctattgaatattgtgaccagtcaatttgggatgttttgtccgtgaaatttggcctatctttgcgccaaacattcgcaatttggtctttcctaatgccgatgatttggacaatttgcgtcgtcacatttcaccgacaattctcactgatcttgatcaattgaattcaatcaattcctattttctggtgcctgatggaattggtgatgatgggccaaacgcaactgctggccaagcgttgaccaaatgggtgcacactccgagcaaaaatgggcaaccgaagcgattgtgttgctttaatgctaatggtccacagaatctcgaatggatcaacaacttcaaagaggtgtgtctagccatattttcgtcaatttgtttttgttttaccaatttttgtgtttaggcattccgtcgtgccaccacttctgtcagttaccatattcaattttatttttgggtggaaccaatgccaattgaacaatttgaattgatgaacgaagtgacgaatgaaaagctgacattgaaacaggagatcgacgaattcgacgtaaatgtgtataattgtgagctgcggtatgacaataatttgggcgccaatttgaacaatatccgatttgatttgtggggtggaaatagttgttgcattgggtgagcagcaaaagcaatttttgattgttgaaaaaataaaaataattttaggccattgtcgctgccagcgaaagaagaagaagcggatgaaagcaatgaaaaataattatttcgagaaatgatcgatctcaccaataggaatcggatttgatactctctttttctccgaaatgtttttgctgattatttcgttcga

SEQ ID NO: 56034 - DNA, 173 bp, Heterodera glycines
  Genomic contig location: Contig_ID=SeqID_550; Location=12009..12181; Strand=+
  SCN-specific regions: Sequence locations=1-173
atgatttcaatcgatgctagtattgtggtgcccgattggattgctgatgatggaccaaatgcaactgctcgccaggcgttgtctaaatggttgcataccagggctggacgtaattacggattacgtattacggattacggaaattacggcctttttggagttacggattacgg

SEQ ID NO: 56035 - DNA, 694 bp, Heterodera glycines
  Genomic contig location: Contig_ID=SeqID_551; Location=244..937; Strand=+
  SCN-specific regions: Sequence locations=1-331,353-694
atgcgaatttctttttataagacaacaacgccaattgaaccatttgaattgctgaatgaacggaccaatgagaaactgacaatgatgaagaaggatttcggtggtagtgattggctgttcaaacggtgcccaattattgaagaaacggcggcggttcaaaaagacaacaatttggaccatttgaacggagttcacttcagtctttataatgattgctttgggtgagcagcaaagaattggccttacttttgtataaaatacggatatgacggtgtcatggcaattcgtacaattttaaattgatgtggccataatttttttagaattttggcagagctccaggagttcctgctaaaacagcagaggacttcattcagtccctgtcttgtcctgctggtccatctaggaaacgctgctggcccgggtttttaaaaataattccgggttctattttttcaataaaaatgtttcatcctttcaaactgcatttctttagaccactgtctccgccagcagatcaaaacgacaaagaaagcttctcgactcccgggcccagtgatcagcagaagaaggagcgatcatttaaggaaatgaccgatcatttgagttaagatgaattggattgaatttttggcatccctgattattataattcagtatttcttgaaagggaaaagtgtgctctaaaattgca

SEQ ID NO: 56036 - DNA, 538 bp, Heterodera glycines
  Genomic contig location: Contig_ID=SeqID_551; Location=1527..2064; Strand=+
  SCN-specific regions: Sequence locations=1-117,140-341,364-538
atgccagatttacccttacccccaaaccagtgtttgggttacttggatgtgtgctgccgcttattactgggagtattttcaatcagtcaaagcggtcgtttttcaattagggttaacttttttaatttaaattaatttaggtagtggactcgtttgatccgaatgatgctgcctgtgttgaggactgtcaagaatgttttactgattctgtgtggcaggatttggcatacattcaatcaaattttggacgtttgagtcatgcaatcacaaagttggaaacacagggccttaccattcaagagtcgctggaaatttttgcgggtgtacaaaacgaaatggacaatgcaattggtgaaaaagcagaaagaatccgcgaaagatttgcttttattgtttcgaacaacgccggtcttgaaacgtaagaaacagagcaaaattttcaaaaatttacccggcggcgcctatcggcaccgccggccctcactattcttgaaactttttttgaacaaagccaactatcaatattgtgcgaaaacaa

SEQ ID NO: 56037 - DNA, 1860 bp, Heterodera glycines
  Genomic contig location: Contig_ID=SeqID_4871; Location=50..1909; Strand=+
  SCN-specific regions: Sequence locations=1-232,254-615,638-840,863 -938,960-1017,1040-1077,1116-1860
  Gene Ontology: Mol. function=signal transducer activity; Cellular component=cytoplasm; Biological process=signal transduction
atgggtcctcatcttgtcccacagtccaccccaacgctttcccacgcaatgaacggtccaccgtcttcgtccgccggactcgcggggcgacaatggaaacaatgccggcggtggtggcctcatcgatgggccctcggcggtggtgccgctgcgcatcacttgggcgtcccgtccgcaatggtcgtcgtcagttcgaccgccgcttcttcggctggtcaaccaccgcccacctacaacaacaccaacgccgcaatgggcggcggcgtgggtcagcacagaatgggaccgcacgggcagtcgtcgtttgtacaaccgcagcaacagcaaaacacgggcggagggcaacaacagcatcaggtggacaattgaatgttcggcagggtcaattagttgttaaatttcaattttaatggcactggcaaatcccagcgaattactgaccttaaaaacgggatgaatttgttgcctaataacaacagcaacaattagggatgttcccattgcgtgtttattatcccacaattgttttttgaaagagaagattttctcttatttttcaatttgttctttttattcccattttcagccaatgctccaaggacctccgatggactctcatcatcaccagcaacaacaggggccaccactgcccatgacaattgctcagaggcagtccgctgctgtgcagcagcagcagcagcagtcgtccgccaacccaaacgccgctgggggtgccatgatggtagcgcagagtccgcttggcgccatgatgaactcggtgagcggggagggcattttttgcattggcacgagatactacgtatgaataaaattggcttaaaattttaccaattttattttcataattttagcagcagcagtcgatgaacaacgcaaacagcggaggaccaccgcaaatgcgcgggggtggcattgcgcagcagcagcaaatgctaggcgcggggggcggcgctggacagccgcaggacccggagaagcgcaagctgatccaacaacagttggtgctgctgctgcacgcacacaagtgtcagcagatcgaacgggtcggtggttacaaaatttatatattttttatcccttatttcctgggatttcatttttacaattgattattattttcccataaaatctctattttcagtctgaactgcgacaaaaccgtgcgccctgcacattgccctactgctcggtgatgaagggcgttttggagcatatggtcggctgttcggccggccggcagtgtcagtacgcgcactgcgcctcctcccggcaaatcattgcgcattggaagaactgtaacaaggacgactgtccggtgtgcaacatggtcaaacggtacaccaccggaacagcggctgaccggcgacaaggcatggcaaaacatcaagaaaattttaatttaacgcaataataaatttccgatttcttgttggtaaattgctcccatttagctgacattatgctgattgctgtcggttttccctctgtgactttacctcagcaaacaatccaaggcgcgattggccaacaggtcaatttaatgccagaaatttaaataattaagaatttttatgcgtggacttggcgcaatcaattatttccatgaaatttatgacattggctcttttccagcaaccttcaagttcggcaagtgcctgcagtggaccgtcctctgtcggcatgaacaacacttctaccggtccgtccgccgctgtcggccccacaagcgttggcagtgtcggcggtggtccgatgagttcgttcggctcaccgccgtcgacgagcagtgcggtgaacaatttgctggacgggtacacaccgaacacgttggttttttga

SEQ ID NO: 56038 - DNA, 1285 bp, Heterodera glycines
  Genomic contig location: Contig_ID=SeqID_4873; Location=411..1695; Strand=+
  SCN-specific regions: Sequence locations=1-430,452-1285
atggagaagctggtgcttggcgacgaccagaagtcggcggacagtgccgcgtccgcggcgtcgcgcaacgactcggtgaagaagtgcatcacttcgttggtgcacgcgtgcatatgccgagatgccaattgtcgtcggggcacgtgccacaagatgaagaaggttagttttgggtcaaatgggacccgtctattcatttgacaatgaccgacccttccctggccaatccgtacggggcaactattttattatgttttaatttccctcattttcaaggtcattcaacacaccaaacactgcaaaaggcggcaaacggtcggctccaactgcgcggtttgcaagcagctgattgccctgtgctgttaccacgccaagcattgcacgcaatcgaagtgccaagtgcgtcttgtgatgccaccaaggctatttatggggacaatttaaagaggccaccctcgttagcggcgtttcaatatgccccgtttcatttttaattaaatgacttttcattgccattttaatttctaaaaggttttgctaagttttatggaattaatttacaaaagtaaagcttttcataggttttcaaattttcttgaaaataaaaacaaaaatgttcgatattttttactaattgtaagtgtttatgttttaatcctaaatcaaatttcgcaggtgcccttctgtctgcaaatccgacaaaaactgcaggagcagaagcgttcacagaatcgccaggcggagcggatgatgcagcgacggatgatgaaactgcaaagtgtcggcgcggcggcgatgaacggcagcggcggtgccgccaccgtcacgtcccaaatgacgtcatcagtgcccactccgtcttccgtctcgtcggcgtccatgcaacagcaacaggtggtcgttttgggcgtgtcttttgcatgtcggatgggattttttttttgagtttttctacggctgttagctgaaacctcccaaaaaaatagctttattaaaaagttggcgatcctcaactcatccccgtctattttttattgcgtatttttcttcagcaacagtcgccgtgggcacagccgcctcagtcgccacgccaacagcaaattggcgcctgcggactacagcagcagcagcagcaaaccgtttggtgcgccgccgatgcaaatgtcgggcatgatgatgtcaccaaatgcaatgccaccgcagcagcagcgactgaacggtccgatgggcgcggcagcggcgtaccatcgtaagtttcacaattggctatggccctattttcaga

SEQ ID NO: 56039 - DNA, 1048 bp, Heterodera glycines
  Genomic contig location: Contig_ID=SeqID_4874; Location=133..1180; Strand=+
  SCN-specific regions: Sequence locations=1-183,209-246,269-304,345 -627,650-1048
atgccggttttttggtccataactctcgctaattgtgtccattggcagggccctgccggacttcaccgtgtgccgtccagcggagcgctgcagcagcagatgatgtcgcccaactcgcagcagcaacagcacatcactccgcctccgtatgttcgaagcgccgccgccgcgcaacagtcgcctctccaccaccagcagcagcagccgttcgttggtggaggcgttggagcagtgcaaccgccgggtcagcagcagcaacaccaagaacgctttggcaccgccggagcccaaccgcaacaagtggtacaacaacaccacaccaaacagcagcagcagcggttgtttcaacagcaacagcaaatcagaggcaaacaaaaataaaataaggaggagaagtccacgccaattggctcgactgggcaaaatcggcctgttttccattttttaccaaatgtccatgtaatttgagtttgatccgtaagtttagtgctgggccatcaagtgatgaacaataacgatatgcagctgctcatgaatcggttcaaggaggccagtcaacgggggagcaacgacgaggtggaaagatttttctcggacttgcgcaagacgccccacatgttcaacgcgtttttgaagctgaccaaaaaagtgacattttcctccctcttattctcttactcctagggcagttgtcgttttaatccccacatttgtgcccttttttgccattcccttcagcagggcgtctgtatatccggcgatccgtttcctcatcaacatcaaccgcaaggaggtgctgcaacacaaccgcagcaacagcactttgtgcagccgcagtcgtccttctaccagccgaaccaaccgcagcagaacggtggcaacattccatcgtcacagtttggcgggcccttccaacagcaaatgccgtcccacggcgccggaacggcgcaatggatgcaacccccgaaccaatcgcagcaacagtccgccgcctcccaacggaattcgtcctgacaaatgagcaataactgtttgatggatgaagcaa

SEQ ID NO: 56040 - DNA, 56 bp, Heterodera glycines; identical to SEQ ID NO: 52733
  Genomic contig location: Contig_ID=SeqID_25289; Location=934..989; Strand=+
  SCN-specific regions: Sequence locations=1-56

SEQ ID NO: 56041 - DNA, 481 bp, Heterodera glycines
  misc_feature (369)..(369): n is a, c, g, or t
  Genomic contig location: Contig_ID=SeqID_25292; Location=431..911; Strand=-
  SCN-specific regions: Sequence locations=1-82,108-433,455-481
atgccgcattggacacgagcaattttctcaatccaacagccgtcgagaagtgagtaaatgttcataacacctttcaaaaaacaaattttaaaaaaaatttttaatttggtcaactttgaaaaaattattacgattttatgacgattttttatgttacgagtagggcagtacgagtttgcctagtacgagttgaagttttaccaggtcctgcgctatcatgttataacatttaaaaaaaaaattcacatggttttgtctattattttttaaaattatagctcaaagggccgcggatttcaatttttcctccaaaaagccggtttttggttcagttaaacaccgtgaaaagcctaatttacatcccccccnccccaaagaatatatttttggttagaaaattaaacgaatagcttgcttattctcgtgtttaatcaatgtaaactctgaaaatttttatgaaattttaaattcttgaaataaa

SEQ ID NO: 56042 - DNA, 321 bp, Heterodera glycines
  Genomic contig location: Contig_ID=SeqID_25294; Location=1058..1378; Strand=+
  SCN-specific regions: Sequence locations=1-321
agttgcacaacgttatttttcgagcagtcgtaaacaaacggaacaatatttggaacgacaggccaacgaccaatactcgaggcgggccagagaacactcataccgtgcaaggagtgcctttaaactcatgcaaatcaatgacaaaatgcacttcatcaggccgggtaccaataataattgtgagtcagcaaatgctcggctcaaacactcattgcaggactcgttgcgattgacgcgggtgcaggttcatttctgttactcttttctgttgaaactcgctctttgcccagcgcccggctcgtggtgccaagtgctcagcga

SEQ ID NO: 56043 - DNA, 732 bp, Heterodera glycines
  Genomic contig location: Contig_ID=SeqID_25295; Location=766..1497; Strand=+
  SCN-specific regions: Sequence locations=1-732
atgttcaacaaatcatcaaactacgataaggtcctccagcacctccctccacgtgaagactactgtcctgatcaaatgaaaaaagccgatttacagaaatttgataattggtataactacaatcgcagtcaaccattcgacctcaaagagaaactacctgaatactgctgcaacgacgtccgaatcctcacccacgcccttgtagaactacgccgggaattcaaacaacttacacaaagggacggaaaacacggtggaatcgacattttgtggcaagccatgaccatcgccagtgcctgcgtcaaaaattttgccctcaatcatctgaagcctaactcacttgccatcgtccctgaaaaaggctatactccacaacagaatcaaagtgcactggccatcaaattttttgactggtactcccacatcaataacgtcaacattcaaacggcacactctcggtacggcgaatatgtctttaaacgcgaaggggaggtttaccaagtcgacggatacatcaaaggcacgaatggaaggcgggacaaaattattgaagttaatgggtgtgtttggcatgggtgtgagatatgtttcggtaatatggatgaggaatcgaggatgccgaacggaaagacgctgagggaaataagagagagggagaaaaggaagcacaaaacattgaggcgttacgttgacttggagttatatgggagcacgaaatcaatgaggagctga

SEQ ID NO: 56044 - DNA, 1771 bp, Heterodera glycines
  Genomic contig location: Contig_ID=SeqID_4876; Location=4610..6380; Strand=+
  SCN-specific regions: Sequence locations=1-762,784-786,900-1771
  Gene Ontology: Cellular component=integral to membrane
atgaacgaccaacagcccatcccctctttcatgaccaattttcctgtcagtggccaacaaaaagcggcacttcaattcgccttttacaacactttactcttttcgctggtaaatgctattgtttctgtctcaagaaggtcagaaatgccaacaaattcagctcggaatttgtttggccagcatttttgcggtctatcgacttttgtacttatttctgatgccaatgttatgggctttgttagtcggcactgtgcttttcccgctcaaacgaatgatcagcgaaggcttaaaaggtaaaatatacctaattgagtattaaattcaatccaattttaggttggctcgatcgtttggatggtgaaaatcggccccttttggttggcctggcatttcttcccgttcaaatcactttgcaattttctttcgccgtttatgagacggcactgaggttgtatttttgctgactttctcccatttcaattgtcttcagtttcaccggcctttgccttggcctcggttatttcgctctgaaagtcctttgccattacggcgctttctcctctttgctccttttgatcggtcgaatttacggtttcgccgattctctcatcgaaatttccactcggaattgggtcgttttccttttaattgaacttttttttattcctttttaggtttttctgctgattttctgttattctttggggcttggcggttggatttatcttcacgaaattggccaaattaacaagaaattcgcgcgtgtcctttccctccccatttggtttttcattcatttttctttcatttcccttttttaggttttttctgttggcttacctttccgatttcttcggtttttttcgtgttttcattttcattctctgctgctctcttctcgtgttgatttctgccggattaattggaacaaatgccgaaaatgaagacgaaaatcaacagaaaaagcaccaaaatgaagtggggaaaattatggattttggagggattctgagaaaagacaaatgcacggagaaataaatataaattagcatgttaaaacaggaagagaagaatgacgaagctgacaccgaaactgagcaaagtcagcgggaaaatggcaatggaacgaatgttggcactgcgctgggcggcgaagcgcggcttgaccaggtgaagcggtggatttcattaaattggtttgatttgaatttgttatcccccaaaaaggctttctcctccgacgtccatttgcgtgtcattggcggactgtgcgctttgctttgggtggttaaccacgaccttttgctgtttttcttcgtcattattccttttgccattgcctttgccgttcacttgggtaattttttaatttttgtcaaaatttcttcgcatttttaggtgcacaaattggcctttttgcgttcattttgcaacatttgacgcaatgcaaagaacaaattgtgcataagactattaaatttgtgcatgttattgtggcggggcccctgcgaaaatttgtccatttgcttttcaccagcgaccgaatggtcatttcttaagtttttctagcagaacggttgattgattcaattttccaattttttactcaatggttttcagtttacaaattcttttttcatttttgtttttccatttttcagtttgtcattggcttccgcgaccgcgtcgatttgctttcttcgctcattgtcatggccattttggccgtcggatgtctctttgcgttgcttttcaccctttttcaacttca

SEQ ID NO: 56045 - DNA, 1680 bp, Heterodera glycines
  Genomic contig location: Contig_ID=SeqID_4876; Location=1093..2772; Strand=+
  SCN-specific regions: Sequence locations=1-304,326-346,369-458,481 -859,881-893,916-1307,1332-1554,1576-1643,1671-1680
atgaagaaggtcgcgcagcagcagcagcagcagacgaacaaaagggcccaaaacgcggctaaggtaaacgaacccatccaaaaacaaaaaatgacagaaaatggggaggggacaaaagatacccaatgaatactgacaaacaattaaccatggctaacctgcttgaaggtgctgaaagtgatcacgccagagcagcaaatcgaatgccatccgaagacaaacgccgctggcattccaacgcaattgatttgcaaagtgaacggacaacaggtcaccggagatgagcagtgccaggacagttcttcatgtgtgcagttcaacaacaaacagcaggatgacgtgaccattcagacggaggcaatcgcagtgcgtttcaacggacgcaaggcgtggctgaaggtgtcccaggcatacaaaaacacccaatgcggactttgcggacactacgacgactcggacgaccagggggaggagctgcgcatggccaacggccagagaggtccttagcaaacccaaagcagcgactttgatgccaacccaaacaataacagattcattttttgctttcagcttccgacttggccgagttccaccgctcctacgctttggaagacgcggaagaatgcccacaacaggtgatgaacaacttctacagcgaacagcagcagcagaacagcgagcaggacacattctacgggcagttcaaccaatttgaggacgaagacgaagcggacgatgagcagcaacaacagtctgaaaaggacgaatggcagaatgagcaattcaatggccaattcgaggagcaaaacgatggccaagtcactgacggaggcaatccgttcgaaggaattttcaacgaccaacaacagcagcagaagtgttgctgctgctgtgacgacgacgaggacgaagagggcaccaacgaacagagccaatgccgacaaaactgccaaaacggcggggaatgcccagagaagtgcaacaaaaacgaccaaaagcaatgccgaaagtcatcgccaccacagccgcaacaacaacaaaattgcaaaggcagcgacgacgagcagtgcaaagggatttgcaacgacggagacgaagcatgtgccgagcagcagcagcagcagtggaaaggtgggcatgggaagggactgttggcctaatgctaatttgcatttgactgttttcagcagtttggccgattttgagaaccaaaaccccacgagcagaaccacgcggtgtgcttttccacccgcccggtcaaacactgcccgccggatgcctacccgtacaatccgatgaacggttatgagcagcagcagcagccgaagaccaagaaggtcagcttcgtgtgcatggagcgggcggagccggagacgcgtcggctgttgcgctcgttgcgacgcggacagcgcgtggtggacgtaaacgcacgcggcgcctccttcacggagaatgtgagcgagccgcatcagtgctggcgcagacgctactgatggaagaacggacgatttggtggatgacagaggagtgaccccccaacggagtagaaaagcacaaagcgtagaccaacccaaacacaaaacaataatcaccctctgctgatcaatgccattactcaaatgatcagcaccacaactccgccatttcctataacaaattgtatttttgtaatagtttaga

SEQ ID NO: 56046 - DNA, 307 bp, Heterodera glycines
  Genomic contig location: Contig_ID=SeqID_4877; Location=703..1009; Strand=+
  SCN-specific regions: Sequence locations=1-35,57-117,159-249,271-307
atgccaatcattcgaccattccgcaggcaatcaaatggaatggcacaagtgaacagcccgagggatatgtgccgggtcgaagttacgtggtcactgtgcgcggatggtcggttggatgcaattaattcattaattaatgtttttatttgagatggcacagcgaaaaaataagtgaattttcaggcgcacccaattcatcgtgcagacttttcgcggctttggcattaccgcactttttgaacagaatggaaaagctggagggaaatttgacattaagaaggtgaaatatctaattaatattaattaa

SEQ ID NO: 56047 - DNA, 442 bp, Heterodera glycines
  Genomic contig location: Contig_ID=SeqID_25296; Location=10..451; Strand=-
  SCN-specific regions: Sequence locations=1-43,65-405,427-442
atggtcaccaaagtgttccttctgttccccggcgaaacttcggtggcatttctattggaaaagtttttccttatttattcgttttggtaagtgtttgggttgtgccgaattgatgaaattgcgaaattatgaaattcaagagtgaattaatcgcaaaatccatttaagggtttggccaatgccattgcaattaaaagaaattaattatgccaaagaagaagcatttctgaattggtcccctgaacgagaatggtttgagagaaagcaaagcgaagttggccatgcccaaatttggatggaaatgccaatcatttcgccagtagttccttacacaaatatggccaacaaaattcagccttctgtcgctaaaaacattctaaatgaatttttgaatggtaaattaaataaattaatggaaaggaaaaagaatccaataaattaa

SEQ ID NO: 56048 - DNA, 759 bp, Heterodera glycines
  Genomic contig location: Contig_ID=SeqID_25296; Location=585..1343; Strand=-
  SCN-specific regions: Sequence locations=1-63,85-214,263-444,536 -543,565-737
atgggccaagtcccgccgaagcttaatttcaatgggaaattaattcaaataattctcactaaattcgggaagaaaattggtactttactcaaagaaagttttgttgacgtttataccaatgaaaaggatgagaaaattggtagggaaaagcatgagaaatttcgaatggaattggaggacgaactttttgcaattggtatgaaatttaaaaaggaataaaattaattcatttaaaaattaataaaagtattaaacattttatggaatttttttaggggatgatgatgataaagctgcgagaattatggaaaagttggaaaaaatggtaagttatgaagaacggacaacggcacaaagtgattcaatgaaagaggaagtgaaaaaggcggaaatgaagcgaaaaaccatttggcaattgatggaaaatctgaatgttttgtggggtaattttcaatttattcatttagtttattatttacattaataaaacgtaaattgtatttttctttgatttttattttaattaaatttaaatccattaacttttattaccattttaaatttcagagcattcgcttcccttggctcttcttgagcacttattgtcaccaaacgaattgtatattttgcaccaaacggacgacgaaaatgtgctgaatggaagcactttgaggaggtttagaacattttatgcatttgtcgaattatgggcaaaaggtggcgacaaaacggaagaataattaattagttttaattaaa

SEQ ID NO: 56049 - DNA, 1101 bp, Heterodera glycines
  Genomic contig location: Contig_ID=SeqID_25297; Location=172..1272; Strand=-
  SCN-specific regions: Sequence locations=1-405,427-818,840-900,924 -1101
atggccggggatcgggattggccacatccccaaaatgccatcaagaatgtcatgccaatgccattccattcagttacccttcctccggtcaatggcattctgccgtccgatgcaatgcgactgaatgcagttgaagtgctggaggatgtcgattttcgttacgcaaagttagcgcttaaatccaatgttatttcctataggcaatcattgttttacttttattatccgaaattttgttggtgacaaaatttgaatacgggttagactaactggtcacttgcttaactggactaaaaacgcttttgctgataggacggcggctacagcccggcagattcaaattccacccagattcggctcgagagtcaatcaaagtctcgttaattatcgctgatcactcaatgttttgccatttgagtgttttttacaacttttagacaccgatcagtttattttatcagttggtccaacagttactgtatagtcagtgcaaacattgtactgattttctttgttatcatttatcagagaattgtgtgacgcgcactctgattggacgttggcgtacgagcggaaacggacccgcgtttggacacgccgcgtggacgacgccagcggtggcggcaacggtgggaaacagtcaacgctgcaaatgatcaaaacgcgcagcgaattcgccgatgtgccggccgcactttgttatgacatgcttcaggtgagagaaaaaggctgaaaatgcccgagagttaattgagtcccgagaacgaagcgaacagtgctcgggaatttgagttttgccatttgcgcgaggctcggaaattggcatttgaaaatggaagcaaatgttgagaaatgccattctcgacatgattctcgagcatctcttttaagcttttacagtgctaattaattcattttccacaggacaccgactaccggttaaaagtgagtccaatcaatcgatttttcatttattcttccaccaaacaatttgatgccgtaattccctaccgtaccatcacagtgggacaaatacatgctgaagacggtgcctgtcggctttttgaacccgaacaacgacatttgctattacgcccgtag

SEQ ID NO: 56050 - DNA, 426 bp, Heterodera glycines
  misc_feature (27)..(27): n is a, c, g, or t
  Genomic contig location: Contig_ID=SeqID_25298; Location=1..426; Strand=+
  SCN-specific regions: Sequence locations=1-113,135-266,293-375,418-426
caacgcagaattaaagtacagactatnagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagact

SEQ ID NO: 56051 - DNA, 1681 bp, Heterodera glycines
  misc_feature (124)..(124): n is a, c, g, or t
  misc_feature (206)..(206): n is a, c, g, or t
  misc_feature (244)..(244): n is a, c, g, or t
  Genomic contig location: Contig_ID=SeqID_25300; Location=166..1846; Strand=+
  SCN-specific regions: Sequence locations=1-222,244-258,280-330,353 -658,695-947,969-1136,1165-1231,1253-1338,1404-1570,1601-1603,1651 -1681
atgaaagatggacaaaacccaaacgcctttccattaagcatgtaaaaatccaatgaaaaataaacgagataaccgatgagaataacaaagatagaatcaacatacgcagtcgtgcacacaattntaacatcaaaaaaagcaattccaaaataaagcgagaccgctgcttcagcacggcatgaacgcgcagagtctgaatgaaatcncatgaattcggaaccgcaataaaaatgtaaattagatntaaggattcttaacccatgtgggttttgggaattggttttattaggtctttaaaaaacgaggttttttattttttaacaaaaggtaaaagaaaaataactaatcaaaattaatttattccaatcgcaaataaaatgagagaattgaaaattcgagtccgcccatttgaaattttttctggctacgggcccgcccctaaattgtctttttcgaaattccttaaattggaaaatttacacttttttcgttttttgtattttttattctgggtttggtttttaatggctcacctgctgaagaaaagcgtaagtcgataaacaaaattgttgtaaaaaaagagtatcgtgaattttattgctaaatttttacgtttgacgaaataatttaaagcgcaaaaaacaaaatttcaatagtttttgaagaaatcaaaaatatttcaaataacattttctttgtcaccaaaatccccaaactatatcattcattcaaaaataaacaagaaaaatcacagagttactgacagacatgctccattgaggaaagtttttgctttgaatgcattaaatgaaaattggtaactcatattggacataaaaataaaattcaggccattcattgatgagaaaatgtgaagaaaatgataaaggggcgggctccttttatttgaacaaaaattgtgagtgggagagagtaagaccatccgtaatctttaatctattttgagtatttgaaagcattttacaatttcttttcgttttttttaattctttttccttcttttccaacttcatttccaaaaaaacttatcccatatccactttattacaagtggcacccaacaaaactttttttacttttttttatccttctcgttaagtttttccaatttcgttttcctgcttccattttattttaaaaaatgcttttctctcccccctccccctcatccacttcatttttttaggaaagcaaacaaataatatttgagaaaaggaagcattttgattaatttgcacgactcacggaaaaataaatttgaggcaatggaatttggaaaacaatataaaatggcataatgatgaaaaatattaggggaatttttaaaaatttaaattaattaaaattaaaatttattatagaaattgtatttgtttaaaattgaataagcagttgatgaaatcaataacagagctaccgaattcatcgataaacgccaaacggggaaaacataggaaaagccgaagaataaaaagtaacaattaatttttttttaattgttttgttttttgggtggcacctcatagctgtctgattctaatcgatcggaaaagcaaaaaggggaaaaagcatttaaaatgccggggggcagggagggaggataaaagcggggggggggcggggggggggactgatattgctgctgtagtagtggaatcaa

SEQ ID NO: 56052 - DNA, 807 bp, Heterodera glycines
  Genomic contig location: Contig_ID=SeqID_25302; Location=181..987; Strand=-
  SCN-specific regions: Sequence locations=1-232,256-397,433-613,635 -774,796-807
  Gene Ontology: Mol. function=DNA-directed RNA polymerase activity; Cellular component=DNA-directed RNA polymerase III complex; Biological process=growth
aatcatcaacgcggtccgctccatttcaacgcctatcatcaccgtggcattggccgatgagcgggacgaaaagttggcacgacgggtgaaggcacggattgagaagaccacattgggtagcttttttaaatcaaatcccccccccccttttaaattagctaaaatttgttttccattttccaatttttcccaaaaaatgtaaatttcaggagcatttccgccctgaaaatttcaaaaaacaaaatataaattttaggcgatatcagtgactatgtggagcaagtgtttttgccggacgacctgttcgtgctgatcaaactgaacacccggcgaatcagagcaatgcaattggaggtgtttatttaaaaaaaaaagaatttacaattttgggattcaacaattaattcaattaaaaacataaaaattcaaacaaatggaaccaaaaacttctaaattttttcatgaattcaagataatggtttgaaaatttttcatcgattttttggaaaaatttttcaaaagttttttggaaatttcttacaaaaacaactaagggtttttgaaaattttccgggcgggaatcaacctgctcccgaggacatgttcggccgagtagaaaatattttttccaggtgaccatggacaccatcatcgacgcaatttgcgccgccaaattgccggtgccacgcattctgtgcgaccaggtccgctcggtgggcaagtcgatgctgctggtcaggccggtcgagtcgtccaaatgttcgatgaccatgtacatgcactacctgaagtaccatctgccgtcgg

SEQ ID NO: 56053 - DNA, 4580 bp, Heterodera glycines
  Genomic contig location: Contig_ID=SeqID_4878; Location=42..4621; Strand=+
  SCN-specific regions: Sequence locations=1-705,727-1091,1113 -1243,1265-1642,1664-1934,1956-2927,2956-3893,3916-4580
atgactcgtcgaactgttctccaacagctcgcctccgtttttgaccctctcggactagtgtgcccggcacttcacgatgccaaaatgtttttccaatcactttgggaaaccaagcttgactgggatgatcctcttccgactgacaaagtgcaagaatggaacacaattgccacgacttggaaccagcaaaaggtccgtgtcccgcgccgagtcaccccgttggaagtggcctctcatcagctacatgcctttgtcgatgcaagtaaagatgcctatggagcatgcatcttcattcgggcacaacatggagtcgcgatcacggcccatctcatttttgccaagagccgagtgaagccaaaggggtcaaatctcactattccgcgcatggagctcatggggatgctgattggcattcggatgcttcaatttgccgaaaaacagctcggacttgccattcgccacaaattcatttggtgtgactccaaaccagtccttggttgggtgtcatcttctgagcagcaacctcgttttgtggagaatcggctaaaggaaatccgtgccgtcgaccaagttcgctttcgctacatatcgacagagcaaaacccagccgatgtcgcctcacgaggatgtactgtgcttgaactcacctcccatccactctggtggaacggcccaagttggcttatccatcccgaggatcgttggcccatcaccatagaagtcaagcctgccaatgatgacgtccaaaacattgctgagatcgctgccatcgtacccattgtccaaaaggacgaagcatggatttgcgccgacagattcagcgactggacttgccttcggaacgtggtggtgcttgtcctccgtgcccttcgtcgatggctcacaatgtctagcaagcccattatcggattgtgctcccgtgtttcggcctgtggaccaatccaagcaagcgattttcaactcgccgagcgtcttctgatcgaacttgcccaagttgactgtaccgatttggccaagcaaaggcccgaggtacgccttcgcactgacgaacagggattgatccgccttgagaccagactcggcaactgtacagcaagtgatgactggaaaagcccaattctgcttccggaccagtcaccaatcactctgctgataattcgagatcgtcatgagaaggtgcgacactcaggagtagaagccacgctcacttcattcctggagaaattttggtgccctaaagccaggggcacagtgaccagagaggtcaaaaaatgccttcgttgccgacgaatccaaggcccggcatttgctctgccagccatgccatccctgcccactgatcgtgttgtgcgatctgcaccctttgagcatgtcggcattgactacttgggccctacaatgacgagaatcgtgaccggtccaaccaccgcggcacataaggcctggatcgtgctgataacctgcctggctactcgtgccgtctatcttgaaccggtcctggacctaacagcctcgtcatttcttctcattctgcgccgcttcacgtgccgacgaggcgtgccaactcggatccttaccgacaacggaactcaattcgttctggcatccaaagtttctgcggctctcgaagccggcagagtgccaacttcagcactggaccgatttctggcacgagaggcaatccattggcgttttatccctcagttgtcaccttggcaagggggagtctacgaaagactcgttgccttggtcaagagctgcttcaaacgagagcttggccgcgtaatgctctcatgggaagagctggtcacatacacagccgaagttgaagcagtactcaaccaaaggccgctctgtcatgtctctgaagagcctgacggaatcctgccactccggccaattgacttcctccttccaagagcaaaacttggcattgcgttcaatgccgagactgaaaatgaagagttccgaatctcttcaaccaatcaacgagatacgctcatccaacgttggcattccgtgtcatcatcaatcgaccatttctggaatcgctggcagaaggaatacctgctgatgcttcgccagagattgcagtggaagttcaagaaacagaggaaccaaattgcgcgagagcccacggaaggagaagttgtgctaatctctgaagaaaaacttcctcgcaactgttggccgatgggacgaattgtcgagttacaacgctcacacggggagattcgaaacgccaaaattcgattggccacaggaaaagtgctaagccggcccctaaatcgtctttatcccttggaagtggcttcctctgccggacaagatgagagccaccagcagctgacaaacccgccgcttgaggaacatcacaaccgaacccaaacagcggactcaactccaatttgccaactgcgtgcccggcgcaattcacctggcccgactcattctatggtcactcgctcaaaaaccaaagcactggcctccgttctgtccattctgatgtgcctatttctgattggcgcttcccaaaccaacgccagtagcacgaccaagccaaagcgtgggaaaggacttccaattcgttgccgtggatgcgaactgacctgcacaaaaaccggcgttgacatttcaataccgaatgggattgtcaaattcttgctatgttgtgccggtggaactcagtgcatcactcaatcaggcgttcggaaatcctttcatcgtttgcccaaggaacatcttcttttcgactacgattgcgaagcaatgtactggacgaaacggggcaacaaaagaatcgggagcgtccaatgtccaggcagagatgcgtgcgagctcatcgattgttgggtgtgcctcgaacgactggcaaatcctgattgtcgtccagatgtgaccttcggactcattggtggagcgagcttcttcactttcctcttccttttctggattctgccactgatgtgccacgtcaccatgttttggatcctacagcatcttttcaccctgctcgttcgcttattgtgttgtttttggccaagccaaaatgcaccgcagagagaagaatcccctctccttgccttccaaagtctgcctactccgcgcaggcgccaaatgagtcgcagtcgttttcgtccttttccaaaacttcaaacgacgctcctgttattgaccctatgtgcctttacttcatgtgccagggcacaagttgtctcaatcactgcctctgctgagaaatgccaaaggtccgactttggctcggtgtgccatctcgagagctcgacaacagttactcttctcccatcgggtctgccggtacgtctactccttcgacatcccgacgagagagtccttggcacgcttgaaatcagcatgcgctcactgactttgcattgcctgccaaaatctgagcaatggcttcggtcctatcacattgagacagtttcggtaaaacggtgcccgagtcgtggaaattgtacacgcgagttctgcgatgaagtcaacaacggaaggaagacagaagttcatgagctgagcgaatggaccaagcatcccggattcaacagatgctcagcatcttgctccttttggtggtgcgggtgtttaaatgccggtgccagctgcatcttctaccgtccacatgccattgctaactcgccaattgtctacgagcaaatctcctgtcctacatgggaataccgcttgcgcacttcactcaaactgtcggtcaacgcaaacttcacgaaagagccgtccgtgtcgctcacacccggcattactttccgttggaaggatttgagcatcacacctattgcctcttcggttcctccggccccaatcatggcaaacaagttcctctcggatggcaataacatggcaatcagtgatgaaatccaaagtgaccttcaatgccccagtcgtgccaatgccaaacgcctcaactgcacactcagatggggctcatgtccgatgtgcctgcctgaccacgattcagcaaaaatcaactgccaatgccgagatgtcaaactcgaaccagcactcgccgatcctgagaagcgcctaccaattcagctcaaaaacttgcttctccggaacgaaaggcgggacatttttgccgaaatcacctacgcgccgattcagttgtccattcaattcgaggggcttcgaatcgctacggaagaagacctcacaaaatgccatgccatgtccaagggtcttttcgggtgctattcatgccacactggagctcatctccatttgcaatgccacaccgacttcggttcagcacttggctacgttcgctgttcggatggcacagaattcacagccctctgccacaaaacaccagaagttttgaatgtcagcctgtcattcaaccgtgccgaggtcgacatcaattgtaccattgaatgcagtggaggacggaacccattcgtgattaatggtcatctccgctatgtgccaaaacacttccaagcacctaatggaggaagctcatttgcctcgaaggccaaacccagcaactcatgcctaatttggtgcccagattggaacttcgacttttccgatgtcttttg

SEQ ID NO: 56054 - DNA, 700 bp, Heterodera glycines
  Genomic contig location: Contig_ID=SeqID_4878; Location=815..1514; Strand=-
  SCN-specific regions: Sequence locations=1-209,231-361,383-700
agtagccaggcaggttatcagcacgatccaggccttatgtgccgcggtggttggaccggtcacgattctcgtcattgtagggcccaagtagtcaatgccgacatgctcaaagggtgcagatcgcacaacacgatcagtgggcagggatggcatggctggcagagcaaatgccgggccttggattcgtcggcaacgaaggcattttttgacctctctggtcactgtgcccctggctttagggcaccaaaatttctccaggaatgaagtgagcgtggcttctactcctgagtgtcgcaccttctcatgacgatctcgaattatcagcagagtgattggtgactggtccggaagcagaattgggcttttccagtcatcacttgctgtacagttgccgagtctggtctcaaggcggatcaatccctgttcgtcagtgcgaaggcgtacctcgggcctttgcttggccaaatcggtacagtcaacttgggcaagttcgatcagaagacgctcggcgagttgaaaatcgcttgcttggattggtccacaggccgaaacacgggagcacaatccgataatgggcttgctagacattgtgagccatcgacgaagggcacggaggacaagcaccaccacgttccgaaggcaagtccagtcgctgaatctgtcggcgcaaatccatgcttcgtccttttggacaatgggt

SEQ ID NO: 56055 - DNA, 68 bp, Heterodera glycines
  Genomic contig location: Contig_ID=SeqID_25306; Location=264..331; Strand=-
  SCN-specific regions: Sequence locations=1-68
atggcaaaagaggagaatgtaacgggacaacacttgttcatttacagctcattcatctacaagcaaag

SEQ ID NO: 56056 - DNA, 416 bp, Heterodera glycines
  Genomic contig location: Contig_ID=SeqID_25306; Location=1697..2112; Strand=+
  SCN-specific regions: Sequence locations=1-383,407-416
atgtatgcggatcctgccggatcccgcacaaaaatcaaatttgcggatcctgttgcaggattggaattcaaaattttttgccggaccggatccggccggattaatcctacaaatcctgcattttccaaaaatgcaggattgcggactgggatcctgcaaaatcctgcacaggatccggtcctgctccgggctctagtatcgggtattgttgcgcgaaacgtttcaattttggacagctagcagggaaatccaaaaaattttgggttgttaattagggatctgtttaccaatcccgcaatttcgttggattagggatgaacaatcagccccaattttaacactggtacagtagtcatggttaaaagagttgtacatccattcatccttcattaatgattaatgatattgttgaaaaa

SEQ ID NO: 56057 - DNA, 1420 bp, Heterodera glycines
  Genomic contig location: Contig_ID=SeqID_25308; Location=22..1441; Strand=-
  SCN-specific regions: Sequence locations=1-622,669-690,712-1420
atgttcgcgcagcacttccgacgatggccaaaatgtatcacaaatggccaaataagcgcagatggaacagtggcggacgaaagggtggcgaagggcaccgaaacgacggaggacggacagccaagcgaaggaggagctgagggagtaagaaagaaaagggaaaatggagagacggggaagggaggggagggagaggaccgaacagtcacctcaaaatggagagaatggagggcgaatgggccgcacatccaaccaactcgccaagggtcagcgccaatttccccaaaaagacgttggactgctgtaatcaatcagtgtttttttttgtgaggcgtaaatgaggacatccgggtcaatagcagttcgtacaataggagtttcgcacaatggagttacgtacaatggtgtttcgtataaaagccggttcgtacaacgaacgtttcaatttggcgtttcgtacaaaaaaattcttatttagtaaaaaataatgacgggctaacccctttctgcaaaaaaatattggggaatggaataaaatgttatgtaaatttaaagtttgtcgaaaacttcattggccaagttcagttgaagtgatgcaaattctccgaaaaagctcgaatgaattattattgttttggttattactattgttatttttataattattagctcattacttatttataatttgctttatttttgttattttgatgaaattatgtgtcactatcacttatttttttttaatttgattattgtacgaaacgcaaaattgaaacgttgtacgaaccggcttttgtacgaaactccattgtacgaactgcctattatacgaactgcccattgtacgaactgcctattgtacgaactgcaaattgtacgaactgcctttgtacgaactgcccattgtgcgaactgccatgaccccgttttttagcttttccaaagaatcgctgaatttttttcaacaaattaattttgaaaaaaatattttccggcggtgccaatcgccgcggcggatgagtgaattccaataaatttacaaaaaatttatccaagaagggatcattgttagaattaaaaatctggggggttctaattttttaggtgtggaaaaacctgggcacgataaatttacaaaaaatgattcccggcttttcgaattgggtgagaccaattccgactcgaggcccaccaatttcttaatttccccaatgttcatgttgtgtttaaggatgccgaatgcgagggcagtttcgccattgagccaattgacggtgccgaactgaggggccaatgtttggccaaaattgcgaaataccaaacgaagcgaaaggcattggacaaagcagtcggcacaaacttttttgttggcattcaagacgaactgttggcattcagacgggccaagcagaaacag

SEQ ID NO: 56058 - DNA, 100 bp, Heterodera glycines
  Genomic contig location: Contig_ID=SeqID_25308; Location=601..700; Strand=+
  SCN-specific regions: Sequence locations=1-100
ggcagttcgtataataggcagttcgtacaatggagtttcgtacaaaagccggttcgtacaacgtttcaattttgcgtttcgtacaataatcaaattaaaa

SEQ ID NO: 56059 - DNA, 1249 bp, Heterodera glycines
  Genomic contig location: Contig_ID=SeqID_25309; Location=226..1474; Strand=+
  SCN-specific regions: Sequence locations=1-245,267-575,597-656,678 -846,869-1054,1081-1106,1128-1155,1187-1249
atggtcgaacaatgtaaagactgccaaaattctgcaaaaatgccacgtaaggcaccgcttcacccatggcctgtgccggatggagtttttgacagaatccatgtcgattttgccggtccttgtcaggatggtcgaacttatttgattttagtggatgcaaaatcaaaatggccagaaatcactcaaatgatttcaacaaatgcggccagtacaatcgatattttaaacaaaactttccacagatatggttttcccaaggaaatggtcagcgacaatggtcccccattttcatcgtttgaattccgccgtttttgtgaacaccatggaatcaagcatagtttttcaccgccgtaccaaccgcattgcaacggtttggctgaacggatggtagacacttttaagcgtcaagctaaaaaggagggcacaaacaaaaatcaaaattggatttcagaatttttgttttcctacaggacaaatccgagtcaggttttaaacggttttgctcctgccaaattgttcttgggtcgcatgccacgaacatcactttcattgttggcaccgaaaaacgattcaagtccgaacaagatcaatgtctaccaaagcaagatgaaacgacagtatgatcagcaccatgacacttctgatcgacaattcaaaattggtgacacaattttaacactcaattatggtcggtatggtaagccatcatggcttgaaggtaaaattgttgatggtaagaatttggtctggaaggtcaaaatccattctttgggtattgtggttaatcgccacataaatcaaattcggtcatttattcccaaaatcccaatttcaaaagattttgtcgaagagcagagaccaaattcgccaacaaagaccccgacgacaaagaacaatcagcctcatggttcgcatgacgagcaaccttccgttttggcacgtcctcagcgtgaacgacgcccgccgaaacgattgaatatcggcccaaatgctggcgctcgatatgaaattgagggataatttcatttaaagggggagatgttgtggatttgacaatttaaatatattttattatttattgacacgattccctgtgtcatcacttggaaatgtttatttaatattgaccctttcactcattcgggtcacttgccgttctctccttcatttttcatttcattgattgtctttcctccgtcatttatttatttgttatttatcatttatttttctgtttgtctttgcttta

SEQ ID NO: 56060 - DNA, 899 bp, Heterodera glycines
  Genomic contig location: Contig_ID=SeqID_25311; Location=202..1100; Strand=-
  SCN-specific regions: Sequence locations=1-41,63-403,426-899
  Gene Ontology: Mol. function=transcription cofactor activity; Cellular component=cytoplasm; Biological process=SMAD protein heteromerization
ccgtttcagcagcaggtagagtttgaatggcaaggctttttaaatgctttttctaaattaatttgaccatcttttttcagatgtgtcaccaaaatacgactgcccaaagtcaaacgcatcggttcactcattgtattttctgaccaatgattcttttgccgttaaacatttctttcattgaagacaatttcgaactgcttcaactcccttcagttcggagtatcttttaattgtgcctttgagaacattcactgtcaacggatggttctttttcagaattgcccgaccattggtgttccatcgcttattttgagttagatactcagtcgggcgaactgttcaaagtgccatggcaaatcaaagaggtgccattgcataaatgttaatttgtttcatcggacaatatttaattctttcaatttcaggttgcaattgacggcggaatggacccttccggcgctttgtccgctcgcttttgtttgggcgcacttgcgaatgttcaccggaggttttaccactttgtaatgaaagaaaatggcactttaagtgaagcatcggaacgggcacgaatgcacattggcaaaggggtgggcacacaaagggacagaaaagggtcaaattggcactgccaacgactgatcagttggattttggggaatgaatgacctaaaagtgatcaaaatccgtttacaattggatcaaaggaggaaagatttgtacaacagttaaatcttatcttacaatgatttacactttcataatttataggtttcgttgaaatttgctgacaattgcgaggccgtttttctcaagtccattgaatttttcatttttttcttaatttgtttttgttctttttttctcagatgtctctcccaaaaaagcgttttcgtacgaag

SEQ ID NO: 56061 - DNA, 656 bp, Heterodera glycines
  Genomic contig location: Contig_ID=SeqID_25312; Location=509..1164; Strand=+
  SCN-specific regions: Sequence locations=1-389,411-524,575-656
atgcattctttgatcattctcggcattgcttttgccaatttggcaccaaatgcttttggccagcaatggccaaaagcaacaagtgatgaaacggtttcggcaaccatcaaagtgtcgggcggcaccaaagactttggctacaaaagattgaccgcctcttcggcgttgggcaccggtgatcagtcggagggccaaaaagcgctgatccgtgccgaaaagggcgcagtgatcaaaaatttgatcatcggccaaaacggggcggacggcattcactgctatgacgggtgcacgctgcaaaatgtgtggtgggagaaggtgggcgaagacgcggccactttccggagcagcagcggatgcaaggagtacaattttctggtgacgggcggcggtgtgaaaaatgccaaggacaaagtgttccaaatgaacggcggtggcacgttgacgatcaaagattttgtggtaatctacacatatatttaataaccaaaaatgcgtggcaattaatcccggatttaaattggatatctatgccatggatgcaatggaatataattgaattttttaaaatattttagaccattgtggtcgaattcccattcaggcaaaatccatcttttccccgtgttctgtcaattatgtaattatttattccctaa

SEQ ID NO: 56062 - DNA, 725 bp, Heterodera glycines
  Genomic contig location: Contig_ID=SeqID_25314; Location=330..1054; Strand=+
  SCN-specific regions: Sequence locations=1-207,229-449,490-725
atggttgtttcgaaagtcacacaacaaaacaacgccagtgaagatgaattggagttgcacaatgcctggcctcaatattccccagccgataaagttctccccacacgctttctacaaattattagactcatcaacaacaaattcaaagagcgtttacccgcctggcaaatcattgaacaacatccgcaacacttcacccatttttttatgcaaattcttcaaatggcactcgacgaaaaacttccatttgtgcaccaaatcgacattatcactttcttatgcaattgttttaattctttggaagtcgatttggtgtgccgtgaagctggtaaactttgttcaatgcccatttggataaatctactcaaggttggcggatttcaactattttttgaattcataaatcaccccaaatcagagacaaagagatttcttgctggagcaaaatccaaaaatgaaaaagatttggacaaagatggaacagaaatttgccaaattaccttctgatgattttgacgctttggactttaataggaggtttttatggcggttgcttcaaaggctaaagcggacggttgacttcatcgacgatgagagacaaagtcaaaacaattaaagaaccttaacaatctcttcttttagaagccgacattgatgctgtgagctattgtgaacggcttgtttctctttttattgacttagaagcgcagcttacgactcggtaa

SEQ ID NO: 56063 - DNA, 117 bp, Heterodera glycines
  Genomic contig location: Contig_ID=SeqID_25314; Location=69..185; Strand=+
  SCN-specific regions: Sequence locations=1-117
aaattagtcaaaatacatgtcagattcgtgattagcgacctttaaaaccccggataaaaaattatcatggttttttatcgtaaaaaaattttgcaaaacaaaagggtcccccctttt

SEQ ID NO: 56064 - DNA, 548 bp, Heterodera glycines
  Genomic contig location: Contig_ID=SeqID_25315; Location=790..1337; Strand=+
  SCN-specific regions: Sequence locations=1-38,63-236,259-363,388-548
atgtccgtttccccggtgatcagtcgcatgctcagcgtggagatgaaggagaagcagcagcgaatgatcactttggacgaattgggcgtggacatggaccaattcatggagtttttggaggccatcacttatctgaacggaccttttctgcccaaccgtaattccattatactgtatctattcaattcaaccctctgaaatatttctctcccattttatggggttgaaaatatgtgatatttaaatttttttaaatatgattccaatttttagccaaaaatgtgctgatgcttctcaaattggctgattacttccaggtgggtcctctgatcacttatcacatcctcttttccctgtctgatcattttaattaaatattaaatttaaccaccataatgctaatgagttttgtcctaataaaagtgtcgcttcactttcaggtgtccgcgttgaagtcgcgttgcgaaacgcatctgatcaattgcgtggaaattccactgatcgaccgtttccttttgattgatcgctacggactcgacaatttgaaa

SEQ ID NO: 56065 - DNA, 58 bp, Heterodera glycines
  Genomic contig location: Contig_ID=SeqID_4879; Location=506..563; Strand=-
  SCN-specific regions: Sequence locations=1-58
ggattgctggagtcgtgggttcgagtcccaccgggcgagttaccttttatgttctaca

SEQ ID NO: 56066 - DNA, 1315 bp, Heterodera glycines
  Genomic contig location: Contig_ID=SeqID_4880; Location=1140..2454; Strand=-
  SCN-specific regions: Sequence locations=1-1315
atgagcgcggaccaacttaagcaactccttgaggccatgcgtgtgcaatcggatgcgatccaacagctaatgggccaaacaccgcaaaacgccgcgtcagcgagtctgaaccatgcaaatttggcaagttccatcgacggccgaatttcaaaattcaattacgacgccgaaaccggaaacactttcgaacagtggttcaaacggtttggagttttgattgaggaagatggtaaggacctccccgagtcgacaaaagtcagactactcctcggcaaactcggcgacgaggagtacggcaaataccgcgacagcatcagtccgacccagcccgacaaagtcacttgggtggactcgatcaccaagctgaaaggattatatgccgaaacgcgttcactatttgtccggcgctacgacggtcacgtctatttcattttggtggactcattctccaaatggccggaggtctaccaaatgaattcaatgacggccgcggcaaccgtcttcacactccgttcaatcatccaccgactcggtattcctgaagaaattgtttcggataacggaactcaatttcattcgtcagaatttgcggcactctgtaaggagttcggaataaagcacacttttacgccgccattccatcctcaatccaacggacaagtcgaacgtttcgttgacactttcaaaagggcgatgacgaagtgcaaaggcgagaagaacagccttgaaaaagtgctgctctcctacagatcaaccggatattcgccagatcaattgttccttggacggaaactgcgcaccaaattggcactcgtccacccaaaaggacaaattgatcagtcggagaaatttgaaaaatgtaagttcaaacagcaccaaaaggactattcaaccaaaatggcacagcaattcgatcggaacaatggcacaaaagctattgagttcctcccaacggattccgtcctgctcttgaattatcgccttggaaaaagccattggctacagggcacaattgtaaaaaggctcaacaattcgccaacataccgtgtccacgtcccaactctcggccgaattgtccatcggcatgccaaccagcttcggtgccgattggattttgaggacaattcaaattgggaaccccccattcaggaacaaatggccattgagccaaatcaaaggacaccgccacgccaacacgcagccatcgatcagcgaactccacctgttgttgatcaggctaggcaaaaggctaaaagcccaattggcgtccgacgttcccagcgcgtgccgaagccggtcaaacgcttcacgccag

SEQ ID NO: 56067 - DNA, 667 bp, Heterodera glycines
  Genomic contig location: Contig_ID=SeqID_4882; Location=208..874; Strand=-
  SCN-specific regions: Sequence locations=1-667
ggactcaattcttctgcatttcaatcactgggactcaacccaccaacattccaatcaacaggactcaacccaccaacattccaatcaacaggactcaacccaccaacattccaatcagtgggactcaacccaccagcatttcaatcactgggactcaacccaccaacattccaatcaatgggactcaattcttctgcatttcaatcactgggactcaacccaccaacattccaatcagtgggactcaatccaccaacattccaatcaacaggactcaacccaccaacattacaatcagtgggactcaacccaccaacattccaatcaacaggactcaacccaccaacattccaatcagtgggactcaacccaccagcatttcaatcactgggactcaattcttctgcatttcaatcactgggactcaacccaccaacattccaatcaatgggactcaacccaccagcattcaatcactgggactcaattcttctgcatttcaatcactgggactcaaatctccggcattccaaacaatggactcaaatctccggcattctaaacactgggactcaacccaccaacttcaacgggactcaatccaccagcatttcaatcactgggactcaatccaccaacattccaatcaacgggactcaatccacca

SEQ ID NO: 56068 - DNA, 319 bp, Heterodera glycines
  Genomic contig location: Contig_ID=SeqID_25316; Location=1018..1336; Strand=+
  SCN-specific regions: Sequence locations=1-319
atgagtgcaaagcctttgctcgagttgtatgtgaaggtaaatcacaaatataaaacaccaaagttttttttattgtttttcaggcctcagggattgacagccgacgcatcggtgcatgcttattttgccaagaattttggatggaactctacgctctttacgaagtgggctgtgttcgtgttgaggtttcatcggaaatttctgctttatgcaattaaatttttcgctaaattaaggtaaaaactgtgaatgtcaattcggaaggatacaaaaagcacttttcgggagcacagccgccaataatggtggaacaagacaa

SEQ ID NO: 56069 - DNA, 783 bp, Heterodera glycines
  Genomic contig location: Contig_ID=SeqID_25317; Location=978..1760; Strand=+
  SCN-specific regions: Sequence locations=1-27,49-58,80-100,123 -176,198-362,429-559,590-603,625-633,667-783
atggccaatttagtgaaattggtacgaaattcatataccatataatttctaatttgtgcataatcaattaaaattttctttaaaggtcggcttcttcatcctggttcttttatggccaaaagcattagcaaacagtaggtcgaagctcacaagctcacctttcctattttgtatgataaaattattattttaagtaacatcggaagtgaaggacatgatggataagttttcttcactaaaagcttatacaaatgacatcgtcaaaaaattgagaaacgtgagcgataatatcgacgatttcatttgggtcacacgtccagtgagcgcattaatcaaagcaggggctaaaaccgcatttcaagtaaaaaatgttttttaaataatctatttattttgacttttagtttaattatttgtttaaattttaagccaaacgctgaagagctagaagccattaaagtatggcataactttgtaaaagtcgagtttgaaaaccttatagaagtgacacaacaactaaaaccaggaattaaatattatttaattcaagacgaatatataaaggtttgaaaaacaaatttgtttattcataatgaaattacgaatattaaatttaaatatttagaaaagtaattctgttattcatttgtttttcaggctgtgaaaagaccaatgcatggtttagaggaactttataaaaatataacggacccagacaaagaccgttcacaatatttagaaaaatttcgtgctggatgtttagcacagcttgaagttttgcaa

SEQ ID NO: 56070 - DNA, 304 bp, Heterodera glycines
  Genomic contig location: Contig_ID=SeqID_25318; Location=411..714; Strand=-
  SCN-specific regions: Sequence locations=1-304
aaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcaccgccctccctatcatgctcgagcgcttttgtgtggtataaaatttctcaaaaaaagagatagccatttttctgggatagagtataaatttaaaaattccctcaaaaataaaaggtctattgcgcaccgccctccctatcatg

SEQ ID NO: 56071 - DNA, 304 bp, Heterodera glycines
  Genomic contig location: Contig_ID=SeqID_25318; Location=918..1221; Strand=-
  SCN-specific regions: Sequence locations=1-304
aaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtaaattgcgcaccgccctccctatcatg

SEQ ID NO: 56072 - DNA, 1135 bp, Heterodera glycines
  Genomic contig location: Contig_ID=SeqID_25319; Location=848..1982; Strand=-
  SCN-specific regions: Sequence locations=1-306,328-964,986-1135
atgtcaaaaatatgtacaaaaattgatcaaaatatgtacataggtaaatatgggcacccccacaaagtgtccaagccacgaaaaagttttttttatttttcacaagaaaaaaattttcaaaaattctcaaaatatgtataaaaaacgaaaaatttgcagaaatttttgattttttttgaggatttccaaaattttccgtaaaaaattctcaaaatatgtaaaaaaaaagaagaaaatatgtaagaaaaagtacaaaatatgtatcaaatcccgaaatatgtaaaatatgtttaaaaccccgaaatatgtaaaaatatgtaaataaaagtcccaacattttgttcgcaaacacaaaaaagaaagtgtttttcccactatttagagcatggagaagtcaggaaaaaaatgtatttacataaaaggtaaaaacccaactcgtactattttagagtatctttttttctctgttctctgatgacttaacgctgtctcgcttttttctgtttctatatttactacataatagtacgagttgggtttcgtccgtttggaaacagcacgtggtacggctcacgtgcaaaaaagccgtaaagcccgcgtgcccgtgaaacccgtgtccagcctaaaaacacggattacgggcgcgggcccgtaaacccgcgcacgggcccggcctaatccgatctctaataatcattaagttcctatcacgtttgtttcagcgagggtacgctacatcaaaaggcagccagcgacctatgtgaccgcgagtgaaattgagcgggcttcatcctcatataacttcgaattgtatcgcaaagacatggccattattcgcgacatgcttctggatgatatcgaactcttccagagcgttcctcaatgtaagccaatggagggactgaccgcaggtcccggtcccggcactggtcagtaacgttccaagtttttcctgaaagtacagctccggcctattttttaaattttgatggaacatttttggtattggagaaaaaaacgaagaatttttttcgaaaattttccagatttcaagccatttttggcttttcagatcactatgaaggagtgaaaaccaaatataatttttgtgaaaaaagttcagaaaaccaataaa

SEQ ID NO: 56073 - DNA, 698 bp, Heterodera glycines
  Genomic contig location: Contig_ID=SeqID_25320; Location=797..1494; Strand=+
  SCN-specific regions: Sequence locations=1-191,226-506,530-578,600-698
atgttaattggcaggattggaggtaatcgtacgctttactggtcccacaaaaaaaaggtgaaaaaaaggaatttcagcttttaatggtgcactcgggggttcagggcgctgatcacgaatatgatatctatttcgaatcccgaacccgaattccaataatttttttgtaaaaattttgaaaaatacagaccataaaaaatagtttttttaaattataaatataaacatttctagggggtttcggagtcgctgatcacgaatctgttacccatttcgaccaattccgaagcccggacctgaattctgttccgattctaacaaagtgaattttggtttcgaattcgggttcgggattcgaaataggtcgaaatggatgtcatattcgagatcagcacctgcgaaaacccctgagtgcacgggaaccgcccggctcgccgcgaccacttcgccgcggccggttcgccgcccatagaaaaatgtccttttcgccgccataattattgttcaaaaaatttttaattttttttttcaagaatttgttataacttaggctgaaactatggtgcgaagcgaaaaaattaattaaaaataagtttctctttattttgggcaatttaaatgtatatgtattaggataaaattctggcgatggatacaaaagaaggaacgattgaaaaaggcgaagccgattggtttaa

SEQ ID NO: 56074 - DNA, 232 bp, Heterodera glycines
  Genomic contig location: Contig_ID=SeqID_25320; Location=1..232; Strand=+
  SCN-specific regions: Sequence locations=1-196
acccattcattcttaggcacgtattgaggctcggcaacacaaactaacgggtaattggaatgcaacttggaacctgaaatacgccgaactcaaaaggccgactcgagtgggctcaaatgggaaatttggttggcaattaaacataagaatgtccaaatgattccatttttaggcattaagctcaggctgaagaaggagaaaagggggtttttgtttttctcttccaaagatg

SEQ ID NO: 56075 - DNA, 851 bp, Heterodera glycines
  Genomic contig location: Contig_ID=SeqID_25326; Location=104..954; Strand=-
  SCN-specific regions: Sequence locations=1-471,494-646,696-851
atgtttgttgatcagacaaaacgccaaaaatgcgccgaatcgtttcaaaaagttggaaaacgtaattcaacgggcacaaacacaaagaaattatttggagaaagaagtggaagaagatgtggagaagtgcaaggccgaagtgagaaggcttttccaccagaaattctctggtaattttggaataaagggggaaaaggtttcgtttcgttttttcagattttgaattccctccgatcgtttgggtggtaatgcattcgctcctttcccactgtcaactgttggctgattctcaccaatccgaaggggctttttctgttgtacgctttgggcagcacggattcatgcacttgagcaatgctacattgcgtgcattggacattttcacaatcggtggagaaattggtaggaaaaatggaatttgcactgttagttcagaccatttaatttttcctaatattaagatgcttccgctgttttttcttctccttctgtcacgctttttgatcacatgaacaaatgtcgttctcagcccggcaaacgcttaatacgtaagaatttatcaatttattattaacgctgcatttttatttgaaacttatttaggcgaatggttacgccagccactctttaacattcgacagattgaaggtgattttcatacacaaaaaattgacatttattatatatttatttcagaacgactcgatatggtcgaaatattaataaattttacatccattcgtcaaactttgtacaatgattacttgaggcggattcctgacatcaaatttttggcgagaaaattggtccaaagaaaagccggactaattgtttgtttgtttgttttttag

SEQ ID NO: 56076 - DNA, 3274 bp, Heterodera glycines
  Genomic contig location: Contig_ID=SeqID_4883; Location=1..3274; Strand=-
  SCN-specific regions: Sequence locations=1-109,134-205,228-3274
cttatcaaattgaattgcttccggcgaattcgacgagcctttaagccaatgctttgtccacgataagccaaaaggcgaatttgcggcggctggcaaattcgaaagcggtagcatttatttgtttaattttttgcgtaagtactttgaccggtttttctttagcctcgtctacgactcagaatcagttatcggttggcgggtgccttgaatacaattgacgctgaagtgacgagcatcgcctgcctcgcctcctaacaacagtcccttcccactctaatgatctgtgacattccatttgttcattctgtcattagtccacttttaattaatttatagtaacaatgtaaatcattctttgtaacttagttcattgtttaaaggaggaaatgagtgtttacttttccctataattgcaaataatctaacagtcaatttcgactggtattaattacatataatttcaaagaatcacaataagagttggtaacactaacaagccttcaaaagttcttttggcttaacgccctaagtctcgaatggagaatggaatggaggaagaggagttcgattttggcgcattgggtgggcgtttcggatggtttgtacgggcggacagtgaggcggcggaggagcggacgccgttcgatcgtccaaaattttctcaggtgttaaaaataagaattggcttttttttattaatatccgttgggaatgcgttttcttctcccttaggttctccaactgatcccttttttgtgtcgttacgcgttcttttggcttcgcaatgttttcagtcgggagcgtcttttcatcgatattttccgccctttccgtcatttcccttacaccgcgctcccctgcggtgcgattggttcgggctcaatcagtcgggactttcgtggcgccttttgtcgcttcaacttgaggcctggcctcgtccagcaacacaacgagccgattaaggcaaacaaagactgtgactgtctgaccttcgctttgtcgtccctttgttaggctgaccaattcgtcctcactttgtcttccgccgatggctctctcatccgtcagactgcgctcagtgcggtcccttcttttgctgcctctgatgagttgtcttcctgggagttttccctttctccaaatgatgtcacttatcggtcaattagcgttaattttgaattttaaatttgccttccctaatgcgcaaaattcattttgttttcttttttccagtgctctttatccgcgcgcgtggatgaaattcgaattgcccgaacaaaaagtggtcgttttgatgcgtcaactttcgcccgttttgcccggtgattacatggcgcgtttcccttcgcttttcccttcatcgtttcagcttttccttcagaattcctcgttgccttgcactttgttcacttttcgcattgtcaataactccgattatccgctgaatgtttccgtcacttttacctttcgtaatgcaattgacgtcaatgacgtcacacccgccacggaatgcaattcaaatctcttcaaaacgagcaaaggtcggctcaaattccattggcttcccccttcgtaaatgccatttgccaatgtcagcggaaggtgtccttctccaccagtcggtgttcggaatgccctgcaccttcgccttgggtgccctccctcgtccaactacggcgatgtccgccactcgctctttcgatccctccggggatggcttttgcttgtggaattcaatggcatccggagaaacactcgctgaaattggtttatcaattcacaattttcaaagtgtgtacttttttaattttagtagatcagccaaaaaagaacggcgctttcggagttgccttgtcacagcgtacgaaagtggcagcaaacagtgcgactgattgtgaccaggagatggcatttgcactcatttggcatatgtttgggaaagggcgaagaatttgtggattaatttgcttttcatttttaaggccctttgttcaatttggcggtggcaaacgcacttttcgaaggtacgaaatgagttgggaagaaaagggtttctgggttgaattgcattcaattgtgtactcaactcgtcccaatgctccgatggcgagttgctgaagggacgaatgcgaaacaaagcgattcctttcattggtctttgatctcagagactgaaactgcgaagcaacactttgccatttattttttgttaaatgtctgctttattttgtcccttttctcagatggtattcccaatttttcgatcaatccgaccagcaaagcggcgctgtcgcattgtgtgaatacgctctcgccaattacgtccaatgggaggcggagattgacaaatggcagggcccaattctgagcaatccgtgagcatttccattcgtatttattttatccgaccaatttgattggtcgcccattgtcagtgcccttcccaattggttcaaatccgcgctgttcaacgagctgtactttctcaccgcggggggcaccgtttggatgtgttacgattccgaatggcgtcagcaggaaacgcaactgtccgattactcggccgcccatttccgtcgttttggtcgctttggctatttggaatgtgagaagggaagggcaaagggcgagcgcattccgcacaaactcttcttcagcttgggaatatcgcatgctcaacacttacgacgttcacttttacgcttcgtttgcgcttggccatttgttcccccaattggaacactctcttcagacggacttcagtgagtccgctttttcttcgcggatgtcctcatttaagatgatcagatctgccatttcgaccccaaaacagtgaaatatcacatgagtggagtccattcgccggtgaaaacgaagaacagagtgccgcatgaccttggcaacccaggcactcccccacccaattgccccattaattaattgctcttttacagcggaagagccatggcttaaaacaaatgtctaccgaatgcacgacaccagcgaatggaaggatttgaatcttaagttcgtgctttgttcctatcgaaccttttgcacagtcctcgggagagatcgccaattccttgcgcaagtctcgcaattccatttttggcgaacaaatgaagtgacgatgaatacattgaggtgtggccgcaagtccaaattatggtggctgaagggttggaacattgggacactgacggaaacggaatgattgagaatttcggccccgctgaccaaacttagaggcatggaaaatgcacggagtcag

SEQ ID NO: 56077 - DNA, 1596 bp, Heterodera glycines
  Genomic contig location: Contig_ID=SeqID_4885; Location=829..2424; Strand=-
  SCN-specific regions: Sequence locations=1-550,572-1545,1567-1596
  Gene Ontology: Mol. function=transporter activity; Cellular component= clathrin adaptor; Biological process=intracellular protein transport
atggcaaatgttgttgaaatgacaattgagaaaattgatgaagtcaaatcaagactaggaaggtgtgaattaattgtcacaaacctataattgataggcatgactttaacattttaaggacattgggtgcgtcgatgcgcttgcgtgatttgattcgtcaagtccgagcggcacgaacagcggccgaggaacgggcagtggtggagaaagaaagtgcaaacatcagagattccttcagggacgacgacaacaaatacaaatgcaggcaattgcacggagtttcgcattcgatcgaaaattaaattaaggaatatggctaaacttctctatattcacatgcttggttatcctgcacatttcggacaagtaaacattcatttttaagacgaaatccgtttcaatccttccaaatcgaaaggttgaatgtgttaaattggtgggcagcaaggataaacgattcactgacgttcgaattggttatttgggcgccatgcttttgttggatgagcgttccgaaattcatttacttgttacaaattgcttaaaggggttttaaatatttcttttttcttcgttatatcttttcatagccatttaaatgatccggaacaattcgtcgccggtttggctttatgtactcttggctcaatttgttcggcggaaatgtgtcgagatttggcaagcgaagttgagaagcttttattgaagtcgactaacacctacctcaagaaaaaggtaggaaatgtttggacatttcctctatttgctggtattgaggccgctctgtgtgcgtttcgtatcgtccgaaaggtccccgaccttattgaaatgtttatctccagcacacgctcattgctcaacgaaaaacaccacggtaaatgccacttttaccataggcttttgcatttttgagggtttaaaggtgtactaatggcgggcattacactcgtctcggaaatgtgcgatttgagtgccgatgtacgcattcacttcaaaaaggttctttattgatttaacaaccaaataaattcggttttacattttggatggtgcctaatttggtgcgcatactcaaaaacttgctgatgaatgagtattctgctgagcatgacgtcgctggtataagtgacccatttttgcaggtctttcttttcacatagatttcttacaattagctaattttgaatttaaggtcaaaattctcaggctattgaggattttgggcagagatgacccacgggtcagtgaagagatgaatgacattttggcacaggtggcgacgaatacggaaacgacgaaaaatgttggcaatgccattttatatgaaacagtattgactataatggaaacaaaaaggtgggcatgaaatagcaaggctaacagtacgtaaaaatgaccaaattcagtgaaagcggcttgcgagttttggccgtgaacattttgggtcgttttttgcttaacaccgacaaaaacattcgatatgttgcacttaacactctgctcaaaactgttgcaattgatttccaagcagtgcaaaggcatcgcaccactgtggtggaatgtctgaaggatgccgacatttccatcaaaaagtaa

SEQ ID NO: 56078 - DNA, 578 bp, Heterodera glycines
  Genomic contig location: Contig_ID=SeqID_4885; Location=3975..4552; Strand=-
  SCN-specific regions: Sequence locations=1-54,76-236,266-505,527-578
  Gene Ontology: Cellular component=integral to membrane; Biological process=mitochondrial translocation
atgatattcccagaaggatccgtatttttccagttggatccgtcaattttcaaggagagccaaccacaaatcatcatgcctgaaggttatgagtctggtcggggaaaatttgagttcgctctcggttacatcggttgttcggttatcggaggattcggagttggaagtgttcgtggaatgttcggcgagttaggaaatccacagaacagaactttggtttgtggactgattgtgagttattatataaaaatgaaaaaaataatttcaaggcttggaatccgtggtacactcggatgctgaatgccgccactaagcatggcagcggatacgcacaaactgctgggactgccatgtttctctattcggtcactgagttggggctgaagctgtcacgagccgatgacttgcttaattcttttatcgccggaccaatcgctggcggacttttccgcggattgcctcatgggctgcgtgctggcggtgttggtgcattggccggactgggtttggtcaccgtctggaatttgtgtgatcgagacagcagaagagagttgcgcgaaatcctccgattgtcttaa

SEQ ID NO: 56079 - DNA, 274 bp, Heterodera glycines
  Genomic contig location: Contig_ID=SeqID_25327; Location=1278..1551; Strand=+
  SCN-specific regions: Sequence locations=1-56,80-274
atgacaaaattcattcaaaaaggtaaaaaaataagtcaaatcagtattgagttaccttattttttaaattcaaaaatttgtccaaaaaaaatttaaggacgatttttgagaaaattttttatttcttaggagatttattttcagaaatttttgggtcgattcttaagggtgtatttttcgtttttattgcatttttttaataaattttcggcaaaacgccaaaataggcaaaaataggctctttcaaaattttttaggcttttaagctctaaaa

SEQ ID NO: 56080 - DNA, 1002 bp, Heterodera glycines
  Genomic contig location: Contig_ID=SeqID_25329; Location=1..1002; Strand=+
  SCN-specific regions: Sequence locations=1-1002
  Gene Ontology: Mol. function=protein binding; Cellular component=DNA -directed RNA polymerase II, core complex; Biological process =regulation of transcription, DNA-dependent
ccccggccgagactgagacaaccccggccgaaactgagacaactgcagccaagactgagacaacttcagccgtgactgatacaactccagccgagactgagacaactccggccgagactgaaacaactcctgccgagacagatacaactccagccgagactgagacaactccagccgagactgaaacaactcctgccgagactgatacaactccagccgagactgagacaactccagccgagactgagacaactccggccgagactgaaacaactcctgccgagactgatacaactccagccgagactgatacaacttcagccgagactgatacaactacagccgagaatgagacaactccggccgagactgaaacaactccagccgagactgatacaactccagccgagactgagacaactccggccgagactgaaacaactcctgccgagacagatacaactccagccgagactgagacaactccagccgagactgagacaactccggccgagactgatacaactccagccgagaatgagacaactccggccgagactgagacttctccagccgagactgagacaaccccgaccgtgactgagacaaccccggccgagactgagacaactgcagccaagactgagacttctccgtccgcgactgagacaactgcggccgagaccgagacagcttcagccgagactgatacaactccagccgagaccgagactactccggccgagaccgagacaactccagccgagaccgagagaactccagccaagaccgagacaactgcagctgaaactgatgcaacccgatccccgactgctccatcaaccagaggcggatattatcccggagctaggtcaacacattcatcttctgccccaactactccatcaaccaggggcggatattctcccggagctcggacaaccgattcatcttcagctccaactccgccaccaaccagaggcgattattatactgggacaa

SEQ ID NO: 56081 - DNA, 1141 bp, Heterodera glycines
  Genomic contig location: Contig_ID=SeqID_25332; Location=83..1223; Strand=-
  SCN-specific regions: Sequence locations=1-1141
ccattcgccttgcttggcaaattcatctgcaccgtccaattttccgacaaaccaccgcaaactctgatcgcctatgtgagcggagaagtcggacacaatttattgggattgccgtggatcgaagctttgaagatcattccccgccaaattttatttccgtccagcaaatcggctgatcaggcgacaatgattgaaaatttttcggcagtgaagccaccaaacaaatcgatcaatgatgtggcatcgcttacagcggcactccaaaatgatttcacggaagtttttgaagatggattgtgacactgtcaaaaaccaaggcgcatatcattctgcgatctgatgcaaagcctgtctttttccgcgcacgtcccattccacacggcgccatggaagctgtgaatgccgaattggaccgtcttcttcaaatcttcaaattggcgcaattaagccgatcgatttcagtcattgggccgcaccgatcttggccgtaaaaaagaaaaagggcaagtcgagagtctgcatcgacttctcgaccggcctcaacaatgcattggaattgaaccgccacccactgccaaggccggacgacatttacgcctcactgaatggcgcaaaatttttctctaatttggatttacgcgatgcgtatttgcaaatggaaatggatgaagaatccaagcaattgtgcgccatcaacacacatcgcggacttttccaatgccaacgcatgccgttcggagtcaaatcggcacaggcaatatttcagcatttgatggaacaaatttgtgctggcatccctggtgttttcgcgtatcttgacgatggattgatcgcaatgaaaaccctggagcaacacatcacggcactttacactctttttgggcgcataaaagagtacggtcttcgcatccaactcgacaaatgcaaatttttgcagcccgaacttttgttccttgggcatattgtgtcagcaaacggcattcgtcctgacccgtcgcgttcagacgcaattcggaaaatgcccgcaccgattgacaaaagcaccctccgatcgttcttgggggctttgaattattatggaagatttgtgaaatgcatgcgcgaactgcgtgcaccgctcgacaaactcctccaaaaggac

SEQ ID NO: 56082 - DNA, 825 bp, Heterodera glycines
  Genomic contig location: Contig_ID=SeqID_25333; Location=418..1242; Strand=+
  SCN-specific regions: Sequence locations=1-458,480-740,769-804
atggcacgtggaggaacagacgaaggcgggacagttgccggtctcctattttcacatcgtatacaaagcgatcaaaagacgagtccaaaagcaacagaaggaagagtccaagcaggtcggaatcatagtgttgaaattgaaaaaggggattttcttatagaatttggatggatcacttgaaaatgccatggcagcggacgaagaggaagacaacggcgacttttggcagcagcgacgcctcacaacggaggctgtcgaccgtcaaagtggcgacgagaaacaatcgcttcagaggacggcaactgggaagaattgaagcagaacgccagcgaaatgaccgcaattcggcaaaagagtggggaaaatcattttatttctatttcttgttcaacatttgtttatttcagatgctgaaaatgagtacgacattggcgggcttcagccgttcactttgtacgagttcaccttcgtggccttcaacgaggcgggcagcagtgaccctgtgacgatgaaacaggagacggtgaacgattgggtgccgccgccacgcgaagtgcaaaacgccgaacggcacaacgaaaatgttggcgtctcgtccagctcgacatcagtggccacttacatcagcgtcggttagtcgaccgttcattatttattttatcccaaaaatgatacaacataatttaaagcattgatttctccttcacaaagggaaagatagaagcgttcgtaaaagcgaaaagaattttaaaaatttaaaaaggttttcaaatatatgaaataatgaatagataatcttcgctcattaatttcattcaaaatcaa

SEQ ID NO: 56083 - DNA, 305 bp, Heterodera glycines
  misc_feature (289)..(290): n is a, c, g, or t
  Genomic contig location: Contig_ID=SeqID_25333; Location=1492..1796; Strand=+
  SCN-specific regions: Sequence locations=1-305
atttttcgtgctgtccagcttcgtcatcgccgctgcctattgctccatcgactcgggtgggaatgcctccccctcctccgccgatggcaaatgcattgcgacgcccacccccgtgccctgagactcaattaattctttttttttttgaatttcacattttttgcgttgctttacttatttatttttgttctttttggtgctcattcattccttttttgattttctttcgatttcaaacaaacaccataaatatctcttgaatctcctctctttcgcttgatcttttccnnaatttacgacgatca

SEQ ID NO: 56084 - DNA, 663 bp, Heterodera glycines
  Genomic contig location: Contig_ID=SeqID_25334; Location=33..695; Strand=-
  SCN-specific regions: Sequence locations=1-312,344-532,575-663
atgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtcgtgctctgaagggcgtgggaggggggggggcgaaggcccaccacgaggccgcgaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaagagggagatgaataaa

SEQ ID NO: 56085 - DNA, 262 bp, Heterodera glycines
  Genomic contig location: Contig_ID=SeqID_25334; Location=1143..1404; Strand=+
  SCN-specific regions: Sequence locations=1-262
aaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctataggga

SEQ ID NO: 56086 - DNA, 304 bp, Heterodera glycines; identical to SEQ ID NO: 51570
  Genomic contig location: Contig_ID=SeqID_25335; Location=73..376; Strand=+
  SCN-specific regions: Sequence locations=1-304

SEQ ID NO: 56087 - DNA, 2179 bp, Heterodera glycines
  Genomic contig location: Contig_ID=SeqID_4886; Location=221..2399; Strand=+
  SCN-specific regions: Sequence locations=1-211,235-247,269-717,741 -949,971-1226,1329-1552,1576-1720,1754-1836,1858-1897,1945-2144
atgggcaggttagttcgtacaaatcttttttttgcactttcaataaagctagtattttctctcaaaaaaaaaatcagaatcgattttcaagcctagaaaaaaagttttttaaattttttttgcttttttcaaaattttttcacttttttttcttcacttgtaaattcattctgtttttttttactgcattctaatgcaatttaaaatgaggtggtttttgtttgggttttttgtcaagaaaaaaattgaaaaatatttttaaatgagcaattagcagtttaactcagggttgcgatctcaaaattttgaaagtcctcaattcagagataaaaaatactcatttgccactaaaatacctgaaaaaaatcctcattttttaaagcataaaaaatgcaaataaaatcaattaagagtcatatttttcatttgaaacaatcaatgtcatcaatttcttgtcatttataagcattttacggaagtctgagcacgaaaaatcgaagttgcacttcactcgggccaacgctttcaccgtgcatccgttaaatttttcgcttttagatttgctcttttcgtggcgcggttttccaaaaaacttttcggaaacatcgggagggggggtccggcagtgccgataggcgctgccggaaaaaatttggaattttgagtgcgattgttaacaaattttgtcaaaaaaatgattttgactgaggatttttcgaaaaaatgtttaaaatttgaagaaaaagttcgaacattttgccaaatatacctaatttttaaaaaaatcatgcggttttgtcacttgtttaacaaaagaccacaaaaatcctcaaatttctcaaaaggtcacaaaaatatgcaaatcctcatttttcaaaaaaatcctctttgaccctctaaaagaccacaaaatgagtaaaaatactcagatatcgcatctctggtttaactcatttaacaaatgaatttcttgatgctaatacaaacatcagcagacatataaatcaggagatggagttccgaggcactaaaaattttcggaagtcggaactcggaattccgaggccccaaaaattttcggaagtcggaactcggaattccgaggccccaaaaattttcggaagtcggaactcggaattccgatgccccaaaaattttcggaagtcggaactccgacccaaaaaaggtcggaagtcggaactcggaatttttgaaaaattttacagaaattttaaaatatttcataagttaactttaaagttataaatcaaaattactaaatataaatgtatttatgtattaaaaaattaatattaaaaattaataatcaaattcaacaattgataaattggactgcaaaaaaatcaatttcctaacattgtctcccttaatccggtttcgcaaatccgtacaaatgagcccggctttagaaaacaatctttcgctttcaactgatccacaaggtgcgctcagaaattttgggcaacacgacaaagaagaggccattttccatgttcttctttcaacttccagtaatagaaaatacaaacagaaattaaaaacagaaattaaaaattctcaagaaaattaagtttttttgagtccggcggtgccgataggtgccgtcggaaaaaaattgaaaatttctatgcaatttattaacataaattgtacaaaaattgctaattttttgaaaaaaaaactcaaaaaaagaggcgagtttaattaaaaataaaaatttaattttatttttcaattgcaatttcattaattatccacgttttttaaaggttttgccagcacatcagcttattttgaagagcgcttgagtgaaaatttaaatttgtgattggcgtcgacccagcggggtgccgaaaagcaatttaaattaatggggaataataaaaaattaattagaaattatttcttatttataataaattacagcgttccaaatttatatttcttcacggatttgcaattcgtctcgttcccaaaatttgacacaacaaattctgatcaatttgcaaaaatgcctccgatttaagcaaatcgtccttttcgtcatttttccaacaagaaggtgcattggcgcctttggcgaaaaaacttaccttggaatacaaaaccaaaaaaaagcaaacaaaattttaaaaaaaaatttgttttaattaaaaaa

SEQ ID NO: 56088 - DNA, 1173 bp, Heterodera glycines
  Genomic contig location: Contig_ID=SeqID_4886; Location=3610..4782; Strand=-
  SCN-specific regions: Sequence locations=1-178,281-637,659-955,977 -1173
atggcctcttctttgtcgtgttgcccaaaatttctgagcgcaccttgtggatcagttgaaagcgaaagattgttttctaaagccgggctcatttgtacggatttgcgaaaccggattaagggagacaatgttaggaaattgatttttttgcagtccaatttatcaattgttgaatttgattattaatttttaatattaattttttaatacataaatacatttatatttagtaattttgatttataactttaaagttaacttatgaaatattttaaaatttctgtaaaatttttcaaaaattccgagttccgacttccgaccttttttgggtcggagttccgattccgaaaatttttggggcctcggaattccgagttccgacttccgaaaatttttggggcctcggaattccgagttccgacttccgaaaatttttagtgcctcggaactccatccatccctggtgggcacccgattgagcggcgccccacctactgttggccgccgtagtcgagtgtgcgctggcttttagcgcattattcactattcaaggctaaaaaatgtgactcgtcaagagctgtcgaatgataccaattttgtacggatttcatccttataaaaggttaggagagccccattttgttcattttttaattttgaatcggtttaaagttgaaacgagtaaaatttttgattttttagtattttgtacaagtgtttgatgtaaattaataaaaatacgaaaatttgaccaaattgaaggcatttttgcaaaccgatcaaaaaatgttatgcgaaattttggaacgtgacaaatttcaatttagaacacaggaatttgacaaacaaataacgggccaggccgtttcatacgggccgttttcgtacgagcacatgtttttggactataacttttttctttgtcaaccaaattcaatattcttggtgtcattcgagagcacttcagatgccaattagcctgcaaaattccaaaaaatttcgtttagtttaaaaaaagttcgagccaaaaaagttggaaaatctggttttttgaattcttctgatcataactttttttgaaccttaacgaaattattcgaaattttacaggctaatagaggacacttaaggctatcgaataaacaacagcgttggatttgattgataaataaa

SEQ ID NO: 56089 - DNA, 816 bp, Heterodera glycines
  Genomic contig location: Contig_ID=SeqID_25337; Location=1257..2072; Strand=-
  SCN-specific regions: Sequence locations=1-175,198-325,348-415,438 -505,528-781,803-816
atgaatgataaaatcgactggctcggccgcttcgcggcctcgcatccttttcttggctttttctccaatcgccgggactcaacccaccagctattccaatcactagggactcaattctcctgcatttcaatcactggcactcaactcaccagcatttcaatcactgggactcaacccaccagcattccaatcactgggactcaacccaccagcattcgaatgaccaggactgaacccaccagcatttcaatcattgggactcaattctcctgcatttcaataactggcactcaactcaccagcatttcaatcactgggactcaacccaccagcattccaatcactgggactcaattctcctgcatttcaatcactggcactcaacccaccaacatttcaatcactgtgactcaacccaccagcattccaatcactggggctcaattctcctgcatttcaatcactggcactcaacccaccaacatttcaatcactgtgattcaacccaccagcattccaatcactgggactcaattctcctgcattccaatcactgggactcaacccaccatcattccaatcactgggactcaacccaccagcatcgaacattttcctcgtcttttcttctttcttgtggcatttccttatggcacaacattcttggcattttcatcatctcttcttgtttcttgtggcatttccttatggcacaacattcttggcattttcatcatctcttcttgtggcatttccttatggcacaacatgacacacattagtgtctcacatgaaagtcacagaacaaaccactaa

SEQ ID NO: 56090 - DNA, 269 bp, Heterodera glycines
  Genomic contig location: Contig_ID=SeqID_25338; Location=1355..1623; Strand=-
  SCN-specific regions: Sequence locations=1-77,100-269
ctgaatccgatgactttgttgggaaacggatttcgcgggattggcaatggatttccaaaggcggatttgacaatttgcattttctttgtgccattttcttcgatgtccaattgcataataagcaatttgttgttcaatttccatttgcgtgtcttgaagtgttcgtccacgtaaaagtcaaagcggcggctaatcagtgcaattccaaggccaagctgagaaggcgcaagaaaatcgaacaccaaaagccaacaatcgccgcagacaaa

SEQ ID NO: 56091 - DNA, 782 bp, Heterodera glycines
  Genomic contig location: Contig_ID=SeqID_25339; Location=975..1756; Strand=+
  SCN-specific regions: Sequence locations=1-257,282-431,453-782
atgccgttaacaagacttccggtaaatggctcctgccccccgcccaccccccaacaaaaaaattgggacaagaagcatcgggaaaatcctaccgggatctcgctggaccacgaatgatatcaagattgttgggtttcgatcaacaattaaaaaaattatattggctcaaagttggctcagacaaagttagcccgttccgattccgaaattataaaacttaaaaattgagtgcctaagaatcggaaaaaaatttatgctatatatataaaaaaaaataataagtctaaataaatttccatgtatgtttcgtagattcgtcacagctgtcatcatatttctccccaaccatttaaacggacaagaaggaagttcctagtgtcacaaaattgccagcaaagaaacgacatgataaatagggattttttaagggtgaaaagtccaaaataaggccgtaaataagggcgaaaaattcgcgaaataagggcgaaaataaggtcgaaaaagtcaaatttagggtataatttttaaaattgctgttttttacatgaaataatttcagactaaggcaaacaattttattcactgattgcagttacaaataagctatattttagaaaaaaattttcatttcttagggtctatttttgaaaaatttagtgtcgattcataggggtatattttttcgaaatttttttgggtcgattcttaggggtatattttttcgaaatttttttgggtcgattcttaggggtgtatttttcgtttttattgcatttttgtta

SEQ ID NO: 56092 - DNA, 97 bp, Heterodera glycines
  Genomic contig location: Contig_ID=SeqID_25340; Location=38..134; Strand=-
  SCN-specific regions: Sequence locations=1-97
ttggatgggtccgtggcacggcacttcccttcccagcggtcgctgctcggcactttcctcgacccaattgcggacaaatttctcatcagcactttgt

SEQ ID NO: 56093 - DNA, 213 bp, Heterodera glycines
  Genomic contig location: Contig_ID=SeqID_25341; Location=42..254; Strand=+
  SCN-specific regions: Sequence locations=1-213
atgtctcctgttattgcccctttcgtcctcgccatcattggcatcatcgccttgcccaccatcgaaggcgcagtcgggcgtcagcaagtcaagctgggcgagcagtacaaatacgagaatgtgcccggcaaattgatggtcaagcgacaaactgcggccagcaaggagccccagtatttgttcgccggtcaaacggcatggaccacggacgga

SEQ ID NO: 56094 - DNA, 1667 bp, Heterodera glycines
  Genomic contig location: Contig_ID=SeqID_25345; Location=144..1810; Strand=-
  SCN-specific regions: Sequence locations=1-1578,1600-1667
atggcctatcgacggctaacgacaatgcttcaacggctgcagaagactcccgaggtgctcaagcagtacaccacagtgatcaccgatcagctcaatgcagcaataatcgaggaaacgacgatcggagctggtaaacacgaacacttcatccctcaccaagcagtgatcacgcccaaaaagttgcgggtcgtctacgatgcgagcgcacacacacgaggggcaccttccctcaacgactgcctactcagaggcccagtttggctgccggatctggccggcatgctcattcggttccgagcatgccgagtaccagtgatcgccgatgtcgagaaagcatttctcatggtcgggattgaagaggacgacagagatgtgtgcaaatttttgtgggtgcgcgacccatttcggccagtgacaacggacaatttggtaacataccgatttcgacgcctcgcatttgggctcacgccaagccccttttgtctcgccgccgttgtacgacaccacctgcgcaaatacgactccaacttcgcggaagaactcattcgggacacatacgtggataatgtgctcatcccggcggacactgcggaagaagcagccattaaaggacaagaagcgaaacgaatgtttgcggacgcgcggatgaaccttcgggaattcttgagcaatgacgagacactcaacagcagcttttcggacgcggaattcctcggcaagacgacggccaaagtcttgggactcgaatggaacgcggagacggacaaaatacgaatgaagtaccccgggagcgaacccgacactccgatcagcaccacacgcagaacggtgctgagcagcgtcgccagcctgttcgacccgctcggcttggtctgcccggcgaccctcaaggcgaagctgttcttccaaaagctgtgggacgacaaccacgaatgggacactcctttgtcccgggaggaagctcgagaatgggagcacattttggcaagttgggagggggaaagtaatgtgattcctcgaggcgtaactgcgggcaggggtcacccgcttcaactgcatgtgttcacggatgcatcggaaatcgcatatgcagcagcagcttacatacgaacgggaggagaaagcgggtgcaactcccgcctcatcatggccaaatcacgcctcaagccgaagaaagcggctaccacgttcacaataccaagaatggagctgatgggcattctgttgggggtcaggctggcagcattcatcgaaaagcaactccaccatccaatcgcggggcaacacatttggagcgactcaatgatcgctctccactgggtcagaacggcttcagcgcaaccacaattcgtggccaatcgactcttcgagatcagaaaagcgacagcaacgacgtttcactacattcgaactaacgaaaacccagcggatttggcaactcgaggggaagtgcccaccctcttacaacacaatgatcagtggtggaatggtcctcaatggttgcgcgggccgagaaccgaatggccaagcgaattggagtttcagcctgatcaagagggcctaccctctccggcggggcaggaagaaggacaatcagcattcattgtccgaaatgaagcatccacaggcctcgagagtgaacaattcccgagttcgttgcttacgag

SEQ ID NO: 56095 - DNA, 1044 bp, Heterodera glycines
  Genomic contig location: Contig_ID=SeqID_25346; Location=95..1138; Strand=+
  SCN-specific regions: Sequence locations=1-40,63-119,142-982,1005-1044
atgttggatttggcacgcccaaccgaggagaacgccgatcagaagaagccaaaagatagtccgacatacagagaccgaatcaaaagaaattttgatcggggaactcgagaacgaacttttgaaattggccaaaaagtttttataaggaattatcgtgatgggcctaaatggtttcgcggtctgatcatcacgaaaaacggggtgatttatttcgttcggactatgagaggtgtttggaagcggcacgctgatcagcttaaaccggggatttgacggtcgaagatcatcaggagaacgaatccgtggacagcgactcgaatgtcggtgatcaataacaggagactgaagatgaacagaatgatggcccagctcctcccgaacttcgacgatcacagcggaccaagaagaaaccgagatcttggatccaagcagctgatccttgataaggagggagggatgtgatgtatccatccccttattatttatcttcatttatcgattaacaagataattcgtgggttatgtttagggatattaaaaaggcatgttctcaaaaacattgaaatttaaccaattccaaaaatcgcccgaaatgtcaaaaacgggaacggacttttcggtttttagttaatacgaaaatttttttaaaaagtctcgggattttcggtctcgagtctagagaatagcctagatcagtttgagaatttttttcattaaagagattatttatatatctaattcaggtattgaaactaccaataactttctgattcataagtccgagtaatttgtttagaaattgattcgatcatggaatctaatcatggataaatttgaaaaaaaacctgcttaaggtaccgggtttttgattatgttaatcaggactgttgcatgaattttaaaaattcaaacacttgtcctgactgtcctttgtttttttaaataccaatctccggtcaaaatcactaggccaaatcaaattccaaattgttaactttttgttccactaaatatttgttcgcaaatttccccccccccccccaa

SEQ ID NO: 56096 - DNA, 454 bp, Heterodera glycines
  Genomic contig location: Contig_ID=SeqID_25347; Location=482..935; Strand=+
  SCN-specific regions: Sequence locations=1-49,78-454
atgaaggggttagaacttttaatctttttatttacaaagtccataagagaattaatttaaaaacttatttaatttatgttttccagtgactttaactttggggaagccgtcaaaaatttccaactgttggacgaaggaatttattgatcgggcacttttgcatatttttgcattaacggtcaatggaaaagtcgtaattcggatacacttatggtgtcggtgatgttgtcgctgcggtgttaatttggccactcgacagataatttccaaaaaatggacattgtttgggtatttaaaattttttgtcgaaacattttgttttccgatcatttatttgtttattttctttgcattttttgcatgaatttgtttataaaatatatttattcgttgctgcatcttatcccccacagaggcgtcaaaaaacaatagaatactaatatttggttgtgaa

SEQ ID NO: 56097 - DNA, 925 bp, Heterodera glycines
  Genomic contig location: Contig_ID=SeqID_4887; Location=3119..4043; Strand=-
  SCN-specific regions: Sequence locations=1-313,340-925
atggtggcggcggaggagttggaggacgtcaaagaagaagtgatcggacgactgctgaagcttttgcccaaagttttggaaggactgaagccaaagcctgccgaactatcgacggaagtcgaccgacgcattcaggcacttgacgtagtggaagagcaactgaatgtggtcaaaagagctcgagcgaccgacgaaatggtgacgggggcaatggccaaagtgatggcacagctgagaaatgcgtcacgaggaatgggaacaatggacatgagcacactgaggtgggcaatcttaattaattaggctaagggactaattggggggataaagggattaaaaacaaagagttggtaattaaatggatggatggttatttcagttctcttcaatcgaattgggacaatctgatgagaaaggacacccattggcaaattcggaaggcaattaacagcctggggggatgcccgaaagacccgcagggcaacacgctaatgaagcaatgcatggaggaagcgatcaccaaagtggaccgatacattgacgacgtgaacgactggttcaaatcccagcgaccaatcgacatggacgactggaagtggctggtcagtgcaaaattggcatttgatccaacccaacgttggcattttcaaaacaattttaggctgctgagattcaaatgataattcgttggaagagcccttgaggcggcagagaaggagaagaagacggactgttctgatctgattttgggattgattgagtttcttagaggagaaaacacaccaaagaacaaaaagattcaaatgtttcaaatacagaaaattgtaaaaaaatgaagcaaatttagagcaattaaacataaatattaatgcacagttgaacaaagtgattaattaactaataattggttgtctattctaataaa

SEQ ID NO: 56098 - DNA, 519 bp, Heterodera glycines
  Genomic contig location: Contig_ID=SeqID_4888; Location=21..539; Strand=-
  SCN-specific regions: Sequence locations=1-33,57-519
atgccagccagagaaagagtgttggcaccgagtaaactgatggaactgatggaaaagctgggcaatgtgctggttacggacccaaaaatgcgccaaaagatcgacaaatacgacaaaaaaagagcggatgaggcggcgcgaagggcggcgatgatgccaccaaggcaagacccacaagcgattgcaaaacgcaggacgtggccgaaggaggacggattggcattagaaaggggccatttgcctcaaggcaacaaccagaggtaattaattatcagaaggggtaattagaggacattccaaagaggcaatcaaatttgagctgactgatcaatttgtacattttcccagtccgacgcgactccagtcgacgcccaggatttggattcaagaagatgaccggtggcgccaaccgatgactttctcccgaaaagacgtgcgggaaagaagttggctcgagtcggacaccgactcggacttggacagcccacttccgtgttgcgctcgcggcgaaggagtcga

SEQ ID NO: 56099 - DNA, 648 bp, Heterodera glycines
  Genomic contig location: Contig_ID=SeqID_4888; Location=1069..1716; Strand=-
  SCN-specific regions: Sequence locations=1-122,145-378,408-469,492-648
atgagggccacgagggagaaaaccgcggcgttttcacgatggccagtttcaggaatctctggccccatggggctgcaaggcccacccggacttcaaggccaaatcggaaattcgggcagcacgggccctccaggccctccaggtaaacaaaaaccaggaatttttgcatttgagcgctttttatgcgctcccacggagtattgtctgtgctcggaacgtttcaatggacttccgccggacgaaggaccgccggaaaccgccggtggccgaaacgccagagacggcaattggccaaagtgcgtatagaaaattggcacatgccacggcactgcgacgcacgcgacaccattagcattgagaaaagaacggacgaattgcaatttattattatttattagttaattaatgataaagacggaagaggataatttgccaaaagatgtcatcattaaaaaagagcgaaatttgttttaatttttaattaaacaattttggcgcgtcttcgtttggctgtgcgttggcaaatgaaatgccgtgcctttcgctttacttccgcgcgcccctcccatggcttttcctgccaaaatccacgtaaaccaacaaaaaattgttggcttaatgatgcatataatgaatgaaagcaataaa

SEQ ID NO: 56100 - DNA, 740 bp, Heterodera glycines
  Genomic contig location: Contig_ID=SeqID_25348; Location=75..814; Strand=+
  SCN-specific regions: Sequence locations=1-253,276-650,672-740
atgttcccaaagcgatggtaagtgaaagaaacaaccattttcgctttgattgaacactgttttcatgccctccccccctcccaattttgccgcggttcgacctcgtcattgtcctccgttgtgccaccgaatcgctgttcgatcggctgaccgaacggggctattcggagaggaaaagacgcgagaatttgtaggccgaaattttcggcatcatcgcagaggaggcaaagtgggcacatatatatcgatctgatgtttcattttaattccaattgttaagtcctttttttccgattttttagccatcgcgctgaacgcaaaatgggcaaggatcgactcgataacgccgcgccgggtatctcctgacaatttaatgatatttctggctttacctaccatttcggattatctttcattttgaagcctaatcacttccgtatcacttgggtggccatcgtacacaaactgtcaagcatttaagccattaccaacctttgcattcaactttataccatggaaaactttgacgaaaaacattgaatgaggcatttgttgtcacttaaatcggctctgtttgccgttttaaaatcctgtctgatttttctgtgccgtattccggtcaatttggcatttttgcaaatcaaaatgtaccccatagttttgtttaattttctcttctcagttccctccatccatcaatgaaaatctgtgtccgtatcagggatgggccaaattgaaaa

SEQ ID NO: 56101 - DNA, 547 bp, Heterodera glycines
  Genomic contig location: Contig_ID=SeqID_25349; Location=912..1458; Strand=-
  SCN-specific regions: Sequence locations=1-547
  Gene Ontology: Mol. function=tyrosine 3-monooxygenase activity; Biological process=serotonin biosynthesis from tryptophan
cacgcggtggagggaaattcggcgattttgcgcttcgacccggacagagtggtgcagcaggagtgtctgatcaccaccttccagaccgcctacttcttcacgcgaaactttgaagaagctcagcaaaagcttcggtgcttttccaataaattctcaaaataaaagtgccaatttctatttggcactttccgtccttttcagcacattcacttccaatatgaaccgccccttcgttgtccgctacaatccgtacacagaatcagtggaagtgctgaacaacaaacgttctctgatgttggccgtcaattcagtaattcgtttcattaatgcaaacagagaccaaactgaattttgtgtcagagtaacaaataaatgcgaaattcgactttgttcgaatcgcatccggggacatcgaaaacatgctttcaagtcaaaaaatggtggtcgggagatggacaaacaaagggttatggctacataattttcaaattttcagcttcgttcggatatcaatctgttggctgcttcccttcacaacatcctttga

SEQ ID NO: 56102 - DNA, 1170 bp, Heterodera glycines
  Genomic contig location: Contig_ID=SeqID_25353; Location=12..1181; Strand=-
  SCN-specific regions: Sequence locations=1-115,167-216,238-416,440 -526,549-612,634-1003,1025-1170
atggaagtgcccgatgttgaagcagcagcgtttaaagtgatgctcagcttcatttacgcggacgatttgagcgaattgaacggagaaaacgcaatggcagtgctttacgcgggtgaaaataattttaatttatatgcaattaagtcaatttttaatttaatttaatcttttgcgacccgctctcatttatgaaaataattacaaatcacttacgctttttgtttttaatatttcccagaaattttatgattgtttagctgataagtacggcatcgatggattggtcagtcattgtctgcaaattccaattcaaaatctgcccaatgttttcttggcccatgcccatgctcgtcttttcaatttggaggtggaacaccctttttttaattaagtgtccattttaatgtatattttccaaaaaaaattaatttttataatacctatataggattttgctcaccaatatttgcgttacatttgtcaaaatgcgggcgaattgttcgaatcagaggaatttttgcaaattgaccaggattttctttgtgaattattcgtacgtgatcagttggtgatcagcgatgaatttgaaatttggcaagctgtaatttgtaatttaattttattgtattaaattgatctttgtttttccgtttaggcactccgttgggccgacgaaaaatgccgtaaaaatgccatcgaatgttccgctgaaaatcgtcgtgaagctcttggcccggcactgttcaaaattcgtttccctcttattcatacaagtgagattgccagatgtaaattggagctgcgaatgttcggcaacccttcgaattgtttcgcaaaatctcggaacggaggatttgacgacaaaatgtgaccatgtttttaataaggaatcggacagctggggatttcctcatttcattacttttacagtgagtggctttaaaacaacttttattcgcttaataattgtaaaattaagaaattgatggacccggacaaaggattttatgaaaaagagggggacaaagtgacattggccattgattttacggttgaagaaaaaagggacaaagcgcaaattggtcgataaataagcccattcaatcactatttctgttgatttggtctttttgaaatttatacaaaaaaattcggaagcattttaataaa

SEQ ID NO: 56103 - DNA, 1717 bp, Heterodera glycines
  Genomic contig location: Contig_ID=SeqID_4890; Location=977..2693; Strand=+
  SCN-specific regions: Sequence locations=1-107,132-228,265-359,381 -953,975-976,999-1418,1449-1578,1603-1672,1694-1717
atggcaccacgacgcaagagaaaggcggctcaattggtcgggcaggacgaagcggtggtgagcggaccgagcgcacaggtgaattgtgttcaccatcaaattttcacatttaaatttcatatgctttttatttcacagttgccaacgaatgacggacaacaattggcatcagcagcaccagtgacaaacaatggcaccgtccaacaagcggaaaacgacggaactgacgcggtggcggcagcagcagcagcaattgatggcaccggcggacaagtacaatttttgtcttttcgttagctaagggggggggggcttttggtttacaaaattcaccggatggtatatgaaaaaaaaaaacttgttaatttggaaaaaatttgggtcagtgttgcttaataaattctcattatatttaaatcttttcagcaattggcggcaaacaacaatggcggacaacacgcggaagcagcagtaatcgatggcactgggatgcccaacggacaacaaattgaggcggcagcggatgaaaatgacgacacaattgggcaagcggtaatttttcacaagcttttccaaaaaaattattcctttaatttgaaggggaacaaattgttgcggcgggcggtggccaatcaatgcatttcatcgtccggctcgcgcagcacagtctcgcgcacggcgtcgcccgcactttcttcgacttcgtccaatgcctcccgaagacagaggaagaattacaacaaaagtggacgcgtaccggtaagaaaaaatttgcaaattcaagccaaacacacacacacacacattcacttcctagataaatgtgaatgccgattgccccaatgttccgcccggtgtactgccgaacccaaaaactcgccagtaccaggtcaagagcgttttggcgcaattcactcatgcatcggggaggaaatgctatttcttggagtggctcggtgagtttgatgatgaaattgaaagaaaaaatgtgtgaatgaaaaggtggacggatggataaggaaattgaaaatttattgtaaaattccaaacgtgtgccgagttaacctggtttagcttcgccacttttggaacggaataatttgagggtgtgggccgagttaacacagtttagcttcgctacctctcttgctatttcactttaaattttctttttctttttccattaaccaatccattttcttctctcatttttttctcgcaattataggctttcgcggtcgcaactcatggtgtttgtcggaggacaccgactgtacagagtacattgaaagatttgggacagtggcaacagtcgacgcggtactctctgcgctattgggtgaaagcgtcccagcttcgatagctgatgagctccaggccaatcctaaatttggacaaggtgtggagagtgaggggaattaaaaattgcataattttttgtcagtgttggcaaagttggatgacattgaagatgaattcatattgaggacaactcagtataatattttgttcgcaaaagggcttatggaaagccccgagggcaaaaccataattgaggatgtaagcacacaaatgcacttttttaatttaaattatatatttcctaaggcgaagagtaaactgggacgcttcgtggcaaaatgtatgagctgatgagtgaactggccggccgaattgaacattttcaccatttaaatttcaccatttaatttcacca

SEQ ID NO: 56104 - DNA, 406 bp, Heterodera glycines
  Genomic contig location: Contig_ID=SeqID_4890; Location=3620..4025; Strand=-
  SCN-specific regions: Sequence locations=1-16,50-235,258-406
atgaaaagacgcgttgctcctcttactactgctgctgctgtttctgctgagcaacataaaataattggtcccgagtcgcccaagccacatgaagagacgcccaaaaatgttgagccgaaggatgagttggcaacgaagaaacgcaaagtggacgaccgagagttgtggaaattggcaaaaggcaaatttttgctgaccacctatttgtgccatggtaatatttactaacaatttcattaaattttaattaaaattttgagatgattggaatcgtctgtacaacaaccagcagaaagtgaagcgcctggagggggaccgttttgccttcggctttgagatgtgtgaggaatgcgtgtgggccaactgccgcgcaaccgaccttttggcgccaatgaagaaaaagtga

SEQ ID NO: 56105 - DNA, 779 bp, Heterodera glycines
  Genomic contig location: Contig_ID=SeqID_4890; Location=4195..4973; Strand=+
  SCN-specific regions: Sequence locations=1-388,410-711,733-779
atggttcttgtaagcacattttgcgctcagcttctcaactgccctgtcaagtcattgcgcgaccggctcaaccacccagaggatcgggcgcttgtgctgaaacacatcattggacgcaaagcgcgcaccacctacaacgaccgtaatgggatgaccaaaactttcttcgtcactggaatttcggcacaaggcgccgcatttcttcctgcatatgggcaattgcgcaacccgttcaacatcaatgtggcggcacatttttatacacggcaccgcataaagcttcacttcccgtatgcaccgtgcataattgaacgcttttcggggggaggggaggatcggcactacccaatggaacttcttgagctgattgatgacaacatggacatggacatcaacaacaacaacgagcattggctgggccgtcttttcactgaaattgacgacaaacaatcgtcgtcaaactcatccgacacaacaatgcgcctagtatttgagggagacatggatgaagacagcggacgcaatgaatgctcacagagtactgtaccgttatattagttttgtttttgctcactaattatgcatttttcttccttaaaatgaccacttccatctattaatttgaaattgcattttccattccttaatttttcaaaaattgtgtcttctttagcttaattatgcacttttttacctaaaaatgacatcttctaatgcttaattatttcataattgcatcttccattcattaataatgcacaaatttttattaaaaacta

SEQ ID NO: 56106 - DNA, 1384 bp, Heterodera glycines
  Genomic contig location: Contig_ID=SeqID_4890; Location=5338..6721; Strand=-
  SCN-specific regions: Sequence locations=1-733,762-1285,1307-1384
atgggagggcgaactggaccactgaagctgctgcgcaaggctggaccgggagagaaaatctcctattatgacttcacatcgctctacccgtacataaagtgagcacagttaaagttgtaacaaattaacattgtttccttcacagcttcacaacccgttaccccatcggacagccaaacgtgcatgtgttgaaccaggaagtggattggcgcagtgcagcggacaacccctaccctttggcactgctcaaagtgtgggttgtgccgccccgacgcgtcgacgtccccgttctgccagtgaaagttggagagcggctttgcttccccctgtgcatcacttgcgccaaagagcacccgacaggaggagtgcacaacgactaccactgcgagcacaatgacagacagcgggggtgggtgagcacgtgcacctcgattgagctcaacgaggcgttggacgagggttacctcgtcacaaaggtcttccgtgtcctcgagtatgagcaaagtgacgacaagctcttccgcccgtacattgctgagtttatggcccagaagatccaggccagtggatttgacaacagcatcagaggcgatgcggagaaggaacaacagtttgtccgagagtgcgcagagcagttcgacatcaccatcgacccaaccaaaatggcggtcaacaaagggaagcggtccctggccaagttgtgtttgaacaacttatgtgagtactgtcgtccattattattatatatttttaaaaaattagggggtcgattttcgcttcgcaactttgggctcgctcaaacactcatcactgacgacccagcgactttggcggagtacctggacaacaaatccatcgaagtgacatcaatcgacgagttggatgagcagcacatactcatcacctatctgcagaagaaggactgggtggatgagcactcatgctcaaacattggtgagacacacacactcacaataaattgttaaagtacttcagtcatctctctatggaccacctcagcagcgcgcctcgttctgctcaaggcaatgcagaaggtggtcagatcaccgggctcggatctgttgtacactggtaagtcaaactacaaaaaaaaaaattttgtgcacaaacatttattttagacactgacagcctcatcctcgtccacccggaggagcggtgcccgctgaaaactggcccccacttgggccagttcaccgacgaataccccgaccacgacattgtggaattttgcagtggcggagcaaaacaagtgcattttcagttcatttttgtttacttttcaattttaccaccttttagtacggtctttgtctgcgacgcaagggcgcggagacgggagcccaattggaacatgtgctaa

SEQ ID NO: 56107 - DNA, 1898 bp, Heterodera glycines
  Genomic contig location: Contig_ID=SeqID_25358; Location=95..1992; Strand=+
  SCN-specific regions: Sequence locations=1-1898
atgcaaaaacctattccttcaaatcgccccaattcttctgtctccaaaacccttgcctgcgggcttgaaaaaatggtgaatgcgagtggaaatgagccactcacggtgccggtgctggcggatcggagtgatccgctgggactcaagtcggtccaacccgacacggtgccaatggaaagtgccgagggcaccaaggaagtggaaataatggaagtggatgaaatgagtggagaaaaagggaaaaaggatgaaatgggtaaagaaaaggtgaaaagtggtggaatggaagaggaagaagaaagtgaaggcagtgaaagtgaactgctaggagaaggtggatttgacaatttgaaattgaaccccagcctgagggcgggaaataaagcagttgaaaaggaagataaggggaaaccctatctggtcgcccaagtgagaagcgacggtgtgatcgcggcacggatgaaacttttctgggatttcccggaattggtctttgtcccttttagcctcttcgacaacgcccagccgatcgaaatcggcgatttgttccgcttacataagtgtgagtggacgaagagcgaaacaggatgggaagagcgcggagattggctgtatgaagcaaccggacggctgaactaccaagccacggcaacggacgtgagccaattgcgccagcgcatccccactcaggccgtcggcattttggtcgatgtgcaaagagcccgtgaccgacacgtcaaagtggccatggtgtcagcacctgagctgagctgcgtgatgcgcgcctaccgtcgccacttcccggccgatttcacggataacgacatccgctaccgctccgttgttcgtcttcaacttcggcagatcaacagtccgccatgggtgctgtattcacagcagtttgcgtatgttttgccatctgattttggtaaaaaaaggggcgatgaactgctcgttcatcacgcaaacgtcattgctggcgttgagcctgagccaatgggctatgagttccctttcagtgccgaactgagctgggcgaaggtccagctgggtgagaaggtcatggcggcggctgtcgcagcacaggcattcgatgtgaaggctgatctgcggaagcacactctgttcgtcgagccggtcgtcatcaatgagatctcgacaagaagcgtgatcatccagttcgtcatgccggtgccgagcatcgaagagctgacggaattgtgcaaaatttgggaggtcgatttggcggtgggttgcaaagtcaatccggcagccaaggcaaagccttgtgcgcatgggtatgtgctaagcatcgaaaagcgggcattctgtgtaggatacgaaattgatgttaaagtgatcctttcctaccaagaagcgaaggatcaggacgcgcaggaggaattcgatcagatgcgctgcggcgaactcgacggatgcgttgaactcattccgcagacgtcagtcagggccctgcaggaacggatgttcacgctgcggtccaatgactgctcgaaagtggcgaaggacgaggcaaaggtgggccgaatcatgtcgattttattgggccgaccggtaaaaccggaaagcccaaaggccaataacccattaatgacttttggggctctttcaaaattgaaagagggacagatcgacaccgcgctgtgcatgctcgacgaggtgccgcgccttgtcttccaacaggccgggcccggcaccggcaagacgttcagcgcggcgtcgatcgtggccacggtcctggccacggatcccacggctcgcgtgttggcgctggccccgccgaatgtcgccgtcgtcaagctggtgctagagatgcaggatgccctggccgccggaaaccacgtagagccgaatgcttgccttgttctccgggacag

SEQ ID NO: 56108 - DNA, 85 bp, Heterodera glycines
  Genomic contig location: Contig_ID=SeqID_25361; Location=641..725; Strand=+
  SCN-specific regions: Sequence locations=1-85
caaaagtcatttggcgaaatatttggagaaaaatggcaagaaaaggaagaagaaaaacgaaatgaactcaaaaaaagagaaataa

SEQ ID NO: 56109 - DNA, 1143 bp, Heterodera glycines
  misc_feature (98)..(98): n is a, c, g, or t
  Genomic contig location: Contig_ID=SeqID_25363; Location=660..1802; Strand=-
  SCN-specific regions: Sequence locations=1-46,68-763,791-817,841 -891,941-1044,1075-1143
atgtcaagaaatatgaaagaaatttgtgatcaaaatcgatttttcaatgaaaaacagaagagagaaattgttgaaaaatttcataaaattaaagaganaattatgcaaatgggaaagaaatattcaagaaaagaatggaaaaaaattgaaagaaaaattgcaaaaaaattgggtgttagttacgagaaaatttacaaattgaaaagagaatttggaatgatgaagaaaaaaaatcattcaattgaagaaaaaagaataatgttaaagcaatttgatcaaatatatgcaaaattaaaaatgaaattcaatgaaaaatgggagggaaaaagagaaaaatgcaaaaaaataatagcaaaacatttgggcataaatatcagaagcatttatcaatggaagaaacaattaaaaaatggaaaattgattaaaaatcaaaataaagatgagcaaaaaagagaaattgttgaaaaatatttaaaagtaaaaaatgaatttatgcaaaatggaaaacattcattgaaggaatgggaagaatttagagcagaaattaaacaaatttttggtgtgggttattcaacgattaaaagatgggcaaaaaaattaaaaatcaatcaaaatgtttcaaaaggtgaatttaaagatttattaacgtatttttttcaatttacagagcgaaaaatgttatcaattgctgaaaaaatggaaaagattaaacaatattatcaaatcaaagaacaaaatccaaaattgaaagaagatgaaattgccaaaattttaaacattccaaaaaactcattacgcaaatacaaaaccaaatttggcattaaaccaaaaaacaaattgctataattaggacgatcattattatcgaagaatatttggaaaatttcagacataaaaaatattcaattttttacaaatgtttttataaataattttttttcggtttatgaaattattaatccttatttcatcgcttataaaaaatatttgataaaaatcgttgattatgctaataacatttttaattggtttagttgaaaaaccaaattaatttttcatatttatttttattttgaaaaatgagtaaatatggccaaaaaaagtaaatttttagagaaaaattaattaattaaattcaataaa

SEQ ID NO: 56110 - DNA, 74 bp, Heterodera glycines
  Genomic contig location: Contig_ID=SeqID_25365; Location=231..304; Strand=-
  SCN-specific regions: Sequence locations=1-74
gccgagctcagcccaaagttccaatcttacgacgaagccatcaaatggcgaatgatgggcgtaaaccacgtccg

SEQ ID NO: 56111 - DNA, 610 bp, Heterodera glycines
  Genomic contig location: Contig_ID=SeqID_25366; Location=11..620; Strand=-
  SCN-specific regions: Sequence locations=1-9,51-77,99-246,268-610
atgaaaatctataaattgaattttgtaatatttttaattattaatttattcgacgaaactttatcagttgacgataatttgtgcaaaaagaatgaaaaaattcggccaagttttgccgaaatatttggccaaaaatgggaaaatgaaaaaatggaagcaaatgaaactgatcaaagtgatcaaaattcgaattggcaaaatgaaaatgaattaaattctgctgtttccattgaaagtaatcagaacaacaaccaattgaatgaccaacaaaaaatcgaaattgttcataaatttcacgcaacaaaagaaggaattaagaaaacggggaaatattctcacaaaatttggaatagaattgagcaaaaaattgcgaaaaaattgggaattggccgaacaaaaatttacaaatggaaaaaagaattaggaataaaaataaaaaatgaccaaaattattatgaaatgaaaagaaaggaatttattcaaagaattgatgagtttaaaagaatgtcagcagtaaatggaaaacagaagcaatttgcgaaagagttgggcattgacagaaaaacattaagcaaatggaaaaagaaatttggcattgaaatgagaaaaa

SEQ ID NO: 56112 - DNA, 635 bp, Heterodera glycines
  Genomic contig location: Contig_ID=SeqID_25367; Location=478..1112; Strand=+
  SCN-specific regions: Sequence locations=1-81,141-287,309-341,397 -508,534-635
atgtcttttaaacgcgtgaactccttccaacccgccgtgccaatggccaaaaaatgggatttccgatcaatcgggtaagtgatttttaataaattaaataaaaaaaataatttcttaaacaattataaatacaattataagataataccctttaagaattatttcaaaaaatttttttttgttcagaaataattttgctgaagaaatggaaaattataaattgatggattaccaatcgacaacttgcgaaaaaaagtcacgtgcagatttcagaaataatggaagagaaataaaaacccatcaatcaattttggttgacaggtgacctacttttgaaaaagttttttaaattatttattcattttcaatttttatttttaaataatcaattttattgtgcaattcaataattattcatggcattgtttgctgctaatatcaattaattcacacttcttccaaattccgttatcgattttttttttcgcggcggcggcatcgcgtcgccggacgggcggggagggaggggggaagaggtgataaaaaccgcacggttttggctaattttcaaaaagaatttttaatttcaggatccgaaaaacccatcataaaaaaaaatctcaggatttgagaaa

SEQ ID NO: 56113 - DNA, 1127 bp, Heterodera glycines
  Genomic contig location: Contig_ID=SeqID_25368; Location=985..2111; Strand=-
  SCN-specific regions: Sequence locations=1-239,262-995,1018-1127
ccccccccccccgtttccactcgcattgtcccccccccccctaaaaaagtttttttttaccagttttcaccgttttcaagataggaagaatttactaagattttttcgtgaatattttaatttccgggggaaacgacgggggaaaaagaagtgcatctcctcgagcctgtacccggtacttgtatacataaccttaataaatttggaaattaagcacttaattgaacgattagaggaatgcccatttctgaggattttgctgccatggagtgaacggactatctgttctgataaaaggccatccggttattcctagaagacattttccataaactattcacttctttagaatccgatgatggaccaatttattggtgtcgtcctggtgagcaactgatccgaacggacgaatcgaaattcgacgaaataaagtcaaaacagcacaggaggggaagtgctggcactaaacaaactaaaagtgccggaattccgttgaagtggtcatctttttaatttgcccaataatttttcttttttagggcgttggagcggagggaaattctctttgaagatcgcactccttgccatgccgaccatgtgacagacgaaaacaaagcacacacaactgcagcagttggccttctgcaggcagtcagaagccccacggaaaaagggtaagcagcttcaaaccgaactaaaattacaccgaaattaaacagcaaaatcggcgaccgattagtgaaagatgtgatttgcttccatgctgcagacttcaaaagggtgacagatattttgaagttggatttgtatgagccgccaatgtcccaggtttgcaacacttacgattattaattataaaagccattttagtgcacccaatgggttgaggaggccaaattaaacactttacgccgtgagggaatacgttatgcgagatttatggttttgccaacaattttttattgccatattcaatcacaatttttaagctacgtgaaaacagtgtttacttcatgccacgcaaaatcattcaccaattccgaactatttccgcttgtggttccgtcgcatggcatgtgagactgagaaagtattacgaggacgaatgaacatgcggagaatcttgt

SEQ ID NO: 56114 - DNA, 303 bp, Heterodera glycines
  Genomic contig location: Contig_ID=SeqID_25369; Location=648..950; Strand=+
  SCN-specific regions: Sequence locations=1-7,40-90,145-147,204 -261,295-303
aataaagtaatttaaataggcatattttaaaaaagcctatttttttgccttttcacaagagaatttattaaaaaaaggcaaaattcgccttaaattaataaggtgaaagtttgaaaatgtttattaaaaaatttcaggatgaaatacaattaaaataatcaaaaagaaaaaaaataaatttatttttctaaataaataaaaaacattgtcagaggcagtgcctgccgaaaaaaaagacaaaaaattttttgaaaaaaagccaaaaaaaaattgaaaatttaaataaatttaaaagtgaaaaaa

SEQ ID NO: 56115 - DNA, 549 bp, Heterodera glycines
  Genomic contig location: Contig_ID=SeqID_25371; Location=11..559; Strand=-
  SCN-specific regions: Sequence locations=1-59,81-159,181-500,523-549
  Gene Ontology: Mol. function=RNA polymerase III transcription factor activity; Cellular component=transcription factor TFIIIB complex; Biological process=transcription initiation from Pol II promoter
atgttttttccaataatcaaaaattgcgttgctgttgtagacaccaaaacacccctcgatattgaaaaaatttatttaatatcgccctccacaaaatataatccacgtaaaattcatgctgtaattatgaaagtgtataatccaaatgctaccgccataattttctcaactggaaaattcgtatgtacaggggcaactaatgagaaagaatgtaggcaagctgctgagcaggtcacggagcgaataaagcaatgtgggtataacgaggctcgagtccacgaatttgcggtaaagaatttgattgcgacagctgatgcgggatttcacatacacctcgggccgctctatgattttgtaggagccaaatgttgctcctttactcctgaattattcccaggcctggtctacagaaaccaaaaccccaaaatgtcgatcattgtattttcaagtggtaaattaaacctaacaggctctagatcaaaagaagaaattgattttgcatttaatcaattttatcaaattatatcaaatttcaaatattcaccataa

SEQ ID NO: 56116 - DNA, 397 bp, Heterodera glycines
  Genomic contig location: Contig_ID=SeqID_25372; Location=372..768; Strand=+
  SCN-specific regions: Sequence locations=1-397
atggaagaagtgaacagcgtgtatcagcattattcccatcaaaatttaagtgatgccactgggcttttcccattgaaatttccaacgcaccgacggaacaaaaacgaaggcacaattgagatggaaattgaaaaagtgtctgaatttgcggtggaggaggtgggaagtcgccgatttagcgatgccatggacattgggggatttccatggaaaataatggcacaaatcgaaacgaaatacggaagcaatgagaaatggttggactttaccctttccaacgatggccttgaaaatggtaaaaaaaagtctttttcataaatctgtccgaatttaaattcaccaaaactaaatatgtataataaacgattatgcagacaaattagacaaagtgtaaaca

SEQ ID NO: 56117 - DNA, 525 bp, Heterodera glycines
  misc_feature (364)..(364): n is a, c, g, or t
  Genomic contig location: Contig_ID=SeqID_25372; Location=1585..2109; Strand=+
  SCN-specific regions: Sequence locations=1-25,47-281,304-525
atgatttttaacaatgaagcgaagtcttgggggaacaatttcatttcatttgcggtgagtggaaattaattagttaatttacattttaatattgtaatggcaaattaaggaattaatggacccaagcaaagggttgtacaacaaagacgaggacaacgtcaccttggcaattgattttacatgtgaatagcgtaaacatttcgagaaggattgaaaagggaaaggaaggaaatcagcaggatgagaagagagtcttggagggcacaaaattttcttggtgcttaaattttatatttttttatagtttgtaaagtattttggtttcataaagcaacatattccaatgatagggatggatttttantgtctaaaaatcgagaaatatatatacctaaaagagttgataaaaagctacttattaagtttaactagtccttttcacatgcattttaaattttgaaaattctatttttgtagaaaattgtctacataaatcgttatttagttcaaatgatttaaataata

SEQ ID NO: 56118 - DNA, 693 bp, Heterodera glycines
  Genomic contig location: Contig_ID=SeqID_25373; Location=333..1025; Strand=+
  SCN-specific regions: Sequence locations=1-216,245-261,283-453,475 -491,513-618,674-693
atgattgagccgataggaaaagccaactttagaaaggcatgcgcacttagagacacccgttccatgtatgcaccgacgtctgccgttgatgcagccagcgttccaaatttggcaaggaactctgccacaatttcagttgctgaacggtaaactagttggttatgagtgagttatgccaattagtcgaagataaaattcaaaaaattttaaggattgaaaaataatttaaattaaaataatttatccgtgtaaaaaatgctaatttgtccatttttagttgaagaataaattttaccacgctgattatcggcagaaccagcttcgttactgtcctcactgtcttcatcactgatttttgcgacgctgagtaaaaaaattgcacttgacagtgccgcaaggaataaaaatgttggcatcataatatgcttaaaatgaatgccattaaataaaaatattatagctgctttaaaatattttccgaaattttttcgattatttaaaaaatataatttcagcgcttgtttttgcgtttttagtcagtggataattaagttgcgctggagagcttctggactagtcagctggcacacaactcagctgatgaggacaactcagctcattttaatttttcttttttttaattatattttaatttatatatatcatttttaaacgttagaaaataatatttta

SEQ ID NO: 56119 - DNA, 421 bp, Heterodera glycines
  Genomic contig location: Contig_ID=SeqID_25373; Location=305..725; Strand=-
  SCN-specific regions: Sequence locations=1-111,133-149,178-421
ggcactgtcaagtgcaatttttttactcagcgtcgcaaaaatcagtgatgaagacagtgaggacagtaacgaagctggttctgccgataatcagcgtggtaaaatttattcttcaactaaaaatggacaaattagcattttttacacggataaattattttaatttaaattatttttcaatccttaaaattttttgaattttatcttcgactaattggcataactcactcataaccaactagtttaccgttcagcaactgaaattgtggcagagttccttgccaaatttggaacgctggctgcatcaacggcagacgtcggtgcatacatggaacgggtgtctctaagtgcgcatgcctttctaaagttggcttttcctatcggctcaatcattgccagctctctgcaaatttcaacaaaa

SEQ ID NO: 56120 - DNA, 1519 bp, Heterodera glycines
  Genomic contig location: Contig_ID=SeqID_25374; Location=223..1741; Strand=+
  SCN-specific regions: Sequence locations=1-42,64-366,389-733,771 -1088,1110-1332,1354-1519
atggacaccataaacaattggatgggcaaaaacagaaatttgttttattattttgccttttcaatggcaattccttcgacaattttgtacattttggaaatggtgacaatcataagacataaacaatttgcgcagctgtccttctacaaattgttctgcgtccgagcaattacagtgagcaaaaagcaattttaaaataaattagcgaaaatattttgctgatatttatcataaaaagccctaatttaatgagtaaaaagtatttatcataaaaaactctaatttaataacaaatttggttctattcataaatttttacagcaaaaattcctttaaacatttcattaatcacccaatttttccataaatattttaaaattaaccttaacttatcggaccaatcctttgcccgtggcgcctatcgcctcagcgctttaactttacatttaaatgttatcccgttttaaattcgatactaaaaattattgaataatttttcaaatatgccatgttaaggacattctgtggtttctctcttccagttacggtaaccgtatcccagcactgtttggccaacaattgctgcccttttaccgtatgatgcccggctgggccatcgttctgtgttttttttttgcaacaacagtcgcttaccaagcctcaaatattgccacttttctcattcagatgaatcgtttcactgcaattgcatttcccctcaaacagaaaagggtttttaattattaaaaaattaattaatattttaatttcatccattagatttgggaaagtcaatcatttttgatgatattggcactgattgtgttcgttgtgccattgctaagctgtttgccaattatgaaaatgaacgtcactccaatggcctatgaaagggaaagcgacggatttttcatccaagaaaatgtttcggtatgaaggaaaagcatcggaaaacgcaataatcgagcagagaaatatttagataaaaattctgcatatttccattaaaaaaatattcaagctaaaataactgaattccgaagtaaaagccttagctttggcctctggacttaggcttaagcataagctagacttatgttggttttttacttgactttggttttagcttagaccgtcctagctaagttgattgaagtcggattaaaagccttagttttggcctcagataggcttaagcataagctaggcttatgtcgttcgctcagaccgacttaggtcacttgttaggtctatgatcactgatatattattaaatttttccgttttttagggttattccttccttggctatctcaacggtatgaaatcgcttacttctgttattttcctgctcttgtcgcttttggtcaatttgtcaacgctaattgcctatagaagaagcaaaagagtgcaccaacaaaattcccaaaacggaagtgacgtcattgagaagaaattgctgatttacgcccttctcactttttctggccatgcttttgtctcagtttttttggtttaa

SEQ ID NO: 56121 - DNA, 1090 bp, Heterodera glycines; identical to SEQ ID NO: 25375
  misc_feature (1029)..(1029): n is a, c, g, or t
  Genomic contig location: Contig_ID=SeqID_25375; Location=1..1090; Strand=+
  SCN-specific regions: Sequence locations=1-628,695-728,755-766,788 -1090

SEQ ID NO: 56122 - DNA, 624 bp, Heterodera glycines
  Genomic contig location: Contig_ID=SeqID_4895; Location=1015..1638; Strand=+
  SCN-specific regions: Sequence locations=1-129,151-186,226-509,531-624
atgcaaacgatcatttcggtggatgaaagtcgcgagccggcgacccctcagcagaaaaagcgcaaacaaaagcagcaagcggtagaacaattgcttgtggaagtgccggaagaagagcatcagcaaagcggaagaaagccggcgggagggaaaggcgaaattggcgaagaaacggaggggacgggcggaaaggaggggacggggcagcacttggaggaagaggcacaacttcggcaaattggcccaacaaccgacacaacgccaagagatgccgaacagacggggatgagttttgttggcaaagtgaacacattggaccagaagattgggccggaggcgaagcggctgcaaattctgttggaactcacgcacaaccggcacaacagggcgaatctgaacgcaaaacagctgcacgtggtcaatgaaatgttcaacttgttcatgtacaatcacacatttgttgtttacctttcattcattcgttattatctttggcaggtcgcgctggtccaaaattgtggccacaaacagccaatttctgaacacactgaccaacccggaaccgttgctgtcaaagaggaaggccaaccaacagggcacggaaaaggagggcaccgttgctag

SEQ ID NO: 56123 - DNA, 409 bp, Heterodera glycines
  Genomic contig location: Contig_ID=SeqID_25384; Location=1332..1740; Strand=-
  SCN-specific regions: Sequence locations=1-51,86-123,145-409
atgaacgtttcgactcacccgggtaaaaacattttataattcaaatgaagcaaaaaaaaattaactttttttaaaatttttaattgatacgacatttggttttgaaaaaaaaaaattcttcattaatcttagaaaattctgaaagcgaatatattacagaattacaaaaaactcaaaaaaatatctgcaagacacataaaaattccccggcactttaattcgcatttttccaggaatgtacgaatttttgccaatgtacaccaattttgagcctaacagaacatacacattgactggaatatatgaacaaagcacaaaaattgacccgccacagttcgaaacaaactttgtgattatgcacaaatccgagcaaacgcggcaaatgatgaaatggtaaaaggataataaa

SEQ ID NO: 56124 - DNA, 223 bp, Heterodera glycines
  Genomic contig location: Contig_ID=SeqID_25385; Location=138..360; Strand=-
  SCN-specific regions: Sequence locations=1-152,175-223
atgaactatcaaaattttgctgaatacaaaggcgtggcaataagaggagcagcggcatgggaaagacttgggcagcacgcctttgtcaatccgtaccaagacttcgcttcaatgtcacacagtaaaggcgatgaaccgcttatggagcgtccctacagcaaaaacaaaacaaatggacgcggaaatggtgtccgtagtttcggtagacagtcaatgatgaggg

SEQ ID NO: 56125 - DNA, 359 bp, Heterodera glycines
  Genomic contig location: Contig_ID=SeqID_25386; Location=1672..2030; Strand=+
  SCN-specific regions: Sequence locations=1-1,29-125,227-242,264-322
atgttgctgctgctcctcctcctcctcgacatgttgctgctcctcctcatcaacaggctgcgccgtcgacgacaacctccacgtccggtgatgggacccgggcgaaaacctggtcctaaatcatattatttttttaaatttttttttttctaattttttttattaatttttttttcttaaagtttttttttagaataattggtaattttttttttttaatttttttaaactgcctcttgattattaattttaaaggcacctttagcgtgattggtctaaggtagcaaattaattagttttttaatggattcgagaatgaatgttttttattttatttttttaatttttttaataattta

SEQ ID NO: 56126 - DNA, 484 bp, Heterodera glycines
  Genomic contig location: Contig_ID=SeqID_25387; Location=30..513; Strand=-
  SCN-specific regions: Sequence locations=1-39,76-125,169-370,399 -412,450-454,476-484
atgtccggaactattagaacccgaattcctattttggttaaaagtttgaaaaataaaattgaaaaatattatgaacaaatagaacaagggaaatatgaatttgattccaatgatttacctggttgtttaaaattatatgaatttattaaaaaagaaatatttaattttgaaaaaacgtttgatagtttaacagaattggataaaaaatggaaaaagatacgaaacaaattaaatactgaagataaaaatgctgagataaaaatatataaaatttacacagaaaaacatgactatttaaaaattttagaagaagcggatagtgttatcgatgaattaaaatcgcttaacttagaggtaaagaaagctattcaaaatttaaaaagaaataagaaaaataattcaggggatcaacatgaaaatgatgatgagaatgatgatgatgaagacgaaccaaatgatgaacaaaacagaaaagaagaattaa

SEQ ID NO: 56127 - DNA, 575 bp, Heterodera glycines
  Genomic contig location: Contig_ID=SeqID_25388; Location=187..761; Strand=-
  SCN-specific regions: Sequence locations=1-403,425-429,451-575
atgtcctcaaagatcgaacatcgcactgatcagaaagaaaaatggacgaattacaatgacccgagtgggaatccgaacgtgctgctatgctcgtacattctgatcgctgtgagagaacgcgaacatctctgggaactgatcagagtttgggacaaacagtgagtgatcagtccgtttggggtagggattgagcaacaaggcaaattggtcgttatgaaaaggaatcttgattattgaatgtaaaaactgaaaatggtcagtcactgattggacgcctaaagtgcaatagagccgggatttccatctgaaatatttaatgtttagagtgttccaaacgaaaaagttgcgcgtccaattgtcaaaattcgacggcggcgatgatcagtgagagtgaagtgatcagagggaggaaaagaagaaggcatttgcgaaaggaaagtgttgcattttggaattgactaatgattagactaatattgtgtaaaactcattattttccattttaaacattacctattttaaattaaattggcttttccgcattattttctattcgttttttgctgagtaataaa

SEQ ID NO: 56128 - DNA, 676 bp, Heterodera glycines
  Genomic contig location: Contig_ID=SeqID_552; Location=1182..1857; Strand=+
  SCN-specific regions: Sequence locations=1-676
gcgaccacggttcattattacaaacttctccggttggttttgtcactgtcgctgcttaagtatatgtccaattcccctcgtcagatcaaccgaattgtggacgaggagggccaagagtgggaggtggaggaagtgcagctggacgtgtccaagacgggactcggattctcaattagcgggggttgcgaccgcgagcctgacttgatgtataacgaccgatacattcgcgtgactgacatttcgaaaggggtgggtcggcacgtacactgtcacgcgttggggtggcactttagggcgccgtggagacggaccgacgcattcgcatcggtgacgtgattctgttcgtcaacgattgggagacggccaacagagagcacgacttcgcagtgcaagcactgaagaacgcgggcacttttgttcgactggtgagaattgtgccattggtaacaaatgggcagaaaggcaacactttcagttagtcaaacgcctcaaatatccgccgctgcaaaaatcgctgagtcaaagccatttgagtgagcccatcgccagcggcaccttccaacggtcgttgagcggagtcgcggccgacagccgaacattgcctctgcagccccccgtccgttcccgtaagagaatgaatgggatggctgtaccatggatacaacgattggactga

SEQ ID NO: 56129 - DNA, 795 bp, Heterodera glycines
  Genomic contig location: Contig_ID=SeqID_553; Location=112..906; Strand=+
  SCN-specific regions: Sequence locations=1-120,142-795
  Gene Ontology: Mol. function=protein binding; Cellular component =cytoplasm; Biological process=regulation of synapse
atgggcttcggttttaacattgtgggcggcgaagatggcgagcccgtgtacatcactcgcgttgcacccggtggagcggcggaccagaccggcaacattcggatggtaaaaacgaattgtgaccatcggaaaacaaatattgactttcccaagggagacgtattgctgcgtgtcaacgatgttgacctgtcaatggctacccacggagaagcagcggtcgccctgaaggcgattccgcagggggcccaagtgaaactgctattgcaattcaggcctaaggaatatagcgaattcgatgaacgattgcaacagcagaactacagatgatgttcaggaatatcagtggggggggggagtaaggaacctaaccaaaagtggcaataatgctgtataaatctggatgaaatagctgtgaaagtgacataaaataacaaattaaacatttttggcatttaaaactgagaattaagtgcttctttcttgttcaatgcgagaatgttttgtcagcagttctttgttcaacattctttgttgtgtttggtccgattcgggaggaagcacttttatcgcgtgaagcacatacccaccagaaatctgaattaattgcagaagtatagcttaatcgttgttttctaaccaattgctgcatgatgggatgcgttcggtcggggatcacttgttggaaacggaagaattgctgactcaactgaatgtccacggccgagccaaccgaccggagccatttccaagcattgagcaaatgctgaaagaaaagattagactagaaaaggatta

SEQ ID NO: 56130 - DNA, 206 bp, Heterodera glycines
  Genomic contig location: Contig_ID=SeqID_553; Location=1236..1441; Strand=-
  SCN-specific regions: Sequence locations=1-85,107-206
agaaaagtagagggtttttgacattacgaatcacaacactgctccagcgaaacaatggacgggacgaggagaaaacgaacaatctgaaaaacacggaggaaagggatccgggcaagcgagaggatgtggcagaggcaattgcattgcgatttgtttaaaatgttggaattgactccaggaacgccgggaacagcaaatacagaaga

SEQ ID NO: 56131 - DNA, 1961 bp, Heterodera glycines
  Genomic contig location: Contig_ID=SeqID_554; Location=442..2402; Strand=+
  SCN-specific regions: Sequence locations=1-630,653-1158,1180 -1190,1212-1292,1327-1395,1417-1602,1624-1961
atggaatggattggggccaatcgccgcggtgaagaaaaatgcagtggccaaaagggtttatccgttccaacacagcagcgccaagcaatccgagaaccgaaaggaagaaagtcatcaaatgggaatcaaatgcccaaaaataaggtgaccaacttggtcgaagacaaaagcattgcatttgccggagtgaagcccggaaagctgaagcatcagtccgagctggtcaattctaacggctcattgttaatttgattaccagtataattcagtaaattttaacctcaaatgtccgagtcgttcggggtcctttcggtagtaacagtcggccaaaaggcgaatattgggctgcaaaataacaacccggtcctaaaaaaacaaaaaagctttggaaagaaaagaacagtcgcaaaccgaatgcttttgaactttctttcgcatatatttttcttttgaaaattttgtacgagattggaaatggcaatttccgctgaccaatttggaaaccttaaaattgaattttgctgaatattaatgaagaggaaagttaaaaaaaaagatgtactaattcgtttgtagtgattccatcctcttttaagctcataatttgattgcttgtaagttgttgagtgctttctgaatattattaaaaattccaagaatgcatgttagatcggcgtttttttttaatttccattaccatttccgtggcccctatctcctgctgaattcccatttgaaaattcggttttaaatggctttgaggcgaattcaatggggcaaagcatgtcaccaccattgctgaccttaagcagaagtgtgttgtcagactgatattcaaacaattattgttatatgaaaaatacttcgaaaatcccataaaaatgtccaattgcgtctttcggattaaaactcagtcgttcaattagcacgcgttgcccacttatcaaacggcacaaacgaatatgttcaccaccaactttacgaacaatagcaaaaacaccttcgtgaattttagagggcttttggtgccaattcattaataagaataggaattttattctgaaatactaagaaaaactccgaccagcagacaggtaattactttattcactttcaatatttttccgttattcaattcattgcattgaactcgataaatctctcctttcctctctctttgacgttttcattgaaattgtttacttttgtttgatctttgagcagttgatgtgttcctttctcgttctcatttcacacccaacctccgtgctttttgagagaatgaacaaatcttaatttttaaaatttttttttgaaaaaaattttcatgaagaatttggctgatagaattcttgggtttccatcatttaggtaaatgtagtaatgatatatatataattaccaaatctaattaaggaaacaaaagacaaagtctaaaaatgaccatcaacacagacaaagcgaggaggtggtgggagagacaaaaggggcatttgttatgttgataagagaagttgagacgaaattgcaccaaacggaaagaaacaaagaattggaggagatgcgagaaaaggaacatgacgagcatcagcaaccccgaaaagaggaaaaagagaggggtaagtctaacgaagcagaagtagattacgcacctttataagggagacagaacagtgcaatttacaggagatgaagcagaaattgggctaaatgacgaggaagagagggcgacatggacaacggaagatggggaaaacgaagagatggatgaagcgaggaaaggaaggacggatgagagcgaattggaagaaagggtagacgaaacggaaaaaatgaaccaggagagagaatggcttcataggcaaagaaatggagaagtggaggtgggcacatcggagattagtccaaaaaatcaggatgtgaatggtggatgtgacctattcgcgtcacgaaagccataa

SEQ ID NO: 56132 - DNA, 608 bp, Heterodera glycines
  Genomic contig location: Contig_ID=SeqID_554; Location=2038..2645; Strand=-
  SCN-specific regions: Sequence locations=1-581,603-608
ccccaccctctctctctctcatccaccttttgatgaaaacaacgggctgtttcgctctattgcaatcattaatcaacaatatgagagataagtcgataaaatagtaaacagctccgaataagaaagtttgattaaagggaccttggcattaaaagggatattggaaatgaatttttgtacgtcagtaaggtgcagctttacgtttgttttccaatgaggtaccggaattccatttgcgaaaaattatggctttcgtgacgcgaataggtcacatccaccattcacatcctgattttttggactaatctccgatgtgcccacctccacttctccatttctttgcctatgaagccattctctctcctggttcattttttccgtttcgtctaccctttcttccaattcgctctcatccgtccttcctttcctcgcttcatccatctcttcgttttccccatcttccgttgtccatgtcgccctctcttcctcgtcatttagcccaatttctgcttcatctcctgtaaattgcactgttctgtctcccttataaaggtgcgtaatctacttctgcttcgttagacttacccctctctttttcctcttttcgg

SEQ ID NO: 56133 - DNA, 1151 bp, Heterodera glycines
  Genomic contig location: Contig_ID=SeqID_555; Location=367..1517; Strand=+
  SCN-specific regions: Sequence locations=1-50,72-587,615-642,672 -893,915-1151
atggcggacgaaaatgaaagtgagcagcgatcactggagagaatggaaaagtgagaaaaggcaaagagaaagccaagcgcattttaaaatcaaaaaattcagagacatggaaagtgttcaaatgaacggaggacaccagcagcaggaggaagttgaggtgaagcaatgggagaattgttttgcagtcaaagcattgctcaaaacaaatcagaaactgcaaatgacactccgaacattggaagagaaactgcgaaataccaaccaggaaaaggactattacaaaaaacatttcaagggagagaatggcggtttgtgtctttgtcctgctcatccgacaatttattgttacaaatctttggctaatctttagggactcataatggcaattggcgtggacaattgacagacgactttggcaaggagttgctgatggccaataagagaaagtaccagctggagaacaggaccaagcagttggagttggaattgagagagacgcagcaggtgggagtggaaccacttttgtggaatgtaactgattcatacatttttttggggagggtcgcaaattttgaaattttcttaacaaattcattaaaaatccaaaaaattttccccggcggcgcctatcggcaccgccggcccccctgtttccttttttggaaaaaccgcgccgaaaaaaactgttttttgaaatgcaaaaaaaaggtcttcggcggccgaccctccttcgcaaaaattttggccgacccacccccctttatgtatgaactgattagcactcattgattggcaaagccaacatttcacttttttaagaggtgccatcatttgggggaaagtgtgaaaagcatggagaaattgttgtggctggagaaggaacgcagtgccacgttggaaagagagagggaacagttgaggggcgagttgggcgagctgagaaggcacggagacgcgttgaagagggagttggccgaactcagcggagaagaaggcgtcgggggcacggaattcagcaccgaatcacacaatcatcaggtgggcatcgacggagacaccggtaaggttgaatgagttcattctgtaggaaactatcaatcgaatgcatgccgaatttgaacagcagtataacgaaatgcgagatctgaaga

SEQ ID NO: 56134 - DNA, 892 bp, Heterodera glycines
  Genomic contig location: Contig_ID=SeqID_556; Location=180..1071; Strand=+
  SCN-specific regions: Sequence locations=1-89,112-835,859-892
atgacacggaaggacaacttcgaggaacagaagcgaaagttggagtggcgacttggagagatgacacagtggtggaacgacgcgaaatggaggtgggcacaatgcacacaacatgatacccgaaaacgcaccaccaacagaatcggcgaattggaggcgactttgggacacgagggaaacgcacgcaataaccgaggggaaggcaatggagacgacaagtgaaagggaagggacggcgaaaagcaattggtcggtttagcttagctgagactttgggacggttcagggaactgttgagggacggcattttgctcatcagaaaacagtcacatttggacagagacaagtggaagatgatgaaatagtacgtttttagggggggggggaagagactcaccctttgggtatgaccacttgcaaatgaattgaataattaatgattaattggccaattacagtgagcatgcactggagaaggatgttcgtctgaggagttgttggttcgaagtcgattctgaagggcatcaggaagtgtttctgattgtgaggatgggatgggctgaaatggacgttcaattggctgttctgtattcagggcacttttgtgaattgggagtgcgctttgttgtgtgagcaaattcctgaaaagccttcacgtcggggcatttggcttgaccttccccccgggcattatgagtttcgctttcttcgtgacggtttgtggcacacggaaagcaaatacggcgaatgttggaacgaacacgggaccaagaacaattggataaatgtcgagtgatttttcaattttgacaaaattctattaaattcttaattcaatattttgtcagatttattatttttcatcaaatgacttgttttcgttaaattaata

SEQ ID NO: 56135 - DNA, 2661 bp, Heterodera glycines
  Genomic contig location: Contig_ID=SeqID_557; Location=557..3217; Strand=+
  SCN-specific regions: Sequence locations=1-1116,1138-1897,1939 -2043,2065-2471,2493-2510,2532-2661
  Gene Ontology: Mol. function=lipid transporter activity; Cellular component=integral to plasma membrane; Biological process=lipid transport
tcgtcggcgacggtccgtcgtcgtccctccgttgtgggctcggcttttgcactttcgattggctccaaaagctgcacaccgccaaatggttgttggccattttgtgcatgtaattttggatgattgccttggggttcaaatgcgcttcttcagatgcgccttcaaccaatccttcgttatcaatgcaatttttcccgtgggcctttcgacgttagagaagcgatttcaaatgagcaggtaaaaaaggtcagcagaggaagcgtacggctaaattcagcacgaggaccggcatcatctccagttggtacgactttgccgttctgatcgccgttttccccgtctgttactacggaaattacggtagggtacggtagaagcaaaggaagggaaacagagccaatcagctgctcggttgaggtctgattgacaaaccataatccatttcaggtcataagggccgatggatttctgtcggcagtcttataatggcattgggctcggctgtctgcgttctgcctcacttcagcagtgccccttggcacatggaccactcacagatggactccaataatgattttggccaatgcgccctcaggcaattcccccctctccctcgagaattgtctttaaatttttattttactatttgctgcctcaggaatacttctcgaccggactgtgctccttctgctgctgtttggggagcatccgacgcatatttcgttatgtttttgctcgggcaaactctccacggttttggcgcgacgccgcttttctcactcggcacggcttatttggacgaaaatgtgtctgaaaagtcttcgcccgtttttctcggtcctttcgatcgatcagaaaaagcattgccccattctgacagttcagccattcactcctttctgaccagcgttggccccatcgttgggctgttcgtcggtgggaagttgctgactttttacgacgatttcgacagagtctccggcagggaaaggtacgccgaagacggcacttggcacccgcgaccattggccactcgccgtttgtttaggttggccatcaaagactcggccgacccgcgttgggtgggcgcctggtgggtcggattcgctgcgtgttccgtcgtttctctgatcatctcctttccgatcatggtttttctttctttgtgttttcctttttcatttgggcattttttcaaatgttcgcccatgaattgcccgaggcgaagaaacggcgagaaaatgaagttgatttatcagttattttattaggcgggtatttcacattaatccattcagcagatgcacaccgtcacaaaaatggtcacaaataacgacattttatgcaaaaaaagcttcagacttttgagcaaagacattttggtgggtaaaggcactcactcagtgatctgttccaattcgaatcattttgatcacaaatctcattttcattgttttatcaattcatccatggacactttttaggtgcttttaagcagtccaacttttgtcgccattatttttgtcggcattttcgagtccatcgtcctcaacggcttttcctctttcatgcccaaaatcctggagataattctgaatacttctccaacagttggctcttatttgtcatgtatgccatctttcccattcagtttaattttgccatttagccgttataatttttggtgccgccgggggagtgatggtcggtggcattttagttcgacaattgcagttgcaagtgggaggaatgctaaagatggttttgctttgtcatttagtgagtttttgaggccgggtgtacagagacttggacaatcaaccgaatttgtagaatatcaagctttgaaggggggggggtgccatttgacccttttgtcgtttgtcccttttgacgttttgtccgtctgtccctccctccttctgtctgtttgtctgttccatgtcctttttatgggccgccctttctctgatctcctgcatgcttctcaagtgtccctctcgcgaattggtcggtatcaccgtcgcctacgaccacaagttcgtgctgttcttctgttcccttccctcctcttatccctctgatcactttttctgatcagttcgtcgtccctcactttgcttgaaaatctttgtaattccgagtgccattgcgacgccaattttcgccccgtttgcgacagaagcagtggccgaacgtattactcggcatgttacgcgggctgctcccttcgacaggaagaaattgatggaattgtgagttccaaaaaggaggtgggaagcattgacccatccgtccctccttttgttccttaattgccgttaattgctttttcccagggcactctttggggcgattgtagctgcgtacgaaatgtttctttgccgaccaatgccaatttttcgtccgctcgccatttggccaacggtttttgccccgttgattgcggttggactctttggctgttccttttcctcctctttttgtcggttgtcgccagttttgcggccggcattccgacccaacaggcacattccccaccatgtcatgcttatccctaattgcctcattagattatgctcagagtcattcccctccagcaaaggactttgggcatagcagtcaattggacttttctgcgccttcttggtacgctctgct

SEQ ID NO: 56136 - DNA, 2200 bp, Heterodera glycines
  Genomic contig location: Contig_ID=SeqID_558; Location=880..3079; Strand=+
  SCN-specific regions: Sequence locations=1-73,98-383,412-1606,1628 -1635,1657-2200
  Gene Ontology: Mol. function=protein tyrosine kinase activity; Cellular component=integral to membrane; Biological process=protein amino acid phosphorylation
aatgacaatgcgtcgacgtcatcctttgctcagaattcgctggaggaactgctcaccgccactgatttgctgaggtttttgttctgtttttcttggccaattgtcctccgttcttcattgtttgtcagttaccacgacgcactgaaaaatgtgctaaaattgcgccatgccggagacataggggacacggacagcgcggatttggatgggattggcatgagcaggcccgagcagaggcgactgatgcgggaatacgccaaacactacgcattggagcaacggcagcagaacggcgtcgtttggaagaagttcagactgaaagtgtttggggaggcgaaacagtgcaaacagcgaaaagtgacgggggagacggaccattggcaggggccgggaggggaggcggagacggcgcagcagccgcaacaccacatcatcccgccggaacgcgtcactctgtgcaagaaaataggcaccggcgagtttggccacgtattccaaggtccgctccaaacatctccccgaataaaaggctcttttggtttaagccgcttggcgagacgcaacaggcgatgggaaaaaggcgattcaggttgagtttgggggggggggagttgaccagcagaagccaatcggcccactctccaaaggtggcggtgaagcggattctgccggagaagctcatctcgcaacacgcgtcctttctgcaggaagcggccataatgacgcggatgcatcatccgaatgtaatccgattgttcggcgttgtgctggagacaaaggcggtgatgctggtgggtgttggctcgcttttcgtctcccattagctagcttattattaggtgtccgaactcgccccctgcggctctctgctcgagtgcctccaatgtccgtcgtggagagagcccttttcggtcgctgtcctctccgattttgcgttgcaaattgcccagggcatgcgttacctttccagtcacaggtccctccccccccacccaattttccaattccttccgctgaccgtcgccccccaaaggctcatccaccgcgacctcgccgctcgcaatgttctcgtgtgtactccaagcaaggtcagaccagcgagtgttaccctgacaatgaccggcgcctgtgctttgccaggtcaaaatctccgactttgggctcagccgttgcctgggccatggcgaggattactaccgcagtgagttcactccgtccatgaaattgcccatcgcgtggtgtgcgcccgaatgcatcaattttctgcgctttacctcagcctccgatgtgtgggcttacggcatttgtttgtgggaaatgttttcttacggcaaaactccctgggaagggatgagcggctcacaggtgagcagaggacgaggaaggcaccgcagggggagggagggcaaagatgggaatgaataggatttggcaaaaacacagggggattggcaccagcaagggttgagcgcactgcgattcgcgtttttttcccgcgatttgcgaccgcgggcttttctgtatacgttcacctctgattgacacagttggggggatgacgagaacgaaatattttattttttgagtttgaaaaacgccgccgagaaaactgacagattttatttccacgaagattctccattccatcgacacccaacgcaaaaagttgcactgtcccgaggcgtgtccccgcgaggcgtatttgctgatgctcaattgctgggaatgggaggcgcatttgaggcccacttttgaacaaatctgtgaccgccttccttcgatggttccccctcttttggtgacaatttgcgaaagtggcaccgccaaaagtggccaactcaattacggaagagatgaaaccatcgcattgattgacaaaaagtaaggccaacccattaattacttaatgtatttccgaattagcccttgcgggaaggagggcttttggcgaggaatttcgaaggcgggaaaagtcggactgttccgtcccgaggacacaatcgcatttttgggtgcggaaaacccttcggcaaagggcgacgcgctttcggaacaactaaggacagaaaaaggcaaaatgaaaaagcaattggacaaagaaaagaagcggaaaaaggcggtggaaataagcgagccgaagggcgacttacggcacacgtgccatgtgggggcggacgggagaagttttggccttttgaat

SEQ ID NO: 56137 - DNA, 2079 bp, Heterodera glycines
  Genomic contig location: Contig_ID=SeqID_559; Location=1..2079; Strand=+
  SCN-specific regions: Sequence locations=1-53,75-669,790-796,884 -1140,1164-1272,1294-1678,1700-1820,1843-1896,1918-2079
  Gene Ontology: Biological process=axon guidance
atgaccacttcgatggtttcactgccaccgccaaggccaccgaaaaatgggacaaaacagagaaaaaagacggaggcggaaaatggggatgaaatgacaagaagtgtgtgcattggccaaattaacggttagaggggaggggggggaggggaatggacaattaaagcaccgaaagggcatgccaactaatgagcgtggatattggggcagttggcaacgagggaggggggggggcgggtttaaagtgtcacattcactaataagcattcgcctaattcaatgaatttcattttccttttgttgggcaaaatttatgggtcacaatgtatttcagaaaatttccaaataattgcttctctaaatgcaaaataacataattaggaaatgatcaattgcttctaatctctgccgctgggcattgttccgtcgcggagtatttaaacgcgtcgtccgccgccgcttcgctctctccgcccgcccttcccccgaaaccgccgcgcttccgctcgtttgccaatttctccgattggccttccccctccgcgcccagcgccagcccaacggacactttgagccaaccgaaatttggacaacatattcaatcaccaattaaccttcccgatcaaacgcatcctcctgaaccgattcatcacaactcaaaaccaactgaagaagaaaggaaacggaaaaagtcaaaggaaacagaggaggacagagggaggaaaagcgacgaagaagcagagaaaagaggaaagagcaaagaaaagagagaggggaaagacggaggaagagatcgggaggggaaggaggaggaggaggagagagagagaggaggaaagagagaggaagagagagaggaggaggaggaggaaaatgaggaggacgaatcactgatcagacgaccgtccagcgtttgctgcgagttcagcagcaaaggcgaggacggggaggaggagaagcgcattctgcaggtgctcactgacctccaacgcgacctcacaaacttttcgctttgttcgctggacgattgctcggaagggcggccattgctcgacggggagcaaaggagagaaaagtccgtccgatttgaaagtttaacggacgaagaccgattcatttaattcatttacaggaaacttaccgaggaggaggagaggaaaaggcacctcagggaattgtcattggaacggcacggaattgtgacgggacattcggcagaaattgtggggatggaccgagccgaattggagcgaagaaccaacgaggagcggaggagggtgctgaagaagctggtcagggacggcggcgaggagagcgcggacgaaaagagagcttcttttgtgggcagcttcatctcttcggcaagcaaaatgcttgtcggagggacaaatcacggcacaaacggcgggtaggcaaaagcaaaagccatgggggaaagtgaaagccatggaagcaaaagcaatggggtgcctttgggaaacagccaatccgaatggctagcccaactttggcatgcttaaatgcccctgtttatttattcctccaatgatggcatttccgcacttcagcaaagagccattggcaaattggccccccgaagcgcaagaagcatacaaactgctggtgcaatgtggccacaatctcaagggaacatcaatcaacgaagggcattccgagggaaaaaagccatcgccgaaaagcaacgacggaacacttggacaaactgcggaaatgatcgaactgccaaaaaaaattgaatatatcaattcgatgttggtcggctgggaaggagaaaaacgggggaaacgaagtgatcggaaagacacattggaaaggagaagtgatcgaaggaaggacgaattgcatttggcggaagcatcacttcaaaatgagtcgccaccaccagtgccaccaaagccaatggcaagggcgaggtgggcacaaattgggaacaattttgatcaagggaagacagaggataagcaaagtcgatcatttgattaattagcagggttgaacagcagtagtaaatgaaaatgcagagaagaaacgaagctacggaagcaggtgaacgaagca

SEQ ID NO: 56138 - DNA, 886 bp, Heterodera glycines
  Genomic contig location: Contig_ID=SeqID_4898; Location=1593..2478; Strand=+
  SCN-specific regions: Sequence locations=1-115,138-280,303-779,803-886
atgcgccgtcgtaatctgttcaagatgttcttcaacaagtatttgtttctgtttgccgctttccttgcctctgattatgtgctctattcgaaattgtcaaaatttttgttggatgaaaatttggatttggaggaattaaacgcgaagacattccatcgggtgaccattgaccaactaattgccaatgtcagccgcagcactccgttggatttgctgaccaaaattccgagtcggaacgacatcgacccggaggagaaaagcgcgttcgcatatcagaaggtgaagcaacaaaaaggtggggttgctgatcagagtgatcagaggcgagttgagctgatcagtagtgatcagaataaaaaaatgtgtgtaaaatgggagtgtcaatggaggaacggtaattagtgtaactttatctgctgcaggcagtgtgcaattcgttgacgcggattcgaggagatcgcaacaatttccaaatttgttatcctcctaaaagaaatctcaccggacaattggcaagtgaatgaagcaaccgaaaatcaaagtgcggagaatgttttaggcgtatttcataaatgggaaaagggacattccatttgagaggaatttcaaaacgatgctgaaccaagggacgaagctgaaagtgttcacgaaggtgtgctcagaggtcggaacacacattgacaaaacttttttgaacagaagaaccaatggacgacggaagacggacaatgggaggagggggcggacgttgtggaggatgtgaacgtgaagatttacacggaggaggaggaggacgagcacggacagagccagacgggcatcaaggacctgatcgactcgcaggacgattaccatctgatggaattcctcaaattcgaaatgagca

SEQ ID NO: 56139 - DNA, 558 bp, Heterodera glycines
  Genomic contig location: Contig_ID=SeqID_4899; Location=295..852; Strand=+
  SCN-specific regions: Sequence locations=1-558
atgctcatccgtctcgatcacttctcctacaacgaatttcgatatctgatcaaaagactcgcctatgccctttattttccgtattcagtgagcacaatcgaaattcaagctgataaaacgcatttctttcctcagattgaaagtgatcggaaacttcgagtgcatttcgtgtcgctaatgcacaaatattccatggacagatataatgtcattggattaatggaaactaaatgggccgaaaaagcaatgagtgaatgaaagagagaggaaagaaaagttcaaccgaattaaaagattcgatttatccaattgtttgttgaacattgattatgcaaaaatatgctatttcattagtaaatgggctgtgggtgagggggtgccatcagtggagaagccgaattggggccaagactgattcgtccggcctgttgctgcatcagctggggcggaaggggcgcggattggtcggacacaaatggcgggggttgggcagcggccccattgaaaaacacctgttgggacagggagcggatcagatcgatcaaaatgggaaacata

SEQ ID NO: 56140 - DNA, 477 bp, Heterodera glycines
  Genomic contig location: Contig_ID=SeqID_4900; Location=578..1054; Strand=-
  SCN-specific regions: Sequence locations=1-139,167-241,268-477
atgggtaattcaaattcatcgtaaattttactcccaaaaacgacacaatcacttccaatccctcagaaaagcgtgcaattggaaagttcgtcaacagttttttacgttccgatggtgtttttctgctccgtttaattggtaattaatttaataattattataaattgtttacctcccattttttatttgttaagcgtccaatgcgggcgatttgatcaccacagacattgttttccaattatggcacatgtttctgaaggaggaaatggcacggacacaatcgccaagagaaccattgggccaaatggaagaagtcggagggggggacgacaagttatttttggaagacgtggacaacgcggacgaaaaacagaggctgacgacactcacttaggaataagcgaaaagaaagacaatcccaaaagatgattagtaaacatttttgaaaaaaacccaaactagcgaagaggcaataaa

SEQ ID NO: 56141 - DNA, 1114 bp, Heterodera glycines
  misc_feature (51)..(51): n is a, c, g, or t
  misc_feature (60)..(60): n is a, c, g, or t
  Genomic contig location: Contig_ID=SeqID_25391; Location=1..1114; Strand=-
  SCN-specific regions: Sequence locations=1-343,365-421,443-1114
cgacaggaataggacaccgagcggaactcacacctccaggctagagttcangaacgaagnggaggaagcccattgggcgagggaacgaacgcgtggatcaaactgaacgtggggggaaaggttcatccaccggccaaactgcaattcatttaatgcccattctgttggccggcttcaggtgtttctgaccaccagacagactttgtgtcgtgaaagtggctctttcctcgcccgactttcccaggaggaccattcgttgcccagcgaaaaggtcgtagtcacaaaaggcagggagtttctcccactttctccggttagggtcctcttttacctatgatttttagatacctattttcaaattagcgtatttctgtgggttagcttttttgttggtccaaacaaactgcttattgtataattggaaaacccaaattttgaatttttcgaaatgtgtcatttgaatatcagcagaatattgtacaaaaacggggtcttcacttcgttttaatgccttttcttctccaggatgagtccagttcctatttgatcgaccgcgactccgattatttttccgcagttctcaattacatgcgccatggcaaattaatccttgatcatggactctctgaagaaggttttgtttttggcatttcctgggacattcttccgggtgttttcgggtcgctgattaaaatgtggcatacattcatacaatttacaatttttggcctctttgaatcccttgcctgaattggaccagaaatgttttttatttacggcttagaattgctttgtgcgttcgaaaattatttgaataggatcaattgtcttattaatgcatttaggacttcgcgaggaagccgaattttacaatcttccgaagctgataagtttatgcaacgagcgaatttcggaaagagaaaaacaaaaaaagatgggggttcgttttttggcacaaacgaaaaactgaaaatcgaattgcagacaaagcatgtctaccgcgtgctccaatgccacgaagacgaactgaccaatgttatttcggcaatgtccgacggatggaaattcgaacaggtaattccctcactataaaaagatcaaaggaaaatgggca

SEQ ID NO: 56142 - DNA, 754 bp, Heterodera glycines
  Genomic contig location: Contig_ID=SeqID_25393; Location=133..886; Strand=+
  SCN-specific regions: Sequence locations=1-204,230-754
  Gene Ontology: Mol. function=pyruvate kinase activity; Cellular component=cytosol; Biological process=glycolysis
atgatcgaaaatgggatggacgtcgcccggatgaacttcagtcacggggaccacgaagtgagttttatcactaaattttgagaatttgaactttttattttaaagagtcgtgaaaatagttttcctggagtctttagcgtcgctgaacataaatatggcatttatttttgcccatttcgaatcccaaattcgagcaaaaagtcgaaaattattatttttttttaaatttcgacttcttgttcgagtccgggattcagaataggccaaaaattaatttctatgaaattgcagtatcacggcggtacaatcaaaaatgtgcgtgaagcagctgccaaatgcaccaagaaacgcaacgtggcgattgcactggacacaaaagggcccgagattaggacgggacttttggcaggggtaataatttttgtttgtatttccgcaaaaatgtcatacattttaaaatgttcgctatttttcttggcgtattacctttctttcaatcgctttatcaatccgatgtgccaaattccagggcggttcggctgaaattctgctggagaaggacgcgtccattcgcctgaccaccgactcggcatttgagaagtcgggcaccgccatcaacctctacgtcgactacaagaacataacgaaggttgtgaccaaaggatcgcgtgtgtacatcgatgacggattgctgtcgcttattgtggaagaattttgtgggtttatttttaagtccctacggcgacgtttttag

SEQ ID NO: 56143 - DNA, 1914 bp, Heterodera glycines
  Genomic contig location: Contig_ID=SeqID_25394; Location=244..2157; Strand=-
  SCN-specific regions: Sequence locations=1-35,161-310,332-684,706 -1134,1157-1174,1198-1395,1422-1425,1447-1914
  Gene Ontology: Mol. function=translation initiation factor activity; Biological process=regulation of translational initiation
atgggagcaagactgaaaaacaacgagagattaccagaaaatgagagacagacagacagcgaaagaatcagagaaaatgggagacagagagacaacgaaagaacacgagagaatgagagacagatagacaaccaaagaatacgagaaaatgagagacagatcgacagcatgatggtcgaagttagcaacaaaacaacggaccaaaggatcaacagtgaacagcttcatgtcggacaattcaccgctgcaaaaggacagactaacaacagaattgaaggtgatacttcattattgaggaaaagcacactgaaagaaaaagcaaaaggggagaaaaagcaatcgaatgatcaaaataatgaaagggaagtgatcgctgataagaaaatgggggcgataaagcagccgagcgatcggataagcgattggacgagaagcaatcggaacgaagaagcatcaagcggcaaaaaaatgccgaacggacgaatcctttggaccaaaattctaccagttcagacttccgcaagcaacaaatctctcccaaattctgctgataaggaaaacattctgccgacaacggatgggcgatcactcagaaatttgtcgggtgatcggccattttcatccaaacaattgccgacggatgagcaaaagaaatcggacggacagaagaaagacggcccggggggacaacagcggacatctgacatgaggacaaaagcgggaaacagcgaactttcgcaacggattctccaattgctgaaaaatttgcgaattgccaaagaggcggtggcaaattatgggacgggacgaagacggagaagaaagcgatcagccgaaaagattgctgatcagaaacagggccggagaataacggaaaacggccaagaaatgatcagtgatcagaaaagtgatcagtcattggctgatcagggccaggcaccgttgccgggtcagcagaaagcggcaattacgggacaggattttcgggagcgccctggggaagagaagccaccggatgagaagaaagcggaagaaaaagggatagaagaggaagcaaaattcgtggttgaagaattatttactggacaaatcggagagaaagccgaccaagttgaagaggaagaagtaaaattaagaggggaagaagaaattttggacggaatattggtggaagaagaacagaaagaaagggaagaaccatttggagacgtaccagaagggatggtagatgaactggttgagaaacaactgttaaaaggagagaaggacggaacaaaggcatttgcggaagtgatcagagcagttttgaaagaaattggagatgtgttatttgatggcgaagaggaacagaatcaaatcgaagaagcacagcaggggactcaaaaactgccaaaaatgaaggaagcgggagaagaagctggtgatcagggaaaagaggatacctatcaacaacaaatgccggaagtgatcggcagtgatcaaccagtgtttggtgatcaacgaaggccgagcataagggaagatgacaacgacggcattgaccagcctttatctgatcagcaaacaattaacagtggtgccattccggatcagctggacaaatcactgccagcagcagacgcacaaaatgacgggcatcaattccaggaatcagcgaaggcaccaaaattatctgagtttgatcagcaaaatgaagaagagaatgcgggaagttatgggagaagatggagtgatcaaagccagcggatcaatgatcgccctcggggcaattcggacgaattcgggacgagacaagcagacgatcagcagcaggggagcagcaggaagatgtttgatggagtgctgcgcgaccggggcggacgcgcggttcgagtcgaagatttgccgggtaattcggttttaaacaaaatttaa

SEQ ID NO: 56144 - DNA, 236 bp, Heterodera glycines
  Genomic contig location: Contig_ID=SeqID_25398; Location=100..335; Strand=-
  SCN-specific regions: Sequence locations=1-236
  Gene Ontology: Cellular component=cytoplasm; Biological process =signal transduction
atgttggactggctgatgtccaatgtgcagggcttcaaggacagaaagtgcgcaagggcattcgcctccgccgtccttctcaaggggttcattaagcatggtaataaagtgttttgccggaatttcttttttttttaattttcatatcctaaaaataatatatttcagtggtcaatgtcagtgcattcaacgagaagtgctactatatttttgatggtaatttgaacagtttttaa

SEQ ID NO: 56145 - DNA, 153 bp, Heterodera glycines
  Genomic contig location: Contig_ID=SeqID_25398; Location=1445..1597; Strand=+
  SCN-specific regions: Sequence locations=1-9,31-153
ggaaaggaaagttgtcagatgaccatgtcaaatcacaacagaatgatgaattttaacaacgtaaatattagaaaatacgacaataaaaatgagagaaatggtgctgggtttggagcaaattctgacactgcggcgtttgaggtttaatctctt

SEQ ID NO: 56146 - DNA, 841 bp, Heterodera glycines
  Genomic contig location: Contig_ID=SeqID_4901; Location=1854..2694; Strand=-
  SCN-specific regions: Sequence locations=1-133,155-189,211-265,297 -514,555-586,608-620,642-647,698-751
atggccttaaatctgacctatcttttaactctgagcttgtactgctccaactccatgcatgaagttggagctgtacaggtttgttgagaacccagagaccaaatctaaagccatattcggactcagcgtggtcaatttatatagtttaattaaattcggaatttccaaaaccacttttaaaacattttgttatttgatggtcttgaaaaatgccgtttttggagaccatttttagattccgccctccaataattcatttttgaagtaataaaatttttttcttataattttttatagtcctaactttgctctatttactcacgttttctctgcctctgtatctcttttcattttctttaaatcagccatcaaaaatacatacctcgaaaatgaccatttttacattatcaactctaactccttaaatacttttctaatgggatttatcccttgcccgataaatagcaaactcattctcaataataatgtcagatatttcggatcatgattgtggttttttaaatttatattcataaaaaaattctttaaaaaaagttgtgcggaaacttatgttacaccctaagtacctttatttgtaaaaaattttagaaatggaacctaaatacaaaaataaagaaattctaaacaaatttaagtattattttttctgtaaatattaatatttataagaaatattggaccatatcaagtattttttaaaagtattattgacttcattaagatgtataactttataaaatttaaattaattcattaaaaattaatgcaaaaagaaaattttattactttagctataattataaaatacaaaaaaaataaa

SEQ ID NO: 56147 - DNA, 209 bp, Heterodera glycines
  Genomic contig location: Contig_ID=SeqID_25407; Location=1038..1246; Strand=-
  SCN-specific regions: Sequence locations=1-209
gctcaggcagccaagtgcgcggacgacggtttcaagcaggtggagaatgggtgcaagttggagtgcgcacattggctggacgcgtacgcgccgacgccggccgcgggcaaacagcgggacgcgcatccgctgaccaattgcttcgggcgcaacgtgaagatggaggcgatgcctatgaacgaatgcatgcgcaagcgcgtggacaatta

SEQ ID NO: 56148 - DNA, 1214 bp, Heterodera glycines
  Genomic contig location: Contig_ID=SeqID_25409; Location=17..1230; Strand=+
  SCN-specific regions: Sequence locations=1-190,226-348,377-453,475 -508,533-614,639-809,831-1027,1103-1214
atgccgttcacaaaaatgataaatattgttctggtggtaaactgcacaaaagcacagggagcagcagcaggtcaataaaattcatagcttccttgggcctacagcagggatggcattccgatttccgagaattccgaggctcaaaaatttttcggaaatcggaattcgacccaaaaacgtctaaaaccggaaatttttgaaaaatataaattaaaaagtttttaagtcattttacattgttttagaacatttttgggaaggggacatagggggggaggggcgtccggcggtgccgataggcgccgggaaatttttaaaaaagctagtgtaatttttaacacaattgtgtaaaaattactaattaaaaaataaaattccgaaaaattccgactttttacaaaaattgtcggaaatcagaatccgtgccatcactggcctacagtttcatttatgtttaatttttttttataatttcacctttcccctgacccgaacaagctgcagttttttgtaaagcaattcttccccaaaagcatacaaaaatagcaaaatgtacaaaaaaaaacatttttttcccgaaaattgcccaaatttttagcaaatctttcctcgtgggatttgttttgaaaatggaaataagtcatttttcttatgcttaaaaggcattaagttaagataagaaatcaaatctcacatccattttgtggttttgtgctgctgatgaaaaaaatgccgaaaaatgtgctgaaagttatcaaaaggatggttcgttgtgccagtgccaatacggtggggagggaattgaccatggcaatgagcagttcattccaacgcctccgccggttccttcgagtgagaaaggtagaacaaatgttcgtaatgttccgtttaatttgtctttttctccatatttcctccttaagtttcaatttccgccctatacataaataataaatatttttggaccattttaaaatatcttacataaaattaggcattttttcattttattttttccaataaatcgtaaaaaatttagatttaaaaaaattttacttaaattggcaaaaatatttaaagataaatattttaattattttaagtcgtacggtgcaagtatggaatgatctatgaaaacaagcttggctttgcctacccaagagtttgcgaagaagggtaccattattgctttgcggcaaatatcaccaaaaagg

SEQ ID NO: 56149 - DNA, 1918 bp, Heterodera glycines
  Genomic contig location: Contig_ID=SeqID_4903; Location=683..2600; Strand=+
  SCN-specific regions: Sequence locations=1-43,69-539,561-583,605 -1145,1167-1205,1227-1730,1753-1918
  Gene Ontology: Mol. function=ATP dependent RNA helicase activity; Cellular component=nucleolus; Biological process=nucleobase, nucleoside, nucleotide and nucleic acid metabolism
atggacgagaatgaacatttcagttgtgatcagctgcaaatgttggtgatcgacgaggctgaccgaattttggacatgggatttagacatcaggtgactaaattataagtcgctgatcagcgaacattaatatcctaattctgatttttatttccgattgacgccatcattgaaaagttgccgaaagaacgccaaactctgttgttctcggccacccaaacgcgacggacggaggatttggtccgagtttcgcttcgtgaccccgtcttcgtggcggcccacgaacactccggcagtgcgacgcccgatcaattggtgcaggtgaagcggaccaaacctgaaattctgaaatgttgttttttattttcaatccattcttttttgcagagttatttcgtgtgcatggaagaagaaaaactgacatgctttggtagcctttgttatttcgataatatccgtctaaacttattgttagttaatctcctctttaatcctttcaggtcatttctgaagaacaatcggacgaagaaaacattggtttttgtcacttgctgtaaacaggtgatgaaccatcccatccgaattcttttgatttagtttttaagtgcttttcctttttaaggctcgtttcatcactgaaacattcactcatttgcggcccggcctttacttcaccggcctttggggcgacctgaaacagagcaaacgcattgaacgctttaacaagttcaacgctgtcgatggtggtgcggcgatggtgtgcacggacgtggccagccgcggcttggacttccggggcatggattgggtgctgcagatggactgtccttccacggtcgacgattacattcacaggtaatcacccttttatggtgttttttttctcttacgaagtggattttgtggaatacatttttagagttgggagaacggcacggatgaaccgaaaaggagaagcgatgcttatgcttacgccgttccaagaaccttttgttaccttttgttgctttgctcaggcaaaggaatgtccccgtcacagaagtgacgtgagttctctttaaatagattttgttattttttttccatttttaccttggttaatttcagagttgactccaacaaagtgtttgatgttcgtaataaaacaccaatttgatggttcctttcccatcggtgaagcaatttgctcagcaggtggtttatatttaaaacaaaaaatgacattttgtttttaagagtttaatcgcttatgcaaaagctctctatttttcggaattgaaggtaagcgctgaatacttaaaagttttcgttttatttattttaaaagtttttactttttgttatatcccaattaaatgcacagcagcacttttattaattctaggaagtgtttgatgtgcaaagcattgatttcgatgcactttctcaaaacgaaatggaggaggaagaaccatttctgaaggtgtcgcgaagggacgtgttcaattccatcactgaagtcgatatgaaggtaagcatttcgctgatatatagtcaagggaaaattgagaattttcaggaagaaattttggcgagaatttcttcaaagaaaccaaatggccaggacagccacgggtatggacatcgtgcattttcgacttcaggtttgtgtttggagctcgaattgggttgaaattaatttcaaattctttaaaatcggcagtgaaaaacaaaacctcaaaaaagaatattcaaataagaaatagaattttttaggtgctgcacaagaactgagcagcgcattggacgaggagatcaaagcggagaaggaactcgttcaggacaaattgggtggcacttccgcgccttcagtgcccggcttcaaaatcaccacgaaaggggccgaagtgcgactgagcaaaacgcacggaaacgaaaa

SEQ ID NO: 56150 - DNA, 577 bp, Heterodera glycines
  Genomic contig location: Contig_ID=SeqID_4904; Location=538..1114; Strand=+
  SCN-specific regions: Sequence locations=1-97,123-136,158-377,400 -430,452-577
gattgaagtcattctgatcgtgaatcattcggtcgacatcgaagaggacgaggagtacgaagacgacccacaagcagaaatggagaccagaggtttctattcattttttgttttgcttgggtctaagtttcatgtttgatttgacctgaattttctaggaaaatcctcaagtgttgcctgtatagtccaattttgggctgagtgtttgaatttgtttaaaagaagctacttacaattagtacttaaaaaatctaattgataataaacccaggcataagtctaactctgattttcaatatgatcaatcattttcagtctgtgcccgtctcgttgccacacttcaccattaggtgttttttcaattccgtttttacaaaacaaatgcattatttttagcatcacaaagaacaaccagagtatgttcgaagacaatgatggctatgaaaatgatcaaacgaatgggcgttgttgggaagcgaaagcgattcgaaactgagagagaaagcgacgaagaagaggacacgaaacagcagcagaagaagggggacgcaatttgttgttgatttttaaatgctaa

SEQ ID NO: 56151 - DNA, 200 bp, Heterodera glycines
  Genomic contig location: Contig_ID=SeqID_4904; Location=1262..1461; Strand=-
  SCN-specific regions: Sequence locations=1-200
gtttcatcagtgaacaattttcttgatgctttggagcaaagtgcgtattgtacaaattttgacgacaaaaaaaattgaggatgaaaagggggaagaaaagagggaggaacgaacagcagaagaatttcaaaaatgatgatgacccaattgtgtgcattcgtttttcagtgatttggaacacaacgaaaataggcaaatat

SEQ ID NO: 56152 - DNA, 2066 bp, Heterodera glycines
  Genomic contig location: Contig_ID=SeqID_4905; Location=935..3000; Strand=+
  SCN-specific regions: Sequence locations=1-45,68-297,319-333,355 -498,520-537,563-936,958-1226,1249-1498,1522-1537,1559-1874,1897-2066
atggcaaattctgtgggtgcgcaaacaaatggcactaaaattgcttctccgtccaaatcgacaagccaagcggtgcttctcgcgcaggcaatccgcgcgaatgacaccgaactttttgcatcgatggtcaaccgattgggcaataattggcagacaattagcacaacaattaaggtacaaaacggaaagggatgcttctacaatataatacttcagtttggagccgctatttttggcaacagttctctttttttttttaccaatgctcacaaaaattttaaccattataaattatcattaaaattccaatttttggccacataatcagatttttagaaaaacgggccattttttaaatttactttaaattgtaaagctgctcatttgatgaatcagaagacccttggaattatttttgcaaattttaggagttgcccacgtccgaagtgttgccccttttgcggatgatcgacaagcatttgcaacaacacggaagagagataaaaaagtataacccaaaaagcaatgacaaataaatcccattatttttcccattttcattcagtctcgaattgtggctttcatgggtcaacaaaatcttgcgcattcacagcacacatttggccacggtatctctttttaaaagtaaattgacaatttgtaccggttaaatagctcaaaagttcaagcaaaaccaaatgggaatagaatgtgcccctaaaatatgcaaatttccaaaatccgatcgtttttcttaaattcccatttcacacgatttcaaaattctctcgggcaaatttgatcacgttttgatcaaaattccatttaacacaactgctaaaatgctattttgtattcccccgcttcgcataattttgaaacaaaacttgttggaccgggttagcccaaattacgccccagacttgcgcctatgtctaaattcgggttctaaattaagtttttcaatctctgatagcctaaacagcatttcaactgattgaaaatgattatgtctgataatttgataattaattaacttttgaaaaatctttagtttgaattcaaagacattgtgcaaatgtttagtcccggctcggtgcctttcgccaccgccagcagagccattgtgccattctttattagcaaaaattataatttttggcgcaaaccgctacaaattctatttgcgcattttcgccacggtgttgaaaattgccaaacctcacaccaacattttcattttcaggtgcccaatttgaccgatcattttgcaacgatcacccaatggatggaaaaccgcgtgcggcacattgacaaactgctccaactccagggcaaactcagcttcatgatcagcgcaatgccgcaacagagtgacctgtggagagcgcgggacgagcagccgatgatcgtttttgcagccgatgaatgccaagttgaagaggagcaacaggaagacatggacgactgactgatcagcctttttttttgtttacacatttttcatcaaaaaatttaaattgttacaacaaatgcttgcttttaattttagcatttgccgagagagtttttgaaatggcgaaaacatttcctcccataggtattattttgcctcggaaacgcggcattttgccggttatggggaaggggggggggggggaagtccatgccgcatttttgccgtttttattaacaaagcgaaaaattttttgtagccaagattcttggtcatcatgaaatgagccaaattaagtcaaaatcattctttaggattgataacgaaattaaatcatttggacacaaaaaccaaaaaaaaaaaaattttctaattttactgtcaaaatcaactactggcaggcggtgccaaagacgccgccagctaaatttttgaaatttcatcctaattccttagttgattttccaaaaaaaaaaaaccaaatttcgctgttttgtttcaatctttggcaatcctgaagaataggtcgcagggttcggttgaaattttcaaaaacaaccgctttcccggttttccctccaaaaccgggcccggcccggctcggtctcta

SEQ ID NO: 56153 - DNA, 362 bp, Heterodera glycines
  Genomic contig location: Contig_ID=SeqID_4905; Location=140..501; Strand=-
  SCN-specific regions: Sequence locations=1-79,104-362
aagtaacgctggagggcagaactcgactcccgcagagagtgcaggtcaactcgaatttacaaaaattaaatcccacgtgatgattttctttcttttaaggaactcgtgatcgacattggcaatgccatgacaagcattcaacaaacttcgggtcgtcttttacatttttacaattggctttatcctttatccgaatttccctttggcaggttctacagatttactgattacttcgattcgaaatttcacttctgttgatggaataatggcaaattctgaacaaaatctcgtcaaaattcaaaatcaaatggaccgaattgagactcaaacgaatggcgctgagcaaaaccttaaaaatgttt

SEQ ID NO: 56154 - DNA, 77 bp, Heterodera glycines
  Genomic contig location: Contig_ID=SeqID_25410; Location=260..336; Strand=-
  SCN-specific regions: Sequence locations=1-13,35-77
atggatcttaaactatttttaatactgaaaatgtcggacaatccgaaagaggaggagaaacaaatggacaaagaaat

SEQ ID NO: 56155 - DNA, 947 bp, Heterodera glycines
  Genomic contig location: Contig_ID=SeqID_25412; Location=792..1738; Strand=-
  SCN-specific regions: Sequence locations=1-175,197-917,941-947
  Gene Ontology: Mol. function=ubiquitin-specific protease activity; Cellular component=nucleus; Biological process=pathogenesis
atgccattcccggtccgtctaactcttatttttacagttccgtccggccttttaattgcagaagaagtggtcggcattgaaaaataccgtagccaatcgaaaatgtgtggcacttccgaaggattactgtacggcccattgcaattcccgagcaattggcgaaatttgacatttgggaaaattatttttgacattgaaaaagtgtcggaatttgtgggagaaaaagtggggagttgccgattcagtgaaactgttcaaatcagaggacttccttggaatattgtggcaaaaataaatggaaaagctgatgaaaaatggctgggcttttatcttcaatgtgcagcagcagaagaaggtaaagtaaatcaaatgctaattattttacattaaaagttgtcttaatttaaattaagatgagaattggtgctgtgaatgttccgcaacctttcgaattgtttcgcaaaagttcgacgtgaagaattctaccggcaaatttttcggacaaatttttgatcacacagcggatcaagcaggattccatggattcatttcatttgcggtgagtggttgtttattgtttaattgatccattatggttaattaaggaattgctggaccctaacaatgaattttacaacagagaagaggacaaagtgacattgacagttgactttatcttaaaagatgctaaaatgggccaattttctgctccaaaaacagcagacaaaacaatttttatggaaattgaaaaagcttccgaatttttttgcgaaatcattggaagtgagcgaaaaagcgaaactgtgctcatcaaaggacttccgtggaaaattgtggccaaaataaaccgaagcgctgatgatgagaaatgtttgggcttttaccttttatgtgccgtcccgaaagaaagtgagtggaattaattaaaaataatttaaaacaataaa

SEQ ID NO: 56156 - DNA, 723 bp, Heterodera glycines
  Genomic contig location: Contig_ID=SeqID_25413; Location=704..1426; Strand=-
  SCN-specific regions: Sequence locations=1-73,97-335,357-406,428 -659,698-723
atgtcttccattgaagtgagacgagtgcgtgaagaggtaaaatagttttgacacattttataatttagttatattttttaagttgagaaaaataatctaccgctcacgtattgtctacgatgttgacgtccgcactatttatgaaaatctaattatcataactattttcgcttcttcccagttagccgatttttgcactgatccatttgtactgtgccatctcgacgcttgcttcgcgtacaatttgacaatttcaccacgcgacattttcattggcaagtaaaaacagacatttgggtcactcgataatcagatttagtgatttagccaacacaaattttcaaaaagatgccggcaagcgaaacaaggacgccgaaaaatagatcagtcagctaaagcaggagttcatcaatgtttttaaaatgaattgggactctgcataaaagcgtacttagaattgaactccgacgcacggccaatatacagaaaggttcgtccggtcccgtacaacgccaaagatgcagttgacggaaaattgaatcgtcgtgagaaaatggaagtcatcggaaaagttgagcacaccgaatgggcagcaccgattctggtcgtcaaaaaagttgacggtagcgacgaagcattaaaaaattcattcgcttattaacaaagaaaaactttcatttacttttattatttatttccagaagtttccgagcaaacaataaa

SEQ ID NO: 56157 - DNA, 227 bp, Heterodera glycines
  Genomic contig location: Contig_ID=SeqID_25415; Location=591..817; Strand=+
  SCN-specific regions: Sequence locations=1-43,221-227
atgtgcttgaggggagggagatgcaaaggaaaaacagtggaaggaagaggaagaaggaagacaaagcggaagagaaagcggaagaagaagaagaaaaaggtcgagaaagcgggaaaagaagcgaagcgcaagcaacagaaagaggaagaggaaaggaaaagaaagggaagagaaagcggaagaaggaagaagaaggaggaggaggaaggggaacaagaaggaagaga

SEQ ID NO: 56158 - DNA, 1244 bp, Heterodera glycines
  misc_feature (1210)..(1210): n is a, c, g, or t
  Genomic contig location: Contig_ID=SeqID_25416; Location=103..1346; Strand=+
  SCN-specific regions: Sequence locations=1-32,54-140,162-215,277 -409,585-599,757-981,1005-1244
  Gene Ontology: Mol. function=GTPase activity; Cellular component =cytosolic small ribosomal subunit (sensu Eukarya); Biological process=N-linked glycosylation
atggtcaccgctcgtaattttttttaatttccaaattaaattttcataaatgctttttagagtttgaaaattcattgataaaacaacattttttaattgatttgttgaaaaatgagaaaaaaacaaaagaagtgctggacattttgggaattgatggcttaacaattcacaaattgcaaaacgaaatcagcgaaaaaattgatcatttaaatagcaaaaacaaaagtaaaaataaaacaaaaaagaaaaaatatataaaaaggaaaaaagagaaaattggcgaagtgttaaaagggacagaagaagaaaacacggaggaaattagtgaaaatttcgatgaaaaaaaagaaggaatggaagaaaataaagaaaaaacgataaaaaatctggaaaaggaagaagagattggagaaaaagaagaaaaaattgaagagaaagaagaaaaggaaggaaaattagatgaaaacattgaaaaagaagaaaaagttggagaaaatttagaaaaaaaagaaaaaatgaaagaaaaggaagaaaaggaagaaaaggaagaaaaaattgaagagaaagaagaaaaggaaggaaaattagatgaaaacattgaaacagaagaaaaagttggagaaaatttagaaaaagaagaaaggactgaagagaaaaaagaaaaaatgaaaaaaaatttagtaagggaagaaaaatttgacgaaaatgaagaaaaaatcaatgaaaaattagaaaaacgaaaattggaagaaaaagtttcgaaatcaaaagattttgagacggaaaatggcacaaaattgaagaaaaaagatgaacaatttgccacagaaaaattggaagtgaatgaatttgcatttatcaaattgggcgattttgaggacgaccaatttttggcattaaaatacggtgaatttttgggaatattaagtcgaaatgacggagaaaaggcgagaaaagcctggtccccggctctgaaacaatttggggaaaaggaaaatttggaaaaatgtgagcattcgttggcacatctgttggacattggcattttggcgaacgaaatttggcattacgttcagacaatgaaggcactgaatggaaaaagcaaagatttggcaaaatttgaaaaggaatgggcccagctgaagcagctcaaattggaagaagaaataagtccaaaaaatttggaacaaacgcttttttcgcttatganacgaattgtggtggagggaatcactgcaaaaaat

SEQ ID NO: 56159 - DNA, 512 bp, Heterodera glycines
  Genomic contig location: Contig_ID=SeqID_25417; Location=301..812; Strand=-
  SCN-specific regions: Sequence locations=1-180,202-347,370-440,462-512
atgggcttcttcttctacctgatcgttgctgtggcactgttcggcggtggaatggtgcgtttgctcgttccaaatctgttcttccatcaatcattttaacggttttgttttcccttttcagttcgttggcatgtcacttggcggcaaaaagtcatcggatggagcgagcggcagtggggccaagaaggagaagaagcacaaaggatcgaagagctccagcagtgagaagagccaatgatgccgccgcagtacacgaggacggacgaacgatggaatggccgggccgacaaacagttcccctcccaaaccgatgctatccccaaaattatatgttgttgcccatatcatttgtgttttatcactgtaagcaaattttgcgatttccataccagtgatcatattgttctaattgtattgatgtgttctatgtgtgtacacattatttatgtatctatctatatctggtccaatgtaactccgtttcatattgtatgtaaagtttgaccaataaa

SEQ ID NO: 56160 - DNA, 896 bp, Heterodera glycines
  Genomic contig location: Contig_ID=SeqID_4906; Location=1506..2401; Strand=+
  SCN-specific regions: Sequence locations=1-329,351-466,498-711,734 -756,778-896
atggaccttacgcctattcatcgcatccatgtcgcatacgtgtggctgaatcacttccatgtgcagctcgttgctctggacgtttcacgtgtcgatacacgcgccgtcttttcaactcattgctcggcacttttggctggtttaagtaagtcgcaatgtctgaagtcacttctttcattttttaaaaatgctttaacatgttaaggtggcacaagtgggcctcaattgtcgttggatggacaattgctggccctcagaacgttattgcagaacgttgacgacgcaaggtcgcaagcggacgtctttcgctttcaggttggggctgcattaaatcagtgtgtgcatttagcagcaacaaattgtttttgttaagggaatgctcactgggattagccgccagttgccgctgctgcttggacttttggacaagtttgaaaaggacaccaagttaaaaaaaaaccacccgataaatttgattataaatttttaaaatttttcagtttgacgagtcaagttgggctgcagatccacatcgacaacatccgactcaacgtctttgagctctacattgatttgaagttgttgtacgaccaattgcaccttttttttgacatgcaacagtatatcccaattgtgcgctctcgtagcgctgttgacctctctcgtaacgcgcgcccgtagcgtgaaaaaaaaatattgttgtatttagccgtttgctttgttttgttgttttctatgtgtattaaagcgttttgataattcgattttgtttattgcattggatttaaggttttagccaatttaataatgtttctgtttcctatcgttttcctcaaaagagtttgttttgagtagggaatattcgcagccttttattatggatgaagcgaaaatga

SEQ ID NO: 56161 - DNA, 1503 bp, Heterodera glycines
  Genomic contig location: Contig_ID=SeqID_25420; Location=194..1696; Strand=+
  SCN-specific regions: Sequence locations=1-13,54-336,364-365,390 -392,426-725,747-876,905-910,932-963,987-1234,1338-1448,1474-1503
atgcactggtaagaattgagttttttggtaaaaataatgattttttattgaaaatctgttaaatatatagccaaaatttcaaaaaaattttcccggcggcgcctatcggcaccgtcggaaccttaaaatccttaattttctttaaaaaatgcctcaaattttcaaaattggctatttttggacataatctgacaatgtattgtatttaaatattcaattttttttccctgcggcgcctatcggcaccgccggcctctctcttccaccctggtcaccaccaaaaagttttttcaaaaaataagccgcaaaaaattgttaaaattaataaagggagtcaaaataaattatttaaaaaatttatttgaagaaatttgaaaaaatttctgattttcgaccaaaaatatgattttttaatttcaaatttctgcttactaaatttttctgtatttttttctctaaaaaaaggattgcccttcaaatttgtgcattaaaaatatttttgtgagtatttaattaaattttcgaattactcccgctcccgcccgggactcccgtaaaatttctgcgggattttaacgggagcgggattttcacgggattcccgatcccgatcccgctcccggaaatttttttttaccggactctattaaaggcccaaaaatggcaaaaaaatagtcactttttggcgaaaaatggctacactcaaatttttaaattaacgcaggccaaaaaatttttgcccttggagcaaaaaaaagtattcggattcccgccttcggaatttttttctggctatactaaaaagtttaaaattaggggtctaaaatgataaaatttattcgaaagtaacaacattaaaccaactcagtaagagatacataattttaaaaatcaaaaattcttatcaaggattaaataaataaattttggagatgaatttttgagaaatttttcatttcttaggggtgtatttttgaaaaaattttaggtcaattcttatgggtatatttttcgtttttattgcatttttgtcaataattttgggcaaacgccaaaatagttgaaatagttttttaaaatttttttatgttttaaggttctaaaaataaaaacctagaaaatcgcactaataactcgaaaagtagcttaaaaacaaccgaaaaaaacatattttcgtgcgtttcaggccataggaagtccagaaaaaaaggtaaaaaactaaaaattggagtcctattaaaagaaatttgtttaattaattattattcattaaaaaatgagtgcataattaaaataataataattaatttaaatatttactataattgatattttatgttcgccccattaatattttttaggttcgaccagcaggcagcgaacaattgtaaatttcttcgatttgctaacaatgcattgcgaaaatatttgctctaccttatatcgaagaaatttttaagagaaaaagaaggtttttaaaatgtttaaaatgccaaatattta

SEQ ID NO: 56162 - DNA, 288 bp, Heterodera glycines
  Genomic contig location: Contig_ID=SeqID_25423; Location=726..1013; Strand=-
  SCN-specific regions: Sequence locations=1-57,144-150,173-177,208-288
ttttttagcttttttcgaaatatttttgtctttttttcggcaggcactgcctctgacaatattttttatttatttagaaaaataaatttttttttctttttgatttattttaattatatttcatccttaaattttttaataaacattttcaaactttcaccttattaatttaaggcgaattttgccttttttaataaattctcttgtgaaaaggcaaaaaaataggctcttttaaatatgcctatttaaattactttcattgctttcctttcgcttacgaccatacca

SEQ ID NO: 56163 - DNA, 429 bp, Heterodera glycines
  Genomic contig location: Contig_ID=SeqID_25424; Location=384..812; Strand=-
  SCN-specific regions: Sequence locations=1-429
atggaagcaacggcattggcattgataattgttggaaaaaatgataaattttgggagcataagcaaagatggtcaagatccgaagtttgccgctttcgtctgattattagcaacatttttgggtaaatattgatcataggccccaaactcaaaaatgcttaaaaacagtcagaatcgatgtaaaaaggtttgaaatgggttggaaaaatagaattaggggcgcgctttcctttttcaggatgaaaagtgccgaaaatggagtgccaaactcagctgggactcaagtgaccgtgctatataaagcactcaaaagacattataaataatttttctagggtaaattgtggcgctgaacacgaatatgacctttattttcaaaattccgaaccccgaacccaatcgaacaaaaactcaaaatttataaataaa

SEQ ID NO: 56164 - DNA, 910 bp, Heterodera glycines
  Genomic contig location: Contig_ID=SeqID_25425; Location=610..1519; Strand=+
  SCN-specific regions: Sequence locations=1-80,102-502,525-649,678-910
atgctaacggccaattcccggcaccaatttcaaatgtttccgcctcctttccatgttgctccgtctgttctgaaccgtccaatggcactttctttggtgttccatcgtgccgcgcttgcagctcattcttccgccgatcggtgcttgccaaacggaactatttgtgccgtaaggcgaataattgtgccatcattaacaaaggtccggagagggaggacaaattggcaatcctaaagaatgggggtccattatttaagattttttattttgggctcaaaatcagtttctggaggttttcgaagatgctcattacgaatctgctctcgtgtttgcccaattccgaatcccggacccgaattcgaataaaaaaagttgaaatttttttcccaaaacatatcgttaaaaccggtcaaattttggcacaaattgcgcatttttatccaattaacaatttcagcagtgttttacatccaaataaatagttaactaaatgaattagaagtttttaccccagaaaaatacatcattggaaaaaaaattgttcaactttttgttcaaattcgggtcggggattcggaattgggcaaatctgagttcagaaattcgagattagcgccctcgaaaacctccaaatactcatttggagctcaaatttaaaaaaaaataatttaaatttaggaacccccattcttaagtactgccgacaaattgccatttcgaacaaatttgtttttttgttttgtttttttgtagaaggaatgcgaaattcgtgccgcgcatgtcggctcaaacggtgttttggagttggcatggacatttcgcaaagacactccaaaaagcctggccaacgttaattaattgtgaaggataaaatttaatattttgccaaatttagccgaaaatatagcaa

SEQ ID NO: 56165 - DNA, 1356 bp, Heterodera glycines
  Genomic contig location: Contig_ID=SeqID_4907; Location=607..1962; Strand=-
  SCN-specific regions: Sequence locations=1-33,56-82,104-121,154 -334,356-369,391-556,580-806,879-1049,1074-1151,1173-1335
  Gene Ontology: Mol. function=ubiquitin-protein ligase activity; Cellular component=soluble fraction; Biological process=imaginal disc growth
atgctgcaatttcgaagggtgatgaggacaattctgctgctgcagctgcttcggcttctctttccgctacatcatcaccagcaaaaaaggtcattccaacaacaacgaaagaacgccaaggtaaaaaaaaaaaattttgtttttaaatattttccctatttgaaatttcgaaaaattgccgaatttccatttttttttgtttagcgagtgccattgacattgtgcgtgagctgtgccgaagtggggcggtgcaggaacatcttgtgctgttgatgcaacagcgggacgtgcacggccaaaccgccttccaatgtgccatcaattttcgtgcctacaccgccgccctgctgctgtgggagactgcggttgagctgcgcgactggagccaaggttaacgaagaaatgacaaaaaaaaaacaatgtttccgggacaaaaagtcgccgcaaaaattaatgaaaaattcaggaaaaaatgcaaaaatattttcaattgagaaaaataaatcgcagtttttacaaatatatgaacttaaaaaaattaacattttgttcaccaaaagatttatttaatagaaattaaactaaaaattccacacatagcgggaaaatatttttgttttttgaagatgttgttgacattgtggcaccaattggggtggaaaattcggacgaatcggcactgttcgcgctgtgtgccaatgacacctgctcatacacatggaccggtgaggagcacacaccgcaggacatttttgagtgctacgcatgcggactggtcgaaacgctgtgttgttgtacggtatgagaaatttttaaattttttgttttttaataaattttgtaaaaatttactatttatataattgttatattttttaggaatgcgcatacacttgtcaccgaaaccatgattgcaagtgagtggtacctaatttgtttgtgttccattcattaagggggtggtggagtggagctagaaattttttaaaacgattttagttttttttttgattttaccaaaaatttgattttccgagagaatttttagaaaattcccgggaagggtggctggaggatcaagtattgaacacatgacattctgtccaaagcacaaagtcattgtgtgcctccaaaaaatttcgcccctttacatttttttttttaaaattaaacattttagaatcaaaaagaccagccccactgcgtactgtgattgttgggagaagtttggttgccgtgcactgatcaccggcaatttggtcaagcgagagcagttgctgaatttgtttctgcaaaacggcaaattggttgacaaattgaacgcgcggtaatttttgttgctataattaaaataaa

SEQ ID NO: 56166 - DNA, 1480 bp, Heterodera glycines
  Genomic contig location: Contig_ID=SeqID_4909; Location=1705..3184; Strand=-
  SCN-specific regions: Sequence locations=1-143,225-438,461-670,692 -927,955-1095,1117-1365,1388-1480
  Gene Ontology: Mol. function=ubiquitin-protein ligase activity; Cellular component=cytoplasm; Biological process=cell proliferation
atggacacttcctgtggccgcaaattggccgacacatttttcgagccgttgatggacgtgccggagccagtggaacgcatgttttgctgcacgcttttctcggccattctgtcaaagggcggcacactgtactggaggtacgctaaaaattttttaaattttacaattaaactttcgaaaatttttttaaatttttagtagaaataagttttttttttaattttgattgtgtggtgggggtacttacttacttgtcagtttatccatgggagggatttcatgaattagtttttttttatagaatcacatatatatttttttaccatgggccatcgaattctcgtttttttccgttttttattcaatggtttgtgttccttttaataatgcaaaaaatgaatacagatgcaccatcactccccattccattttggatacaaaaaaaaaaaattttttttttctacggttattttaaaatttcagaggcatttttccgttcaccgagcggcgcaaattgtgggagaaggcacgcatgaagaagaagcaggtgaccagtgccagcagcaatgacattgtggtgggctctgaagtgcgcacaaagtcgtcgcccatttattcggttggctccgttgctgtcaactttgccggcggtcttccaatggtaaacaaaaaattttttctttagtttttcattcgccaatattttacatggcaatgttatgataatctctatctgattgctgaccttggtgccatgatacacggacagaaatttacttaaaaaaaattctcatctttcaaaaaactaattttttttttcacagattggcacactttacgaggacgcgtggacactcaacgagacatgccgtttccgtgtgcaaacaccggacaattacgatgcaattccaatcggaaacgacaaggacaagcagcaacaacagcagcagcatcgggaaaagcgcgtatcattcagccgtaagttaattttttttttttttgttgtcattttccttggcactaatttttttttttggcacactttacattcattttatgaattacttttgaccaaaaatgctggactgttcttttttgtggtcttttggatgaaatggaagggcctagctggggacctctggccgaaccaactgggtcccggacattttgtgaaaaaactttcatttttttatttttttttggtatgatttcgatcaatttcccccgccatttcctcaaaacctttttttaagaaaattgtaaaatgaaattgtccgggcccacttgtgttcggtcccatgccatagttgggtgaatgaaattggttgactttttgccattgcaattcacccatttgaccaaaaaacccaaatgatcaaaaaaaaaatccaccccccccccccattaaaaaattacacgcaaaacataaattaaccacaggcccgtagccagggggaattacacccttaccccgaataaa

SEQ ID NO: 56167 - DNA, 1048 bp, Heterodera glycines
  Genomic contig location: Contig_ID=SeqID_4910; Location=682..1729; Strand=-
  SCN-specific regions: Sequence locations=1-259,281-871,911-1048
  Gene Ontology: Mol. function=ubiquitin-protein ligase activity; Cellular component=cytoplasm; Biological process=imaginal disc growth
cgtatcatgatgaccaggcctggtgtccggtccggtggcttctgtcgcactggggttatcattgaccggaaccggtccaatcggccaatgatcccggcatcgtctgtgcccgaggagctcattgtgcaatgccaggttcggagggggtgtcaaaaaattttttccgcaattaccaatcaatccaatccgctaacacaacaccctcccccccccatctcgcaaaattgagattttccttggtttgaacatacctaaatgggtttttgtgagaaaattaaaatttaaaaaaacaacccattcttattattctagcctgggttcgataggctttcgatttaaaaaaaaaatttgggttcatttatagaattttgtgattcctcattttttttaatgtcaattttaggtggttttgcaaggcaagtcacgggatgtgattgtgcgtgagttgcaacgcaccaatttgaatgtcaacgaggcggtgaacaacttgttgagccgggacgacgacgaaatggaagacttggacgagacgggcgaggcgtacctgcacgaggaattgttgtccttgttggacgccgggttgcgttctgatggtgatacgggtgcattttacgtgcattttttgaataaaaaaaatttcacataatttttggcgggggtgggtgaacacgaatatgacattcaatttgcaattctgcagcacgccagtttggattcgaacaaaaagtcgaaaaattcaaagagtataaatctgaaaacgaatcaactttgaattttcaacttttgttcgaatccgggttgaaagtgcagacttggcggaattggatgtcaaattcgtgttcagcgaccccgaaatccccctaaaaatgggtttttaaaactttaaaataaattttcgaaaaagtggggaggggtaccatcaaattattaccaagaaatattcgaaaatttgccgccttcagatggctacgagtatgtgatctcccgtgacatggcccgacgtcgtgatggttggaccaataagaaaaaaaattggggaccaatttag

SEQ ID NO: 56168 - DNA, 662 bp, Heterodera glycines
  Genomic contig location: Contig_ID=SeqID_25431; Location=455..1116; Strand=-
  SCN-specific regions: Sequence locations=1-212,240-282,304-662
atgaattatttcatcgaaattctgctgttgttgctgtgtaccttggtccaaaaggtgctgttctgctggatgcaattgattaaaattataatttgattattcaattgatgctatgccctaggctctggttgtttatttaaacttttttagtgttttcagttcttccccaaaattttcttgatttgtgagtgagatttgtcgtttttcgatttttatgtctccaggaaacacttattctccttccttttttgacttttttttcatctcctgagtatgggcatccattttgtccagcttcgaagtcaagactccgactcgaacgaaaataacccgaaataattacaacaaaaggggcgataaaatagatgaaactgttaccaaaagcccattgaggatttttttttcaaattaaagattttctaaatctgcaaattcctgcaggacgaggccgagggtcgcattgtgtttgcggacgaccacctgccgccgacgtccaacgccatcggactgcacggccaccgccacgccacgcttgccgaattgggggcacagccactgcccaaggtggtggcggagcgttacgcgtgtctgaacatcgcctgcctcttcccccgcctcggatttttcacaggttagcaaagaaaaaaatatacgacaataaa

SEQ ID NO: 56169 - DNA, 136 bp, Heterodera glycines
  Genomic contig location: Contig_ID=SeqID_25433; Location=1047..1182; Strand=+
  SCN-specific regions: Sequence locations=1-136
atggagaaattagaaaagagacgaaaggctaaaatagcgtatttcctaaaatataagcccccagggcttctatttttcatattcttcaaaagtgggctcaaaagaatgaatgaggcggcatttgggctcttattca

SEQ ID NO: 56170 - DNA, 937 bp, Heterodera glycines
  Genomic contig location: Contig_ID=SeqID_25434; Location=416..1352; Strand=+
  SCN-specific regions: Sequence locations=1-130,152-515,537-588,643-937
  Gene Ontology: Cellular component=integral to membrane; Biological process=embryogenesis and morphogenesis
tggccaattggcgattgctcagcgcaacttcgtacgccttctgcgacgattcgctcaattcgctgcgaacaatggtcaaattaaagggcagcagcagaagggcatttctcagtcattgcttttcaaaatatttttggattggattttaattgggtaaatttttgatcaaaaaaaaaaaatccgtccgtccgtttatttctgatcactttttttctgctcattaaaaatgctctccgtcttcttcacagatcgacacgaagcgttgtgatcagaaattgtccaacgtggcgcccaccgccacaattttcctcggccttctcattttgggcgttggccgcacaatgccattttctctcggcctgccgctgatcgacgacaacgtgcgcaaaagcaatttgccgctttatttcggttggcttttctcccatttcttacaatcatttttgggttatgttttcagcgggaatgttttgcattcgaataatgggaccgatgctcggctttttgctcggctcctttttcaacaaaaattactacactttgggaaagggtgagttcgtgctgtgatgctgtgcttggctatatattttttatttgtctattttaattcaatttaattaattcggttttattttttaattttcccagtgccctacggaatgactccaagagatccgatgtggatcggcagatggtgggctggctttttgctgatcggctctgtgcttttgctcccttcgttggcactgtttttcttccgaaacccaaagcaaaaagcgtcggctggcgaagaaaatgaggacgaaggagggcatcgcccccggggattggcactagtggaccggcatttggaaaagggcgaagacggcgaagtcggaattggcattgacattacaaatttatccatggaatggcactcaggcaattgtgccgaagg

SEQ ID NO: 56171 - DNA, 242 bp, Heterodera glycines
  Genomic contig location: Contig_ID=SeqID_25438; Location=176..417; Strand=+
  SCN-specific regions: Sequence locations=1-88,115-216,238-242
atgggttctcgaaacgcaccaaattttcatttacatcggttagtttcaggcacttctcgacgcttttttctcatcaaaaagggagatgaataaaatttttaaaaatttttaattcctttttaaacaggccaaaaagtttagggctttaacttttttttttcagaaaactgatcagaagcgcaccaaactttgcagggatactgaaaggaagagaaaataacctatttttaaatattatctag

SEQ ID NO: 56172 - DNA, 662 bp, Heterodera glycines
  Genomic contig location: Contig_ID=SeqID_25438; Location=643..1304; Strand=-
  SCN-specific regions: Sequence locations=1-662
aaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaac

SEQ ID NO: 56173 - DNA, 199 bp, Heterodera glycines
  Genomic contig location: Contig_ID=SeqID_25439; Location=586..784; Strand=-
  SCN-specific regions: Sequence locations=1-199
atggccacaatgggtaaggatttttgctggtatctaaaaaaacaaaaaaaaaaagattttagctcttgtataggcttcaatttaattaatttgttctattttatccagtttcagatttctggtcaattttttttataacttttggcgcctgagccaaaattaacgtttttcctgaaatgtaagccaaaaatgcaataaa

SEQ ID NO: 56174 - DNA, 694 bp, Heterodera glycines
  Genomic contig location: Contig_ID=SeqID_4911; Location=363..1056; Strand=+
  SCN-specific regions: Sequence locations=1-123,145-189,245-287,333 -351,373-549,571-694
atgcatatgtattatataccattggatagaggagggttgacttctattttgaattttgccgatagcgaaaaacaaaagttatggggcctcaaaaatcgaaatttttggctgtgttttcacttaaaattggtggctcagttggttaaattcgcatttttggagctcggattcaaatccaacacaaaaatcaataaattttaattaatgtataatataactaaattattttaaaaattattttttaggcgaaaaaaagtcaactgtttgttgctcgtaagaaggtatatgaaaatttgtattttctaaaaatgaaattttatttccaaaaaattgacgctggaatttctgaaaatcagcaaagcagaaaatacaccccaaaactcgtgattacgaaccggaaaaactcatccagtcccggatccgaaacactaatgtcgtctcgagtggatgtgagaacaaatccacccgatcaaaacaggtcagccatcagcactaatcggtcagtcattcgtccgtcaattatttaatgggaaatgcgtgaccgatcgcccgccgccgacagtcagaagagggcggacaaggaactgctgacgacggggggtgcgcgacaattgaaactgcagcgcactctctccgtgtcccaattttttagggggggggggagagcgaaatgtgaattgtcggtttgggtaga

SEQ ID NO: 56175 - DNA, 2210 bp, Heterodera glycines
  Genomic contig location: Contig_ID=SeqID_4911; Location=1980..4189; Strand=-
  SCN-specific regions: Sequence locations=1-321,343-704,741-778,800 -802,824-850,872-901,923-1017,1039-1076,1105-1178,1208-1426,1463 -1517,1543-1615,1679-1765,1788-2049,2081-2210
ttggcacggatttttgggtgatcaattgtcagccgaatttttcgtcactgatcagcaactgctgaaggtgggccatctcaaaacgtacaaagagagggcgtccggttccgttccggactcacggaatgtgccaaaaacagaaaaagatttttgcaaaatttagttcaaaatttaaaattcgttttaaagttttttaaattaagcactgatataaaattaataggagaatgggtcgacctttttagtgcaatttttgatggaatttttccaaaaatatttcaattatgaagtgaacacacaaattagaaattatttatggactaaattattatttttatttaaggaatgccgagaaaaacttgccaactccgaattgagggaaacgaaattggtgttcaaaaacggggaattgaatgctgagaatgtgagcaaaatgaaaaagacaaattattaaaaaaaaacaatgaaatttcagagggcgaggggtctaaatagagaaaatttcacttttttttttattcagagggctctcaaagcagagttggaaaagcagaaacggatgatggaacacattgaattgaaggcaaaagtcttcaacatggagcaggaaaagcagcaattcgagaaaaaatacggtagggagaattttgaaaattaattataaatttccaataccgtatcccgagacttactgttaaataagcatttaaaaaataatttctttaaattttcatattttagtttctgtcgaagtgttcaatacattggtggaacgcatcaaacaattggaaaatcagcagcagaagaaagaggagggcagaaatggtaaaaaaatgggaaaaaaacggacgtaaaatttaaaaatttccgaattcttaattaacatttagctgaccgtttaccaaatgcaattaaatttcagtttttgttgatcatcaattattggatatatttttggcatgggcaaagcagcagaaggaaaatgttggtcaacagcataaaaaggagaacgttcagcagaaactggatggaaaatgtgttatgttcgacaaaataatgtcgcgggtgtgcaaaattaaatgaaaatgttttaaaaaagttatttaagcgattataaaaaaaaatatttggatttttggggctcatcggatattcgttttgttagggatttgaatttgttaaaaaattattttatttattttttttagaaacttcaaagggtgccggccattcgccgccgccggcggttggccttgtgaaaattgcaaaggtggaaatctttttttcataaatgcaaattgaattcccatcaggatttgccaaattcgaataaacaaaattgttgggatgccaccatttgtcacaaagatattgaaatcaccggggaaagccaattgacggtcaattgtaagggcaacggatttggtaaataattatgaaatttaattatattaattttaatgctttttttaattaggatggcactctgtgtttgcgaaattttccgtctcgaaatgttgtcgtcccggaattttctacttcgaaatgaaagtcaccaatttggaaaggtaaaatgacatttaggtaattaaattttcaaatttgcataacttgctatttaaaattactatttttatgcatttattaataatttttcaaatattaatacatttttatagttttgcttcgattggattcgccaccaaggaaatgccattggacggaccaattggacaacatttgaacagttacgggtaccaaagcaatggctcatttggctgcaattttatcagtcgaccgtgtaaaatggcatttggcacgatgccaattccattcaacggggcggttggaaaacagaggggcggctacggtggaagtgccaattggccatttccattggattttgtgcccgtgccaatgccatcagacagggcattggcatatcaatcgccatcattttccaccggagatgtagtcgggtgtggcgttcatttggatactcgactgatctttttgacgaagaatggcctacgaattggtgggccaaacaaaatttaaaaaacaaattaaattaaaatttcacagatgactactcatttttcactacaactcccaccgattctctgtttccatgcgtttctttgtggactggcgacaaaattgaggccaactttgggccaagtttcaaattcaatttggccactctttga

SEQ ID NO: 56176 - DNA, 371 bp, Heterodera glycines
  Genomic contig location: Contig_ID=SeqID_4912; Location=249..619; Strand=-
  SCN-specific regions: Sequence locations=1-89,151-159,181-371
atgtcatcatcgagcggatccccagattcttttttccgttcagcaaatgatcaaggtaataatatctagaaaaaatttgaaaaaagacgaaaaatagaaaaatgattaatattttttattgaaaaataaaatactaatcaaattttttatcaccaccatcagcagcagcagcagcagcagaagaagtgggaaaatatgaagtgttcagttggcacggatttttgggtgatcaattgtcagccgaatttttcgtcactgatcagcaactgctgaaggtgggccatctcaaaacgtacaaagagagggcgtccggttccgttccggactcacggaatgtgccaaaaacagaaaaagatttttgcaaaatttag

SEQ ID NO: 56177 - DNA, 1176 bp, Heterodera glycines
  Genomic contig location: Contig_ID=SeqID_4913; Location=452..1627; Strand=-
  SCN-specific regions: Sequence locations=1-91,275-435,457-469,544 -720,767-1176
atgtgcccgaatggaaaatttatgagcttagaagaatgggccgcttttattttgcgcattttcttgctaacccaaaaggtaattattggacaattaatattattgatttatttcttaaaatttaaacaaaaatttttatcaaatactaaattttttttttgtaaaatggttttggatctaataaaaagtaaaaaaaaattatgtttttttgaattaaacaattatgattgattttttaatttaattatatttaattattactttaatttttaatgaattatctaattgaacttttatccccttttttgcaaagttttgcttcgaacaattttttctgcaattcggcaccgacttctcattgttgcaccaccggagaaaattgttgccgcagatgttttgttgaaattaatgccaattaatggaaaaacggaaacaaaaaatttggaaagagaacaaatttttaatgacgtaattataaaaataatttaaattattaaattaaaataaatgttttattaaaatttgcatttaataattattttaggatgttaaacgtttatggaatatggacccaacatttttggattcaacttccaaagttcaaccatattggcgacattctcatctacagtttaatcagcagcaaattaattccaatttttacccgaaatttgaacaaaaattgtcagaaaattggcaaaacgatgagaaattcacaagtataaaaatatacataaataatatttaaaatgataagataattaaacaaaaacaaaacatttagttgttcttcaagcatatcgaagggacgcgcaattactgtacactcttaaaagcttggatggcttacggtatttggaccgtgtcattgtgatttggggtgatttcaggaggccaatcactgaacatgcctacacatggccacacattcatgtgccaatatttgtggtcagtgcatctgtttggcattttgaaactcaaaaaactacatttattaacataaattaatctttgaatgccaatttcggttcatcccaaaaaattgccgacaaaaaagcgcttatttgacgtacttaacattggcggcaaaattttggcctgcccaaagaaatgaatagtcattgaacaacggcatattttattttactgttcccaaattctcgtttgagcaataaa

SEQ ID NO: 56178 - DNA, 617 bp, Heterodera glycines
  Genomic contig location: Contig_ID=SeqID_4914; Location=323..939; Strand=-
  SCN-specific regions: Sequence locations=1-89,132-136,159-213,242 -363,385-409,458-617
atgcttatacaaattaggattttaaattctttagtgctaatttttgtaattatttttttaacaatttacacgaccaaatattttaaaggtaaattttttaatcataattttatttctaaaaaaaatttttacagttcaaaattatgtatttattattgcatctaaagaagcagtaaactttttcgattggtcgtatgttttaaaatcaattcctttttattaaaataataattttaatttagaaaatgcgcagaatttggcgtttttatgccaaataattcgaatttgatgccaaaagaagaacaattattagcaaaatggatgataagcagcaattactggcaaaaggacattgaaaaagcgtgttttttggtgtatttcattaacaaaaagtcaaatttattaacggtaaattaaataaataaataaataattctataattaattaataattattcgttcacttttataaatttaaaggagcatcttccaaatgacggaatgaacagtttgatcatatttttgaatgacatcaaacccactgaagagtttagaaaaaagaattttcgtgccatttttgtagcatccgattttaatgaggggtactaattattaaa

SEQ ID NO: 56179 - DNA, 1246 bp, Heterodera glycines
  Genomic contig location: Contig_ID=SeqID_25441; Location=154..1399; Strand=-
  SCN-specific regions: Sequence locations=1-35,70-537,560-1246
atgaactccaaattgggctatttggatgaacaagtaagagaaatgctgactctttccttttctcagacaattaaatcgatttgtgattatatgttggagacgagaagatgggcagcgacggcacttctctcagatccaacaacttttgccagaaaattattccaatctggtaaactggtggcaagagtggctgggcctgaattgattaaagtgtggccatgcatcgaattgcaagcacacgattacgaatttgccaaaattggaaactcagcggactccgaattcgaatgcattgacaaaattccaattaaattccgagtgaaggacaacaaaagaatggcatttattgacccaaggacaatgattttgagctccgatgcgagactggcaccatgctcacaataccgcaaacaactcatttttgtgcgcggttcgctttacgaaattgatcaaatcgatgctcaagtaaagcaggtaaatgccaatcgcattgaaggttttagcctgaatctgtcattggcaccgacttatgctcgccattcctttctccaccttgcccttgtgaatgtgtctgactttattggccaattttacgacgccaatttggcaagagaaagcgaactcacattccaaatcaaaagtgaggacgctatagtcacaaagactttgtccgagcaatgggagcaggtgagtgagtccattcgcagcaaaatgattgggaactgggaacaaattggcaaaattgtcctgtcaataatgataatcattgtttttacagactttttgatccggtttggattaatgattagagacgaatacgttggcagaggaacaacacgacgcatgacttttggtggaaacaaaacgcagaaaattgtgaaatctccagcacgcctcaatatgatggatctgaatgcatctgtagaatttggtaacgaaattgaactcagtcccgttaagctcattgaacccgcccaaacccaggcatacaaaattgcaggaaaacgaaagagaccggtaaaaagggctcgcttcagttttcgggcgccaaaagtactcattgggtttttagtagtttgtcttcccaatgcttttgcaaaccccgatgtgaataaccaaatttcaattcaattcacttctccatcaatgatttatctgcttatcattccatttctgatttttatcactatttcagtactgctctgctcaaaacggaattcagaccttccaatgctcccaaatctga

SEQ ID NO: 56180 - DNA, 522 bp, Heterodera glycines
  Genomic contig location: Contig_ID=SeqID_25445; Location=1015..1536; Strand=+
  SCN-specific regions: Sequence locations=1-113,157-217,239-522
atggcatatgcgagattgcgaacaccgcttctcgaaataagcaacatgatcatcgctgatgtcaccaaacttgtaggttctaaatgaaataatcagcccctaataataatctgaaaattaatttgttttattaaataataatttttttaaaattaaggatttcattggaacaatttgctcaggaatcctttcaaaagggaacactcttgctttggaatctgacatggtaaaatatgatcaattgtcgaagggcatcaccgaatccacgcatttgtggtggaagaccgaatcttgtcagtgtgttatggtatgctttgtggcatttatctagggatgggtacggtgttaggatgttagtcaagatccatcacacccatttgtcaaaaaaaacattgtatgttatagatttactcaagaaagccgaattttaaatcttgatatcattagacagccctaattgttttatattatcctgcaaaatttcaaaaagttcgtcaagtttcaagaaagttaagacgacaa

SEQ ID NO: 56181 - DNA, 828 bp, Heterodera glycines
  Genomic contig location: Contig_ID=SeqID_25447; Location=307..1134; Strand=-
  SCN-specific regions: Sequence locations=1-305,327-472,520-828
tgctaactaaaccaatttatctgcgcaaatatgttggaagaggtaaagcagctgcaaaaaagttacacaagttggagaaaaaagacagtttcaagaaccagacaaaggcggaaaatttacaacaacaacatgacccactaactcagcaagtaatttagaagcattctccgaacaatgccatgccggattccccgaaactttttcccttactttagaagcgtataacatgagggggtaattggatgcccccaaaaaaatttctgcttggatttcagtttcttaaaaattcacagaatacggaacctagatttctggacccaaaaagcactggtgttccctgaactggaacaaaatgcatcactttgtacaatttatgctaacaacgaaaacaattgtatgagatttcaagggcccatgtagcttgaaaaagtaagacatattttcaaggacaccgtgatgagcatttaaaaggattaaaaatttaatttttaaggaaaaattaaaaaaataataataatacttcagagacgtatgtcatttagcaatgcgttggacgcaattcgagcgcgtactttgagcaacaccaattcgccagcccatccgctttttcgcgaatccaatgagctgctgctgcaccaatcgtctgcagttgaccaccttcaaaaaatgaatgatgttaaatgccgtaccaagaatggtggcaatattggcgggcatcgtaaatattttacaatgttcgaaggtggtaatgaaattgatagcgaagaattgaaggcggaggacgaactgccgaatgaggacaaaaatgaatccaaagagatcccctga

SEQ ID NO: 56182 - DNA, 439 bp, Heterodera glycines
  Genomic contig location: Contig_ID=SeqID_25448; Location=821..1259; Strand=-
  SCN-specific regions: Sequence locations=1-93,204-227,249-250,281 -363,385-439
atgctagttgacaatgtgccagagaaacggcaggaaaacaagaattgtaagcgtttttacacagcacaaattacaaaaaatattaaatgaaggttttaaaaagaaaaatatatcataaatttatttaaaatatttttaaaattttattttaattcataacataagatgtatgtaataatatttaaataaatgtttataaaattgctaaataatcctaatataagcaattattcttaaaataggaatatcgaaaaataatattaataaaaattattatttacaatttctttacaaataacgcaattataagtaattatgaacacttaaaaacaatatcgaacaaaaggacaatgtaaaaatttcagatttcaaattactttagttttatcaaatgaaaatattattaccaacttaatattgtaattgttttataaataaa

SEQ ID NO: 56183 - DNA, 1267 bp, Heterodera glycines
  Genomic contig location: Contig_ID=SeqID_4915; Location=414..1680; Strand=-
  SCN-specific regions: Sequence locations=1-183,206-581,604-609,631 -1230,1252-1267
atgtcatcatcaaaacgcaaacatcagtggcatttgttggcaaatgtctcggattattcaaaatccgagaaaggatttcagagtgacgagaagctggatgataatgaccttgaggtgcctacccattaagcgcatccttggcatttacagtggggaatgatttaaaaaaactacgcggcaaagcatttgaaccaatttgaaaagacggacaaatattttaccttttttcgggttttgcacaagttctaaaacctcagatggcgtcggttcattcctttctatcttttttcggcataactcatgagcttttgaatgacctcctatttgtttaggtcttaccttttaaaatgttttgtccatttttcgagttttgaccggttcaaaaaccatttaaatgctttgtcgcgcattttttttacggtttaggcatcttcatcagaaatttcccaaaaaagacatgcgcataaaatatgttgacaattttaatgcaccacaatttttcaagaagcatcaaaattgaatattcttggtatcatccgatagctcaaacaataagatttctctatttgcatgaaaagtttgaaggaattattttatgttttaaaaacgaaatcaaaaaatatttaatttggatgcttctagatggcgctaattggctaaattataaattacaatagacccgaaaatcaaaattttcttttaatcatctctctaggttgcgatgattaatgaatcatgtttgttcggtgacacggtcttccagcaacaatcggccgctttttttgccttgccttcactgcttccgttcaacaatcagaccaacatcgtctcttccttcgtctctccgtttaacgaagaacagaattcagacgagtccgatgctgcggccaaatcggtttttttaaatctatgatcatccattatatgatttttgtaaagatcgcgtatgacgttgtctcttcactgtttgatggagagcctttgtattcttctgagtcgttttcggatgacgaggggagcatggtggtcaatgccagcattctccaagtgcttcaagacgacgaaacggagtcagagcttgaacaagagaacactgaagcgacaaaggaaaatgaaacggcaaagagtgtttcggaagagagtgaatcgattgaattccaaccgacggttccgacttgtaacaactcaatgcccactctcctgtcgcaaatgtacgcagcagacgagcagactttgccagtgtttgattcatgggaggaactcggag

SEQ ID NO: 56184 - DNA, 1492 bp, Heterodera glycines
  Genomic contig location: Contig_ID=SeqID_4917; Location=124..1615; Strand=-
  SCN-specific regions: Sequence locations=1-184,206-426,448-1492
  Gene Ontology: Mol. function=receptor activity; Cellular component =integral to membrane; Biological process=regulation of body size
atggtgacaaaccgctggaatttgctgtcttcgcccaatgcgtcgacgctcgaccttccaatggctttggccggccattcggcccatgtgatcggcaacgaaatgcacattttatttggatataaccctttcgaaggatatatgttcactccgcagatttactcatttggttggtgtgcccattccaattttatattttaattatggcttttcacaatttgctcatttggcagaaaccggacgttggcgttggggtgcggttgacccatctgttcaaggccgatttggccatgcatcagctcaattcgccgaatttaatggcgaggaaatggttctaatccatggcggttataatgctccgattaacagttactcctattctatcagcgacgaactgttgctttacgaaccgaagcgtcaaatttggtttccatttaattaaaagttaactaaagatctttttttactgtataatattctccaggaacaatttgggtagttttggtgcaccgttgtttcgccattctgctgttattttggatggaattatgcttttggtcggcgggaatagtcacaatgagtcgtcgaccactcggaaaaaggactgttactcggaacaaatttatgcttatgacatgagtgagttgtgttgatgttctgaaacaatttttgtattattttagcctatttagaagctgtttctaacaataagcattgcttggtgatcagatcaagcccgtagccagaaaaattttcgggggggggggagatctgaagaccttttccttctttctttttttttttttgctcttcgggcccagggatcagataattaatcaaaaaagttataacatggaaattgcaaaaaaaaaaaatcaaatttgaaaaaaatctttttttctaaaaacattttgctagaatttttttttctttttataaggttattggagtgggtgaacattgaaaatcttacgcatgataccaccattgttgggtttggttgacaatgaaaaaaatacctcgcttaacccctcggaggggcctctgattacgctgataaaattttgctcattttcagtttgcaaaaggccagtaaaaatatacagcaaagagtttgaggcaattgcacgttatgggcacagtgcgtttgtgagcggtgggaatatgttcatcgtcggaggattcaatggggagatgctcaacgacgtgctgttgttcacaccgggtgagtcccagctaaattcacttttgtaaatgctgttgcgttgtttagccaattgtgacagtcaggccaccaatgcggaggaatgtttgcgattgtccaacggcgtgcgctgtgttttccacaacaaatcgtgcaccaaaactctgcccaattcgtccttcaggcagtcctttctctcaattgccaagggcgaaacggcgatggtctcttaccaagaacactgtacagggactgccatgggagacaagtaaagacaagactggttga

SEQ ID NO: 56185 - DNA, 465 bp, Heterodera glycines
  Genomic contig location: Contig_ID=SeqID_25453; Location=530..994; Strand=-
  SCN-specific regions: Sequence locations=1-465
gtttcaaatatcgtaagattgattgatagggccagacaaaagaaggcaactgttggtaccaagtttgcggtaaaaaaatgataaaaaagagatagccatttttggtcaagaattttttttgtttgcgtttcaaatatcgtaagattgtttgatagggccagacaagagaaggcaactgttggtaccaagtttgcggtaaaaaaatgagaaaaaagagataaccatttttggtcaagaattttttttgttgcgtttcaaatatcgtaagattgtttgatagggccagacaagagaaggcaaatgttggtaccaattttgcggtaaaaaaatgagaaaaaagagataaccatttttggtcaagaattttttttgtttgcgtttcaaatatcgtaagattgtttgatagggccagacaagagaaggcaactgttggtaccaattttgcggtaaaaaaatgagaaaaaa

SEQ ID NO: 56186 - DNA, 99 bp, Heterodera glycines
  Genomic contig location: Contig_ID=SeqID_25456; Location=239..337; Strand=-
  SCN-specific regions: Sequence locations=1-99
atgctcttctcaaatcctttcatcctgtgccttctgctgaattttctgatcattggcccgtcccaattcatcggccaattcattaacattattggtgaa

SEQ ID NO: 56187 - DNA, 487 bp, Heterodera glycines
  Genomic contig location: Contig_ID=SeqID_25456; Location=1053..1539; Strand=+
  SCN-specific regions: Sequence locations=1-52,95-188,263-363,416-463
atggccactttcaatgtggcccatctcatcactttaattggcgttggggtacaaaaatttaaattaaattttattcctattttttataatatttgattttgttttagtcaattgctcataggttgttgctgatgagcaacaaaatcaaaacaaaactcaaattggaaaagcaaaatgaaaatggtaagaatttttatttaaaatataatttatttttaattaaaaataattttattgtatatttaaattaatattttattttgggaatgcgagagattcaaaatgcgatggccgagaaaatatcgggaactgaggccaaattgtaaaaacaaattgaaaaaggtaaaaaatagctagctacccaatttaaattttatttttgattatttgttttttttaaatattttaaaaaattgttttagtattcactgaattgcacgacaaccaaaatggactgtcaaccaaattggaaaatggtggaaaatga

SEQ ID NO: 56188 - DNA, 264 bp, Heterodera glycines
  Genomic contig location: Contig_ID=SeqID_25458; Location=306..569; Strand=-
  SCN-specific regions: Sequence locations=1-237
atgcgaagaggtgcaacagtgattagaagaggtgcaacagtgattagaagaggtgcaacagtgattagaagaggtgcaacagtgattagaagaggtgcaacagtgattagaagaggtgcaacagtgattagaagaggtgcaacagtgattagaagaggtgaaacagtgattagaaggggtataaaagtgattgaatgtggtacaaaaatgattagaagaggtacaaaaattgaatgcaatttattataaattttaaaaaataaa

SEQ ID NO: 56189 - DNA, 759 bp, Heterodera glycines
  Genomic contig location: Contig_ID=SeqID_25459; Location=4..762; Strand=-
  SCN-specific regions: Sequence locations=1-40,63-223,246-362,385 -432,454-485,507-545,568-595,618-719,741-759
atgagttggtttattgaaaaacctttcgaattacttcctgtttattattattattatttaaacacaaaaaacaaaacgcagcgaattgttagttcattatcattttttgagatggtgtgtgaaccattttgggttaaggatcaaataactcattgatagtgacaaattcaaataatgacgataaattaacggtttaaattaagtgcaaatgtttaattttacgtatggttttctttaaaaattagcgttttcctatccctatttattcattgcaagttgaacaaacaccaggacgaagtgtacacgcggttcacggaccttgatgtttttaaagtgagcagaaattggcaaattgtattaagtcattttgggtaatactgtttttagagctcgattttttgaaagtcattttaaaaatcaaaaaaatgtttgaaaaatttaattatttgcttagaaacatctaaaaatatctaattaatgataataatgtgttttaaaatgtatttaatctgtttttgaaaacttgaaaaaacatcggtcacttgaaataataaattttaaaattttgtccaggaaaatccagggtttttcctgttttgcctggacctggacctggatttttttttcacatttgacctggacctggatttcctggacaaaaatccaggtccaggaaaaatccaggttgccgaaaaatggcctggacctggatccaggaaaaatccaggcctggatccaggtccaggtcgagctctactt

SEQ ID NO: 56190 - DNA, 1048 bp, Heterodera glycines
  Genomic contig location: Contig_ID=SeqID_4918; Location=137..1184; Strand=+
  SCN-specific regions: Sequence locations=1-976,998-1048
atgttaacggcttacggcgaatttaatggccgaaagcgttcccgttttgacccgtcatattccccactaaataatcagcactcattggacaaaaaacaacaactgctggacggagtggcaaaattaaatttcgacaacctcgtcaacgaccaaaccatctctgaagaaagctgggcgcaaatcgcacagctcaccacccttctcaaattggcagcaaacatcattggagactcgatggcgccacaaattgacaatgccgcggaaatggaacgtcgccgctcggtggtggcaactggtattcctgaatcggtgtccgacatcccgtcagagcgcgtggcggaagatcacaacactgttactcgcctacttgaccagctcggggtcgagtgtccggtaaccagctatcggatgggcaaccaagccccaaatggtcggcccaggcctctcaaaatcgttctggccgcgtcaaagtttcagcgcatcaccatcacacattggagcaaaaaaagagccgaactgcgaaaaattccacaaatgcaacgactcaatttgcgcgaatcgttgacacccgaacaattgtcggcccgccgtgagatgcagaaagaatgcacggccaaacgagcacaaactggtcaggactggatcatctacaatgatcgtctgattctgcgggatgatatcaaaggaaaaagcactgcgatgtttccgccgactgtttctctgatcacaaatgttcatccgacaaaaaactgacttccatttgcaatgatttgaggtttgggggctttttggaacaacaacaaacaaactcaaacaaaaataatgcccccacacctcatccacttcccaaaaaaacttccaattatgttgctcatccacctgcgatacccatgacattatctacctcatatgacgatatttctttcacattatcaccatttatttgttctagggaaaaggccgtaaatactaatctcaaaataaccccaaaagtcagatctcccacaaaaccggtacatacctaattcaaatgttaattttcaaaaaa

SEQ ID NO: 56191 - DNA, 1291 bp, Heterodera glycines
  Genomic contig location: Contig_ID=SeqID_4918; Location=2221..3511; Strand=+
  SCN-specific regions: Sequence locations=1-100,123-254,276-811,833 -1291
aaaaaaatttcttgacaaaaatcccaaaaatatttacaaatttatcgaaaaagattttcaaagatgggaaaccccattaattctttatgaaaacaaaactatcatagacgacggggaaaaagcagaaatttttgccaaacattttgcattgactttccaaaattccagtaattatccacaaccgcccacaactttctcaaatagttccaatttaccgactctttcgaatatacaattcaatgtattagacgttcttgaaattttaatataccttccaaataaaaataacacttcaccagataatattagtttcaaatttcttaaaacttttcacttaatcttagctaggcacctgacagatctgtttaacttatctttatgttcgggcaaccttccaaaaatctggaaaacttcattagttttgccactcttcaaaaatggagacaaaaatttagtaaacaattaccgtcctatatctattacttgttcctgttgccgaatttttgaacgcttaatagcaaaaaaactcactgaattcttacttaaaaacaatcttatctctgaacaccagttcggattcctaaaaagtagatcaacaaccctccaattaatctcctcactggaagactggtacaatgcaatacttagaaaccaaaaaattgatataatttatttagatcttcaaaaagcctttgatcaagtcccgcatgatcttttaatatacaaactcaaaaaaacggaataacgggcaacttattaaattggcttcgggattttcttcttggaagaacctttaaagtaagaataaatcaaaaattttcaaatgaatttcctgtcaaatcaggagtcccacaagggtcagttagccctaatttcagtctttaattgggctgaaacatggggcttaaatttttcagtaaaaaaatcttccgtcttatatttaggaaaaaataacaaaaaaataccgtacacaattaaaaatgcaacaattcctgaatcaaaaattattcgtgatttaggtattttaattgacaacaaactcaaattcaacggacatgtttcaataattctccaaaaagcttatctcaaaagcagaattctttttaaaaaaattaaaaccaaatcaaccaagacttggattacagtttataaaagttttatttgatcccttttagaatacgcaaccgaaatttggaatcctcaaaccaaaaaagaaataaatcgcctggaaaaatttcagaaaaactttacaaaaaatgttttcagaaaatgctgtctcccctacatctca

SEQ ID NO: 56192 - DNA, 1110 bp, Heterodera glycines
  Genomic contig location: Contig_ID=SeqID_4918; Location=3850..4959; Strand=+
  SCN-specific regions: Sequence locations=1-288,310-310,332-335,358 -358,380-459,494-494,516-700,729-760,785-884,910-1110
atgtttcccggactatcattttcttccgtggtcgaaatcgcctggcacggccaaggtgtttggcaccatcttacgttaatatttatatttgtattaattactagagttcggcgcgagattttgaggggtcctagttagagaccggaaatttcaaatttgcggatcctgttgcaggattggaattcaaaattttttacaggacaggatccggcaggattaatcctgcaaatcctgcatttaaaatctgcaggatcctgcgcaggattgcggattttaggaaatttcaaaaaattctgtattaataaaaaagtctttcaaagtataaaaaagtattcaatatatttttaaaccaaaaaatgatgaagatgaaaaattaataaactccaagcaatcggctgaatcttctttaatgcgtttaaaaagaccgatttgcataattgggtggctcataataatagcttaaattaaagtaaaataatttttatttaaatttctttgcaaaaaagccaaaatccattatgtatagggatgggatttttaggcacaaaaaatcgcgaaataggcacttaaaaaggcagaaaaatcctaaaataggcacgaaaatagtaaaaaaaaattttattaacgctttttaggtcgcaaaacacataaaaaattcaattgtataaacttttttcgaataaggataagtttttaaacgaaaaatttttattaagaaaaaattttttgaaaaaagaaagtttctgaatatttggcattctattttttaaaattttcaaaaaatcaatgcaggatcctgctgaatcctgcataaaatctaatttgcgggtcctgttgtaggattggaattcaaaattttttacaggacaggatccggcaggattaatcctgcaaatcctgtattttccaaaatatgcagaattgcggactgggatcctgcaaaatcctgcgcaggatactgtcctgcgccggtctctagtcctagtctccaatcccgcattttttgtaaatttcggggttttacgggagtaatctcgtgggcttccatcgcgttgagttcaatcccataacgggatccacaatttaaatttacaaagaacagaatgccaa

SEQ ID NO: 56193 - DNA, 876 bp, Heterodera glycines
  Genomic contig location: Contig_ID=SeqID_4920; Location=249..1124; Strand=-
  SCN-specific regions: Sequence locations=1-108,130-443,465-599,622 -656,678-876
atggacatttggtcagctgggcttaccattttacaattgaccctcaaaaaaacgtttggctataaagaaaaggtggatgagaaaattggcgaattgtttcgaagcgcaaaattgaaatttgaaggaggaaagtttaagcctgatcctgcaaaattatcactgccaatagacatttatgaatatagtagggaccacttaaaatatgatgaatattggccatcgggaaattggtggtacaattatttgacagtgatccatgatattcttacgttatgggacaaaatgccagagattgtcttcctatcagtggtaagtcctagaagaatgtctaaatttaaagaccattttttgggttttcttgagccatattcagtccagcccctttttcaagtgggtaggggattcacacagaccgagtccaacaagaaatctaggcccagttttttaaaaatacctaaaactatgaaaaatttttcgtgggtttctctgtgaataaattaacttgtatagaatatgctaaacattgatgcagaaaagcgaatgagtgccaaaggaatcattgactatttggagggcaaatgtaagccaaaggaatacgagaaaaatgcagagaaaatggcactgtttggcgatgtgtcagatgaaaaattgaaaatttttatgggaacagaacatatgggcttctgtatttttgaaaaatatttgaatgacggattaattctatttggaggggataatgatgaaagggaaaagaaggtaaaggaagactttaacaaaatggaaaatatcaagcagaatttgatcaaaaatgcggtgaagagcatcgaaacatttatgaaagaattggaagaacgcgacgaaatttgtgaccattaa

SEQ ID NO: 56194 - DNA, 868 bp, Heterodera glycines
  misc_feature (9)..(9): n is a, c, g, or t
  Genomic contig location: Contig_ID=SeqID_25461; Location=361..1228; Strand=-
  SCN-specific regions: Sequence locations=1-40,89-224,288-392,419 -744,808-868
acttctttnatcccattttgtttctcaattctcatcgaacaaatttaattttattaaaatcaaataaaaaaatgatttttctttttttgtgttcagaagagcattagccaaatcgcccgtggtgaagcgagccgccgccattcaggagcaggagcagaagcgggtcagcaagcacaggacgagcagatattggctggatgaacaggtgggacggattttggatgtttaatttaaataatgcaatttgattaaaaataaatataacaactttttttaaatcaaaaatacacttataatcaattaaataagcaaagtttttcgccaattttgttaattattccttaatcattaacaattgggaattattatgctccttcgcttttattctacattaattaacaaatatattttttgttaattgtttacacaataattaattgttttggccctttccctaattggccaattagcgccctgccatttcggcccagtttagttgagtccctctgagcacatttggctgccctcctccgcttcatccgcttcttcgtccgccgtggacaccgaatgttatttgggcgagaaggactgccagaagatgggggagaagcgccgctgcagcggctgtcacattgtggcacacacggcatgcttcccactgctggccaaggcaaacaatccgccaattaagcatttaaacgagcaaattaactaatgatcatttatcttatggattataaaacgatttttaatcttaataaaaatttaatattaaaaagcagtaaaaagttaataaaattaaaaattgatttgcaaaaattgcagatgaatttgagctgcaaaatgacttttcgcgactgcgcacaaa

SEQ ID NO: 56195 - DNA, 915 bp, Heterodera glycines
  Genomic contig location: Contig_ID=SeqID_25462; Location=237..1151; Strand=-
  SCN-specific regions: Sequence locations=1-626,656-881,904-915
atggagaaggagtataaacagagtgttcgtaaggtttgttatttcagtcattttgtgtaattcttacctttgtaaaatcgtatttcagctgtatgctggaaaacaccgtggctatctgctaatgcctgtcgaactccctaatccaaatgatccaaatggggatcgttttagtggccaggggcatgttttgtaagcattttttgtgtctttaattgaccgatttatgaaaaggatggaggatttggtgtggcaactgagaggcaaaacacgcaacgcaacccatgggattattatgttctacgtaatcagaaatttataacctttactttatgaaattgtatccaaggtgcaatacgcgaattggacgctgtataacgtcaaatataacttttagtggttggttaaaaaatagacaatttggcgctagtgaaaaagtcaccacatttgaattttatcaaaaaataaaggggggggggacccttttgtttaggaaattttttttgtaataaaacccatgaaaattgtattatccggggttttagaggttgctgatcagtgatcacgaatctgacatctaattcgaggtcatggacccaaaaacccaattgaatattcaaaaattttgcaaaccaaaagggtccccccttttgtttttacattttgatggaattcaaaagtgttgactttttcactagcgccgacaatttaattgaaaataacagcgaatgggtcactaatttagttgttcaaacattattttttaggattcatagtgcgatccggtcgatgaacaacactccaattgctgatggctgagtaaaagtgtattttctcaaattaacatcgaatgttattaaatccccaaattatgttttttgcgcttttattattgatcattttcaatatgcaaataaa

SEQ ID NO: 56196 - DNA, 847 bp, Heterodera glycines
  Genomic contig location: Contig_ID=SeqID_25463; Location=6..852; Strand=-
  SCN-specific regions: Sequence locations=1-350,372-452,474-606,632-847
atggacgacgccgttgaattggtcactgccttggagaacatgcgggtgaacatcgacctgctcagtgtaaaaaccgacaaatattttattccggacatatttctgagaaatcttgccaatgcaaaaatggtttaaaacctttgctggttttgtttcgattcaatgccccagggtttgatgctcgtaaaaactagacatatatattccaaccttttcaggtacttttccgttttgatgacacaccccatttaaaaagagcacagaaaccgttcagtatgcatagacttattttgtacgcataaaaaaattgggttgggttcaaatgagataaagttttctcatccttctgctattttgatttacttacacatattgaatgggtttgttgtgcttttttaaattggggtatgtcatcaaaatggaaaaatacctccttttcacatttactctagcaattttccacaaaatctcatttccaatttttgcgcttttcagaaaactcgcattggcgctgttttgaatgaattccgcaagaaaatcaaagacgaaaaattggccaaacgctgcaaggcattgatcaaggtttgtttttggatgagagatatgcacaaaaacaaaggaatcaaaaacattttaaacactcaaaattgtggcacaaaattatgagtttttaccgttacaaacattttgaatttgttgccagaaactgtgctctgagatttgttggcacaaactcgaaaatgcatccaaaatttgggtgaatttaggaggaggtctcgcaattttgaaaaaaaaacctgggcccaagttttattattcgattccttggcatgaattttggattaaa

SEQ ID NO: 56197 - DNA, 883 bp, Heterodera glycines
  misc_feature (840)..(840): n is a, c, g, or t
  Genomic contig location: Contig_ID=SeqID_25466; Location=39..921; Strand=-
  SCN-specific regions: Sequence locations=1-197,219-225,467-775,797-883
atggcgccactaagtttgaagggtgggagggggtaagaatttcaattttttaagaattttcgaaatttttttgttgaaaattacccgccgccgctggccctggtcattttcatcaaaaacattgtacaaatgatgaccatggaaatgagcataaaaatgccaaacagaaacaccatatgctccgcgggggcctcctcaaaggaaaccttaaaaattgcgaaaaacattttttttaaaattttatttgcaattagaaaataaattaaaaattatttattttttcaacatttaatgctaaacaaaaaatgaattaaccattttattcaaattaacaggagaatttaataaaatttaaaacaatttaaatatcaaataagctaaaaataatttcaaaaaattaatttataaaaaattcgtttttaaaatttaatttaatgctgaacaataaaaatttaatttattaaaacggagacaattttattgcctttaaatttgtcggttgagggggcccaaattttgggtacgatcgctgctgaaaaaattgagaaactgctggctttgcatttgctgaacctcggcttgggaggcctaaaaatttccaatttttcaattttttccattttaaatgggggcattttttcagcagacctgagaaattaatttgctgcaaattttcaagaaattcattttgtgtagtaaaatttgccaagccatcgcaaaatgggagcataaaaaagaaagcaattagagtcaatcagagattaattagcaaccgttaattattttttattttttacttttcaggcaaattgacaagttgtacaaattgacaacaaattntctcctcaatgtttgcttgagaagcacaaaaatgtgccgatga

SEQ ID NO: 56198 - DNA, 393 bp, Heterodera glycines
  Genomic contig location: Contig_ID=SeqID_25466; Location=1155..1547; Strand=+
  SCN-specific regions: Sequence locations=1-12,34-68,93-204,235 -329,377-393
atgaaagtgcgttttgagaaattccaacatttgacagtatgccttaaaaattacagtacacggaaaagtaaaaaattaaattttttaaaattgtaacagcaaaatactgtacaggttaagaaatgcattaaccatttgttaaataaatcaaaaaaaatgcattaataatttgctaattaaatcaaattacagtactcggatggttactgtaacaatttattgaaatccccaaaatttagctgcacgacatcagcgagctcgttatgctgctcgagggcgaagtttcgtttctgtggtgtcatcgagcaggcaaatgaagaaacagaaacaatatttattaatatttttaattgcaaaaataaaatttgtttaattactaatccaaatttttga

SEQ ID NO: 56199 - DNA, 413 bp, Heterodera glycines
  Genomic contig location: Contig_ID=SeqID_25468; Location=173..585; Strand=-
  SCN-specific regions: Sequence locations=1-341,363-388
atggagtgttcatcaactcacttggatgatgttgatcggaccagcaacttcgctgaggcattgcattccgtcacaaagtttggcggaaatttagttgcagtcatccaacaatttggtgcttcattgacacgatcagatgtgagcagaagacgattgatgccgacatggcagtttgtgtggtgggagaattcgaaccccaaaagaaaaggaagtatcatgatggcgatgctcaaattcttctcgtaaacagttataacgatctctcaataacaacctcgtcccaccaaatgatcataatcatgtcaatgtttatcaaattttatgatatgcaattagtttgctatggaattttgttgttttgttttcgtatatgttaatgaattttcgatataaattttataaatgaaattaaa

SEQ ID NO: 56200 - DNA, 479 bp, Heterodera glycines
  Genomic contig location: Contig_ID=SeqID_25469; Location=845..1323; Strand=+
  SCN-specific regions: Sequence locations=1-372,394-479
aaacaaaaaaatcgattttttcaagtgtccatttggggtactcgaacatttatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgcccagaaaacaaaaaaaatcgattttttcaagtgtccgtttggggtactcaaacatttatggggagcaaaaatccaaggcagaattaaagtacaggctatagggaagctattcctaaaggattcggtctcccccataaatctgggcgcatcggttcg

SEQ ID NO: 56201 - DNA, 827 bp, Heterodera glycines
  Genomic contig location: Contig_ID=SeqID_4921; Location=289..1115; Strand=-
  SCN-specific regions: Sequence locations=1-11,46-192,216-234,256-827
atggtaagacctttaaataaaaacagaaaaaattgttttataaaacaataatcttgcaggaaatcgtctcgaaaaataatccaaaaacccaattacggatcaaaattatggaaaaatcccaaaaatccgtaagccgtaatccatcatgacggggtccaaaaaggccgtaatttccgtaatccataattacgcccagccctgcatctgaaagccttgatcagcattacattcactaatgagaatttcttcaattctctataatttgtcaactataaaattccttaaaaatgtcgcaaaactgtttccatcaatgattctcccataccgtatttattccatcaccgatcgtactgtattccctccccccgtttggtcctatcgtatccgtccgatggtaacaccgtccccatttcctccgccgccgtccctttctttctgctgccgttgtggtgctgctgcttcaaatgtttgctcaaatagctgcgcaaagcgaacacgcggccgcactgctcacagtgccaacgcttttcgtctgacaaaaagccgacttttatttttggaattttttgattgaaacgccaaagtggggaatgaaggcactgattaaccaccggttgattgatggtcagtgctcagatcactgatcaccatcaccctcccccctctttttgagaattcaccccaattccctaattagggttattttttccctaaaatggaaaatccgagacgacaagcgacagctgctacttttgactgctgctgaccattggaggagcttggcggaagcgcattctatcaaagaaactgatcattggaaaaataaa

SEQ ID NO: 56202 - DNA, 981 bp, Heterodera glycines
  Genomic contig location: Contig_ID=SeqID_4922; Location=758..1738; Strand=+
  SCN-specific regions: Sequence locations=1-213,240-645,667-840,862 -949,971-981
atgaatgttaagggatttcactctcgattgactcataaaaacaggtagattttgaatttggttaccccacatttgcgcccaggacatttgcgccccagacatttgcgcctatgtccaaaatcggagtcaaacttattttttcaatccataatagcctaaacagcttaaaataagcgtttgaaagtgtttgtatgcgataatttgatcgtcaggaaatttttaaaaaataattaatttttcaaacaagcaaatcattaatcctaatgaaccaaaagaaccagtttctaaaatttaatgctgtttaagagctctaagactgaaaaatgtaagttcgaacccgattttagacataggcgcaaatgtcgggacacgttgaattttattttacgacaatttttttgtttgattcacttcgttgaattgatgatttcttcgccgaatttccatgcgatgacagtgtgccaatgctttgaatggacaagcggtggccaaatggcttttcacgccactgcaaaacaatgtgccaaaggtgttcaaatgctggttgaaggaggattattggcattttgcgtcatggattgaagccttcaaagcggtgcttacgaattgattatttggcatttttacagtcttttgggttcgctgacaaaaatattttggaaggcactttcaattcgtttttggcgacagttttttttacgaattcaaattgtgaaattttaatgctttttaatttttcacagtttttaactgtttttccatcattttagacatttgccaatgcttcttctcccgttaatttcattgtcgttattcgatctgaccaatgaattgactcgggaacaattgatgctgaaaaggaagaacgatattggccgttttcttctgatccgttacccgattgtgcgcgacccgagcaaatgggcaaaattcgaattccgtgacgcaatgatcagcccaagtgatcagcagcagaagtga

SEQ ID NO: 56203 - DNA, 565 bp, Heterodera glycines
  Genomic contig location: Contig_ID=SeqID_4922; Location=3852..4416; Strand=+
  SCN-specific regions: Sequence locations=1-2,24-530,552-565
atggccagacccaggggcagtggaagagacccattcaaagcacgcagtgccagggcaagacgtcgcgcgggcaacaaaagaaaggcggccgcagggactgctgcaaacgtgggttttattctgctgctgtgctattcggccttcaattgttttttcgtttcactttttggcacttttccagcagacagagcgaaggtcgaaatttcatttctccctttttcaggtgcaagctgccaacaggcgccccatttgtctgatctgcttgaagaaaatgacccaagtccgtcaggtgcgcaccatctgtgaccacgtgttccactacgtctgcttccaccgttggctcaaatatcgtctgttttgccccgtctgtctgctcaactttcgcacggaattgtatcattcgggaaacgccgtgtttgagggcgcgtacaacgatggacacgttgtgctcatacctgatggtgaacaaagcaacagtggataagtgatcggcactcatctccaattgtgatcggacaaaaacgatatctaattttgtattgtacataaataggttattcggaca

SEQ ID NO: 56204 - DNA, 1279 bp, Heterodera glycines
  Genomic contig location: Contig_ID=SeqID_4922; Location=2232..3510; Strand=-
  SCN-specific regions: Sequence locations=1-288,321-1279
  Gene Ontology: Mol. function=ubiquitin-protein ligase activity; Cellular component=proteasome complex (sensu Eukarya); Biological process=ubiquitin-dependent protein catabolism
atgacgtggacacagggaaaagtcggaaaagagagttgtttaaataggcaatgaatgaaagaggagggaaaaggactttttatagtacgacgcagcggggaaaggggcaaaatttccagtgcccaaatccaaatattttttctctttataaatggtgcttttctcatcggattgttttttttttctttgaatagagcagcaatctttgtattaaccaaattgcttaatttgtctcttctttgctcaatcctttgtgttccaaaattcctttttgttttacattttcgaccagcatattgtttttctcaggatttgcctggcctctatcacccatcctaaacttggaatttaatcaaaaaaacccaaaaaattgctttttccctatttgtaaaatttataattcatttcattatttatgtttttatgctttttcattttttagaacacaactatttgcgtttatcatcatcatcccttcattgtgcaacaacaacaacaacacttcaaaagcgacctcatcgccgtttctcatcgttcgttcgttcgtccgtccttcacatcaattcgctcgccgttttcgcaatggcacttcgacgcatcaaacaggtggcgaaatgacaactctctgatcagccaatgctttaaatgttttgatccatttgcaggaactggcggagctgaagcaggaaccgatcacgggttgcaccgcggcaccgatggatgacggcaaagacatgttccactggaaggccaccatcaaaggaccgcccgagtcgccgtacgagggaggcaccttccatttggacatcgttttccgtcgcgactacccattcactccgccaattgtcaaattcgaaacgcccgtttaccatccgaacgtcaacaagcagggtggcatttgtctggacgtcctgaagacgacgcagtgggcgccgtcgttgaccatttcgaaaggtgaaagcgacgcgggaaagagcagacaaaacgccgacaaaatattgagacgacaaaacgatccaattcaaaacgaccaccaaaaccggactttttggaaaagtgtcgatattttgtcgtgtgaatgggatttttcaaattcggaaatgccgttttaattcattgtctcccctccatttcagtgctgctctccatctcttcgcttctctgcgacccgaatccgaacagtgcgctggagatgaacatcgcgattatctaccgcaacgaccgcgagcagtacaaccgaaatgcccgtgaatggacgcagaagcacgcgatgaaatga

SEQ ID NO: 56205 - DNA, 784 bp, Heterodera glycines
  Genomic contig location: Contig_ID=SeqID_4923; Location=483..1266; Strand=-
  SCN-specific regions: Sequence locations=1-75,98-147,180-365,387 -501,524-688,710-784
atggacgaagaaccacgcgatgagatgacacgacaaacgaccgatggatgggagaggatgcagaagacaaccgccgaagagggaggaggaggaggatacattcaactgaccctattcccacatatgatcccaactgtaaagattgtattattgtatctcactgtatgtacagtattatgtcgcctggttactgtttaagcgaccataattgtctgttgttggttgatcaccattatcaatgtgttatgtctctgtgttatcatttcaaatgacttgtgatcaattgtttcgcctaatatgtattaactgtgatgaaacgtgaattttattaaagacctatagacctttttgattgcaaaaaatgtttccataataaatcatgaaaattcattcatggattttcggggttgctcgcatcagcaactggcaattgtctaaatttgttgtcccgataaaaaatagctagaattttcggctttccttagcagcgattttagggaaaaagttctgattaagaatatttcgttaaatgatttatcgaatctaaatttttcacattcattttttcaatggcggcgagaaagccacaaaacaaaggtgcggcgagttgggcggtgccctccacaaaatttagaaaaccacagccaatttaaaaatgcacattacagttttattgtccgaataaactatttatgtacaatacaaaattagatatcgcttttgtccgatcacaattggagatgagtgccgatcacttatccactgttgctttgttcaccatcag

SEQ ID NO: 56206 - DNA, 209 bp, Heterodera glycines
  Genomic contig location: Contig_ID=SeqID_4923; Location=402..610; Strand=+
  SCN-specific regions: Sequence locations=1-156,178-209
tcgactttcgcacggaattgtatcattcgggaaacgccgtgcctgagggcgcgtacaacgatggacacgttgtgctcatacctgatggtgaacaaagcaacagtggataagtgatcggcactcatctccaattgtgatcggacaaaagcgatatctaattttgtattgtacataaatagtttattcggacaataaaactgtaatgtgca

SEQ ID NO: 56207 - DNA, 304 bp, Heterodera glycines; identical to SEQ ID NO: 51570
  Genomic contig location: Contig_ID=SeqID_25472; Location=461..764; Strand=-
  SCN-specific regions: Sequence locations=1-304

SEQ ID NO: 56208 - DNA, 185 bp, Heterodera glycines
  Genomic contig location: Contig_ID=SeqID_25472; Location=841..1025; Strand=-
  SCN-specific regions: Sequence locations=1-185
ctaaatataaaaatcctctgtgaaataaaatggcgatcgcaccagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatg

SEQ ID NO: 56209 - DNA, 572 bp, Heterodera glycines
  Genomic contig location: Contig_ID=SeqID_25474; Location=302..873; Strand=-
  SCN-specific regions: Sequence locations=1-237,357-535,557-572
atgcccctcatcatttatttttccgttctttttttgcttttaattccaatttgcaatattgatataaaggaatggaaattcttacagtattacattttattgtcatcaattccaatgtttttaccctctgccataaatccaattgtttcaatttgcaccatcaaatattaccgttacgaacttgtttcgggattaaaacgttcttctggtaagtgtacaattagtttaaaagcaatgaaaattaaattttttggatttaaaaatataatttttaataaataaactttattttttaccattctaattttcattttttaatctacattaaaattttgttttttaattatagaaaaattcgtaaagcttttctttcgccaaaatattcatcctcaaaatttgaatgaaactgcgcacaaagaagaccaagcaaaatgggctaccaatgttgcaaataattgaagcaacatatttccaaatattatattgattcagttgataacatacttcatcaagctctttaaatttgttaaatatcaatttaaaaaatcattaaaatcaaaatagtgaataaa

SEQ ID NO: 56210 - DNA, 821 bp, Heterodera glycines
  Genomic contig location: Contig_ID=SeqID_25475; Location=81..901; Strand=-
  SCN-specific regions: Sequence locations=1-238,260-353,375-379,439 -669,693-821
atgccattggacgaatgtgtcggatgtcattgggacaactatggatacaaaagcaatggcacttttgagaccagtgggtctgtctggctaaacgaagaacgttatgaattttctcgtggtgataccattggatgtggggttaatttggcctctcgacggatcattttcactcataatggacgacaattaggtagaaaaatgtgtggttggccaattcacaaaaaatgcgcaacttttgaaattttttaaatattttaaagttcacattacagcgcaagcggtgttccgaaaagccagaagcatgggcatttttaatttattggacggagatgacgacgaagcaccggttcaaaggaaggctgttcacaaaacattcaggtgtctttcattagctcatgtgtatttatttgtttttccaaataagatcagttctctctttggcactcattccgccactttacgttcggcgagctttttcaactattgtcagcgcggcaccgcctagagttcaaggatggctggcgtattttggcaaaacctacattggcaccactcaatttgagattgaccatggagcggaggcatttgaacccaatgctgatgtcggacgcttctttctacgtcgcactcaaagcacaactcgtaagcgcatatatgtactgtttcatgataattaacataattttaaatgatttagcgttcagtgtatcacagacgtccacaatagcaggcagtggaccaatacaattcggactgcattcgccacaaccatcaactccgacaatcccattgtccgaagaaagcagcttgcagcttattag

SEQ ID NO: 56211 - DNA, 101 bp, Heterodera glycines
  Genomic contig location: Contig_ID=SeqID_25477; Location=1440..1540; Strand=+
  SCN-specific regions: Sequence locations=1-101
atggcacacgagtgctacggctttggcaatgtgcgagcaattaagcacgcacatcgggccagatgctggggcatttgtgctgcaccgcaagcggcgcataa

SEQ ID NO: 56212 - DNA, 769 bp, Heterodera glycines
  Genomic contig location: Contig_ID=SeqID_25479; Location=936..1704; Strand=-
  SCN-specific regions: Sequence locations=1-15,87-120,142-167,196 -369,429-447,489-490,512-537,676-769
atgagagatgggtacattttataattgaatatattttaaaattttaacataaacaatataaaaaataaataataattgtaaaaaaagattgaatggcccaccaaattgagaatattaattaagaaaatgtttttaaaaaataagacagcttcacaaacgaaacaatgaataatttacaaaataaaaataaaaaatgcttaaaatgaagatgaagaataatttgaaaagaaattaatttttcatatttttggcaacaaataatagaaaataacataacgaattaaataaatttaaaaatgctgctcatcaaaatagaaaaaattatgatatcccgagcgagagaattgaacctaggcttttaaccgaaacaaataaaataattgatttatttagaaaagaacaattaaaattatcaaaattattttatactaattacagttaatcatattgaatatacagcaatgttaacaataaagatgtattatgaagatacttacattttataaataaaattgaaagttggtactaagaatgaactaaattaatttaaaaaagaataatagtagaataaatagtattatagaaattaaaaatataaaaattaaataaacataaattttctttgagaaagaaaaattaattatgaaaattttcaattatttttttaatattttacattcaaatttctagaacgttttactctaatttcaaatgtgcgagtattatgtattcagttataaaagaagcaaaaatcctgttctaaaataaa

SEQ ID NO: 56213 - DNA, 771 bp, Heterodera glycines
  Genomic contig location: Contig_ID=SeqID_4924; Location=852..1622; Strand=+
  SCN-specific regions: Sequence locations=1-94,116-487,511-643,665 -687,709-771
atgttcgagtttcgcgttagggattctgaaattcatcaaatagagttcatattcatgatcagcggccacaaaagcccctggaaacacgtttttatcattaaatcaaaattttttatgtgggtcaaactgtataagtacccaaatcctttatccatttcgaccaattcagaaccctgggcccgaattcagacaaaaattcaaatttttcgagtttcactctgtttccttgaaattttatgacaaaattcatgatttttttaagtttggaaatttagaaaataaattcgatagggaaatgggacgttctgtaatactcatctcaatttgtcttaaaattgttgctgaatttctttctcattttacagtgtctcttcgaagttgccttcattcaactggactgttccgacaatttctctgttcaccaatttccctgtcaaacaattgaactgcgcgcccgactggtaccggagcgagtttcgtcctgctgccgctgcttctgttgctgctgattatgtggagaaaaaaataccgatgacgccgactctgttgttggcacttttgctgccgttggccttgtcaaatcggcaaatgtcgtggtccgggacaacgatggaatgtgcgcacgttttttattttgtgacttattccccacattgcagtttgttatgcaccgatgttttgatggacaccttcccatttttggacccaactcggccacaaaatggcactgatttcgccacatttcgactttttagtcgacgcgcattttga

SEQ ID NO: 56214 - DNA, 1499 bp, Heterodera glycines
  Genomic contig location: Contig_ID=SeqID_4924; Location=2662..4160; Strand=+
  SCN-specific regions: Sequence locations=1-228,250-400,422-468,490 -1120,1144-1295,1317-1356,1400-1400,1441-1499
atgtcctttttcgaggtctttgctctttgtgctcgtccatttgttgggaaggcacgcattttttttgtgctccgtcgtaacacaacaaaaggcttcggcggtgaattggcgagaagaagcaattgccgcatacacaattatccaaacggggatggagaattgtatcccaaattcaaaatctaaacaatttacttttacgattttaaagtccgaggcagcaaattaaatacagagcagaaaacaaaacgaagaaatatcataaaacaaaacgaatgaatgagggaataacaaaatatgtatttacataaaattggcagccctattaattaattatataagcaccgctccattttttgcgatcggcaaaacattggacggaaatgcggacaatttgtcgaacaaaaagaaaactaagccaaacgcggcaacggcgccgccccaacacattgcattccattttggaatttttaatacatttttgattaaataattccgacctcaactcggcctcaaattggcactgctttctcctcgtttcgatgttttagtggacaaacattttggtggaaaatgcgaattgataatttggaggccaatcaaaatttccgctgccaaacaaaattcgctttaagaacttcaaattacgtaattcaaaaaaaagcacagcaagaaagcataaatgttttttaaggtacattgaccatttcgtcatcgcatttctccgctcaaataaacaaatttttgacaacggaagaggcaccaatttgtatttaaatgtgttttatcatttcaacaggaaacgtgtccagcgaattttggatgatgtttttctcagtgaaattttgcccatttttgcgccaaacattcgtcgtttggactttccaaatgacgatcatctgcgtcatctccttcgaatcagttcgccgtcacttctcaccgatctcaatcagttgaattcaatcgattccgattatctggtgcctgctgctgccattgatgattttgatggacaaaatgcaacttctgctgaacaagttctgtccaaatggttgcacacgccgagaaaagacgggcagccgaagcgattgcgttgttgtattggttgtgcattgcaaacgaaaaaatggatgaagaaattcaagcaggtcgccccaattttctttcgacattaattctttccttgttgtaaccaaacaactgaattctaacaaaaagtcgaaagtatctcttattaaaggattgattttgcacacttgacaatgttacttttaaagaatatattaattttttttcctttgactctaattttcatcactaatttttcactcagacccccattcttaccagtgcttgtttttcccggttgccctaccgggaccgggacctgagcttttcaaaatccgggacctcggatgaccgggaattcccggcccggtcccggtcccgtggcactctactttaaatcttaaacattttttcgaaaaatcctcatttttgca

SEQ ID NO: 56215 - DNA, 1504 bp, Heterodera glycines
  Genomic contig location: Contig_ID=SeqID_4924; Location=4854..6357; Strand=+
  SCN-specific regions: Sequence locations=1-146,168-185,207-228,278 -486,508-558,581-608,637-712,734-838,860-870,895-895,922-957,1037 -1132,1318-1460,1497-1504
atgggcgatgaagcgatgcccaattggacaaatggttcagtgggaagagctgaaaatttggacaatttgaacaatgtcagcattatttttcgtggtttcactaattgcattgggtgagcagaagcaactgtattgtgtactgtattgaaaagaattttaaaaaataagtacttgaatatatcttgaaattttttccaaaaagaaggacctccatcagtaagattactgtttttattgaaaatttaattaatattttcaattttttttcaatttatatgtttttgtcggaaccgctcagtttgcgcgcatggttgggcgccagcacgtttttctactataacttttttatttattatccaattagaatacctgcaactgccgacacttgaaagcaggcgaaagctttctgatctgttcatggctcataaaataatttatggccgaacagatctagatttatttaaaattttcaaaccttctaaacgctttaacattcccttttatagacttaactcgaaatataaattaggcaaaaaatttataccttttgcggggcgggtaacaaaaatttggaaccaactcgataaaaagcttattgaaataaactcattaaatcaatttaaaaataaattaaaactatttcatttctgtaagattgaccggaaaaataaaagtcgaattattaattcattaaacaaaaagtgatttggtcattatttttattttttttattgatctcacattatattttattttttggcggcgatctcgtttttaattgtttatgcgctttcttgaggacattttaattaatgttttgccctcaatgtaagcggatttttcccttttgtggactttttctttattgacaaataaataaataaatataaaaaagttgtaaagaaaaaatttcaaaatttttgaacttttgcaattttcgtgtatttttaggtctcgaataaaataattaaaatttatctaatattttaaataaattattaaccgaaattacttagaattttataaatattttaaagtttcattggccccataaattttacaaaataaagcctaaacataggcctaagtccaagcaatttagcttgagatgaagcggatagaaatattttaaaatttgatttttattttttaatttagtccaattataattgaatttgaaatttcaaaataatctggttattattttatttaatattaggtaaattttaactattttattcgagctttaaaaaaacttttagaagaatgtttatttaagtatcaatttaattaaatgttaacatattttaaatttaaaaaaatgataaaaaatcataggaaaaaattgatttttgaactttttaggaatcgaccaaccacagttcataatcatctttcacgaaaaaaagtttcaagccccctaaaaatttttttttctgaaagttttctggttttaagccattttaaataataaaaaattttcaaattaatttttaggtaatta

SEQ ID NO: 56216 - DNA, 634 bp, Heterodera glycines
  Genomic contig location: Contig_ID=SeqID_25483; Location=191..824; Strand=-
  SCN-specific regions: Sequence locations=1-116,146-164,187-384,427 -581,621-634
aaattcaaaaggtccaattcgatcagcggatgcgacagcgaacggaagccgctgattgagtggagcaacgaagaagagatcagcacaacggaggtggagcccgaactggtcagcagaacaacagcaaaaacaacaaaatgccaaggccaaaaagaaacggaggcaaaacaaattcaaaaattgatggacgaaaagtacaaaagcagagctttaatggatggactgaaacagtcgggactcttatgagcatttgaccattcgagattattgaacaattttgaacagtctattttttgtacatttatgcaaagcaatgtaattgagtgtttatttatgcaattattgtgtgtaaaagtaaatttattaacgatctgccaaagacccaaaaaattatatttcagaatttataaatattaatttaaaaaagaacattaaaatggccgtgccgccacaggcgatttaaagtagtgcagcgggaccgggaattttgggcaaaactgggaccgggacttgccgggacctgagaagccgggaccgggacctcgattttttttcgggaccgggaaccgggaccaaccgggaaattttaaaaattcaaaaaaatttattttaatttatttcaattgaaaataaa

SEQ ID NO: 56217 - DNA, 221 bp, Heterodera glycines
  Genomic contig location: Contig_ID=SeqID_25486; Location=1313..1533; Strand=-
  SCN-specific regions: Sequence locations=1-221
cggtcgacagtcgtggtcagcagattggccgaaatctccgcgtcgctggaggcgatgtcctccttggccaggattatgttcgccattgcggacaacaaatacgaaaccaactcgccgacacaatgcgtcagcacgaaatcggacagcacctgggaaaatgcggcaaaattgatgcgtttattggcattttattaagaaattcactcttttcccacacctct

SEQ ID NO: 56218 - DNA, 442 bp, Heterodera glycines
  Genomic contig location: Contig_ID=SeqID_25487; Location=158..599; Strand=+
  SCN-specific regions: Sequence locations=1-251,283-442
agattgccactccgttgcgttatgcctgcactttggtcggcattcgtatcgctttcaacactttgcgtcgtctgggcaaattgcgcaccacgcgcgagattgacctgacggtgcgccaacggctcgacctgctcattgagcaccgggatcagaaacggagtgccaaaagggcggtacggcatcagaacagttgagttttgccatcattcgcaggagcagatcgaaatatctgtccagattcaacaaatctctaaaaattcaaaaaaaaatatatatttttttcgactacggatgggccacttttgggacttgtgattttcccccaaaaatcactttagatagcatgaagaggcattcactgtgttcctcgcggacgaggacaaagttggactaattagtgcctttgaacttattgttgtagcatagagaactgctgaccgac

SEQ ID NO: 56219 - DNA, 653 bp, Heterodera glycines
  Genomic contig location: Contig_ID=SeqID_25487; Location=984..1636; Strand=+
  SCN-specific regions: Sequence locations=1-179,203-653
atgagcgctcggcgtgtgctggtcgctgttggtcagctgaatgtgcagcacgacttgcagcagaatttcgagcgatgtgcgcggatggtccgacgggcgggcgaacggaacggctgtaaggtgggaggactgaagaggaaatggtgaaaataaatggacaggaaggaaacaagcgatcccacagcattcaaaaattaaacattttcttcatgaaaaaaaactttgtaagccggggaataaattgaaatttctttgagttagctataaaagaaaatgtattcagatggttttcctgcccgaatgcttcgattacattggccgtactgttgccgaacagattgaccaagcgctggatacccgtggcccatacattggtaaattccgcgagttagccaagcagcatggcctttggctgtctttgggtggcttccatcacaaggtgaatttgttggattttcatgggtttcatttccgggaattgaatttttcagcgtcccgaacttcggtccgaccatttgccccgaaatacgcatttgctgattgactcggatgggcaaacgcgcgccgaatatgacaaactgcacctgttcgacttggacttgccgggcaaagtgcgactgatggaaagcgaattttcttcccacgggcacaaa

SEQ ID NO: 56220 - DNA, 408 bp, Heterodera glycines
  Genomic contig location: Contig_ID=SeqID_25488; Location=158..565; Strand=-
  SCN-specific regions: Sequence locations=1-134,158-174,196-408
atggccaccatcatacatttggccgcaatttatgagcatccggccattttgcgagctttgctggaccaggacgggagtcacattgacgcgcgggatagcgtaaactttaaaaatttcatttttttccgttcgtcaattaaaaatttaaaaatttccctttttttcgtgagggtcaattaaatttttcaaaaattttcttaggagggccgtacagcgttgcattatgccgcggcacttgcaggaacattgcgcgaggatgacgcggacggaagcggcggcgacgacaaagagaagtcgcgcgatgctgcggagttggaatgcttcgacattttgttggacagcggggccaacgaaggccttttggatgttgagggtcggaaaacttggaaaaatggaattttgatttaa

SEQ ID NO: 56221 - DNA, 677 bp, Heterodera glycines
  Genomic contig location: Contig_ID=SeqID_560; Location=104..780; Strand=-
  SCN-specific regions: Sequence locations=1-116,143-406,431-677
cggacgattttgacaatgccacggcattggccgaccatctgaaggcattgcacaaggacaaggaccgatatttggggtcagtatttaatggacaaaagggtcaatggcaaaacttataaattttaaaattgttaaaaatagtataatgccattaattgccaacaaacatttcgccaaaaaatgccttttaatttttaagatatttcaattggacaaaattctaccagaagcgatgggtgccgactgtgaagacttccgccttttgtcagctgtgtgaaatggtgcaccaccaaatggaggagggcggcgaatttgtgggccgaaattacacagtgaaatcgcacaaaaaattgtggggagctcaaagatgtcgggagaattatgtgcagaacgactccaaaacccccagaaaaaatttaaattttgtgatttttgtgtctcaacccaacagcattccaaacaatggactcaaatctccggcattccaaacactgggactcaacccactaacgttcaatgacattccaatcactgaaaatcaacccatcagcatttcaatctctgaaactcaattctcaggctttccaatcgctggagctcaacccaccagcatttcaatcgctggaactcaacccaccagcattccaaacaatggactcaaagctccggcattctaa

SEQ ID NO: 56222 - DNA, 1155 bp, Heterodera glycines
  Genomic contig location: Contig_ID=SeqID_562; Location=4149..5303; Strand=+
  SCN-specific regions: Sequence locations=1-426,656-693,717-952,981 -1039,1073-1155
atgtacaactgtgataaaaagggtacaacagtgattaaaataggtacaacagagattagaagaggtacaacagagattagaagagttacaaaaatgattagaagaggtgcaaaagtgactaaaagaggtgcaacagtgatcagaagaggtaaaacggtgattagaagaggtacatcagattagaagaggtaaactgttattagaagaggtgcaacagtgattaaaagaggtacaacaatgatgagaagaggtacaacagtgattataagaggtacaacagagattagaagagttacaaaaatgattagaagaggtgcaaaagtgactaaaagaggtacaacagtgattagaaagtgggcattcaaatagagcatttacggtaattaaggaattgtttttattcaaaatagataaaaaatcgatgtgttatatttttcattttttaaaatattatacactttttattaatgaaaaacaaattatgaaatgtataataattgaatagttatttaaattgaaatgaaaaaaattttacaattaaattttaaaataatagctgaaattctttaattaaatataataaataatttaaatgaaaatcattattcatcaaaaaataatttaattaaactaaaaaaatttattattaataaaaccaaacatttaagtttattaaaagtaatgaaaattaacccaaaaaatacaaagaaaaataatgtacaccgtccggcttcgaactttgccccccccccccaaaaaatgatgcctcagaatccccaatcacacagggatcctgaggtcttaacgatgtcaaaagtaaaatctgatcacgtattcgtgatcagcggcccaaataacccctaaagacatgttttttgaagatttttggtgaaaaaatttttcaactcaaaaatcctatgctcacccctttggtcccgaatctcaaaatcacttttatttttataaaaattcttaaaaaagtgatacaaatgccaaataaaatttatacaatagagaaaaaaactgcggatttttgtagtattttatttttccagaatatcttttcagaaccgagttatgaatttttttctgaaaattcgaatttttccagaaattctggaataacttttttccttttttagatagaaattccaa

SEQ ID NO: 56223 - DNA, 155 bp, Heterodera glycines
  Genomic contig location: Contig_ID=SeqID_562; Location=1692..1846; Strand=+
  SCN-specific regions: Sequence locations=1-155
atgattgcacagaattgccgaaaaaattcgagaccaatttccgaatgttgaccgactaattgcaaaacgaaagccgtctttgtcaaagcgtcttaccgagtcaaaaaatttggaaatgtatctcatatgcaatttcaatcaataaatttgaagaa

SEQ ID NO: 56224 - DNA, 4198 bp, Heterodera glycines
  Genomic contig location: Contig_ID=SeqID_562; Location=3209..7406; Strand=-
  SCN-specific regions: Sequence locations=1-553,575-575,689-714,739 -963,985-1655,1707-2082,2104-2186,2220-2278,2307-2542,2566-2603,2833 -3245,3267-4198
  Gene Ontology: Mol. function=DNA-directed RNA polymerase activity; Cellular component=nucleus; Biological process=receptor mediated endocytosis
ttttgtacctctactaatcactgttgcacatcttctaatcactgttgtacctcttctgatcactgttgaacctcttctaatccttttgtagctcttctaatcacttttgtacctcttttaatcacagttgtacctcttctgatcacagttgtacctcttctaatcacttttgtacctctactaatcactgttgcacatcttctaatcactgttgtacctcttctgatcactgtttaacctcttataatccttttgtagctcttctaatcacttttgtagctcttctaatcacttttgtagctcttttaatcactgctgtacctcttctaatcactgttgtacctcttctgatcactgttgcacctcttttaatcactgctgtacctcttttaatcactgttgcacctcttttaatcactgttgtacctcttctgatcactgttgtacctcttttaatcatcgttgtacctcttctaatcactgctgtacctcttctaattaccgttgtacacctcttttagtcactgttgtacctctacctcttctaattaatgcattttaagttattttcaccgttttaaattaattttaacctttttgttttattaaaaattaataaataattttaaatttaaattaaattatttttgatgaataaattttttgtttcaaattaattaattttattgtccataatttgtatttttttatatgccatctgtttatttcattctcatgtttgagatggtgtgcgttattgatttactcaacttttacgtctattgaaaaattgatttttaccctttgtttgtgtaagtaataaaaacacagtctgataatgccttacttagctttttttttgcaaaaaattttttgttttaaaatatccatattcattttttggcttttttcatgcaatttttttcacttttttcagctttgtatgcaacgatatttctgatggatattttcccccttttggaacgttctcaactcgaactcaaattggcactgatttcgcccctttctatgcgctggtcgacaaacatttcgatggcgaaagtggattaagtcgtaagttttattttttttttaattgaccattaaaatattttctaagctctacaatttttggtttgcacttaaaaaaagtgaaatttttttaggaattttctattattttgaatttttcaaattatgattttttgttcaaatttagattaggaaatcggaattgatcaaaataattgaaggattcgtgatcggggaccccaaaaaccccagagaataaatttttatgactatcacaaaaaaattttgcaaaacaaaagtgtgtccccccttttaaaaaattttcaaaaaggcccacttttaatatagcgccgaatattttttaagcagtttgtgcccaaacgggggcctacatttcaaaattgctctaaaaataaaaattttccaaatttggcaattttttaaatttatttttgtaaatgaatatggcacttctttcgccatgtttcgaactttggtggacaaacatttcgatggtaaagagtgattgttttttatgctttttgttgttttttaaggattttgtacgaaaaggggcctccaatttcaaacactttgcctaaaagcaaaattcggtttttttgtaaatgtgaactattttagtgtttttttttttttttttgtaattttatattcttaagattttcagcaaccgccaaaatgtttggatggacattttccaactgttgaccatgctcaacttggcctcaaattggcactgctttcgcccgtttcgatgtttcagtggacaaatattttgatggcaaaaaaagtgattttttaggggtttttttaaggattttgtgcgaaaaggggcctccaatttcaaacgaattttgcttaaaagcaaaattcgggttttttgttgtaaaagtgaacttttttaaaaattcgaaaatatttttcaattttttggtccttggaaatttgggttaaaatttgaaaattcataacaaatcgaagggttgatcaattttacaggaataaagccttaaaaatagagaaaaatcaggagaattttatggactttatttggaatttctatctaaaaaaggaaaaaagttattccagaatttctggaaaaattcgaattttcagaaaaaaattcataactcggttctgaaaagatattctggaaaaataaaatactacaaaaatccgcagtttttttctctattgtataaattttatttggcatttgtatcacttttttaagaatttttataaaaataaaagtgattttgagattcgggaccaaaggggtgagcataggatttttgagttgaaaaattttttcaccaaaaatcttcaaaaaacatgtctttaggggttatttgggccgctgatcacgaatacgtgatcagattttacttttgacatcgttaagacctcaggatccctgtgtgattggggattctgaggcatcattttttggggggggggggcaaagttcgaagccggacggtgtacattatttttctttgtattttttgggttaattttcattacttttaataaacttaaatgtttggttttattaataataaatttttttagtttaattaaattattttttgatgaataatgattttcatttaaattatttattatatttaattaaagaatttcagctattattttaaaatttaattgtaaaatttttttcatttcaatttaaataactattcaattattatacatttcataatttgtttttcattaataaaaagtgtataatattttaaaaaatgaaaaatataacacatcgattttttatctattttgaataaaaacaattccttaattaccgtaaatgctctatttgaatgcccactttctaatcactgttgtacctcttttagtcacttttgcacctcttctaatcatttttgtaactcttctaatctctgttgtacctcttataatcactgttgtacctcttctcatcattgttgtacctcttttaatcactgttgcacctcttctaataacagtttacctcttctaatctgatgtacctcttctaatcaccgttttacctcttctgatcactgttgcacctcttttagtcacttttgcacctcttctaatcatttttgtaactcttctaatctctgttgtacctcttctaatctctgttgtacctattttaatcactgttgtaccctttttatcacagttgtacatcttctgatcactgttgtacctcttctgatcactattgaacctcttctaacaccgttgtaacgggcgcgaggcgcccgtccgatctcaacaaatttaaaaaacgggcgcgaagcgcccgtctgaggccgcaaagcggccgaaaaggcccaactaaatttaaaaacgggcgcgaagcgcccgtctgagcttaacaaatttaaaaaacgggcgcgaagcgcccgtcaaagcaaaacaaaatatgaaaaacgggcgcgaagcgcacgtgcgatctcaacaagtttaaaaaacgggcgcgaagcgcccgtctgaggctgcgaagcgggcgaaaaggcccaactaaattgaaaaacgggcgcgaagcgcccgactgaggccgcgaacggcataacaagctaaaaaacgggcgcgaagcgcccgtatgagtttaacaaatttaaaaagggagcgaagcgcccatctgaaccaacaaaatttaaaaaacgggcgctaagcgcccgtccaaggccaataaaattgaaaaacgggcgcgaagcgcccgactaaggccgcgaattgttgtacctctctcttttaatcactgttgtaccttttctaatcgcttttgtacctcttctaatctctgtagtacctcttctgatcactgttgtagctcttaaaatcacagttgtacctcttctgattacttttgtacctcttttaatcactgtcaattttttaaaaattagaaacgggcgcgaagcgcccgtccaagcccaacaaaatttaaaaaacgggcgcgaagcgcccgaaaaacccctaacatgcttcggattctgatcagtgttgtagcacttttaatcaccattgtacctctcctaatcacagttgtacctcttttaatcacagttgtacctcttctgatcactgttgtacctcttctaatcactgttgtacctcttct

SEQ ID NO: 56225 - DNA, 517 bp, Heterodera glycines
  Genomic contig location: Contig_ID=SeqID_562; Location=6947..7463; Strand=+
  SCN-specific regions: Sequence locations=1-471,502-517
atgattaaaagaggtacaacagtgatcagaagaggtacaacagtgattaaaagaggtgcaacagtgattaaaagaggtacagcagtgattaaaagaggtgcaacagtgatcagaagaggtacaacagtgattagaagaggtacagcagtgattaaaagagctacaaaagtgattagaagagctacaaaagtgattagaagagctacaaaaggattataagaggttaaacagtgatcagaagaggtacaacagtgattagaagatgtgcaacagtgattagtagaggtacaaaagtgattagaagaggtacaactgtgatcagaagaggtacaactgtgattaaaagaggtacaaaagtgattagaagagctacaaaaggattagaagaggttcaacagtgatcagaagaggtacaacagtgattagaagatgtgcaacagtgattagtagaggtacaaaagtgattagaagaattttttaacaaatttaatttaaaaaatacatgaaattctatcaa

SEQ ID NO: 56226 - DNA, 938 bp, Heterodera glycines
  Genomic contig location: Contig_ID=SeqID_563; Location=26..963; Strand=+
  SCN-specific regions: Sequence locations=1-471,627-938
atgattaagagaggtacaacagtgatcagaagaggtacaacagtgattaaaagaggtgcaacagtgattaaaagaggtacagcagtgattaaaagaggtgcaacagtgatcagaagaggtacaacagtgattagaagaggtacagcagtgattaaaagagctacaaaagtgattagaagagctacaaaagtgattagaagagctacaaaaggattataagaggttaaacagtgatcagaagaggtacaacagtgattagaagatgtgcaacagtgattagtagaggtacaaaagtgattagaagaggtacaactgtgatcagaagaggtacaactgtgattaaaagaggtacaaaagtgattagaagagctacaaaaggattagaagaggttcaacagtgatcagaagaggtacaacagtgattagaagatgtgcaacagtgattagtagaggtacaaaagtgattagaagaattttttaacaaatttaatttaaaaaatacatgaaattctatcaattaaaaaataattaatttaaacttataaaatttatttatcaaaaaaaaattaaattaaatataattttttatttattaactcaacaaaatattttaaattaattaaaatcattgaaaataacgtaaaaatgcacagaaaaataatgttacaccgtacggattcgaacttcccccccccctcaaaatgatgcctcagaatccccaatcacacagggattctgaggtcttaacgatgtcaaaagtaaaatctgatcacgtattcgtgatcagcggcccgaataacgactaaagacatgtttttggaaaatttttgacgaaaaaattttttcactcaaaaaccatgtgctcccccctttggacccgaagcacaaaatcacttttatttttatatctttttttaaagaagtgataaaaataccaa

SEQ ID NO: 56227 - DNA, 983 bp, Heterodera glycines
  Genomic contig location: Contig_ID=SeqID_4925; Location=80..1062; Strand=+
  SCN-specific regions: Sequence locations=1-340,388-403,425-498,520 -896,918-983
atgggcgtcttccaacattgtatggatgaagcaattattgacagccgtcaaagtggagttgaaccgactcatctcggatgtattgtttctagccagaacctttcttccgacatttggatccccattcggcagcttactcctgacaccattaacacaatactaaatcgcttcaacgacgttgcacagagcaaaaaacaggatgatgtgacgctgtggggtgaaccatttactgttacagtaacaacacttaaccgtaatgctctaccggcgaagcgtcaactgaaagggggagtagcccggaaattagcaccagttcaccacaatattcatccaaattgtcttattaaagttaataatttataatgtcttaattaaaaataaattttagatccaaaattttgatgatgacaattactgtttattttacgctatccaagcaaccttggttcgatcaattggtgacttggatcgtcgtcgctttcatgattacgtcaatggaaacagtgaaatgagaggaaaacttaaaaatgatgctttggaaatgatgaatgctgttaacgcaccagctggtcaaccaaattacgatgcggaagtatatgtgccaagaattgtggactggtggaatggggaaaaattcgtgggccaatggaaattcaaaacatttctcttcggatcagcaggccattacaagcctttattcaaatatggaccagaggactatgttgtgccgatcatcctttacttcgaagaggaacattttaatggtgtgcagaaaagtggcaatttgttcggcaaaccatattgtctaagttgtgaaaagacttacgatcggccaaaacgtcacattgtcaattgcaaagcccgctgcattaaatggtaataaacaattttaacaatgaattaattatttttaagctcccaattgggtccaatatttccatgcaaaccaaataatggattccgacaaaaatgcaaagagtgca

SEQ ID NO: 56228 - DNA, 2474 bp, Heterodera glycines
  Genomic contig location: Contig_ID=SeqID_4926; Location=379..2852; Strand=+
  SCN-specific regions: Sequence locations=1-174,197-301,325-781,806 -992,1014-1037,1066-1370,1406-1697,1720-2018,2057-2163,2191-2474
atgtttggcttggacgttcaagacaagccgttctttccacatttggcaaacaggccggaaaattacggctgccaaatatttcctacgaaatcaaactatttggccggtgggataaatcctgagaagcgtaaagaatttgacatttggtatgctcaaaaccaaaatcagccgtttctgcttgatgaagcattggccaggtattttttataattttttgaaataaccaaattttcagttattgtaaaaatgacgtggatattttgatggctggccttatcgccttcagaactgaatttttggagatgagcaagcgacctgctgatcccgacggaaaggcaaatcgagcaacttacacaactccacacaacggaattgacccgctcaagcattgcataacaattgcatcagcatgcatgcgtcatttccgaactaatcatttaaagcctggtcacttggctcttgttccggaaaaaggatacgatagctgcggcgacaatcaaagtgatttggcaatgagttttatgcagtggtacaccgaaaaatatgcggttcggattcaaaatgctttttcggctgaaggagagaaaaggtaattttagagtggggattctgagcaaaagttattctcaagagttggcaattttcgtttggacggttggattgagtctcaacgaaaaggactagaaatccatggctgtgtatggcatgcatgctcaaaatgttatccggatgataatgatgtaatgccttgtggcaaatctgcaggccgaattcgagagagaaacaaacagagaatggaatttatattgaccaaagtgccaaatgtggaaatcttttggcaatgtgagattgaggaaatgctgtccaaggacagggaaatgaagcagaaattcaaagaatatacgggagatggcgggccaatcaatattcgtgattgttttatgggtggaagaacaggtgcattgaagctttatcacgagttggcagcggacgaagaaatcagttattatgactttaccagtctctatccattcatcaagtaaaattgaaaattttattttccccaaaaaaagttatagttgtgtaacttattatccggttggacacccaacacttcatgttccgtgtgaggacgttgattggcggagaccagaggacaatccatatccgcttgcaattctcaaagttttcgtcattccgccacaaaaaatcgatgttccggtattgccagttaaagtggatgatcgactatgcttcccactctgcatgagttgttgcaaaaaatgccctaacggaggtgtaagggaaacatacaattgtcaacacacataagcaaagaggatggatcagtacatgcacatcattggaggtattaaatattttattatttttattaatatttttagcttaatgccgcactggaggagggatacagagtcaccatgcttttacgcgtccttgaatacaacaaaagtgacaaccaactttttcgatcatacatgagtgaatttatggcccaaaagttacatgcatcagggtttgatgaagaaattcgcggaaattctgaagccgaggaacgattcataaaggagtgccgggaaaaatttgacataaaaattgaccgagcaaagatgataccaaacaaggggaagcgagccttggccaaattagctgtgaacaatttatgtatgttgtataaaaacccaaaattttttaatgataaatttagggggtcgtttttccctccgtaattacggactctcttaaacttttataactgatgatccatcagagctgggaaattatcttgacaatcggaagatcgaagtgactgggctcgacatgttaactccggagcggattttaatcagctacaatcagaagaaggattgggttcaggaacacccctgctccaacgttgtcatttcacttttcacaacttctgcagctcggctgcacttgctaaaagcaatgcagaaagtcgcgcgaacccctggttgtactattttatacactggtaaatataatttattaatgaaaaaattaaaatttttaagatacggattcgttgatttatgttcacccaaaaggcgcaaatcctttgaagacgggtcctcacttgggtgagtttacggatgaatttccaaaggtaattgatttttgattttaaagaaataaatttaaattcagcatgacattttggaatttataagtggtggagcaaagcaatatggtctgaagcttcggaagaagggcagcgaaaatgagtttgactacgtgctcaaacttagagggataaccctaaattatgatgtgaccaaaaatcaggggctttgttacgacactttcaaaactcgcaccacttcaaaaagtatataaaccatatgttggcaaagggattgtttgctctcgtgattttcgtgtgcttgattttggttattccactcattgattcgttgtataaagttgaaaaa

SEQ ID NO: 56229 - DNA, 540 bp, Heterodera glycines
  Genomic contig location: Contig_ID=SeqID_4926; Location=2973..3512; Strand=-
  SCN-specific regions: Sequence locations=1-156,178-434,456-516,538-540
atggtccttcttactgaaaaaatagcacaacttttgaattgtcgaattactgagctccgtgatcgcctaaatcatccatcagattgtgaaatcgttgtgaaagcattttatggaaagcatattcaaacaacatacaaggacagaaatggatacaccaaaactttggtttttgggggtattactgcgcaaggagctgcaactacaatggcatatgggcgattaggtagaccttacaatgttaatgtggccgcacatttctacgttcgacatcgtattaaacttcgccatccatttcttcattgtgtcatcgaacgctttcctgaaggacaagaggatcgtttttatcctcttgagttatgcaaaattgaggaagttgatgaatcaaaatggcttggtcagattttcaccgagattaacaacaacaatattagtgcaactaattcaacaaattttgctgacactcaaacttcaaatgatgattcgaaaagtgttgatgggcgcgatgaatatagccaaaatgattgctactctttgtggtag

SEQ ID NO: 56230 - DNA, 2250 bp, Heterodera glycines
  Genomic contig location: Contig_ID=SeqID_4926; Location=3776..6025; Strand=+
  SCN-specific regions: Sequence locations=1-25,48-68,99-419,441 -496,550-696,729-754,776-1296,1359-1541,1631-1817,1873-1978,2000 -2083,2106-2116,2138-2250
atgtccgttccatcaaatgacaaccaatttccaaaaactacaaatgaatgccaagtcgatgacggtattttatttttatttattactcataacaaaaaattatgaataacttaagatgacgtcgacactgatccatcacccgaggaagttgagaaatggactcccgaggaagtgatcgagtgggagaagcgaatctttggaaaaatgcctccggaagaggagttttggcaggaaattatcgatgatggagacaaagatgtgagatattcattaaagcatattttatacgccgaaagaaaaaagcggagagatgaaatattgaagcgaaagctaatcgaatacgaagaatcactcaaatctaaggctgataattgatttaacagtttcgattgtcctattcagcacacgaatttttgttaatatattcatgaataaagaattgaaaacaaactccgctcaaattaggttaagcaaacattaaatggtataaaaactctaaatttaatataaattttcattttcattactcaaataataaaattttatattgcaaaatgcttgacaacgaaaatggtggttcaaatgaacctcagcaaataaacgaaaatgttcatgtgaagaattcttataatgttcagccctggaaacttttccgtccgaaatacatgctcacctaccgcatgtgtgaatgtaaacaaaataattaaatttcttttttaatttattttcttcagtgtgtctttccgcattgtggaacaacaaaaacaaatatataccaaatgaacgccgagcattaatcagctttgaactttgtgaaaaatgcacaattgacaattgtcgtgcgaccgaaatacttgcaccgttcaagccgaagaaataaatttggagatgatacgcagattttctcacagacaaaaaattccagttaattatttaaatctttgcatattcgtctctctctatttcaccaattcctcaattatttgcttgtttgcacgatggtgccaaataaaaaaaatgtggtattcaagaaccatttgacctctctaatttgaattcactagtggattcaccaaatatgtttgcatacgattctcggttaggggttaattgcggaacgataaaagagattacggatttacagttcaagcactgcattcgtcgaatggtcacctcggaaatttgagatatttggtgagtattgccaatgcggaaaggcttgggggtctagtaggcggaacgaacggcaagaaggttatttggcggatgccaaagcaaattagttgcttcttcttctaattttatttactttttctattttcttttaaaatatttttagatatcaattaattaaaattcattttcaattagcgacgaataaatgtccgacaacgtctcgaattcgatccaggagttaaggcggatggtcagcgaccaaaaccggatcattttcaacttgcgctcccagatgatagaccaaagagcagtcattttgcagaatttatcacggattgagagattggaatgtttcgcttcgaacgtaatttaaatttatttattggattttttaaattttataattttattttaatataataattcaacattgttaaaattaaaactattttttccagaaccgcggtggtcgtggtaactttcgtctgcggtataacccattggcggctgttgaactgaccctgctcggaaatcgtcttgaggacagggctcgtagacaccgagtggccataggcgcatcgacgtcagcatcgctggtcaggctgtgcagcagcctcagctgttagaaggcgaaaatggtgaatttatttaataaattaaattatataaattattttaataatattaaattttaatgccttcttttgggccaacaattgagcgccatatggagagatcgcgtcaccggttgctccatgacgagatggttcagagatcggtacaacagcatttccaacaccaacaataacagcttgtgttccaagctcaacagcaggaacaccgccgacgtgaagtgcagagacagttcgaggtagccgaacagttgcaagaagagattcaggcagcggaagagggggaaaatgatcaagagaatgaggatcagcatcaacagcagcaacaaggaggggaggaagcgcaacacggaggggaggaagaagtgcaacaagctgcgcagcaaaactttgagcgaacagtacgactccaattgcgcgagtctcagcgctttcacaatgg

SEQ ID NO: 56231 - DNA, 411 bp, Heterodera glycines
  Genomic contig location: Contig_ID=SeqID_25493; Location=194..604; Strand=-
  SCN-specific regions: Sequence locations=1-54,76-101,123-136,174 -241,284-297,319-411
atgtcaatttcgaccaattcaacaaatggcgatttcataccaacagatggaggtaatgagaaaaagagaaagaaaccgtagaaagtaaattgagttttggtaggtgtgaaaataaatattaatttaagtttacgaattaaattttgtatgattttcagaagttaattgtgaatcaattagtttggacaacgatggacaatctgatggaaaagtcactgttcagcagcagccaaaagtgagcaattaaaattaatattaatatattaatttaaaaaaattaaaaggaatttcgtgaaaagtgtgccaagatggaaatgaacttcaaaattatcaaattggaacttgagaaggttgcttttacataaatgattaaaacccgaacaaaaagagcacacaaattaaacaaataaa

SEQ ID NO: 56232 - DNA, 1239 bp, Heterodera glycines
  Genomic contig location: Contig_ID=SeqID_25494; Location=364..1602; Strand=+
  SCN-specific regions: Sequence locations=1-564,589-684,714-730,792 -879,901-904,949-1239
atgaaaacattcttcgtattaatattatacgttttattattaaaaaatgcaaatgaacaaactgaagcaggcaaaataaacaaagaaaaaagttttgatcaaatatttggccaaggatgggacgacggagaagaagaaaacatttgtcgaattgatcaaatatttaatggacagacagctgatcaggataaccaatttgatcagatttttggtgaaagtttggaagtgaaagaaggggagagtgaagaaatgtccacaaacagtgatcaattggaacaattgcaagaaaatgttggacaaatttctgatcatttttcaaatgctattggtaaaaagaaaagagaaattgtggaaaaatttgataaaattaaagaaaaagttaagcaaatgggaaagaaattcacaagaaaagaatggcataaaattgaaagaaaaattgccaaaaaattgggagtaaatcaaaggaaaatttacaaatggaaaagagaatttggaatgatgataaataaatattctattgatgaaaagcgtgaaacagtaaagcgatttgatcaaatatatggcaaatttaaaatgaaatttaatgaaaatttggagggaaaaagagaaaaatgcaaaaaaataatagcaaaacatttgggcataagtttaaaaagcatttataaatggaagaaacaattaaaaaatggaaaacctttgaaaaatcaacaaattgatgatgaaaaaagagaaattattgaaaaatattttaaattaaaaaatgaatttatgcaaaatgagaaacattcacgaaaagaatggaaagaatttagtgcaaacattaagcaaatatttggaatttattatagaacaattgaaaaatgggacaagaaattcggcattaaacaaaatatttcaaaaggtgaaattttttaaaagaatttttaatttaattatttaaatattaaagggcggaagcattatacaattgtcgaaaaaatggaaataatgaaacaatattttgaattgaaaaatcaaaatccaaagctcaccaatggagaaattggcgaaattttgaatattccaaaaggatcattagaaagatataaagcggaattcaagagaaaaagtgaaggcgttccgaatacggaatgattgagaatttatttcaattttcaggttttagtcaatgtgttgttatgtttggtaaatttttgtaatttgaaagaagaatcaaaaaaaggctggaaaaatatttta

SEQ ID NO: 56233 - DNA, 341 bp, Heterodera glycines
  Genomic contig location: Contig_ID=SeqID_25495; Location=32..372; Strand=-
  SCN-specific regions: Sequence locations=1-13,35-176,198-341
atggtaggagaaggggaagcaaaagaggagagaataaatcagtttaattgcttaagtcaaacaaccaaagttgaagagaatgtcggggacaatcggcgaataaatgaaaaaaaggaaaaggaagaaaacggttggttaaggcaaagaattgaaattgggaaaccttaattaacaactaattaataaattaataattggagaatggcaattggttggacggaagcggagctcggcccgaagcgaacaaaatctgctcggcgaaatgaatgaatggccatttattgcgagtggaaaagcgaaaaaggcgccaaaaagtgcgatggatttgccaacagacgaag

SEQ ID NO: 56234 - DNA, 381 bp, Heterodera glycines
  Genomic contig location: Contig_ID=SeqID_25495; Location=856..1236; Strand=-
  SCN-specific regions: Sequence locations=1-184,208-278,300-315,340-381
atgtccatatctgacaaaattcgagaagcccgagaatggagctactgcatcgacactctaaaagcatcagtcgattcaatgtacgaaatctgccgaattcagcaaaatattttgggctgtgaggtaaccgatgggaccaaccgaccaatattaattaatccctttaaatttgttaaggaagcgattatgtttttaaaaaatggcattcgcgactttctcagtctgatcgatacaattaaaattgagcagaattgggagaattctgagaagttcgcttctttggtacttttctgctttatatcacaaaataattgctaaaattaaaaaaaaatatttttagagtaaaaatgtaattcctaacttctaactgaattaaataaa

SEQ ID NO: 56235 - DNA, 103 bp, Heterodera glycines
  Genomic contig location: Contig_ID=SeqID_25496; Location=476..578; Strand=-
  SCN-specific regions: Sequence locations=1-103
tacggggttcggaattagtcgaatgaatgcagttcgtgatcaatgggccccgaaaacccacggaaacatgttttcacaactttacacaaatgtttctccataa

SEQ ID NO: 56236 - DNA, 291 bp, Heterodera glycines
  Genomic contig location: Contig_ID=SeqID_25497; Location=226..516; Strand=+
  SCN-specific regions: Sequence locations=1-146,196-291
aaaatgcaagaaaatggacgggaaatggcacttgtgaagttcacgaaggacgactttggcatttaattactttgataagctcctccgaaactatagtaggtaatagccggttcattcttttgctgtatgtattacataatttatgctattttatttatacaatttttgtacattttcaatatttattaatttattcattcggtctttgtaaaaaaatgaacaatgaatcatttgttgggatgtgctctattcagtgatgtggtgaaattacacaataaaacattgtcatta

SEQ ID NO: 56237 - DNA, 59 bp, Heterodera glycines; identical to SEQ ID NO: 52421
  Genomic contig location: Contig_ID=SeqID_25498; Location=152..210; Strand=-
  SCN-specific regions: Sequence locations=1-59

SEQ ID NO: 56238 - DNA, 59 bp, Heterodera glycines; identical to SEQ ID NO: 52422
  Genomic contig location: Contig_ID=SeqID_25498; Location=282..340; Strand=-
  SCN-specific regions: Sequence locations=1-59

SEQ ID NO: 56239 - DNA, 59 bp, Heterodera glycines; identical to SEQ ID NO: 52421
  Genomic contig location: Contig_ID=SeqID_25498; Location=412..470; Strand=-
  SCN-specific regions: Sequence locations=1-59

SEQ ID NO: 56240 - DNA, 59 bp, Heterodera glycines; identical to SEQ ID NO: 52421
  Genomic contig location: Contig_ID=SeqID_25498; Location=542..600; Strand=-
  SCN-specific regions: Sequence locations=1-59

SEQ ID NO: 56241 - DNA, 59 bp, Heterodera glycines; identical to SEQ ID NO: 52421
  Genomic contig location: Contig_ID=SeqID_25498; Location=672..730; Strand=-
  SCN-specific regions: Sequence locations=1-59

SEQ ID NO: 56242 - DNA, 59 bp, Heterodera glycines; identical to SEQ ID NO: 52421
  Genomic contig location: Contig_ID=SeqID_25498; Location=802..860; Strand=-
  SCN-specific regions: Sequence locations=1-59

SEQ ID NO: 56243 - DNA, 59 bp, Heterodera glycines; identical to SEQ ID NO: 52422
  Genomic contig location: Contig_ID=SeqID_25498; Location=933..991; Strand=-
  SCN-specific regions: Sequence locations=1-59

SEQ ID NO: 56244 - DNA, 369 bp, Heterodera glycines
  Genomic contig location: Contig_ID=SeqID_25499; Location=269..637; Strand=-
  SCN-specific regions: Sequence locations=1-369
atgaacgctaaaattatcagagtgccgaaaatcgcatgtgatctaagcctagcaaaaaatggtgtaagtaaaaatcgtaattacgctcaaaaagcttctcaaacaattttaacgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagctcctcaaacaattttagcgcttccaattccttctacaatcgcctttatacatcccattatgaacgctaaaattatcagagtgccgaaaatcgcatgtgatctacgcctagaaaaaaatggt

SEQ ID NO: 56245 - DNA, 485 bp, Heterodera glycines
  Genomic contig location: Contig_ID=SeqID_25500; Location=844..1328; Strand=+
  SCN-specific regions: Sequence locations=1-240,271-485
  Gene Ontology: Cellular component=Arp2/3 protein complex; Biological process=actin cytoskeleton organization and biogenesis
atgtcttcggctcgacttccgaaggggtcgaacgaaggaacgccaagcagtgacgaaggggagttcaaaaaggtgggtttggaacgaaatcgatcgaaagctgcattgggttatcgtaacttttcgcttttcagattgtgatcggaatatgcgcaatgcaacggaaggccaacagcaagccgatgcgttcgatcatgcttaaaatgaacgagttctacaaggtatttaccggcttacaatgaatgcccttcatctctatttaaatattttccaatattttataaaatgttttacccttttaggactttctcgattttgtaatttttcccgaggaaaccattctcaatgaatcggtggagaattggcccctctgcgactgtctcatctcttttcattccaccgatttccctctcaaaaaggcaattgaatatgaaaaagcgagaagaccttacgtgttgaatgacttacaccgccaatttgatttg

SEQ ID NO: 56246 - DNA, 4704 bp, Heterodera glycines
  Genomic contig location: Contig_ID=SeqID_4928; Location=921..5624; Strand=+
  SCN-specific regions: Sequence locations=1-794,816-1083,1105 -1649,1671-1740,1771-1903,1925-2447,2469-2688,2812-2868,2894 -2917,2943-2974,2999-3017,3039-3058,3092-3268,3305-3372,3474 -3737,3787-3835,3880-3940,4002-4087,...
  SCN-specific regions: Sequence locations=...4109-4297,4319-4339,4362 -4650,4672-4704
atggtggcatttggaactgagttggacgaagggacgcgtgacattggaattggcggagtgccaaacggaggacgaaaatggggacgaatgtgctcaaaagagtcatggcgtttatctagtgcatgtccaccttcagcaagaaaacaatttgctcctacagtatgctactttctcttccccaactgtgtctctaccgtaccccttttcagtccgccctctcttcgtttctcacccttcgtcattttcggtgatctctccgttttgcctgaccttctccgtcattctgctggtcggacttcggacttttcattcgttggctgtcagcgacgaattgccatcgacggaatcgaaataattggccaagatttggccattttggaggagagattagaccaattcatggcggaggtgtttgcccattttattacaataaattgctctcttttgatcagatcaatgcaaccacttcatccatgtgtccgttcattggaagtgcgcgaaataaaaggccaaatgtttgccatggagaaaatgcccggaaggcatgtggaaaaggcatttgtatgcctgagggaagcgattcattcacttgccaatgcgaaagtcagcaagttgagtccgctaattgtgagcagggtgagaattctttgcatatttctgcttattcattaattagttaattaattactcaatttccccaaaaagttctcttcgccgcttccctccgcttcagtcctctccgttttgtgctctcttctcgcactttcaatcgtttgtccttcgtccctttgcccggcaatttggtccattctctcccccgccgtccgttgtccctccgtcgtggagaggacgaaaatattcaatttgccgatggattgaatgtgttggcattggactttcattcgtcgaattcggaaaatggaaaaggcgaagaaacacttttgtgcattgaatttgatgatttgttgctgatgatagcattagaggtgaaaacagcgaaatgtctgataataaacaaaatgaaaatgttattaattcatgcaaatggcacttttgtcaaaaaaatgccaaattctattaattgaccatttaaataataaaaggcctccgcttcagatgaatgtcaattctatgcgcttcgttctccaccggcacaccaacaacactcagccgacgccgtttccgctcagtttccaattgatcgttaacagttcgacgccgttggacatccattggcaccgattggccatgggagtgtcgccagacggaaaaatggtaaagcaatgaacggatgacagcgaaatgtgtcatgtccgtttccctccccttttgtgcagctccgtctccaacttgatgacatggctcccgtcgtccaccggtcgtccctcctcaatttcttccctctccttctccgttctcggctaaaattgctgtcgttgggttcgacatgttcttctctcaacgcgcatcaaaatttgtccgtttttcggggctgcgttcgccgctttctgatcaacaatcagttgcagcaaatccatccccagcagatggctccgtttccctctcacaaaaaggtctctcctcgctccgtctgtccgtccctttttcactgtctttccctcttttcagtctcttcggctgctaattgaggagaatcggccggaggatgcgatttcgcagctgtgcctatcagccaaatcagctgaccattccgttcttgcctcgatatttgccgtcatttctgtcctttttctgctctctttcgttctctttgccatcgtttttcgcttcaaaaagcgaaagagaaaagaaagtgccaaaagaaacagaagtgtccaaatatcatcttcttttgtgacccaaagtcaaactccgccgattattgtgccatcgcaatttaatggagaggaagaagagcagaaaatggccaaattagaaaattggcgggcgatggccgtctcaacggacactttttcctcaattggcttcagttcgtgttcgactttcccacgccactccaacataatcggtccaagtgatgccgaaggtcagttgaaaatagtctctctctattttaaaacgcccctatctataaattgccgcagattcagcatgagccgtccaattatcattcaatcgcttccaaaaaaggccaaggttcgtttatcctttgactggttaaagttcccttttgacaatgggatatctatgctcagtttctgttatgcctttttaattctcttttttcaccccaaagattgtgaaaatgaatgctacgacacgaagcgcttaacgacggcagcgaagaaattgaaaataaagaaaaatgaaatttacgggtgaagcaccaaaaagaaaaatatataaaaagaaacgggtcattaatagggctgccaattttatgtaaatacatatttttttcctggcttctccttgctctaaatagcaggaaaaacactttcttttttgtgtttgcgaacaaaaaccgggacttttatttacatatttcggggtttttatacatatttcgggattttcttacatatttgtactagagtgccacgggaccgggaatttttgccaaaaccgggaccgggacttgccgggacctgagaagccgggaccgggacctcgattttttttcgggaccgggaccgcaagaaaaaccgggaaccgggaccaaccgggaaattttaaaaattcaaaaaaattttaaaaatttaaaaaaaaattcaaattttaatttatattaagtgaaaataatacaaaattatttggttttttataataaattaaattaatgaaaattttcaaacaaattttcttcaattatttcaaacaattaatcatttttggactaaatcatcgaatattaatagaaattcagatttgattttcacatcacttttttcggagcgctttttcaaaaaacttttgggaaagaaggggtccggcggtgccgataggcgccgccgggggaaattttaaaaatttgggtgcaatttgttaacagatttttaacaaaaaaggttggtttttgcgattattaagctcaattggtaggattttcatttaaaaaatgataaaatatgtatcaatttaaaaagaaactatgaggaatcatattttctttataggaaacccacgagtatacaaaaaaaaaattgaaaataatctaatttctgcagagggattgaaacaggggaaagaagaagggaaagccaaggagactagccattaggccatttgcacacttgggcagtgttacttttaaagaatatattaattattattttttatttttccctttaactccaattttcatcactaatttttcactcagacccccattcttaccagtgcttgtttttcccggttcccggttgccctaccgggaccgggacctgagcttttcaaaacccgggaccgggaaccgggacctcggatgaccgggaattcccggcccggtcccggtcccgtggcactctaatttgtacatattttggatttttttcatatatattttcatttttttacatattttgagtattttttacggaaatttttggaaatcctcaaaaaaaaatccaaaatttcggtaaatatttttatacatattttcatttttttacatattttgaagatttatagaaaaaataagtttgaaaatgttgcctaaaaataccaaaaaaagtaatttgtatgtcattttgtggctatttcatactttacggggattttctttcccaaaaaattccattaaaaaaatttttatttacatattttgggatttttcttacatatttctttttgtacatattttttgcagccctagtcattaaaatgctgaacatttatagaatttgaattttaaaaaataattaaactttgtttgtgtgaatagcaataaaattagtactacggtagtcaaattcaaaatattcatttttattttgaatttaatttattttaaaatattttttcataatttaatttaaattctttgtctacaaattgtattacttttttttcaattaaatattaaaaaagtccatatgtacctgtatatgttcttccttgtctcatgtcctttttagatgaaattgttaatctttttgtttttattgctctccataactctgagccaatgctcattaagtgccaatgttccagccgatggagatggagtgattagtgacaatgaatttgccgaatttgagtttatggatgaagaagacccaatcagtgaccagcagtcaaatgataattaccaacagaatgggcaacagcaaaaagagcagagaaatggtgacaaaatggaccaacttaacgaccataattccaaggaagaacaaattggtaaaagagcggatgaaaatggcgcagaaaaggtgacaatgatttatgggattggaattttatttcaaaaaataatgtacaaattatgcattttactagtatgtcggtttagatcaagtgaaattgattagaggtgcatttcagtacctaatcaaacttaatttcaacatttagtcagctcggagtgaaggtgatttttcgtttcttgtcgacgaagaagaatttgatgaatttccggcgaaaacagtggaagaaatcgaccaaactcacaagggggaagtgcctgtcaacaaaccaccaaaaccattgacttttgctgagatgagccttctcggcgctagttaa

SEQ ID NO: 56247 - DNA, 1328 bp, Heterodera glycines
  Genomic contig location: Contig_ID=SeqID_4929; Location=495..1822; Strand=+
  SCN-specific regions: Sequence locations=1-583,605-795,817-919,941 -1088,1111-1328
tcgaacttctcgctttgctcatcatttttgtttatgcgctgaattacgcttacggaaagtccaaaaaccattccattgctcacaaatggttcatggacaatcgtgaacgtttggagaagcaattcgcactggttggcgatgatggcacttcgcaggaaaatatgggcggttgtctgatccgcgagactgactttgcatattctgtgtggtgcacagggcgaattggttgtcgctcaatgcacagccaaataaaggtgcgttttgggttttccatgtgtcaaaatttgtttatgacaaattttcagctcttcaagcgacaagatctgcttggtatgatgatcggactcgtccgtccccggccggataacgtagtgtacaaaatcgacctggaccctgatgagatggattcatttgttcttatctttgggcagcgtaaaaatgtgcaaaaaactgtgaaggaaatgcatgatttggtttgtttattctgcaaaattattaatatttattgtttttcgctatattttagtcaacgtatgtcactgagcgtaaaaatgtggacaaagttcagctgccatcttcgatttgtgtctttgcagaaattgccgagaccattccggccataatcgacgcttcaacgctgcaattcctcaagaaatgcgagaaatacgtggagtacattcatttttccgatcaatatgctggcgcaaaacagccggagtgagtttgatcagactattatttaatataattattcggaaaatgaatttagtgatcaatatgtgcgtcttccggagacgcacccgacgttggtgttcagctacataataacagatgacaacgaagagggacatttgatggattcgatgctgctgaacttcacctttttcatgttggataaagtgcggcggtatcggctgagcaaagaggggaaggcaaaggcggacaagaaaaggcaaaatgtgcaggagaacttcctcaaactgacgcatcagcagagacaggaagcagcacaggtgaggaagacaataatttacaataaatgagacgggaaaaaggctgtttttgttcgatttatagacgcgacgtgaagaaaagacacgggagcgaaagcaacgagtgattgaagaggaggacccggatagacagaaacggttggagaggctagagcagaagcgagatgcgaaacagaagcagccgaagatgaagcaattcaaaattaagtagctgatagcgtataagcagggaacgatggcatacaacttgtaaaaatagctatgaatgccacttcgtattgttatttactcccatttctatttgtccattcctta

SEQ ID NO: 56248 - DNA, 159 bp, Heterodera glycines
  Genomic contig location: Contig_ID=SeqID_25504; Location=821..979; Strand=+
  SCN-specific regions: Sequence locations=1-29,53-159
atgacaacggaaccaaatggtgccgttgaccagcagcagcagcagttgctgtttgcctcaactgcttgcgcatgtcgtccgaacaccatggaatggtgcaaaacaacttcatttattgtgtttgcttctcagaggaccatctgcattgtctctgatcag

SEQ ID NO: 56249 - DNA, 307 bp, Heterodera glycines
  Genomic contig location: Contig_ID=SeqID_25505; Location=277..583; Strand=+
  SCN-specific regions: Sequence locations=1-74,140-272,306-307
atggcaaaagaaactgatgattggacaataaaagccgattggactcataaagtgcattagagccgcaaaattttaaatttaatctgcttacaaagaatttatttgaaaaaacaaattaataataaataattatttttaagttcgaagatgacttggcagtcaatgataaatgggcaatgagcaatttattgggcatggcatctcaactaaattttacattccaattgggaccacctggtggaaaacgtggctacatggtgcaaatctttgtatttaaaagatcaatttaaatcatatttatttaata

SEQ ID NO: 56250 - DNA, 797 bp, Heterodera glycines
  misc_feature (769)..(769): n is a, c, g, or t
  Genomic contig location: Contig_ID=SeqID_25505; Location=825..1621; Strand=+
  SCN-specific regions: Sequence locations=1-101,295-342,473-580,619-797
atgttgaatgtagctcgaccgccaaaatatgtgtggtatgtgaatggatacattgccgatttgtacctgaagcgtggaatcacatacacatttatgtacagttttaaataaattaattttaaaatatttaatttttatttttactattcgattaaaaaagttcgtttaatgtaaatttaaaataatttttttaaataatataaattttaacatttaattaacagtttaaaaagttaattaaataaaaataattttttgttatatttaattttatttttaatattagattaaaaagttcgttattgtaatttgaaattatcatttaaaattagaattatttttttaaataaatttaattaaataaaattaattttaataatatttaatttttatttttaaaaaagtttgtttcaaatatatgaaaattattaaaattacaattaataaacgaatataaattttaacaattttagcattgaaggcggccataacgaaacagttccagagctgtataacccgttctacctatccgatagtccatacggtgcttattccaaattaaacaatgacgagaaattggtaaaaaagaaaaaaaaagttttttttaaaattttttttcggtcttagaaagtaagaaaggtaacccaagaggagactggacgactttgcagatggactgaaacaaaattggatgccaacccggacgaattcgctactttttctgacttcagagacactcttttgtgcgatttgaaatttaaatttgtanaaataattttgcaaatttacaggcttga

SEQ ID NO: 56251 - DNA, 278 bp, Heterodera glycines
  Genomic contig location: Contig_ID=SeqID_25507; Location=95..372; Strand=+
  SCN-specific regions: Sequence locations=1-89,140-173,196-278
atgtcttcattgtcgtcctcctcaaaattggccgcttctttgatggcacgatgctcctccctggtgattggcacctttttgagaattccaaaatattaaataagtaattatttaattttaaaattctatttttaattttgactcattttgtcaccttttctctggtcattaaattctctcattttttaaatttcagaatccataaaatattaggcatcgaaagagtgtatggttgtgagcgtattttcatggattacccagaaatttctcttgcgaaa

SEQ ID NO: 56252 - DNA, 268 bp, Heterodera glycines
  Genomic contig location: Contig_ID=SeqID_25507; Location=2095..2362; Strand=+
  SCN-specific regions: Sequence locations=1-120,143-268
atgatgggaattcgcgatagaaaaaactggcaaaactttgcagttttacgagaagcacttgcgttggcacaatcttatttctacatgtggcagatcggagctaagaaaagggaaatgagacaaaaactgtttgaattgtatccatcgttcaacagcggcgaattattccgcagagacatcaccaaaaagcaccctgctgatcaactccgacgaaaagccgaccaccatcagcacataaatcaaagaattgggcggggtggcggaatgg

SEQ ID NO: 56253 - DNA, 444 bp, Heterodera glycines
  misc_feature (403)..(403): n is a, c, g, or t
  Genomic contig location: Contig_ID=SeqID_25511; Location=30..473; Strand=-
  SCN-specific regions: Sequence locations=1-444
atgtcgggccaggattcagggattcaggcaggtcaatgcggccagaaaagttagcattcgagacaggaaaagtttcaggccagcgccgggacttgaggggacgagaaaaaggggtcggattttgggatttggacggcacaaccctggtgatggcgtcattattatttttttcttggcataaagccaacaaaacgcacggtgcttccgctgccgcttcgctgcgaccgcatggacagactgtcgcggtccgatcgtgcggtgactgcatcaattttttcacgttccgccggtgcgatgaagcattggacttcttgcagcggaaaatcggacctgaaaaagtggaaaattcgttttaaaaaaaaaacttggaaaaaatttggagaggacgatgatccagaaaaanatcggggggagactgacactctctgtttcaataataataaa

SEQ ID NO: 56254 - DNA, 983 bp, Heterodera glycines
  Genomic contig location: Contig_ID=SeqID_25511; Location=646..1628; Strand=+
  SCN-specific regions: Sequence locations=1-124,148-158,191-338,370 -398,447-551,666-708,730-769,791-983
atgtggcggctccgttggtccaaaacgggacagccggacgagcattcgtcatccatccagcaggtgtgttaacttaaaatcccaaaatcttcgggtttttcaaaatctcggctttaacggcaaccaacatttaaactgatggacagttaaaaaatgccaaattaataaaaaatttaaaaaaaaaaattaacttttccctaattttcaaggcctccctcttcaattgcttcggctgactcacagcagaaattgcaccaaattgtcaacaacaacaacaacactgaggaggacgaatacattctcagcagcaaacaatgaaaaattcaatttcaaatttcaaattttattatttatttttattttttaattccgaaaaaacacttctcatccctctttctcactctctcattttataatgttctctctctctctctctctcatctctcgccgtttttttttgtcttattgtctcaccaaatataacactatttatttttcgtatggaccaatgaaaatatttttttcaaattgaatatgcttaaaatccccaatatttttttttatatatttattaatttatttttattttgccaacaattttatatgaaaatgttttttgttccctctcatttcatttttttgttttgtcactttatttttattttgaaaataaatgtttccgtcaaattttggttttcaatttgcttcttcaatcccatccaactccattgatgccgtcattaaactgcttgaggatgaagctgaaaatggagaaaaattatttttaaacaattaattggtaatttgcgggtttttgtcgacttttacaaataaaagaaattgaaaattctttcaatgggttttcaatttttctactttcagtttttttaaaggaatgtttttttttgcccccaagatggcaaaaagttgaacctggattttttgaaaaaaaacacaatctctaccgaaaaaaaaccgacaaa

SEQ ID NO: 56255 - DNA, 1212 bp, Heterodera glycines
  Genomic contig location: Contig_ID=SeqID_4930; Location=62..1273; Strand=+
  SCN-specific regions: Sequence locations=1-926,948-1212
ttattgcaccaacgatgttgggaatatgatggcagctctggtcgcctttcgccgggaattcttcgaaattttcacggcgccaaaggctacgttgatgggattgacgacaaggagaacccacgaccggggattgagtgttgcgtgagtgcatgaccatcgcgggggcatgcatgcggcacttccgcaccaaccacctgcccaacgagcacttggccattgtgcccgagcgcggctatgacaacgcgcagaaccaaagcctgctcgccttacgcttcttccactggtacgccaaggagcatggagtgcaagtgcagacagcccacgcggctggaggagagaagcgcattgggccctactcactggatgggtggattgaggcggaacgacgcgcaattgaagtcaatggtagctgaattttatgcacaattattttaaaatgtgctattttaaggctgcacgtggcacgggtgcaaaaagtgttaccccaacgacaacatgctgctactgggaatgcgagatccatcggatgctggagcggagcaaagaaatgcgcaaggcatttgaagactatgtcgatgacggcccgctggtgatccgcgacgcgtttatgggagggcgaactggaccggtaaagctgctgcgcaaagctgggccgggagagagaatctcctattatgacttcacatcgctctacccgtatataaagtaagcacagttaaagttataacaaattaacattgtttccttcacagcttcaccacctgctaccccattggcactcccaaagtgcatgtgttgaaccatgaagtggagtggcgcagtgcagcggacaacccctaccctttggcattgctcaaagtgtgggttgtgcctccccgacgcgtcgacgtccccgttctgccagtgaaagttggagagcggctttgcttccccctgtgcatcagtagcgccaaagagcacccgacaggaggagtggacaacgactaccactgcgagcacaatgacagacagcgggggtgggtgagcacatgcacctccattgagctcaacgaggcgttggacgtgggttacctcgtcacaaaggtcttccgcgtgttggagtattgtccgagagtgcgcagagcagttcaacatcaccatcgacccaaccaaaatggcggtcaacaaagggaagcggtccctggccaagttgtgtttgaacaacttatgtga

SEQ ID NO: 56256 - DNA, 573 bp, Heterodera glycines
  Genomic contig location: Contig_ID=SeqID_4931; Location=1087..1659; Strand=-
  SCN-specific regions: Sequence locations=1-573
atggttcttgtaagcacattttgcgctcagcttctcaactgccctgtcaagtcattgcgcgaccggctcaaccacccagaggatcgggcgcttgtgctgaaacacatcattggacgcaaagtccgcaccacctacaacgaccgtaatggattgaccaaaactttcttcgtcactggaatttcggcacaaggcgccgcatttcttcctgcatatgggcaattgcgcaaccctttcaacatcaatgtggcggcgcatttttatgcacggcaccgcataaagcttcacttcccgtatgcaccgtgcataattgaacgcttttcggggggaggggaggaccggcacaacccaatggaacttcttgagctgattgatgacaacatggacatggacatcaacaacaacgagcattggctgggccgtcttttcactgaaattgacgacaaacaatcgtcgtcaaactcatccgacacaacaatgcgcctagtatttgagggagacatggatgaagacagcggacgcaatgaatgctcacagagtactgtaccgtatattagttttgtttttgctcactaa

SEQ ID NO: 56257 - DNA, 428 bp, Heterodera glycines
  Genomic contig location: Contig_ID=SeqID_4931; Location=1829..2256; Strand=+
  SCN-specific regions: Sequence locations=1-25,47-428
atgaaaagacgcgttgctcctcttactgctgctgctgtctctgctgagcaacatcaaataattggttccgagtcgcccaagccacatgaagagacgaccaaaaatgttgagccgaaggatgagttggcaacgaagaaacgcaaagtggacgaccgagagttgtggaaattggcaaaaggcaaatttttgctgaccacctatttgtgccatggtaataattaataacaatttcatcaaattttaatttaaatccataaattttgagatgattggaatcgtctgtacaacaaccagcagaaagtgaagcgcctggagggggaccgttttgccttcggctttgaaatgtgtgaggaatgcgtgtgggccaactgccgcgcaaccgaccttttggcaccaatgaagaaaaagtgaactttgcccaaaagaca

SEQ ID NO: 56258 - DNA, 963 bp, Heterodera glycines
  Genomic contig location: Contig_ID=SeqID_4931; Location=3075..4037; Strand=-
  SCN-specific regions: Sequence locations=1-334,356-570,592-701,745-926
atgtggccgccgatcattcgctctctgaaaggggagcgcagctaccgcgtgaaggctgttttggcgacctacacccatagcacaaaaaggatcggatattacgtagactggcttcgtaagtggttgggatgaaaattaaaatttttttttcatttcttctcatatttttgtctctatttgtttggttattgatgagttgtcactgaatagctcctccataatcaaacagtccggggtttgaatgtttgttgccgagttgtctttgaatagctccgcgcaaacgttttaagttccgttcctccttttcatctctctctcttctcgctgtctctcaattttaaatttatcacagtcctaaacactgtttattattaattaggtgcgaggggccaagagagttgggtgcagagcgagtcatgtgattgtatggaactcgctattgacttcacaaggaaggcgaatgtccacgatgtgttgcgtggactacttggcgagccaattcccgagagtattgccaaggaagtgatggcgagtccaaaattcgtagaaggtcatttttttttttgaattttcaaaattattctttaagtttgtaatttgttgggccgggaccccgcaacagtgctgaaaattgacgacctgaacatttcatttgctccatcgctcaatgtacaggacattccgtacaaaaaagtattagcttattaaaaaaaaaattttttttttaaatttcattttttttttccaggccattgcacagttgggcgaatttgtcaaaaattgtttggaagcgccggcaccagagcaaagtgacagcgaagacgaatgaaaagaaaaggctaacaataacaaattcaatcatttttaacatttctcaccaatttgctcttacataacacattcctcaccaatgtgctcttacaaacatttttcaccaattttacaattttaaacagaaataaa

SEQ ID NO: 56259 - DNA, 859 bp, Heterodera glycines
  Genomic contig location: Contig_ID=SeqID_25513; Location=411..1269; Strand=+
  SCN-specific regions: Sequence locations=1-86,126-421,448-514,536 -568,608-679,701-859
atgtcgtctgctactgaaaaaatacttctttttctgttcgtcgttgctcaacgaatcggcgatatggtaaaaggaaggtgagggggaataaaaatgaataatttctagcccaaaaatatggacctttgcttttttagctgttcaatccctcaaattgttccattgtccgaatacatttttttttcatttacagccccccaaaatggaccgtcgcgtcagcctggagctgctcgacttgcactgcaaccggttgccggacgaactgttgcggtgccgcgtgctgcgcacgttggacatcagcgggaacaaattgacggaactgccgctgaacattggcgacctgcaaaacctggccgagctggtgctgtgcgagaaccaaatccggcatttgcccagctcagtcggtcggtgatgcctcatcaattaataatattatatttaaaaaatgtagagctgaattttgcaaaaacccggacccggatttccgttctatggggtttttaaataaaaagtgatttttgtctttctttttgggaacggtttgtttcgccccgccatttttcctcgcataaattaaaattaaaacaaaaaatagatatttttttttgatttgttttcagctaggttttttcctaataaaaatatttttttcattcttaagaagggaaaacgcattgcaccttttttaaaaattcatggcccccatttttgcaggccaattgaagcggttggaagtgctgaagtcgtccaaaaacaatttgacgctgctgcccccgtcaatttgttcacgtgcggtgctcaccgatttgattatgtgcgacaatcaactccagcagcaggttcagcaccaagggcgtag

SEQ ID NO: 56260 - DNA, 951 bp, Heterodera glycines
  Genomic contig location: Contig_ID=SeqID_25515; Location=38..988; Strand=-
  SCN-specific regions: Sequence locations=1-606,729-759,787-817,850-951
  Gene Ontology: Mol. function=satellite DNA binding; Cellular component=chromosome, pericentric region; Biological process =regulation of transcription, DNA-dependent
atgccaccaaaacggagacgctgctgcttgaatcagagttgcgaggattgccgacgtaagcaagctattaaagcaatagaggcagacaacatacgcgcaaaggcatgccaaggggagcacgaccccgcttgcgttgtcaatttgcgcataacaaatccagagctccaccgcgaagcatacgatggcatggatgccgtcgtagagcgaatcacggacggttagtttttaatggggattttcaaaagagaaattttttaggccctattgatgtccattgcccggactgtgatttggtgtatagtcattacgccgtgaagtggattgggagtgaacgcgactggcatggacttgggccaggcgttacaattgtgggcaccaatcaactcgtaagaaaaatatgaaataataggaaaaaagttaaaaaaacaggactcaaacgatgtgcgtgaatttgagacggaaaagagagagagagagaaggaggtccatgatggactaatgttgggccgggtcaatgaaaacattgacctgctcaaccagatcaacgagttcgaggatttcgctgctgacccgggacgaatggcgaagaaaattgtgttcgagttagaagaggaggaggaaagggaagaggaacaagaggaggagagggaagaagaacaagaggaggagagggaagaggaacaagaggaggagagggaagaggaacaagatgaggagggggaagaagaacaggttgggacatcatcagatgtcgggaataaaaagaggaggaagaagaagaaaaagcgcagcagaggtggcaaaggtttccgggattggatgaacaaggaaaaggaaaaagaggcaagtgcctcgggaaatgatgccggaggtgaggaggatgaaaattctcatgccgtttcaatcacctcgtcaacagcaaagaaagcgataatggatttcgcactctga

SEQ ID NO: 56261 - DNA, 1346 bp, Heterodera glycines
  Genomic contig location: Contig_ID=SeqID_25516; Location=718..2063; Strand=+
  SCN-specific regions: Sequence locations=1-227,249-551,573-736,759 -889,912-1137,1160-1167,1189-1346
  Gene Ontology: Mol. function=sulfite oxidase activity; Cellular component=mitochondrial intermembrane space; Biological process =methionine catabolism
gatgctccgtcgggtgatccttttgctgccgacccgcctagacatcccgcattgatcgtcaacatgcaaaagccatttaacgcggaaactcccccgtcgttgctgatcgacagttttctgacacccaaagaactgttcttcgtccgaaaccacatggctgtccctcgggtgaacattctctttgatcgatagtcttgaatttaaaattaatttagcgctttcctatcaaaaaatttccaagtttttaacactttaattttagacaaatgaagaaacgcacaaagtgcgcatcgatgggattggtgtggataagcaaattgtactttcgcttgaccaattgcgcaacaatttcgagcccgtttcaattgtttccgccattcaatggaaattttttttttgcagaacatttcacttaaaaaacgacagcacaggaaaaatgctttttgaaattttatttttttttcgtcgggaccacaattccacaccattgccaaataatgagtctaacaatcaacaaaatgttcagatttatcaatttctaatctatgaatataatgaagataaaaacattttcggtcattttgcgtgacaattccaacaattaaagcaataaaattaatttgtatctgttcgcaacggtgaaaagcgagtcgtcaaatatttcggtcgtattgtcaaatgcattcatcccttgaatcatcgttccggcaagaccaattggaattgaacacgacttaaagggaaaaatatttttaaagccgtgaaaaaattaacacgtcttttcgtgaaaatctgggttagggtcagtcggaaatccgggtggtccaaataactcttatgatagaaaatactaattatttagaattagatttttgcggctagaatgcgttttttatttcttgaaaaaagtttaattacaaatctagattaacttagtgttgtggaattactttggcaaaccacatacggttgtggataaacacaaaacttcgccaaaatgatcgaccaaataagtaatttccgaaggcaaatggctgaccaacattggatttagacaagatctgactaaggtcaccggttccaccgagagcgtacagttggtttctgcaagaaaaataatttcgaaaaattttttataaagtgaattatataaacaaaaagtggaattttttgaaggacacctgggttgctagtgaaaaaatacattgaatgcgcccacttgttttgagtgcccagtaataccaactttatcgccttttctagggcaccgcggtgctgttgaatctgtgaccgggacaaagccagacggtttcaagggtcttcttcctgttcatcaatgcgagtga

SEQ ID NO: 56262 - DNA, 852 bp, Heterodera glycines
  Genomic contig location: Contig_ID=SeqID_25517; Location=431..1282; Strand=+
  SCN-specific regions: Sequence locations=1-7,82-678,712-716,738-852
atgcaccaacaaaaacaaagacagaagaaggagaagaaaaagaagcaacaacaacaaaatgtaaaaataataacaacagcagcagcgatgcatttgacgacagctcatttcactgcccgtacattttgacgatggatttcaaatcgctcggttcgtttcagaagaatgccacacaattttttttttttcaaatttgttatttgtacccttttttcttacaattatttagatccgtcgttggcacttgggtttttgacacgcgacttggcggagtacgaggacctagtgcatcggcttaaggtaatgccgccgccgtcccaattgttaagaaagagggaattggtttcgaacatacatgtgcaaggggtgtctcagcccaagggccatacgacggacgattgggacagggggggggtgtctcgggaccgatttttcatacgaaggtggtccattttttctccggcgattaccttttttcgttgcttaactactttttttttgcgacgcgttttttccaaaaaactttgaaagggggggtggggccggcggagtcgagaagtaccgccggaaaattttttgaattttgaaataaatttttctaaatttatggaataatttctcataacttcttcatacttgctagattatagtaacactttcaaacatgactaaatatgctattaaaaggcattttataagaaaaaacactgtaaagctaaaatttattcatttttagcgaaaaaccaacccgaaaacgaaattttacttttttttttgtttatttttgacctaaaatttaaaaatttttagaaaaagtaacattttattccatatttttcgggaaaaatttta

SEQ ID NO: 56263 - DNA, 782 bp, Heterodera glycines
  Genomic contig location: Contig_ID=SeqID_25518; Location=1..782; Strand=-
  SCN-specific regions: Sequence locations=1-132,154-217,286-444,509 -552,574-624,673-755,777-782
atgcgtcaattatccacagtgtgtttaaaaaaccaagttactgtaacagggagttttgtacaaatacagtatccaatgacgcattttctggacaccaaaattgatgtgaatggtgctgtcccttcgataagtgatggaaatgttgaagaaattgtaagggattttctcaaagttcgcactgccaaggagcggactctgtttttgtgaggaggaaaacaattaattaataattgatgtaattaattaattttggtacgaattaattaattagggtaaataattaatgtgtcgtgaaaggttcatagccagcgaaagggccactgggctgaatttggccaaaatggctcaaaaaccgagaccaaaaaacccggaaatttttcaactcgagatttttcacgaaaaatcctatcttttggaagaaaaatttcaaaatgtttgcatcagtttattttatgttttttaaaaatattaacaattttctatcaattttagaaaattttaaaaaattgtgtatttgcatttgacccattgtttgtccgtttatcaaaaatgaataatcaataacctaattatcattatactaattacctcatgggacatcataacatacagctaaatgaaggcaaaatattataaaattttatgtcgaaaaatttaaaaaataataattttcacctgctcagcacgacgatggcgaggcaagtctctcaattggtcgccagtgtgccatatcacaacggaaacggctttttcacttgaatttttattgtgaaataattaaa

SEQ ID NO: 56264 - DNA, 146 bp, Heterodera glycines
  Genomic contig location: Contig_ID=SeqID_25524; Location=21..166; Strand=-
  SCN-specific regions: Sequence locations=1-79,113-146
atggctatctctttttttgagaaattttctatgcaacaaacgctctcgaacatgaaacgaagtgcggtgcgccatggccattttatttttcaaataatttttatatttaatagatattccagaaaaatggctatctctttttttga

SEQ ID NO: 56265 - DNA, 146 bp, Heterodera glycines; identical to SEQ ID NO: 56264
  Genomic contig location: Contig_ID=SeqID_25524; Location=273..418; Strand=-
  SCN-specific regions: Sequence locations=1-79,113-146

SEQ ID NO: 56266 - DNA, 146 bp, Heterodera glycines; identical to SEQ ID NO: 56264
  Genomic contig location: Contig_ID=SeqID_25524; Location=525..670; Strand=-
  SCN-specific regions: Sequence locations=1-79,113-146

SEQ ID NO: 56267 - DNA, 146 bp, Heterodera glycines; identical to SEQ ID NO: 56264
  Genomic contig location: Contig_ID=SeqID_25524; Location=777..922; Strand=-
  SCN-specific regions: Sequence locations=1-79,113-146

SEQ ID NO: 56268 - DNA, 414 bp, Heterodera glycines
  misc_feature (286)..(286): n is a, c, g, or t
  misc_feature (327)..(327): n is a, c, g, or t
  misc_feature (364)..(364): n is a, c, g, or t
  Genomic contig location: Contig_ID=SeqID_25525; Location=18..431; Strand=-
  SCN-specific regions: Sequence locations=1-414
  Gene Ontology: Mol. function=pre-mRNA splicing factor activity; Cellular component=nuclear speck; Biological process=mRNA splice site selection
atgagccgaatttacgtggggcatattccatacgaagccagggaaagggatgtcgaacgcttctttaaaggatatggacggattcgcgacattctgatcaaggtctgtgtgatagcagcacatccattgggcgggaagagacagtttttaatgcatcaattgcattcttctccaagttcaatttttcgttcttagcgcggctatgctttcgttgagttggacgatcctcgtgatgctgatgacgcggtgtatgaccttaacggtcgctcaatgatgggatggaggntcgttttccattttgatcgcgagttttaatcatcatttcgnctaaaattaatcgttttagtcaatccgtttttatgtngtatatgtataggactatctgactttttctgctgcactctatataataaa

SEQ ID NO: 56269 - DNA, 775 bp, Heterodera glycines
  Genomic contig location: Contig_ID=SeqID_25526; Location=13..787; Strand=+
  SCN-specific regions: Sequence locations=1-21,43-135,157-273,295 -412,434-667,689-775
atgccttgtggtgaaaacaatatttcactttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaa

SEQ ID NO: 56270 - DNA, 513 bp, Heterodera glycines
  Genomic contig location: Contig_ID=SeqID_25527; Location=90..602; Strand=-
  SCN-specific regions: Sequence locations=1-282,311-513
atggttgagatgggaacagaaattcaaacatcccgaaatgaacttaaatcttttcaagaagaagtagataaagccaaaaacataacattggagcatgtggaaaagaatgacatgaaagaagcaaagaaatcagccgacgtcgcaaagggaatcgccagacaggcaaagaccaaatatacatcaactctcgaggaatataatgataaatcggaaaagggttttagcgggatggtggttaggcttaacgaggcgctcggtgagcattttaaacgtaaggaaattgaaaataaagaagtttcagaagctgaaaaagggccgcaaaaacgagagagattagccaatgaggatgttcaatttaactacgacagtattgatcaaaaatttattgtctatctttcctctgccgtcacccatatagatttgtcaaaacacctcgcatatgttctgggatttaagaatacaaggctatttcacgcggaagaggcgacttatatgccggatttgacgggaggt

SEQ ID NO: 56271 - DNA, 215 bp, Heterodera glycines
  Genomic contig location: Contig_ID=SeqID_25529; Location=102..316; Strand=-
  SCN-specific regions: Sequence locations=1-3,31-215
atgaattttttatttttatttttaataaatgcttcagcaattaaacatgttcttgggaatgatagcatctgtggcgaaaacgaagtttataaggcggacttcgaaaatatgctcataaaattaatcggtaatttttgaaaaagttttactttattttcttttattttttagatattaatggaagcagcgctgaattggagaaagagtttgggtag

SEQ ID NO: 56272 - DNA, 621 bp, Heterodera glycines
  Genomic contig location: Contig_ID=SeqID_25531; Location=948..1568; Strand=-
  SCN-specific regions: Sequence locations=1-170,196-209,269-327,350 -443,465-599
gcaaaaattgaactgttgcgcagcattgaggcggacctgaaggcggagcgcaagctgcgcgaggagcgcaagaagcaaagccaggaacgggagcgcaaacagcttgaggagcaacagcagttggaggagggcggcgcaagtggtggcgacgctggtggtgttgacaaaatgccgccaccgccgcccccaccccgccaactcgaggctgctggtggtggtggcaatgatggcattattggtggtggtggtggtggtgaaggaggtggtgttgctgatgaaatgccgtcgaaaaaggagaggaatttgcatcgatgattcattcaatccgttttgttttgttgtaaaaatatcaaaaaaatgttattattatatacctactcttttttcacaccattcattcacctccctcctcctctgccctctctctcctcacaatcagcaaagcaaaaccatcatcatcatcaagcattttcttttttgtttctttttgccaaagttttactttttagacacttatatgcacagtgaatgataaagcaatcaaggcgcaaatgtgaatcacatggaaaattgggccctatgttatttaccaagacacaagaatagaaagaatgaaataaa

SEQ ID NO: 56273 - DNA, 864 bp, Heterodera glycines
  Genomic contig location: Contig_ID=SeqID_25532; Location=802..1665; Strand=-
  SCN-specific regions: Sequence locations=1-210,232-329,351-458,570 -808,831-864
atgccaccaatttcacgtgctattggcgcctgcgtgcaccggcctcccattacattgaggtcaaactgttccgtctggacgggttcacatgtgagcagtcgtgctacaactttgtcgagatcaagcatggcaatttggccaattcgggtaaaattggacaacaaaatttacaaatttaaattcgttgcgttagaaaaactcgcttatttttgtgcgttttttaaaattccaacgcttaaacgttaaaaatttccatccattcccaacaaatttaaccattttcatcgcagtcaaatgggatttctgtactaaattgtcgttgaccaaaaatcctaatttttaataaacttgaaaatcagaaattcataagtaagcaccccaaattaaaaattctcagcctgctgaattttttttctccttgtttagataaaattttgttagatttaaaaaagaagtactaaaaaatcaaaaaattattttgattaacatcaaaaacaaatttttttaaaatttctatttgattaacattttcttaataaattaccttttctttttttttaattttaaatgtttagggccacgattttgttgtgggctgccaaccgagtcgatgttcaccgaagtgaaaggccatgaggtgatcatcattgccagtgctgtacagaagggcaattattccgttgggctgacctacagtatcactgaataatctgaaggattactgtgaccattttattagcttaatcaattcacacaacgaaaaacatctaattgtactgtatttgtgtaattgctatttttgaccgataattttttcaatttgaaaatgcttaaatgtatacttactgtaaagcttggaataaa

SEQ ID NO: 56274 - DNA, 680 bp, Heterodera glycines
  Genomic contig location: Contig_ID=SeqID_4933; Location=598..1277; Strand=+
  SCN-specific regions: Sequence locations=1-99,121-154,176-220,242 -415,453-680
atgtccaaatttgtgattattgcacgttttctactgccaatcgtgctgttgttgatcagcagtcgtccagtctcggctagttatcaggacgatttggacgatgatgacgaggaagtggattatatggctggatacacgtaataattttgtacattatttaaaatcttttaaatctgtcaaaatgtgcgctttttctctaaaaaagagatataactttaagcaaaaacaaccaaaatttaaattcaaatttaaggaaaaaatttgaaatttgcctctttctgagtaaagttgtgatttcattttaaaaaacccattttggcggtttcacaaacataacctctgatatcctgataaaaaagtgctaaagaaacaaaaaataaatccaaaagtggtcgttttggtgaaaatttttcaatatttttgagattttaaatatttatttccattataaatggcatttttgaagggaggagcaaaagaagtgttgtacggactggctacaagcagttcaaaagctgtttccaagaatgctacactaaccagtcacagaacaatgtgtgcgtgctgaactgtcccatcgacttgggcatctgtgtggacaaaaactgcagcctgactgtgtgtgtcctcggcccaaggatttcgggtcagtgccatgagaactggctgacaaatgcgca

SEQ ID NO: 56275 - DNA, 787 bp, Heterodera glycines
  Genomic contig location: Contig_ID=SeqID_25533; Location=289..1075; Strand=-
  SCN-specific regions: Sequence locations=1-474,496-627,654-736,779-787
tactcaaacaattatgggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagact

SEQ ID NO: 56276 - DNA, 123 bp, Heterodera glycines
  Genomic contig location: Contig_ID=SeqID_25534; Location=417..539; Strand=-
  SCN-specific regions: Sequence locations=1-16,38-123
atgaactcattaccattcctctccctgtggttgctcattggcacccttttgctgctgacggcttttgtggcgaattgccaaaatttgttccagcccagccaagtgtcgcttggcagtgagaag

SEQ ID NO: 56277 - DNA, 803 bp, Heterodera glycines
  Genomic contig location: Contig_ID=SeqID_25535; Location=351..1153; Strand=+
  SCN-specific regions: Sequence locations=1-123,198-309,335-365,430 -521,543-803
atgctggtggcggtgcagcggcactcgctgttgctccaactgttgccatgtctgcgctggttcaacgagtccgcgctggtcgagctgttcttcaggtgggagcaaatgcatttttaatagccctaaaatttattgaaaatctaaattactaataattcaaaaaatattatatttaattataaaatttatataatttacgaataattctcgaatattttagcacattgctcggctcaatccctatcgaaacagtgatcccattcatcctgaacaccaatttgccattgaataagctgtaagacatttttgaaaaattaatttttataaaatttttgcaattttttagtgatgaacaatgtgacgggaagaacagcgccaacaccgacgcaacaacaacaaccacgaccacaacaaccgctgaagcaacaatgtctgagcagaatggtggcgcgaatggcacgcccgaaaatggagacgaacaacatggagacagggcggatgttgcggtagaacaacaccgagcagtacaacctgctggagcaggacaaggactaccttctgccgcggttgcggttgcagctgccgcagttgcggaactgttgtccttaaacagccctgctgggcaccggaaggaaaagcatgtgaaagtggagcagtcagaagcagttgattctaatgatgatgataaacgtgacggatgcgcggtggaagatgattaccagcaaagggacaagcataattatgagcatgagaaggaggagaagcaaggacagcaggagagcaagcagtaccagcaacactag

SEQ ID NO: 56278 - DNA, 1496 bp, Heterodera glycines
  misc_feature (1396)..(1396): n is a, c, g, or t
  misc_feature (1441)..(1441): n is a, c, g, or t
  Genomic contig location: Contig_ID=SeqID_25538; Location=162..1657; Strand=-
  SCN-specific regions: Sequence locations=1-547,569-658,691-1446,1468 -1496
atggaatttctaaatgatcatacccaagcacgtgaagacatagaaagaatggaagaatcgaaccgccaaaaccggaatttcccctctaatagaccaccccaaaacagagtacaaagacaatactatccaaatttcccgcacaatcaaatgaaaccaaacccacggaatcaacagacttccacaccttttccatacacctccgcattcacgaccaaatcaaaaccagtacgccttgcacagtttaagccaaatccaacacaaaatagaacccaaaataaaacattttgccgcttttgcgagagagaaaatcatgcaagtaaagagtgcaaaatttattcaacccccgagaaacgaaatgaacgtgtacgtgaactcaaactttgtctaaattgtctaaataagggacatatggccaatgaatgcaaatccacctatttatgttttaattgcaaatacaaacataatactctcctttgtacccgcaaacaaactcagtacaaaccgaaagagcaaaaaaccagagtgaatatggctaaaaattacgaaaatcatgaagagacacaaacattcatgacaatggattatgataaaaatttatctaattatgaggaagaagaattacttatgactgctgaagtaaactgcataaatcccgacaaacataaagtaaaaaaggaaataattttatttgataatgggtcacaaaagagctatataaccgaagaatgtgcccaatctcttcaattaactacgattgaggaaaaattattagcaatttccactttcaatcaaaataagccaaaaatcattaaatcgagactagtcaaagttggcattaaaacattaaaaggtgaagtggagtacataacactacaaacagtggaaaaaattactgatgttacaaaaatggttaataaagaaaatgttgatgtactcggagtaaaaatcccaatcagtcacgcatctcctcaaattctaattggaatcgaccattattggcatttcatgttaccaaattcacaaattcaattacttccatcaggattttactcgataaatacaaaattaggaaaaatattatcaggaaaaggaactattgaggacacaaattgtaactcagtgaccgaaaaaagaaaaaaagacgaaacgaaccaaatacttcagaaattttgggaattagaaaacattggaattatcgactcaccacatatgacggatgaagatgcagcaatgatacactttgataaaaatgttacatttaaaaataacagataccatgttcgatggccttataaaagagagaacccgaatttaccaacaaattttggattatgcatgggaagactaagaaatgttgttaaacaactaattaaaaacaaccaattcacaaattatnacaaaatattacaataacaaatatatactaacataaattaaattnctcaatttaaatcaaataatttacttcattatctcccacatcatccactaataaa

SEQ ID NO: 56279 - DNA, 622 bp, Heterodera glycines
  Genomic contig location: Contig_ID=SeqID_25539; Location=485..1106; Strand=+
  SCN-specific regions: Sequence locations=1-182,206-245,267-555,582-622
atgacattccaaaatgtgccttcctctctctgtcaggagcgtatgattgatgcgcaaccgttgccaatcatttttggccattcaattggtggcccatcatcatccacctcgggcggcacaaattgtggctccgttggacgacgcgtgtccaatgccgggggcaaaagacggagcgccggcaccaacaacaacggcaccggcacaaatcaccaacatttacggcattcattgagcgccatgctgaacatctcgtcctcctcggtttcctccgttgattcgtcgtcgtccctgttgttgttccccccgctttccgcgtcatcacattcagtatccggttcatctccagccaaacagcaacgacggcaccaccaacaacaagcagcatcatccagcaccgcaaattgttgtgccaatgcggacgacggcatgggcgatgacaaaatggaagaccatcaaaatggcaacaaattgttggccaagatggtggtagacgggcaacagcagcaaacgaaccatgccaatggaaaagggacggccaaacgggaggcggacgagcaaatggaggaggaggaaggcagcagcaatgggggcgaaggcccacacgaggccgcgaagaggccga

SEQ ID NO: 56280 - DNA, 618 bp, Heterodera glycines
  Genomic contig location: Contig_ID=SeqID_25540; Location=390..1007; Strand=+
  SCN-specific regions: Sequence locations=1-64,87-618
atgaatgaaatggccgaactcaaagctattattaatcgcctatctgcaattgagaaactaatttcaacaaacaacaacaacacattggcgaccgaaatgactgcgcagttcagcgccatcgcggaccgcctcggcgaaattgagcgcaaattaaacaacaacaacaatggaattggcagtgcggaggataaggagcgaaaaaggagcctcgtgctcattggtcttccggaatcagaggaggaagtgccatcgcttcgagcgaaggatgacgcgaaaaccgtggaggaagtgttggaccgtttggacgtggaagtgtgcccgcaaatggtctacaggatgggcaggaggagtgacgaaaagaggaaggggccgcgcttggtgaaggtggtcctgccggcgtccaccttccaacgcttcgcgctgatgcagtgggggcgtcgtcggacggagctgaagaagagggctggttgggagcgtcttctggtcaggccatccctgacgaaggaggagctggaaattgaacgagaacagcgccaaaagaagtggatggaatttggacagaagaaaacggatgaaaacatcacgacgcgacgcggaggcaatgaaaaaaacttttga

SEQ ID NO: 56281 - DNA, 696 bp, Heterodera glycines
  Genomic contig location: Contig_ID=SeqID_25541; Location=402..1097; Strand=-
  SCN-specific regions: Sequence locations=1-81,112-183,209-633,659-696
atgcctggccaaagcttccaaaatcgaatcattcaattggtcgctgaggtaaaagcagaggcgagtctgaagcattttgacataaatatttttcaattaaaatattaattaccaaattccgaccaaacattggccgtgacataagcccaaagcacagttcggagtttaactgaagcggattttggctaatcaaagaaaaaatggcacaatcacttggtcatgggatgcgaaaaactccatcaaacgttgtttacagtcgcaggggagaagagaaaggtcggcatcgaacaccaaactgcgctggcaaacggaggccagacaaatgtcgaacaaagaacggaccatcgcaagaggaagtgatcactggtcggttgaaggacaatcaattagtgatggacaacagcagcagaatggaagggaaacattcgcaggcgaattactcgcaaatggactgatcaattgatcagctgggcaccccaaatgattgccatcttttacacaaattaatttcaaaaatcttttctgtgctagaacggaagaaaaaatgatatctcggagatatttcagctaattttgatcagaaattcccctcacaccactttttttctttcttcttgttcaattctctgccataaaattgttttattttgccttttctcatcaaatgtattttaaacaaaataattagctaataaa

SEQ ID NO: 56282 - DNA, 481 bp, Heterodera glycines
  Genomic contig location: Contig_ID=SeqID_25541; Location=1023..1503; Strand=+
  SCN-specific regions: Sequence locations=1-269,331-412,438-481
atgcttcagactcgcctctgcttttacctcagcgaccaattgaatgattcgattttggaagctttggccaggcatttcttaatcacgaacttttcagttaaatcgctcttttcagttttaaccaaaaccttcgcattatttcgatcgtcgaatgcccccgggtcactgatacggtaatgcatttgccaatatcatttgtaaatatagatagcatcagttttcattactctttttaaagattgtccgtcaatttaaaaattgtattaagcaaaataatgtattaatttttaatcataaattattttttaattaattcttttatgattttttcaattcattccagggaattgtcagcgtcactctccgccagaataaactcgtctgcctcgagttagtcggaattccgctgctcacttccaatgcgctcaaggctgtgaattcgaaccgtctgagaagcgtcgatttgagtggatgccgaaag

SEQ ID NO: 56283 - DNA, 2605 bp, Heterodera glycines
  Genomic contig location: Contig_ID=SeqID_4936; Location=44..2648; Strand=+
  SCN-specific regions: Sequence locations=1-106,128-2251,2275-2605
atgcgcgagccgaagcgccgaaccgaatcaagaccggaccaaagccgacacgccgaagggacacagaatcgggatcagttcccgagggtgttcatggtcagaagcaacccctcatcccaacgacccataacacctggggcatccgcccttcggaccggaactcacgcgccacaccggaaagtggctgatcggaaccggaatcgacttgcccaatctcgtgggccggccccaactgacaacggctgttctctatgccaaaattggggccaccgtccaagcaattgcccgacttatcccacgttccaagaacgacgacaacgtttcttcgagcaacggcggtgtctccgatgcctttcttctgatcatattgccagttgctgtccccgcccaaaagcatgccggtggtgccagcgcgacgaccatcactctttggtctgttgggtcggaccagggaaaccaatcgcaattcgtgagccagcgggaccggaaacccgcgaacacattgggtcgaaaccagtggaaagtgtcatgatggtacaaactgtgctcaattctgagagcaactcccgcccacccgaggcacgtgcaaaggccaagcgaaagaggccgaagcgacgacggagtcatctgaccaaacaatcggagaatcaaggggaacgatcccctggcactgatctgcgagcattcacagcaatgggtgagagcttgccggctttcctgatggtctgccccgtgatcgctgccaatgacgacaccacgcggcagtgtcgaaccgttctgctcatggatcccgggagtcaggtggattatgcccaaacgattctgacaaagcagctcgaactcccgaatgcgggatcatccccgctggtcgtgcaagtgttcggcggatcaaagaagaaagtcccgtcggccaaacatcgagtgaaactcaaacggttggatggcggatgggagcagctggaggtgtcatccgtaccgaacgtctgcacccccattcatacgaagctggtcgagccgggaacccatcccggcctgctcaagccgatggacgcgacggttcagcctcaaatcgtgatcggaattcgcaagttttgggacttggtgatcggattcaaaaaatcggccgagggggcctttcttgtcgacacagtgttcgggaccgtactttgcggagagcatttcggggcgcccttggggcaatcagtgccccgcgacaccatcctcatggcaataagcggagaagaaaacagatggaaccgcatgccagcctcatcgggagtggaagcagcggacaaatcgaaaccgtccatttacgagaacgatcgtctggggattggtcccctcaacccaacgccaaagaacccgcgcgatcggaaggaccctccgcatgtccagcccgagaagcgatgcagggtggagcagcaacggaccaaatgtgagttaccggaatcggaccaagacggaacaacagaaccgtgcgaaagaggcctcagccagtgcttgctcggggcgtctctgctgtggaaggtgatgacatgggtgactcggcacccaatccgagtttttaatcgtttgacgggtggggacattcccgagccgaccgccgatcaggtcaaaggtcaagaacgagtgcaattggccagacgagcccgcgcagccgctagagcttggagaaatgccgaacgaggacgggcatccaggcccggggccgccatggcactgcttccgctgctttgttttgtcgcccttttttcttcatcggagcccatgtcggtgatgctccgctcggaggactgcgcaagcacgccatcgggattcaaatgttccggatccgcggccatgatcatcggcccggaagtcggtgaactcagggactcagtgaacggcatcactccaaaggggattggtcccctgtgcctcttccttcaatgggaaggtggcatttcgactgtggctcgtcttggcccgcctcgccgccgcccccaatgtcgcgaaagcgacgagagaaaaaggatgggctttggatggccgggattgttcccggcggactgaaggaagcagggggcccgatgccaaacagtgattaatttatgatcaccatcccccatttttgcctccttttcccttcctttcacttcaacaatttgccttccccccccccccctctttttccgtcttatccaatttgtttaccatttcccttccttttgcttctcagcatttctcatttgcatttttgtgcccccgctcactttcatttcaaatgttttcctttgttgccccgccgcggggcatctgctctcaaatcgcttcttttgtcccaattttttgcccgtcttttctcaccattcaattcaattcattttgtaccttgggccccaatgtcatcgggtaaatgttcttcccaactttgtccccgtccgaaatgcccattcacgtgatttgcatttctcattgtccggcctatttaaccccccgccggtaatctctccggcgttcactctctttttccttcggtcatctttcccttttctttcgtccttcccttcacttggtctcccctttaacacatttttcctccaaatatgtgcccttccctttggca

SEQ ID NO: 56284 - DNA, 494 bp, Heterodera glycines
  Genomic contig location: Contig_ID=SeqID_4937; Location=2391..2884; Strand=+
  SCN-specific regions: Sequence locations=1-8,31-253,275-494
atgacgacaaaaacagcaaaagacgagaaattgcgaaatgccaacaaaaagtgggcacggcaaatcgacaaaataacgcaaaaggacgaaatgggcaaaccgatggtaaggcaaagcgaagagaagaaacagttgcaaaaaggcattggcattttgaaattgacccaaaaagcgttcattaaggtcccgctaattttggtggacgatgagtcaacttccgagggcatcaattgtttgaacagtgaaatttcggaaaaatttttgcaaaatttcttttcggtgtccaaccgaatttttttctgccacggtttcggcgtcgtttccgcctcggatttgaaagaacggcttcgatggattataagagataatgcgctgctcgcactcgaaaacgcgcacccccaactgatgcatttcggtgggaaaagcccaatttggacttgcggcatttcatagtgaaaaaatatcttcaactttattgtcaattattgacggga

SEQ ID NO: 56285 - DNA, 1296 bp, Heterodera glycines
  Genomic contig location: Contig_ID=SeqID_4938; Location=144..1439; Strand=-
  SCN-specific regions: Sequence locations=1-80,114-118,141-323,345 -810,840-868,890-1167,1189-1296
atgcaaaaggcgtgcatttccccggtgagcacacttctcaatgaaggtaagtaagtgtactcatcaaatggtgcaaaatttgcaaaatttcctggcaaatcaaaagaataaattttcctttattaataaaaaaattttttcgttttttcttacccccctctcctccggttttttgcaaattcaattgccaacttgaaaatttctagtcgaactggcccgcatctttaatgaaacaaagtgcaaagtggtgttctgtgccgattctctgctcgaacgaattttggcgactcgtccgctttgtccccatttaaaggtaactttgctttttcacaattatttcactttcggcctttctttgtccacttttagtacgttgtgctcatttccaccactaattgtcagtccgctgtttccttgccaaattcgcaatttcaatctgtttttcattggtccgatgccgtcggttcatcgaattccgtcgatttgtcacgaccattgcccaaaattgatgtcgaaaaagacgtgatgtttatgccattttcgaggtggtgcttttgtatttagtgtttctatcacttaaatttccctttcagtggcaccaccggtctccaaaagggagtgatgctttcccatcgcaacgtcggcacaatggcacgaattttcagcaggcaaagaaatgggatgaattcccaaatttaccccccccccccccccttttagtcatttggaaaatcaaatgctgagaaagatggaaccgaattgggattggagcaaagagcacatcatgttgcacttacccttctatcatggtttttgagggggaaacattttaaaaatttagaatttatgtccggctttactgacagcggcgagcagaatttttgaataataattggtacaattcccatgtttcccttttttattttcggaatttgtggccttcaaaatcgaacgattaagaaatctattcgctgtccaattacattttgtaattcgtccgtttgtcagtttatggcttcgttctcggcctcaattcccttttgtgcggcggttcgggcgtcgttttcggtcgttttgacttggacctcttctgcagaaccgtccaaaattaccaagtgcctttggcatggcttcacacgttttgtctccactcttttccaggtcaaagttgccttcttggtgcctccaatcctcgtccttctcgccaagtcggccgccccttctcgttacgacctctcatcactgaaactgattatgaccggtgctgccccggtgggcaccgatctgttggacaaa

SEQ ID NO: 56286 - DNA, 95 bp, Heterodera glycines
  Genomic contig location: Contig_ID=SeqID_4938; Location=430..524; Strand=+
  SCN-specific regions: Sequence locations=1-95
aactgacaaacggacgaattacaaaatgtaattggacagcgaatagatttcttaatcgttcgattttgaaggccacaaattccgaaaataaaaaa

SEQ ID NO: 56287 - DNA, 556 bp, Heterodera glycines
  misc_feature (20)..(20): n is a, c, g, or t
  Genomic contig location: Contig_ID=SeqID_25544; Location=56..611; Strand=+
  SCN-specific regions: Sequence locations=1-71,93-160,224-400,504-556
atgggattacaaggtgattnatttgcattatttattatggtttcgcaattattctttcggtcatttattttactgtgttaatatcttgttttatgtattaacttaagctttgatattaacttatattattggaaattttatttccgtacagtaaactttgtaaaatataagtaagtttttttaaaatttttacttaatttatttttttataagaaaatattttgtaaaagtgtcaaatgtccttgttctttaaattttaaactttattcagatataatttagtttaatatcatgtaaacagacagcaattgaatttatggcacccgctgacatcaaaagtcaaaccaacaatgagcaagaagatgatgattttggttatgccaaataataaaagaattccaattttatttatttttatatataagtcttttacatatagaattatgttataatagcataattgcttttattaatttttttaaaattaattatttattaaattagatgggatccaattaaggttggttgtgtcacgaaatttaatattatttaatga

SEQ ID NO: 56288 - DNA, 1022 bp, Heterodera glycines
  Genomic contig location: Contig_ID=SeqID_25544; Location=653..1674; Strand=-
  SCN-specific regions: Sequence locations=1-25,47-53,75-130,156 -268,290-922,1001-1022
atgttcaatgcgtcgaccacagctggtggtgatgaatgtggaacaaatggcaaaatgaaaattcaaatttcattcacaaaccgaacgattattgtggaaaatgagaattttatgtttaagttagtgcatcattattttttaatttaattttttttggaatgccttttttcatctctttttaacatcgcttttttgggttgcgcaatttcattttctctttcatcattcattttcaacacttcattatgggtttaaaggactttcattgttttttcagttgatatttctagcccatttatttttgaccatttttctaaagcctcaattgctttaatcaactgatttgaatggtcatcatattcttgggcataatataatttaacttcatctgcatgcatttttataacaacagatgccacttcatttgcaataaaggacggcaggtcattaatataattaaaaagagtaatggccctaagacacttccctggggcactcccgaaaatattttgaaactttctgacaattcttcgccgatcttaactttaaaactttgatttttttaaattaccgtatttactcgattagaacccccctctcgaataaagccccccttctgagagaggttgaacaataaagcccccttctcgaataaagccctccttttgaggggggggggggggggtttcagctacaccttatttaaaaaagtaattaatcttacactcaggtataattaaataaaacaacatgcattgaacatgctacagaataacaattaacgaacttattatttatgtatcagaagaccatatactgtatacgcatttattattctaataattttttctccatttacgaaactacggagttatataaatgttcatgagataattatgagagctataactcaacttaaatgaaaaaataatttaatttaagttttatttatataaaaatattattattctataaattacaaaaatgaatatatattattctgcatttcagacgaaaataaa

SEQ ID NO: 56289 - DNA, 252 bp, Heterodera glycines
  Genomic contig location: Contig_ID=SeqID_25545; Location=1242..1493; Strand=+
  SCN-specific regions: Sequence locations=1-116,138-252
atgataaatacaggtgatggtggtgctttgactgttcttaaggacgaaaaagcaatgacatattatggcattggagaaggcgcaaccgttttattgtttactcaatttgaaattgccgtaaaatacaaaaaagataatgcagagaaaatgtgcaccgttcgaatgaaaggcacggatcttgtggcagaattgagagacaaaattgtggaggaaatgaaaaatgtttttccactgattgtttataattctata

SEQ ID NO: 56290 - DNA, 902 bp, Heterodera glycines
  misc_feature (61)..(61): n is a, c, g, or t
  Genomic contig location: Contig_ID=SeqID_25548; Location=1..902; Strand=-
  SCN-specific regions: Sequence locations=1-90,113-117,139-186,219-902
atggcaatgctttcatttgtgttttcaatcggtattttgacttggacatatgattatatgntgggaaatgaccatttaaatctttccttgattaatgctgaagaaatatttcaaattcaacaatttttggatggaaatctcagcgattttgtattatattgtggacaaaatgtgagtgagttcttcttatattttataatgtttttttttttaattttgaaggattattttctcgggcaaattacaatgggtctttattttgtcgaaaacataatttgttatgcggtaattgtcatttgtggatataaaatggccagatttgtttacaaaaacttggacaaaagttcagcaagaagacaacaaattaaccgacaaatcacaatcaatttgattctccaggtaaaattgatgaataatttgaggtgaagttggttatctttttagattattgtcggtttagttaattagtatattatgtataacttaattaatacatcatgctaaaaaaagtattgatgctagcaaaagatgatgattgttgtttaaataaacactcatcccgggtttataactcagattaatttaattatatttaggcatttataccgttggctatgaatttaataaaccttataatttcggttgaaatggtgatttttgaattccaattgtccccgagttttatgtttattcaaatgtgcatcactcttccctttcattggttgcccgtactgaatccgctggtctcaattctctgtgtcggtgactaccgtaacgcggtggccaatttcatccggcatacgatatgcagaagacaaaatgccgttgcacaacagcaaattctgatgaataacctccgaaataataatcgaaatgcacaactgcctattgtcctttcataa

SEQ ID NO: 56291 - DNA, 363 bp, Heterodera glycines
  Genomic contig location: Contig_ID=SeqID_25551; Location=950..1312; Strand=+
  SCN-specific regions: Sequence locations=1-247,269-363
atggtcgccaaatcaaaagttttcgggcaaatcaaaggcaatagccccgccgagcaattgcaatcgttgcggagaattgcactggacacaggactgccagagaaggaaaatatttgccgcaaatgtaatcgcagaggtcccatcgaaagtcaatgcgacaaaatacgagcatatcaccaaaacaaaggccaaaatttcaacaccaatacggttatgctcccagcggcctacatcaattccgtccattcatcaaatctgcttaaagcaccgattaatgtgcacggcataacaattggcttcatcctggacagcggtgcggtgataatcatcatcaatgaagatgattacaacgcaatgggctga

SEQ ID NO: 56292 - DNA, 267 bp, Heterodera glycines
  Genomic contig location: Contig_ID=SeqID_25552; Location=341..607; Strand=-
  SCN-specific regions: Sequence locations=1-5,27-138,160-267
atgtgttgcaaaaattcctcttttacccatacaattggacatgtgacggaagcaattataaaggtaattaacgaaattatttcgaaaaagaaatttttttgcctaatttagcttatgaaaaaattaaacgcggaaaagcttatgtcactttgcccaaaagtcgtccgacaatcaaatgcacttcggttaacgtcggctgcaaaaaggacatgtgcaattgtgacaagtgaatgggcaaaatgccaacacaaaataatcattaattag

SEQ ID NO: 56293 - DNA, 315 bp, Heterodera glycines
  Genomic contig location: Contig_ID=SeqID_25552; Location=785..1099; Strand=-
  SCN-specific regions: Sequence locations=1-181,211-284,307-315
atgtttcttttgctttctcaaatttttctcctttcatttgcgtgccaaatgagcgcaaaaaatttgtccaatttgcatgaaatggcaaaatgccatttgggctacgatatttctgtttataatggccatggatgctggtaaaatgaaataattaaaatttaaatggaatatgtctaaaaccaaaatttaaaaaatatatttataataattgaggtgcgctgtgaacgacggaattaagaagaaatcagttgatgccattgatgagtaaggaaatattcggtgaaatgttaattttctttcttttttcgcaataaa

SEQ ID NO: 56294 - DNA, 1276 bp, Heterodera glycines
  Genomic contig location: Contig_ID=SeqID_25553; Location=486..1761; Strand=+
  SCN-specific regions: Sequence locations=1-514,537-748,770-1099,1122 -1276
atgacagcccccatacaggcattaattagggggtgtgccagcaaattgggagcattattgggtaccgaaattccacccgacttgggaataaatgccctaccgaatcaatgccaaagaaggctgtacaaattcagaaaccttcttaatgacttagaaagggtggtacaaaagattgaagataatttgggtttggctaatgagtatattggtaaactgagtcgagacaatgcaatccgtaaggaaacggaaatgcaggaattaatgcaggagttacaaattaatgagaaacaaaaggcagctgacgttctcattccaattttgagggacaaaattgaggcattagaagagaagttagacataactcacaacacggatggtgacactacctccggcattggacccctctcaaggagcgtgccaatgcgtaaaaatttgccaaaaactgagcttaagagatttgatggtagtccatctcagtggataccattttgggattactttcgtacaataattcatgaggactctcatgtcccaaaaatcgataagttcagttatttagactcatgcattgaaggcaaagccagtgccatcattcagggtattccaattagtgagagtgggtatgatgatgccatagatttacttttaaagacatacggggaaaccaaacgtctgattcgaacgttgaaccgggaacttatgtcgcttccaattagtgagtcatttgaagacgacgagtccttgtacttgaagtctgaaaagatttttcgacaactgatttcaatgaatcagaatgtcgaagatggtatgtattacagtaacctggagggcaaaatgtctccagaggtgttagataagtactgtgttatcaaggatgccgaagataatgatgattgggatacgtcaaagtttcggaatgcattctcacgtgcattggaccaaataaagcataggcaggaattaaggaaaaatgtgattgagcccaaaagggacaaacatgaactgaccatgtctttcacggcattttccaaaaatgataagtaccaagggaggaataaatttcctcaaaggaattcggatcaatcgcaccctcgtgggcggaaatttgaaccaaggaaatttcgtgatcagaggcacgataatagtgactcatcagtcagccattcaccaatgagggataggaggaattctccttatcccaaaagggattggtcaagctcaccagagcgtgaaaaatggaagaaggatgagcagagaaaatgccaattgtgccaag

SEQ ID NO: 56295 - DNA, 764 bp, Heterodera glycines
  Genomic contig location: Contig_ID=SeqID_4939; Location=265..1028; Strand=+
  SCN-specific regions: Sequence locations=1-103,132-218,242-288,310 -339,418-432,482-618,640-764
atggaccacatttattacggtgttcgactcggtggagcagccgaacaaactccaaattggccacggaaacggaccatcacaccaaagtgtgcctgttcaggtcaattattttttaaaaatatatattttaagaattttcgctttttatgcacgaaaaatgaattggtttttggctttaaatttacaaaaataatttttttggtcaaattaatgcattgtaatataatattaataattattagagatcgacattttgaaaaaagcctggacctggaccttgatttcctggacaaaaatccaggaaaatccaggtccaggaaaaatccaggctcctcgagacctggatccaggcatggacctggattttttgaaatttattttaaaaatcaaaaaaatgtttgaaaaaattaattatttgcttagaagcatctgaaaatatctaattaataataataataatgtctttttaaatttatttaatctgtttttgaaaacttgaaaaaacatcggtcacttgaaaaaataaattctaaaattttgtccaggaaaatccaagttttttcctgttttgcctggacctggatttttttcacatttgacctggatcttgatttcctggacaaaaatccaggaaaatccaggtccaggaaaaatccaggttgccgaaaaatggcccggacctggacctggatccaggaaaaatccaggcctggatctaggtcaaggtcgatctctaataattatataggccaaattaattttta

SEQ ID NO: 56296 - DNA, 2844 bp, Heterodera glycines
  Genomic contig location: Contig_ID=SeqID_4940; Location=326..3169; Strand=+
  SCN-specific regions: Sequence locations=1-242,330-478,602-621,647 -670,714-750,813-839,865-977,1001-1008,1046-1340,1363-1375,1397 -1403,1442-1796,1842-1954,1976-2130,2163-2369,2391-2647,2669 -2730,2752-2844
atgaagaggcgtgtgcatgtcggcacctgtttcagcccacttttcctggcagaacattggcaattggttgtgttggccatcgaaatttaccggcattacggcattcagttgcaagttgtgtatttgatgagcgcagttgagggcttatataaaattttgaaggtatttcaaaataattcgcaaaaaatcacaaattataaacaggcgttttttattttatttttttcaatcacaaaaaggacaaattttcaaatttacaaaaaattattttgaaattgtcaaaattttttttgattgttttattttttaaattcgtttaattttaatttgctttaggcatacagttcaaaagaacatatccaattggagccatgggcatcaattgaaattgatggacaaattgataaagagatgaacctggaacttgattggaggaatcaggcaacggcacacactgattgccttttaaaatatggagtaatttaaaaaacaataattaattaaattgatttaaataatataaaaaattaattaattataatataatacaataatgattgttttttaaaatatgatagataaaatttattttattaaaatagcaacagataatggttgtcgtaatttaaaataattattttaataacaacacgcacttaaaaatttggggtattaaaattgttattttaaacataaaaattattaattaattacaccaattgattaaccgcctattcaacatttttcaagtttaaaaatgataatatttattatttttattatatatttaaataaaataattattaattttagtattctgccgaatttttgattgttggtgatatggatgacattttgatccctgatgataaagaatattatgcagaatttattcgaaatgattatcggcataaaaagaatgctgtcgcacttttataccaaagatatacagtggatatagtcacaagtaatgccaaaaatttataaatttagtaaaaaagtccaatgaaatttattttaaaattttaaatgatttaaaattttagcccaaaattcgtcaaaattctcattgttcgatgcgttaacatcagcaaaagttgcgttttatcagcccgatgatcccaaatatgtggtgaacacttcgcgcgcggaatcgttgtggattcattggccagtgatcataaagccgaacactgcaacacgcctggtgccatcaatggaagggcgaatgttgcatttccgaaattggcactttttggaagacgaaaatgacattttggcatcggaaaattatatgcacaggaaagtggtaaaaactattatttaaatgtgtaatagcgagaatcaaaattatataatagtagttatggtccggtgccattttcattttcacgaatatgcttaagtaaaaaagaacaaaagttctagaatttttctcatgatatttattcaaaaaatgtgatgaaaaacctcgaaattatagaaataaaataaataaacaacctaattttaatcgaaattaaaatcccattcaaaatatcataaccaataaatttatttattagaaaaatgcagctctgtggcgctcagtggcactgaatgaatcatttcttagcacgaaaacggcacgacaaattagcagacgatttaaatccgacattttcaagcgcaatttcggcacatttcttaaattgccaaccaagagaatgtatgctgaaatgatggcaaaatgttatgacaaaattttttatttgcatgataaacaagtgacggattgtccgggtaagaatttcgacaaaatttgaaaaaaattatatttttaaaattaaatattttttaaaggaccacaccgatgcagaatcaaaccaattaatgggctaaactgttttattgcaaaacgtaaattaattgaacaagagttggtgcccggaattttttggtacatttcgccagagaaaggaaaatttcgcttttcaaacgaaggatgttcactttaaaattttttatccaataaaattcatatgcttacatattcccgcagtgccaatgatgccgtcgagaaaatttttgatggaaattttaatgcatgtaatagaaaaaagggattttggtttgcaattgtgctagcgaaatggataaagaatgagatatattttttgagagattaaagtatttttgagcagttattgttccaattttacaactattttgccaacttttttggcattttcggtttttttgcttgtttttcattaattttacattttcgccaacttattagaggtattaattgctaattttatggatttgctttcttctgatcagtaggattttcaattaattttatattcttgccaatttatcagaggtaatttaatttctaaaaaatggtaaataatttttttagtgttttatggatttgctttcttctgatcagtaggattttcaattaattttatatttttgccaatttatcagaggtaatttaattgctaaaaaatggtaaataatttttttagtgttttatggatttgctttcttctgatcagtaggattttcaattaattttatatttttgccaatttatcagaggtaatttaattgctaaaaaatggtaaataatttttttagtgttttatggatttgctttcttttttaggtaaaacattggatgacttttgccgttatcaaggagataagaatcattgtttagacggagtcattccatgtttatacaaaaatgatgaatgcgtaccaaatcataaattagatggtgtgacaatctcaagcagtgtaagtaagcgggaaggggtcaatgttataattattcaggtgtggatttaa

SEQ ID NO: 56297 - DNA, 206 bp, Heterodera glycines
  Genomic contig location: Contig_ID=SeqID_25554; Location=74..279; Strand=-
  SCN-specific regions: Sequence locations=1-206
atggtcatttttggcaccgtttctttccctttttcctccgtttgtctgctgcaaaaccttcgggaaacggtcgtaaaatgcctgaattggcagtcggtcattgctggcacagatttcccacgcaatgctaaagcagaaaatagccaatggattcattttggtgtgttttttcaattaccttcgccattgctcttcgttctgccaag

SEQ ID NO: 56298 - DNA, 468 bp, Heterodera glycines
  Genomic contig location: Contig_ID=SeqID_25555; Location=1407..1874; Strand=+
  SCN-specific regions: Sequence locations=1-268,290-468
atgcacgaattttggcgctgcaaaataaagtgtccatattgcccggccagaatcactgtttcacgcatttggcaacaaaatgaacaggggaaacgcttcaaaatggggcattataataatgaaaatcataatcacccgccaagaacagggaatattatggtactgtaactttaaattacagtatactataatttttagtaaatacggtagaacttaattaattttgctaatattttaatgcaggtacgaaatgctgaagacagattgaggcaggaagcaaggcaggccaatccgatgagaacgagggatattgttgctgaagtgagatcttcaatccctgttggtgtacgggtggccgtcgaatctggcactccatcatcttctgcaatggttcgtgcctttaactggcacaaaagcaatgcccgacggcttcaaggagatgaaggactcgatttggatggtagttaa

SEQ ID NO: 56299 - DNA, 657 bp, Heterodera glycines
  Genomic contig location: Contig_ID=SeqID_25557; Location=415..1071; Strand=-
  SCN-specific regions: Sequence locations=1-28,50-76,256-264,290 -365,387-435,460-657
  Gene Ontology: Mol. function=protein binding; Cellular component =axoneme; Biological process=N-linked glycosylation
atggaaaatcaaaatacactgaagaaaggagaagaagctgaagaggaagcggtaaacagtgaaatgggaatattcaaaaaagaagaaggaaacaaaaaagcgaaggaaaaggaagaaaaaggggagaaagaaagagaaaaagaggaggaggaaaaggaaaaagaggaagaggagaaaaagaaaagggaggaaaaaagagagaaagaaagagaaaaagaggaggaggaaaagggaaagaaagaagaaaaagaggaacagatggagaaagaaattgaacaagaagaggatgaaaagggaaaagaacacaatgaaaagttggaagagatgaaaagggaagaaggcccttcaaaaggagtgcgatttatggagagaacagaaacagaagggacgcaagagatggaacgattggaagaatacgaacgcaaactgcggaggaacaccaaagaggccctggaattggtggacagactgtgcgaattgcaacgagggcaaacggcaccatctgaggcaatcagtgggaaaataatggcaattagcaatgctaattggacaatgatcaatgctaatggagatattaatactaattgtgatgctagactcatgccaaactttgattctatccgtttagcgccttcggatgccaccatcaaaaagtaa

SEQ ID NO: 56300 - DNA, 1316 bp, Heterodera glycines
  Genomic contig location: Contig_ID=SeqID_25560; Location=76..1391; Strand=-
  SCN-specific regions: Sequence locations=1-382,405-574,654-1316
atgaccgcgcacattgtgcaaaaacatccgcaatatgcggccaaattgctggcaaaacagctcgaatttggtgaccaccacagcgaacaaccgggcaacacaatgccaaaagtggaggagggggtaaaagggccatttacaccaaatagaggggaagtggtcaaatggggggggggcaccaaaaggtagaaataaattttgacgggttttaaaaatgagagcattgtcaccggatgcgaaaaattgaaggatttgacgcaaacagttcactgattctaatatattagattttgctgtttttatatcaaataaatgtatttttggtcccggggccgagggaaacaaacgccaaaatactaacttgcatttttgaatttctgagtattttcctaaaaatatttttaacaccaatatttttttgttattaatttcaaatttcgaacaaaacagaatgcacatttcaaaaattttgaattttcaacttttcatcgaattatgattcaaaatttgtcaaaaaggatctcagggccgttgaaaaggacctgaaaatctccggtaatatgtgtttgatgactttttaaatttaatttttaatttaagcaatttaataactaacaaaaattattcaaaaaagaataatttttaatatttttcagcagttccctgtgccaaattcggcttcttcgctggctgccactggcattgccaatactagcagcaacgacaatggcacagagaaagaagcattgtccggcactgaagaaggcgccagtttgtgccactctcgcggatatggcacggaaacaccattttcgacaattgtgccgtcgtcaccatccgtgtccatttcgaactttgagtgggtcgaagacattcaaatcggcgatttgcccaaccaaaatgaatcatttgcgcgggtgccatcccccgccactcctccgccattggcaccatcggcacagagcaaagacattccattcgatgccacttttgaacattttcgggtgccaccgcccgccactccgccgttgtcgtcctcgtcgtctgtgctgacaatgaacacaactgcagctgaagacagtagcaattgttctacgatcttttccacgacgacgacaccaaaagccgatgcaattgacaacgaaaacagtgccaattgctatttggaccgattcggcaaagagtggcgtttgctcgtcgaagcggccgccgatgtcaaacagttggaccaaattgcgggcgaacattgtctaaatcgcaaagggccgacgaaaaatgatgggcgcatttacttcaagtgggtggcgatgagctga

SEQ ID NO: 56301 - DNA, 93 bp, Heterodera glycines
  Genomic contig location: Contig_ID=SeqID_4941; Location=4742..4834; Strand=-
  SCN-specific regions: Sequence locations=1-46,69-93
gacttaatgtcccatattttcgagaaatttattttcacatatttgataaaatttaagtaatttataaaaagtagtaataaaaaaagtgagagc

SEQ ID NO: 56302 - DNA, 97 bp, Heterodera glycines
  Genomic contig location: Contig_ID=SeqID_4942; Location=822..918; Strand=-
  SCN-specific regions: Sequence locations=1-97
atggctattcgaacagtggtggcagtggaaaacacggcggaagcaacgattccagaaaaagacggacagttattcgacgcgtcaacgaaaccgcgag

SEQ ID NO: 56303 - DNA, 904 bp, Heterodera glycines
  Genomic contig location: Contig_ID=SeqID_4943; Location=448..1351; Strand=+
  SCN-specific regions: Sequence locations=1-270,292-379,401-443,667-904
atgggaagaaagaacctaaaaacttcaaagtcacttcgacccttagaaaatatcaatgattcggttggaaaaataggggaagacttggaggacgaagaactcgaagaagcggacgacaacgaatcgcttgaagacgaaattggagcggaatcgggagaaggtccgtcccaacaattttaatcggatttaattattccaatgttttagaaccttttgaattagaatttgttgggtataaatcggcaacaaagtcggctaaatgtttgcttttggaagcattggaggacaacacaattgcaacttcgcgctttgttctcttcaagttttcggatggcataaattaaaaggaggcaagcgatccggtggtcaagtagttagtgtgccttcctttggtgctggcttcccatgagttaaagtcccatttcttctgattattttaaagcaaatattatattgaaattattctaatttttgttttttttaatttatttttttaattaattaactttatggtattttaaattaatgataatgattttttgaattaataaaataataaatatttttaattaatagaataataaagtctaaattaaatattaaaattaatcgaataaaaattaaaaataaacaaatattaataaatatttaaataatttataaatttcaaaatgagttaattttagggttagacgaatgtcgggtatttgggcaaaactcgggtcctggatatttccgggtccagaaaagccgggtccaagtttttaaaccgggtacgggaggaacagagagtggaagaggaacagaaagtggaagagaaagtggaagaggaacagaaagtggaagaggaacagaaagtggaagagaaacagaaagtggaagagacacagaacgtgaagagaaa

SEQ ID NO: 56304 - DNA, 278 bp, Heterodera glycines
  Genomic contig location: Contig_ID=SeqID_25564; Location=113..390; Strand=-
  SCN-specific regions: Sequence locations=1-85,107-278
  Gene Ontology: Mol. function=pre-mRNA splicing factor activity; Cellular component=nucleus; Biological process=mRNA splice site selection
atgtcatctcgacgcggcggtggtaataatgttgagggaaaggtttacgttgacggtctgccagaggacgcaacttccgaagaggtttcaaataattttttagttaaattagaatttacacagttcatatgtcacaatttcagctcgacgacgtcttccacaagttcggcagaattcgtaaaatttgggtcgctcgtcgtcctccaggttttgcctttgtcgaatttgaggacacgcgcgacgcgcaagacgcagtgcgatcattggacggaacgtaa

SEQ ID NO: 56305 - DNA, 1608 bp, Heterodera glycines
  Genomic contig location: Contig_ID=SeqID_25568; Location=64..1671; Strand=+
  SCN-specific regions: Sequence locations=1-12,100-679,701-1014,1036 -1138,1160-1521,1543-1546,1571-1581,1603-1608
atgccgcgtccgcttttccctcttcctttcccttcttccgcttctccgcctctctctgccattcctcgcgttcgtttcctcactctttccctttccttcgtctccgtcgtgtttttcctgctcactttggcattttctgtgctcattctcaccaacatcaatgccctgcacacggaagtgatggtggacatcgagcagttcaaagtaaatttgggaaaggttcggatagtgagtgaattgtgtcccatggctaagggcgtcgtaagcaaagcgtgggacggaatggtcgaacttcaagcggcggacggaggccaaaacaacgggaaaagtgccggcaaagaaaacgcacaaacgacgattgaccgacagaaaagacagtacggcacaatgccatcgtacagctcagcctatgttaacaaacagcagacatccagtgagttggcaagcacaagcaaaaagataacaacttcctaaagattgcgctgcccgagcaaacaaatgccccgccggacctccggggcccccaggcgccccgggattgcccgggggtatgtcattagggggaatttcctaatgaaatttggttggtcagagccaggaacacgtggacaagacgggattccaggaatgcctgggatgagtcagagtttcgacagtggctatcaagatgttgtccattttcgccatgcaaaatgccctttcgccccttaagggctgtgtccaatgccccccgggcccaccgggcgttcaaggcattcaaggcgtgccggggactcctgggcctgacggacaagtgaaaagttggacttgacaaatacacagaattctttagccaggaacacccggcacaaatggaggagggggctacgcaggcgcaccaggaggttatttggctaattactgatcaatcgaatggaaatcttttagaacccggagaacccggccaaccaggtgaaggtggtgcggaacaactccattcgaaaatgatttaggcactcccggcaccaacggatctccgggccaaccaggccaagcgggacaaacaggaaaaggtgggattaagcgggaggagggcccgggagcagagcgattttcaggtccgcctgggcctaaagggccaatcggaccggcggggccaattggacagcccggacagcccggtaagtgaagcgatggggaggcggcatttagaaaaagcaactgtcaggcgcacccgctgcaacgggcgcacagggccaaatgggacgagtgggctcgtcgggactgaatgggaacagcggtgggatggactcaattgaaaatttgcaacaaatactttttaggatcaccaggccaaataggaccggttggacaatttaatgatccctaattgaggagaatgacttgtaaattacagcctgggcctccaggagcaccggggcaagatgccggatagtgaggagcaatggccaacggcaccaaaaataagcaaacattccgttcagttgcccgtgcccaccccgagtccaagcggcgccgtacagacagaagcaatgaacaaagaatcgaaagagaaagagaggaagagaagcaatgatatgaaaatgatgtgtttttctaaatttagaa

SEQ ID NO: 56306 - DNA, 1427 bp, Heterodera glycines
  misc_feature (22)..(22): n is a, c, g, or t
  misc_feature (93)..(93): n is a, c, g, or t
  misc_feature (1356)..(1356): n is a, c, g, or t
  misc_feature (1361)..(1361): n is a, c, g, or t
  misc_feature (1370)..(1370): n is a, c, g, or t
  misc_feature (1394)..(1395): n is a, c, g, or t
  Genomic contig location: Contig_ID=SeqID_25569; Location=1..1427; Strand=-
  SCN-specific regions: Sequence locations=1-1427
  Gene Ontology: Mol. function=microfilament motor activity; Cellular component=actin cortical patch (sensu Saccharomyces); Biological process=exocytosis
gcgttatgcgattttgtgtgcncaaacgtggccacaatggcacggggagccaaagtatcattaagtgaatgctgtcggtccgttgatttggcncaattaattcagaaagggttgcgaattgatctgtcgctctgccgaattggcggacactgaattccgactcggacacaccaaaatttttgtgaagaatcccgagtcgttgtttctgttggaggagggccgggagcgtaaatttgacgcatttgctcgagtgattcaacgcgccttccgacgcttcaccgccaaaaagcatttgaccaagcaaaaagtatcacaacagcagcaatgttttcgaaataacgatacatttggccaaatcaatttaaaatttaattgattactaatttggcattgttaaaggatgaagccgtttcgttgttgcaaggccgtaaggaaaggtgccgattttcaatggaacgccgatttgtcgcgggtgagtgagcaattagagtgattcactaactccttacggaccgttgcacttcccatccgaatttcgctgttctttccccacagattacattggcatggaccaacggcccgggctgcaggccatcatcggacggcgtgaacgtctttactttgctgccgctgttgtcaaattcgacagacgatttcgggtaaacaactaattatggcattttggtgcactttctcattcaaaggcttcccgaattgaccttctgctcacggccaaatatttatttttggtcggtcgcaagccgttgaaaagcggcgtaaacaaaggcaaattggtggaagttgtgaagaggtaaagcgcataaaatggggaaataaattcaaaaataatcattccccccaccctaaggcaaattccgttgacccaacttcaagcggtcactgtcagcactttgcaagacgacttggtgctcctttctgtcgccgattcgtactgttccctggtggagacaccgctgaagacggaactgttggctgcacttcagtaagtaatgtaaattcatttcttttacccatttttaaatatggtttttacccctccctcaatttcagcaaacgatgcaaagaaagggtcggttgtccgcctctgccgttacaattcagcgaccgtttcgtcgtccatctgaaacaagcacaaaaatttccgcttgcaattcgactcattgacggcgaccaacgttttgtggaatttcgacacgcggacggagagggcgaaaggacaattggacaaacggtgaagacgcagctgaagacgaacgggcgactgatggtggtcacagtgctgaagggactgccatcggagagcagtcagtttttttgggggggagggtttatccngagangtccccganatcaccaatctagtctcttaatannaccattcattctcatttttaaattccgaatcg

SEQ ID NO: 56307 - DNA, 356 bp, Heterodera glycines
  Genomic contig location: Contig_ID=SeqID_25572; Location=247..602; Strand=-
  SCN-specific regions: Sequence locations=1-42,72-127,213-219,242 -246,277-356
ggaatcgaaggtgttgtaagctttttttccttttttcacttgtaaatttatttaaattttcaatttttttagctttttttcgaaaatttttttgtctttttttcggcaggcactgcctctgacaatgttttttatttatttagaaaaataaattgattttttttctttttgatttattttaattatatttcattcttaaattttttaataaacattttcaaactttcaccttattaatttaaggcgaattttgccttttttaataaattctcttgtgaaaaggcaaaaaaataggctcttttaaatatgcctatttaaattactttcattgctttcctttgcttacgaccatacca

SEQ ID NO: 56308 - DNA, 351 bp, Heterodera glycines
  Genomic contig location: Contig_ID=SeqID_25572; Location=683..1033; Strand=-
  SCN-specific regions: Sequence locations=1-40,70-125,208-214,237 -241,272-351
ggaatcgaaggtgttgtaagcttttttcctttttcacttgtaaatttatttaaattttcaatttttttagctttttttcgaaaatttttttgtctttttttcggcaggcactgcctctgacaatgttttttatttatttagaaaaataaatttttttttctttttgatttattttaattatatttcatccttaaattttttaataaacattttcaaactttcaccttattaatttaaggcgaattttgccttttttaataaattctcttgtgaaaaggcaaaaaaataggctcttttaaatatgcctatttaaattactttcattgctttcctttgcttacgaccatacca

SEQ ID NO: 56309 - DNA, 71 bp, Heterodera glycines
  Genomic contig location: Contig_ID=SeqID_25572; Location=1114..1184; Strand=-
  SCN-specific regions: Sequence locations=1-71
aaaaaataggctcttttaaatatgcctattaaattactttcatggctttcctttcgcttacgaccatacca

SEQ ID NO: 56310 - DNA, 1693 bp, Heterodera glycines
  Genomic contig location: Contig_ID=SeqID_4944; Location=2197..3889; Strand=-
  SCN-specific regions: Sequence locations=1-25,53-254,287-698,726 -1032,1056-1334,1365-1693
atggcttttccctgccctcccctcgcttttcctttgcttttcattttcctcctttcgctctcttcggtcggcactgtccctttgatgggttccgccgacctcgtgcatttgccgcgtgaacatcaatcgactcagagaattcagaggttaaaaacggcgttgaatgagaacgaagcaaagagagaaggtaaagctttgtcggagaatgcagtctcgcaattccttttttgctttagtgccctccgggggaaatgcgccgccactgtcgtcctccgcttccctcttcacttccacaacttccgctccttccaacacttcgtccgatgcctcggctcgtctgctgtgtcaattcttcattttcagcacattgttcggctccgtctgcaccatctcagcgtgcacttgcctcttccgcactcgtcgctccatcagcacgcaacagagacgggtcgcgtcgatggaagacgcatccattagccgtgagtttttcattctattgaaacaaattatccccgtgttttacccattggcttcctttagtttatattgcttatcaggcctgggcccgttcagtttcctgactttttcccttttccatgcttttgcaaaattttaaatgatgatgaaataattagcaaattggagaggggttccccgtccgttgccttttcattatcatttgagaaatttgaaagaattatggggaaggggaggggtggtttcccaatcgcgtatcttttggtgttccccactttttgtaccttcgagtggggggggggaggggtttccccaatttctcctctcaatttcattgatgaatatgtttatcataaatcttcaggattgacacggatacgagagcccttcggcccggataagccgtactgtcttaaggttggactccctttttgtctgaatgccttaaatacgatccctcaaattcagttcgatgaaaagggtctctgctacgccagtcctctgactcgcgaagtgccccctttgccaacttatgaagacgcctgcaaaatgctttctttggctgaaataatggcaaattgcggtgaaaataaaggaaggaaagagcaaagtgaatgcatagaaaacaaaggaaagcagcagaaaaacgaaaaggtctaggaaattgacaaatggcagggaacagagtgagaagtgccaatgccaatgccccccccccacatttgtacatttctcaaattttgtgcattattgacgacgcttacccaagcaattaacggaattacaataacaaatacctcaaaatgcacaaaatttcaaatgatctcatcaacaaagtgccattgtatttgtttcagtaatttataaattataaaagttaaaaaaatgattggagtggaaaatgacgagggacaatttaattgtatgaatgaattgactcaataacagtacccggagtggaatttgcttgcttcacatgtctgtcaaacgcacgtcccatcgcagttttcccgggaaacggcgtcacagttttggtcctgtcccatgatttggtcgtggctcccggcctcctgcaattgtcgcgtgccaatcaccgcaaaagtcggcttctcccccccccctcactcacttgtctcgccaatatattcggtcgagcccaagtgcaaatgattccctcctgacaagcagtcacttaagcagcaaaaattggaataaa

SEQ ID NO: 56311 - DNA, 2384 bp, Heterodera glycines
  Genomic contig location: Contig_ID=SeqID_4944; Location=113..2496; Strand=+
  SCN-specific regions: Sequence locations=1-76,100-319,342-469,491 -537,571-1204,1226-1729,1752-1768,1790-2384
  Gene Ontology: Biological process=meiosis
ttctataacgaagaattgtcttcgcctcagatgccaataaattaccaagtcatgaagcaggtgtcgcttaaaccgcttattaaaaaaaaaattttttttgaagggcaccgattacagtgttcacggatgcaaggcaaaggctgagagaaatccaatttaccgatggactgttgggaaaggagccatcaacaaatttgaatttgccggtcatgacaacagtctaatggcaactgctggacaggtcgtcaatcggaaaatgagcaaaactcggtatttaacttacggatttcttataggatgggtttttgcgagttttcaattggaagacgatggatttggttggctttttcaagtcctatttcggtggactcctctgtcttgcttggagtccggacaacctttacatcgcaaccggtggagaggatgacctgctcaccgtctattccctagctgaaagtgggtggcgttagcacagttttgaaaatttaaactttagatagggtcgtatgtcgtgggcaggcgcataagtcatggatttctgaagtttttcccttttgaaataaataaaaagcgaacctctaaaggtcgccttcgattgttatgcacccgaatttatgttggaacaaactcaaattttcgacgaaaaacgctgttgtccgcctttgaagggtgagggcacctgttcatcgtttgcaactaatgaaggttttttgtgtttaatttaagtgagcctttttggaaaaaacattgaatgaatccgattttttcaaaaggccaactttcattcagctccatagttgttttttttctaatccttcccattcctcaggaaacgcctttcaaaatgggcaccatttcccttctggccatgaagaaagtgtttcttctgccccgcaaattggccatttgccttttgctaattgcgacgacctccgcacgaccaacgcaaattcgcttcaattgcttcccaacggaaaagtaacgcacagaaacggctcatcggatgatgcaaatgacgtttctcactgtcagcctcagcttctctatagggttggcactgttggccacgactgtcaggcattgttttttgtttttgtctccaaatgttcgcatttcattggccatttttttagttgtgcctttgggacctttccgaagacattttggcttctccgcccctttcccaacatcacttcgacgaaatcaccgtttctccttcaccctcaaactttgcaaatgtttcccctcgaaataccacggtcattcccattggcttcgcaaatgcattgtccacaaccgaaactgatgtgagtcatcctttttaagcttaatttagaataggaaaaaggccggcttaaggtgagaacagctgacaaaccttctgacgcaaatagcaaaagcagcggacgcttcagaaaatttcataagcgtggcttcagtttcgggtcccgtttgacgggaaatgaacggtgtgttttcctatacaattttcaaatcttgaaatgttagaggtctgacaatgagcggtgagatggtttacaattgaactttacgaactttaagtgggaagcatatatgaattcggtatcaatggatagataaagtagagtcgacttctatgaattttcaattttacagacgcagaataaaaaaagtacttaaaaatctgaatttttaggcctaattttgaggggtattccagctttttcaattattgcctacttttgcattgcctatttttcatttaatttctgtaaattgaagaatgaaataccacattttttaaatagctattaatttttaatgaaattgtttaagaaaacagcacgggaattcttcgaacggggcaaattcgaatgaaagtacattgaaaagaggcgaaaattatgcacaatttctcggaactgtgcaatgtccacgactcgaagacgtgccaatgattgagcctttgatgtgcaaaaaggtcgttgtttttcgcttcgctgcaattggcgtgtccgttccgttcagattgcacacgaaagactcggcgctttgctcttccgcgaggattgcatcggttgtcaattttaatctagcggagttttattccaatttttgctgcttaagtgactgcttgtcaggagggaatcatttgcacttgggctcgaccgaatatattggcgagacaagtgagtgaggggggggggagaagccgacttttgcggtgattggcacgcgacaattgcaggaggccgggagccacgaccaaatcatgggacaggaccaaaactgtgacgccgtttcccgggaaaactgcgatgggacgtgcgtttgacagacatgtgaagcaagcaaattccactccgggtactgttattgagtcaattcattcatacaattaa

SEQ ID NO: 56312 - DNA, 277 bp, Heterodera glycines
  misc_feature (21)..(22): n is a, c, g, or t
  misc_feature (33)..(33): n is a, c, g, or t
  misc_feature (44)..(44): n is a, c, g, or t
  misc_feature (52)..(52): n is a, c, g, or t
  Genomic contig location: Contig_ID=SeqID_4944; Location=5374..5650; Strand=-
  SCN-specific regions: Sequence locations=1-242
catgaaagacgtttggtcacnncacaaaaagtncgatggacganccccaaanaaatgaaattctcccgggaacggttcaccatttgctattaaagaaggtgactctgtcgcctcccttttattgccttgtttatttgttaaggtcggcgtcctccgtcggtcgtttgtatgtcatttatttcaggccaatgttgcacttttcgcttattcattttgtttcggttatttgtcaattgtttttgtaaatattttttttattaaaaataaattttaaatg

SEQ ID NO: 56313 - DNA, 2253 bp, Heterodera glycines
  Genomic contig location: Contig_ID=SeqID_4945; Location=1088..3340; Strand=-
  SCN-specific regions: Sequence locations=1-731,753-1179,1201 -1282,1349-1392,1418-1476,1499-1982,2004-2050,2073-2253
  Gene Ontology: Mol. function=transcription factor binding; Cellular component=cytoplasm; Biological process=chromatin modification
ctggggcgcttaagaagaaggaagccgagcgaaggaaggagcaacaaagtgccaagaaaaatgcaaaagaaagcgctgagaaaggtcggtaaacccagccataagagaacataacgggattgaatgataagtttcagcaaatggccaaaaggaagttttatcggacgaaaagaaatcgccaaatgtaaaaaaagccgactcaaagaagacaaaatgatggaacgtatgacttatgatggattcgacaacttcccgagtttctgcctttaaatttaattgtttaccaattggagttataacttaaggtcacttccacttttatacatttattaattgttactcaataaattatatattagcgcttttacaaatgattgtgagactattgccaatcatcatttgtcttcgtaaatatgcgtacaaaatatcgaaataaacaactcacgagtctggttttgattgctttcatttcggcttttcacctgctgatctcattgccgatgtgcgcttccgctgctctttccgcttttgcttttttggatgattctgaggccgaaatcgactgggacgaacgatgtccaattgtttattccgaggattacaacatctcctttttcggcattgagaagtgtcaccccttcgactccaataaatggggcaatgtcttccgctttttgataggcaataataccctccttaatcctttaagtgtcgggccccaaatcgacttgtttcattttcagtttagactttctcccattttccagcaagtggtgccctcgtcgaaagtgccgtcctccgaccaatcgaagccaaaaaggagcatcttttgctggtccactccaaaaaataccttcgctcgctgaatggccgcttcactttgactcgcattttggaagtgggcctcgtcctcctttttcccatttgcctaatcgaccgtcgcatccttcgtccaatgcggtgtgtctctttttttggcccttttttcctctgatacagcgactgctttcctcaacagaattcaaacgggaggaacggtgttagccgcgagagtcagcctaattaggggctgggccattaacatcggtggcggctttcaccacgcctcaggtgagaaatttgagaagcggcgagatgcattggacaagaaagtgtacttatgttatggcattgtgccactttctcttaactaatgtaaaatgttttttcgcagagggaaaaggcggcggattttgcgtttatgctgacgtcactttggcaattaaacttttgttcgctaatgaattgatcaaaagtgcaatgatcggttggttggttttttgaaattatttttatttgagaaataatgatagtcaaattttgatattcccctgtttttcaaaataatgaaactcaaaaattatttattttttggtttcgctcacaatttaatcccaccatgggaatttgttcacaatttgaaacccaacatttgtcgattcatttaaagttcttaatgttcacatatatatttttttcagttgatgttgatgctcatcaggtgccttccctttccgtcccttaaatttgccttttccctcccttaagggaaatggccatgagactgattttgcctctgacagtcgcgtgtatatcctcgaccttttcaacgcgtccatttaccccggtgactccgatgcactgagttcgccctttttccgtttgtccgtcccttttcacccctcccttttctcagagtccgtttcgcgcgctgttccgctcccttttggcgctgaggatgatttttacctccgtcgactcgaaatggaattggacgccgcctttgccgatttctctgttcccgacttcctccttttcgtcgccggcaccgattctctgatcggcgaccctttgggtggcctcagtctctcccccaaggtgttgtttctcttttcattcgtttcattgccaaaatcagtgtcatgttctaggctaaataagtctgaaaatttttaaagaaatttcggcggcgaaatttggggtgcaccccgaaatccgggcaccttttcattatatctttttattattttctcatccgttatcattgttttcttcctttctaaggccatttttcgtcgtgacgaaatcgtttttggtgctgcgatccgtcggagggtgcccattacaatggtcaccagcggagggtacacaaatcgatcagccaaagtgatcgcggactcaattttgaatctcaatcaaaaggggcttattcaa

SEQ ID NO: 56314 - DNA, 572 bp, Heterodera glycines
  Genomic contig location: Contig_ID=SeqID_4946; Location=149..720; Strand=-
  SCN-specific regions: Sequence locations=1-66,101-572
gcatcagtttcgggccttgcattacccaaactaaacgagttggaaattcgcctgctcacttctttagtaagtttttattgaaaattaatttgtgaaatgactgaatattttattttgtttttttttacagcgttgggatgtttcaattcaatccgaagattttgaaaaagttttggcgagattagaagggttcgttgccagcgaaatggcccagcaaaatggcgttatgagctacaatgaactttgcattctgtccaacacacatggcttcaaccgttccattctctgtttgctcacagttctactgaagtttttgtttgtgttattggcttttcatctcgctttgttagccggtttatccgtgctgaatatggcagtctcgcgaaaacaggaattggcggcgagtgacgcgtgcatttatcatcacggatgggatgattgttcgcatccaccaattcttttagcaaatgaacgaaaaatcgatgcgaacttgacgaaagttgttcacaaggatgatttttttgcatttgttcatgcctttagcatcagttgatttttattttggaaataaa

SEQ ID NO: 56315 - DNA, 146 bp, Heterodera glycines; identical to SEQ ID NO: 56264
  Genomic contig location: Contig_ID=SeqID_25574; Location=305..450; Strand=+
  SCN-specific regions: Sequence locations=1-79,113-146

SEQ ID NO: 56316 - DNA, 146 bp, Heterodera glycines; identical to SEQ ID NO: 56264
  Genomic contig location: Contig_ID=SeqID_25574; Location=557..702; Strand=+
  SCN-specific regions: Sequence locations=1-79,113-146

SEQ ID NO: 56317 - DNA, 146 bp, Heterodera glycines; identical to SEQ ID NO: 56264
  Genomic contig location: Contig_ID=SeqID_25574; Location=809..954; Strand=+
  SCN-specific regions: Sequence locations=1-79,113-146

SEQ ID NO: 56318 - DNA, 1438 bp, Heterodera glycines
  Genomic contig location: Contig_ID=SeqID_25576; Location=684..2121; Strand=-
  SCN-specific regions: Sequence locations=1-97,119-909,931-1045,1074 -1218,1241-1271,1301-1323,1345-1438
atgcaaattttttcatgcgctgtttgcaatgcaaaatgtggaatatcaagcagtcaacaactactaccattcctggatccggagcttcacattctcacagcgtcatcaccattcgcagattgtggaaatttctgctaccattatctgcagctgagccagggcaattggatcaaaatcgacacacgcaccgctacgatccagaaaatcgactccagcagcatcggagatccacgaagcctcgggagacaaatctttgttggaaatcacgccgctagtttttcatcgatggacgatcgacaacgaaccaggcgaagggctattcgcgcacttggacgaatggctgcgtttggatcaatggaagtcgaaggagaaggagcacaaaacggcgcgtgcgctcacactaggagctctcccgagcgtgtgattggcctcaccgaagaatggttcagggacaaacttcggctgctcgtctcctactggacaacggcatgcttcatttacgtcacattcattttagggcgcgatgtcctgatacccttggtatgggtctacttaatggggcccgtcatcgttaccatccgcaatttggtgacgggaaatcaatggacgcagcggaacagagctacacgaggcacacggcgagcaccggcaatttcaaggattgaagcaattgagctggtaccgcctccaatgccccaggaaatgagagcgaatgaaacggcaagttcgcaacaagaggaacccgagctgtcaccgctcgtgatggagctgaaacgacaaatgatcgcgttccgctccaaacgacgttttcaaagccgtcggaatgtcgcgactgaacgtcagccgcgaatgtcccggcgatcatttgatggaaagaggcgaatttgcgggagatcaaattcgcccggacccttcccccctttttctccggtgatgtgccccccatttgtgccatttttcctttgcatttacccctcccattttgtccccattgacacaattccccacccccttttgtatttctcgcacatttattgtaagtgtagggtttaattacccaagtttgagataaacttgcggagtatttttggtgcgatttcttgggcggcaaattgggcaattggcgacggctaaatcggaacaaacggcgcagacactcccccatctgcgtcactctcccaaaaatctcaattttatggtttttatctacgcacatgaattattttatgcatattctttcagttgtctgcgggtttatcctatttttacccaaataaaaaatttataaatataattatttcctattattttctatgaatattacatttttagatttcatatatagatagacaaggcacattatattaatacattaaaaatcatagaatttttcttcgaagaaatgtatgattcaattgataaacaactaaagaataaa

SEQ ID NO: 56319 - DNA, 236 bp, Heterodera glycines
  Genomic contig location: Contig_ID=SeqID_25577; Location=1042..1277; Strand=+
  SCN-specific regions: Sequence locations=1-18,40-236
ttttaggtcgattcttaggggtgtattttttggttttattgcgtttttgttaaggaattttccaaaaaatgttgaaatagtgaaaaaatagtgacaaaacgccaaaatagtgatttttaactattttagtgacgaagtcgccaaaatagtgatttctagtgacgaaaagtgacgtccaaatgaaaaaattttaacgcagaaatgcgttttttgagctcctttcttcaaatcaattg

SEQ ID NO: 56320 - DNA, 78 bp, Heterodera glycines
  Genomic contig location: Contig_ID=SeqID_25580; Location=190..267; Strand=-
  SCN-specific regions: Sequence locations=1-78
acgggcgcgaagcgcccgtctgaggccgcgaagcggccttaatagcccaacaaatttagaaacgggcgcgaagcgccc

SEQ ID NO: 56321 - DNA, 1196 bp, Heterodera glycines
  misc_feature (1075)..(1075): n is a, c, g, or t
  misc_feature (1092)..(1092): n is a, c, g, or t
  misc_feature (1099)..(1099): n is a, c, g, or t
  misc_feature (1134)..(1134): n is a, c, g, or t
  misc_feature (1139)..(1139): n is a, c, g, or t
  Genomic contig location: Contig_ID=SeqID_25581; Location=1..1196; Strand=-
  SCN-specific regions: Sequence locations=1-48,70-276,299-435,467 -1047,1069-1196
  Gene Ontology: Mol. function=meprin A activity; Cellular component =integral to membrane; Biological process=digestion
cagcggagtcaagtcctttcgctggacaatgggtaattaatcggcaattaaatgggcaattaaaccaaaaagagtaattaattccaaccatttcagttgcatggattactctacaataattcacgaggtaataaaaccattcaatgggaaaatgacttttgagtttgttatccctttccaatagataatgcatgtcgttggcttttaccacgaacacggtccatttttgttaattttcattaattaatcagctaatatgaaatgatagtgtttaattatcataattattaattattcagagcgatgggaccgcgacttttacattgacataatatggcaaaacatcgacaaaagtaatttatacttaatgttgcgtttccaaaatgtcggagtttcgaagtgtcaacattaaaatttatgcgaatttttagaagcaataattttattaaattattaaaaattaaatggggaaaatcacttttatttactctggtcattttgttgaggtgcccttgaccaattcggcaaaattgacttgaccaaaacgagttattacggtcagccgtacgactacaaatccatcctccattacgttcgtttgacctttgatttgtgtcttgaatttggcaaataaatgaaaattaggacagtttggcattcagcaagaacggattcccgacgatgttgccaaaaaaaggaggtaagacaaaggcacccctccccattcattccgacccctccccccaatgttttgcggccacaatcggaaacgccaaggacttcagtgagatgtgagactttgtagcggaacttttgaggagtgaaccaaaaattcggatttagcgatctggcgaagatcaatcgaatgtacggctgcgatgcgatggcaacgcaccgactgaacccggcggaatttgccgttgccagccaaggccccgcaaaggcacaaatcgcgccgacattttccggcacaaaggacggcactttgccgcagatgccaatcggacaagtgccttttggtgacgaaaagtcgcacttggacagagggcaaagcgaacacggacaaagtgaggcnttcgggaagggtcagcnttgtctntggcgcttcctccccttcaaggcagcatgcgcagntcggntcgccgtttgctggtcatcaaaggaccgatgccatgccacgaatctccaacacgtaa

SEQ ID NO: 56322 - DNA, 713 bp, Heterodera glycines
  Genomic contig location: Contig_ID=SeqID_25583; Location=75..787; Strand=+
  SCN-specific regions: Sequence locations=1-146,176-202,248-340,478 -608,630-682,706-713
atggcacaagcagcaggaatagcatcgacgagagcactccaccgtcaagaaaacagtaaaaaatggccatggaaaacagacaaacggttttggccaagttcgacagaaaagcgggtggacactgctttaatctaaaatatttggagaatttaatgaaataaattttaaaaaattagttgtgtatataagagcattttattcgtttataaatttgaaattattcttatttaaaaaatatttatttaaacacatgaaatttgatcggactattttttaatacaaaattaattgaataagttaatatcatctaaatggataaggaagaacttttgaagcaccctaataaaatttgaattaatttaaaattattaaacaatcgaaattcattgatttaaatttcttatattatgtacaaaaaaagaaaatatttttaatcgaaaaaatgcaataataataaaatttataaattaaaatttactttaatgaagcagggtatattacggcaccaacaattgccgaaacgtggtggacaaggtgaaaaattagcggaaaccaatgcaaatgctcaacgccagaagattttcggagaaaaagcaatggaaacaatgcccttgacaggccaaaagcaatggccataatggccaaggtcataggatcgagatgggattgggacaacattcctttactaaaatttaaaattcaattttctcaaa

SEQ ID NO: 56323 - DNA, 2218 bp, Heterodera glycines
  Genomic contig location: Contig_ID=SeqID_4947; Location=789..3006; Strand=+
  SCN-specific regions: Sequence locations=1-112,134-294,317-653,675 -839,861-862,884-1759,1781-1998,2021-2050,2073-2218
  Gene Ontology: Mol. function=protein kinase activity; Cellular component=filopodium; Biological process=signal transduction
ttggacaaatacgagaaaattggcaaaatcggcgaggggtcgtacggcgtcgtgttcaaatgcaggaatagggacacaggcgaagtacgtcccgcttctgctgattggcacgaaaaaataaaaatttaaaattcagttggtggctatcaaaaagtttttcgaatccgaagacgacccggcgattaggaaaatcgccctccgagagattcgaatgcttcgggtcagttcgggtcggacaagggtttaatggtgaagcgaggacacatttaaaataccaattcaaatatttaacggtaattttctccagttttatgtggaagagtttaaactttcaatttgaaaatttgcttaaaaattttaaaattcccaatgcctttaagcaactgaaacatccaaatctggtgaatctgattgaagtgttcaagcggaacagaaagcttcacctcgtctttgagcattgcgaccgcaccgttttggacgacttggagagatttcccagtgggtcggtcggttttggtgccattaaatttgcaaatcgtccaaaatgtcagttgtcccgagtcactcaccaaacggctgatttttcaattgttttccgccattcgcttctgccattcgaggaattgcattcacagtcagttcagtccctttttggccaaaggcgaaagccccggccgatttaatttgggggggggagaagccacggagggaggcgaaaggcaaatccaaaaaaaggaaaagcggcgaattaatcgcgccacatggagaagcacgaacacagaaaaagagaccatactgataggtcataggcttaaacattttcaagctgaagaaaattaaaaagttcctttttccattaatcaaaaaataattttgtgttttgggcgtaaaatgttcaattaaccaacggcaaacgaatgaccctttgccaattgcttaaataatctaattattggtgttcaattgttcaggggacataaaacccgagaacattttgctcacctccaacgacgtcgttaagctgggcgactttggatttgcgaggataatgagtgggttactgtggttttaagttatttaatcaaaatgaatttatattctattacaaatgttgcaattacttaattaccgccccccccccctcaattagcgcaggtgttaatgaaatatacaccgattatgtggccactcgatggtaccgtgcccccgaactgctcgtcggcgacacgcactacggttccccagtggacatttgggcggtcggctgcgtttttgccgaaatgctcaccggagagccaatttggccgggaaggttagccgcgctgagttggtccaacatttaaagaatccaaaaaccaatggccgttttccaatcccatttcagatcagacgttgatcagctttacctaatcattcgaacaatgggtaaagcagcaataacaacagcagcaatgctttcataattaacagtttaattgacaattatttttcattttctcggaatgcttttcgtatgttttgcttaaggtaaaatcacttcccagcaaatgaaaatcttccacaacaacgcctatttccgcggcatttctatccccgagccggaggaacacatcggactgctgcagagattggcacagacggcgaaccccgcggtgagcgtcgattttgcagcgatggatttgctgaaggtggcggcgtaaatgggggagggcacccggtgctatgtcgttacttaaagaaccatcattatgatttgatgaaaaattatttattagctgaaaagtaaccgaatttttatttcttgatatgattcgatagccctaagtgttctctatcagtctacaaaatttcaaaaaatttcatcaagtttcaaaagagttagggccaaagatgctcgaagatcaaggttttttgagttcctctagccataactttttttaaacttaacgaaattttttgaaattttgtagacttatagagaacactaagggctatcgagtgatatcaagaattaaaaattcagttgcctttcagctaagttataaataatttttcattaaatcataatgatggtttttcaagtaacgactcagccccagggcacccattaattttaaaaatgaatttggcatttttaattagcgatgcgtcgaaatggaccccaaaatgcgatggagtgccgaggagctgttggaccacgagtattttagaagcagcg

SEQ ID NO: 56324 - DNA, 339 bp, Heterodera glycines
  Genomic contig location: Contig_ID=SeqID_4948; Location=1277..1615; Strand=+
  SCN-specific regions: Sequence locations=1-339
gtctccaatcccaaaatttggccgatgtcttaacaaccataacggactgtgctcggttcattcgcgagtaccctttccccggctttgttcacaacgttttgtttaaattggctcaggtaattccatcacttttcgtttacccattttttccgcttgttatttaggccttccaaggcgaattgttcgggcgcaaattcgagcagtctctgaacgccattcggctgcgcattgtcaccgccatccgcgagtgcagcggcgtcaatttgggcgtcacaattccgtcggaggacatcgtccgctgcattatgaaagtgtcccattccaacgattacaaagcgc

SEQ ID NO: 56325 - DNA, 520 bp, Heterodera glycines
  Genomic contig location: Contig_ID=SeqID_25587; Location=143..662; Strand=+
  SCN-specific regions: Sequence locations=1-229,260-420,443-485,507-520
atggctgttcaaatcgcacaattggcggatgaacggaaaaagtacaagaaaaaatgcgatgaattggaaaagcaactaaaacaacaacaaaaacaacatcagcaggagaaagaaaagggcaacaacggtaagggaaggatattataaaaaaaattcataaaataggcaaaatgattttgaaattctttaaaaaatatgcttatagaattgttatgcgattgcagataaaaaagctttaaaaatatttaaagaagggaatggcattggcaaaactgagaaaagctgtggaacttcttccgctgatcaccagcaacagcagaaggtgaactaattacgctatatttagtttcggcgggggggggggggatacggtggctgagtcggggatacggtggctgagtcggggatacggtggctgagaatttttcttttcaaaaaataagatgattttttagctttaaaaatgcaaaaaaaaggatggtgtgatctatacatatttattatgattgccattagatca

SEQ ID NO: 56326 - DNA, 259 bp, Heterodera glycines
  Genomic contig location: Contig_ID=SeqID_25587; Location=748..1006; Strand=+
  SCN-specific regions: Sequence locations=1-122,144-185,207-259
atgtttattgcgaaaaaggaaatggaattgataaactcagaacagaggcgacaaatttcgaagttggaaattgaaaatgtgagaattttaacacaacaattgatattttagttaaattttaatcacattcattagagagcatttggagaagaattgaaacgccagaaaatgatttcatttgcattggaattggaaaacaacaaaatgatgatggaaaaaaagcagaagcaaaaagaggaaatggcaaaggcgaaatacg

SEQ ID NO: 56327 - DNA, 446 bp, Heterodera glycines
  Genomic contig location: Contig_ID=SeqID_25588; Location=786..1231; Strand=-
  SCN-specific regions: Sequence locations=1-24,52-54,175-228,258 -258,342-347,380-446
atgcaccaccatccaccgaatcatgaaaaagctatcaatctgtcaatccttacggtgtccgggccgggtgagtttccccgtgttgagtcaaattaagccgcaggctccactcctggtggtgcccttccgtcaattcctttaagtttcagctttgcaaccatacttcccccggaagcggaagactttcgtttccgggaagctccccaccagggcgaataaatccgtcggcggatcgctagttggcatcgtttacggtcagaactagggcggtatctgatcgccttcgaacctctgactttcgttcttgattaatgaagacattcttgccaaatgctttcgctgtagtccgtcttgctacggtccaagaatttcacctctcacgtagcaatacgaatggccccgtttgtctctgttaaccattatctcggtcagcaaaaccaaataaa

SEQ ID NO: 56328 - DNA, 1635 bp, Heterodera glycines; identical to SEQ ID NO: 25588
  Genomic contig location: Contig_ID=SeqID_25588; Location=1..1635; Strand=+
  SCN-specific regions: Sequence locations=1-78,123-252,283-295,317 -366,402-405,431-466,488-498,545-558,592-852,885-890,974-974,1004 -1057,1178-1180,1208-1215,1291-1362,1430-1565,1601-1635

SEQ ID NO: 56329 - DNA, 650 bp, Heterodera glycines
  Genomic contig location: Contig_ID=SeqID_25591; Location=108..757; Strand=+
  SCN-specific regions: Sequence locations=1-220,253-517,540-610,641-650
atgcgaaaagcgaaatgcgaaacgccaaaaaatgcgaataatgcgaaaggcgaaatgcgaaaagcgaaacatcggcccatccctgcccggcactgttcaaaattcgctttccgcttttgtcaaatgaggaatttacgaggaaaattggtaaaaaaataagtcaaaatttcaaactcgttttctgatgagatgccgtaaaatattcatagtttttgtggcgatttttaaaaatgtttttaaaaatttatttttcaataagttaatacatatttacagttcccttcggtgttttgtcaaaagatgaagtgatcgccgtttatcagttcaaatcccttccaaattgtcatgggatttccgacggaattttcccaatgccattttcgactaatggacggatttctgatcgaaaaaagggcacacttttgatggacattgaaaaagtgtcagaatttgcacgagaggaggttgagagcagtcggtacagcgaaaaagtgtacataaatggattaccatggaaaatattggcacaaataaaaatgaaaaatggaggcactgacaatgagaaatggttgggcttttatctttggtgctatgctccaaaagaaggtgcaaaattactaataattaatatatatattaacaacaattaa

SEQ ID NO: 56330 - DNA, 1049 bp, Heterodera glycines
  Genomic contig location: Contig_ID=SeqID_25592; Location=61..1109; Strand=-
  SCN-specific regions: Sequence locations=1-220,243-1049
atgaattttaaccccttatacacaattgattatgaaaattattttcaattgtttttggaaaacctccttaatattcaaaatgaggccaaacaaaatttggatgagtaccggaaaagaagtaaagattggtatgatgcaaaacctcaagtgaaagccaataaatttgaaatttcggaacgagttatggtggcttttcccggaatgcatcgcaattcacgacataaaaaattattgtggaatcattttggcccttacaccattacaaaaatctccgaatcgtccgccgaattagtcccagttgataaaacagctgctgaccctattactgttcctttggaaagactcataaaagtgccaaaggcagtccccgacatcgcaacattaccacggggaaaaaacccgtataaaaatgtgctaaatgcaatgattttcatgatttcggcccaactgaattttgaaaatatgccaaaacgtgcgaccgaaaattggcaattggggacaattgctaaagaatgtgtgggggcggataaatatggaaaggaaaaaagtagtgcaaaaattctcagagttaattgcctaaacctgaaattgaaggtaaaaagggaaagaaaggcgaatttttcaggacaaacgcaaacggacgccgggatttgttggacttcggtttgcagtcaaaaagatgccgagcacgaactctgcacgactctgaaattgggcgaattggaccctgttcttggacagtctggcccaggcgccatgatcgtacagtcgccgcttcaagctcttttggccgtttttctgcttcgctccggcacagtcacttcaaacaccgcagcccgaacattcgtcgaaatgatcattaaaagtggaccacaaatggaaatggccacttattcagagaagcgaggggattatgttggcaccgggaaattcccacaggaaaatgaccaagtcaaagcgctcgaaaaatgcgtcgaaatgtgcttcgttgcacgtgccgctttaagcgcaactggctacaaaccgcttgcgatggcaccaccaaattg

SEQ ID NO: 56331 - DNA, 460 bp, Heterodera glycines
  Genomic contig location: Contig_ID=SeqID_25593; Location=208..667; Strand=+
  SCN-specific regions: Sequence locations=1-395,417-436,458-460
atgagagtcgatttcaagtacgcacttgccattcaagtacgaatccatgctatgcgctcaacattcaaatcaaaaacaagatttcgtgcatttgaacgtgcatcgatcggtgagaattacaaaattcggaaaaaaccctaccagcagagctcgtttttccacgatagcttttttctttggcatccaaatccaacaaatgctctattaaccttaccaaaatcgaaaggattatcaagcctggaaaaattttattaagaaaaaacttcaaaaatctcgacttttttaggttttaactaaattttttgctcaattgttttgaagaaaggagctcaaaaaacgcatttctgcattaaaaattttcgaatctgatgtcattatcgttcactagaaatagaaatcactattttggcattttgtcactatttcgaaattttttggaaaattccttaacaaaaatgca

SEQ ID NO: 56332 - DNA, 70 bp, Heterodera glycines
  Genomic contig location: Contig_ID=SeqID_564; Location=158..227; Strand=-
  SCN-specific regions: Sequence locations=1-29,51-70
atggatgttgatgaacatcaaccgccatggaaaaaactgtcggtgaacaccgtggacaatttgactcttc

SEQ ID NO: 56333 - DNA, 178 bp, Heterodera glycines
  Genomic contig location: Contig_ID=SeqID_565; Location=118..295; Strand=-
  SCN-specific regions: Sequence locations=1-178
atggcaaacagtggtgaacattcctcgcgccgtcagcagcaacaacaacgccatcctaacaccacggcggaaaacaactcggacattgagggcactgcgcatcgggtggcgtccgttactttgaacacggagtccgactcgcgcacatccgccgacctgccggcatatccttttcgga

SEQ ID NO: 56334 - DNA, 990 bp, Heterodera glycines
  Genomic contig location: Contig_ID=SeqID_566; Location=135..1124; Strand=+
  SCN-specific regions: Sequence locations=1-464,497-710,732-766,804 -817,861-949,979-990
atgttttctcgccaaatgctaaagggatattatgcaaagcgtggatataactttgatattagaacactttttggtttgttacgcttttggactagggttgcaacttcaacgtcggggttgggaaatatcgggggtcgaggtcggagacaaatttcgaaaatcgccaaaaaaaatttcggagacggtttgcaaccctattttaggaattattgcatcaaattacactttttttatctttttattattttaagatggtattgataagcgaattgatgcatgtgccaagggattcaacgaagatccggtggtgctttatggtaaaaaaaacaaacaattttttaactgatttattaaaaaaacaaaaataattgttgtttttttgggctttcgaattttgccactccatcaggcggacagagactttcttgtacaaacaatgggcacagttatcaatgaattatgtccaaatgtaattctacaaaaaaaaaataccggattttttttttttaatttttcgatagataattgcatttggactgctcatcgcccaccgtcaactcgtcacattagtacgcatgaaaaaactgaacttggacgcgccagatttcaacacaattgtggtaaataataaaaaaaattctaaattttcaacaaaaaaaaacaactaaaaatttcagaatctaattgaatgtcataaaacgaatctcatgcaaggtgatcaccaagtcagttttggtcaaaaccttgtgataaattaactaacatgtttttctttaggtgccaatatgtctgccaaaatttaaccaaaagttggttgatttatttatttttttgtttgtaaaatattttagtttaaatttgaattatccgcgaccccgaaaaccgtcagaattatctttttgacactttttttcgcaatttttttaaaggagagggttcaaatattctcatttaatataaaaacaaaattttttttttgattccatgcca

SEQ ID NO: 56335 - DNA, 711 bp, Heterodera glycines
  Genomic contig location: Contig_ID=SeqID_567; Location=138..848; Strand=-
  SCN-specific regions: Sequence locations=1-221,261-284,317-711
atggcattgacacggctgcaccatttcaccaaagcgctcgtcaccgaagcaaatgcgctgtcgaaaggtggtagtagttcaattgtgcttggtcacagtgccgaattcgaacgttgcattcattctatgcttgtcatggcacaggtaaatcctgagattttttttaaattctcaaacagaaatttttttggaagaaaatctttgaaattttttaaaacgccaattaaaaaaataatgacaaatttttattttaaaaaaatcgctcactgtgaacattttttgatttataataaacaaacaaacaaaaatgtgcacaggtttttgcgccatgtttggccacggaacagtgggccaaataccaagcggtgccgaaactcaacgaccaactccagcgacaggctgagaagccgataaatgagaatgaatggccaacggtggacgaggacgacggcgacgtggtgcacgaagcagaaatgaaataaatatgtctgcttgttgtttttgtttgtgcattttttcaaatggttgtgtttttttacaccgtacaccaaaaaaatgttgcgaattgtgctgtgcccgggccgtggtaaagtggaactccacttcagcggtccggcacgcaattggtacaatgcatgcaaaaaaaacaaccattttttgttttgttcaattatgtttggtgtacttttacaatttgcaggctcaattaaa

SEQ ID NO: 56336 - DNA, 1442 bp, Heterodera glycines
  Genomic contig location: Contig_ID=SeqID_567; Location=1475..2916; Strand=-
  SCN-specific regions: Sequence locations=1-43,189-474,496-1013,1035 -1094,1116-1149,1171-1442
  Gene Ontology: Mol. function=leucine-tRNA ligase activity; Cellular component=mitochondrion; Biological process=RNA splicing
atgagttgggtatggaagagtcggatatggatgagttgggtactggatatatggatggatgagttgggtactggatatatggatgagttgggtatggaagagttggatatatagatgagttgggtactggatatatggatgagttggatatatggatgaattgggtacggataagttggggatggatgacttgggtatggatgactaaatgtcgggtaaccgaaaatttttatgaattaccaatccctcaatcattttctcaactgatttttacttttcagctttccctctggctggggtcgcgtcgaaaccgacactctgtaagaaataaatgatcaattaattaattcccttccaccggtttcattccttttaattcccttcccattttccagtgacacattcttcgattccagttggtattatttgcgttatttggacccgcacaattcgaatgcgccgttcgacccggacattgtcagcaaacacatggtgagcatgaaatggagacgacttgaacttgaaatcataagcatagagtatggatttggataaatttcaaaaaattttgatcctttaaaaaaatttaattggagaatttagaacaaagtttttatataattttggccttttgtagtgcaatacttaattctacagtaccctatataaaaatactgtattgctggcgcattttccgggaggggagcaccccgtcccccaaaatccaaaaaatgaaaaattagacaattttcagcccgttgacatctacattggtggcatggaacatgccaaggtgcatctgttctacgcccgcttcatctaccatttcttgcacgagcttggcatggtgcccagccgtgagccgttcgcgcatttcattcagttgggcgttgtccgggcgcccacctacaaattgcctgacggcagatatgtgcccgactcggaggtggacggcaacaaaagttggttttactgaacaaacccaacgatttttgggtgttttgaacattctaaaaacagagcactcttttcttgaaaatttaaagggttgtaagaaaattggtcagacggccttattgggctaaaaacaggaaaaaatatttaatttactttttgtctcacagaattgcctaattctcggctggtgcacaaagggagcggccaagccgtacagaaggagtttgagaagatgtcaaagtcgaagcataatggcgtggtaaattttgggaaaatttattgggaacatgaattgaattttctcgaaaattcggggcctaattgttttccgcttttttaatgtaattttttattaggatcccatgggtgtcatcgacagctatggtcttgacgagacaaggatgcaattgttgatcgaagcgaggcccaactatcagattgattggccctatccgtaccccacatttcgtatgttagcatcctaa

SEQ ID NO: 56337 - DNA, 2272 bp, Heterodera glycines
  Genomic contig location: Contig_ID=SeqID_569; Location=449..2720; Strand=-
  SCN-specific regions: Sequence locations=1-158,180-763,786-1863,1893 -1966,1988-2221,2245-2272
atgcgcatacagttgtcaaaaactggcgtcaatttcgattggaatcgcgtgagtgccctcctctgtcactcgtccaattgtgccgaaactgcgatttctcccccttttcaattccaggagattttcacatgccgaccagattactttcgctggacccagtggatttttatccaactcttcaggcatggcttcgtcaggaagacgctttccgaagtgaactgggacccacttgacggcactgtgttggccgatgaacaggtgacctaaagtgccgtacccagaagacccttattgcttcggcgagggggggggggaggcgagcgaccgtttttttaattaaatcgaccctctatccagtggtatatcacacatatgcattttccgactaacagctcgcgaggttcccttgttagtttttataggcaccgccggagaaagaaaattctgagaaattttgacgaagtctgttttaaaattgtataattttaaaaaatccccattttttcccattcattttttcgttttcaatttctggttgcttcattctctaccaccgcaaattacaatatttttttttcattaaagattgatgacaacggttgttcatggcgctcgggtgccaaaattgagaaacgactgcttcgccaatgggccattgaaacgccgcgttatgcaaaggttaaaaaaaagttttgctgaagcactgacccaatttttctatgggcacattatgttgggtgcatttcattccccttaccctcggtttccaaaaatttttcaaaaaatctcaagaaattttttttattttcttaatttgttttcagcgtttgttggacggactgtcatcattggaagcggaatggggcggtgtggtcggcactcaggccgattggattggcacttgtgacgtgcaccgattcctcctccaaacggaggtggtgtacaatttattaatataagtgtacacaatagatttggatgtggtagtggaaaatgaaataaaaactttataaatcagattaaagtgtcataggtttgaagaggttttgggtggtccacaatctgacagagtagacaatttgaagaaaaaaaaatcttgttctatattctcgtgaaaaaaatgggggaaaatttttttttgtttctttttgaaaatcatttcaacaaatttaatagaaatttcttccagcacagcagtgggcatggtgttgaacaacaacagtttgaccttcgtctgacggacccgacccaacttggcaccgcacaatttgtcgtcatcacaacagagcattcgcttgccgaagaagcggccaagcacggcaaattgtcacacaacgaaccgttcagtgagtgggaaatcatttgtttatttgtgaactcattttgggagggagcagacgatggaggacaatattacaaatatttatgttttttttcatctccaccataaaaaatttggcgctatatggaaagtcaccgattttgaaattttttttcactttttttggtcaatttttttttgtttatttttaatgcagaatttgtttttttaacatggaacgtattgcatactatttaataaactgaaaaaaaacattttaaaagaaaatttagcgctagttaaaaattgacaacttttgagttttatcaaaaaccaaaggggggaccctattgttttgcaaaaattttttgagataaaaaatcgtgaatatattttttattcgccataattatgctgttaatacttaatattcatcattatgtgtcaaaaaaaaaaaattgaccaaaaaaaatgaaaaaaattttcaaaatcggtgactttccatatagcgccaaaaaaacgatataagttggttgactaaatttcctttaaaaattttcaaaaaattcctacatcaaacaatcgcgtattttaacatttttcccactcccttcaacatgcttcaatttaagcaatatctgagccaaaaggggtgtttgtttgtccaccggatgtggctgctcgtcgcaaacatgcttgtccaagacaaatttatgccaaaattggcgattttaccacaaaagggaaatcgttttaagtggcataaaatgaattgtaatttcacgtttttggtgtgcaaagacacagaaaattaattgcaacttcacgtttgtttggtgggtacttacttatacagtttaggccacatggattttttttttgttaaaagacataaaaaatgtaaccatggggtttttggggtcgctgatcacgaatatgacatccaataaa

SEQ ID NO: 56338 - DNA, 1179 bp, Heterodera glycines
  Genomic contig location: Contig_ID=SeqID_569; Location=3576..4754; Strand=-
  SCN-specific regions: Sequence locations=1-19,41-113,135-223,245 -354,382-386,409-826,848-1093,1115-1179
  Gene Ontology: Mol. function=ubiquitin conjugating enzyme activity; Cellular component=cytoplasm; Biological process=flight behavior
atggctgcaccgaaagttcgttttatgacaaaggtatgttttttataatcccagtaaatttcaaatttgcgattccttcgggttattttgtaccaaataatatatgatttcagatttatcatccaaacattgacaaacttgggcgaatttgtcttgacatactcaaaggtgcgtgtcgctacgtttacattatttttttttcaaaaattgaatttcgtaaaatttcttttactcaaaataaaacgagcaaaaaatcatgtccctcttccattttatcatcgagaaaccgtcgggattgtttttgaaaaaattttttggtctaaatatggtgtttgttgtttggaattgtttttcagataaatggtcaccagctttgcaaattcgcaccgttcttctctccattcaggcgcttctgtctgctccgaacccggacgacccgttggcaacgttcgttttgaatgaattctagcaacatggaattcggaatttcatgacacactctatgatgaccggtttttcaaattttcttgtttagtgatgtggcagaacagtggaaaaacagcgaaacagaagcgattcaaactgcaaaacaggtcggatgatggggtgcacacattatgtgacattattggttagaccaaactttactataattgcgcattgggctatcatcacccgcctaaattcaaatgagacacattttacgtcaaatggtgaaaacgaaggagagtgaaatatattgagcaatattagattttcaaaatttgtcaaaaatccccaaaagtgacccaatttttgggaaaatcgacaacttcactatttttttataatttccggaaaacctttgccgcttatttctgattgagtggtttatgtatgatttgaagcctaaaaattgtataattgagccatgcaaattcagtggacccgattgtatgcgcatgcctgattactgtgtgagttggtgaggacttggcttggctggcgctagaggggcggaggaacatcttttttttgtttttgtgaattaattcgtggatatgtgatctgtttgcttggacggaaaagaaaacgtacagacgacgacggcgacactttctttcccactctttttcctccccctttttttgtgacaaaatcaaaagcaaagccattttttttgtatttttgtggaataaa

SEQ ID NO: 56339 - DNA, 1767 bp, Heterodera glycines
  Genomic contig location: Contig_ID=SeqID_570; Location=197..1963; Strand=-
  SCN-specific regions: Sequence locations=1-12,34-478,501-552,574 -831,869-944,977-1026,1048-1256,1279-1767
atggcattaattatgaagccaacttttctcatgctcatttcaacttgtattattgcgttggtttacgcatctgcggagtatgatgaatgtgaaggtaaatatgcagtatttgctgggatcagttttattcccggaaaggacagacaataaatatcgaaattcatttatgataagggtaccccattttttgggagtttggcctcttccgtgaaccaatccaatccttgggaccatcactaaatattggcaattataacggaagtatttttcttttatgacacataaataagtgtatattccttaaattttttctctcaaaattttcttaattcgattttttcaatccccatttttgttttttaagtttgcactgatctgtttacggaggtgatgaaaaaggttgatgagtctggtgaaaagggagagccggcagtgaagtatttttcaacaattttcctattttttttttttcttaaaattaccagttttttaggaaaatgattattgagcattgcaagtctgtcaaaggtgtggatgataagaaagaaaaattggttggcattttcaattaattcttttaaaaaatgaaaaaaacaattgattatttcagtgcttctttattggcgctcatcctgactcgtccacttcagtcctgggcgatattgcgaaaccattgagcttccataaaccgccgaataaagtataatagggctaatatttaagtgagattttgtaatcattaaagactggatttattttattcaaactctgatgggtattcaaatgaacaaaatcgattgacaatttttaattaggtagaagtttggcttgattttttttcatattttttaaattatattaatatatagtacatacctatatgcttttcaggtatgctctcaactcaaggaaagggattctcagatctgcgcactgaaatatggtaaaaatatcataaataaaataaaaataataagactggcaacgagttcacatttttgtctaaaattcaacctaaaacttcactattaaaataatttgcatttttcgtaacgtgaatttggatgataattgtttatttttgtcccctaaaatcgggtggatctttttgtaaaaactgttaaaatgattaaaaaatttctaatctgtccaatttaaatcactttcagataagccaattggtgagtttatgcttctgttttggcggtggtaatgtttaattgcttctgtcattgtgttgttttgttcagattgggacagtttggtgctggagaaaatgcgtgtcaaacagctcaaggaacttttgcttaaattgggcgattcctgcaaggcacggatttaaatttaaatttttcggaaatcgaatgaactctttttaagcctcacttttttttgaggaaatttcactgtcggtcgaaattcttacgtgcattttttgcgcaataattagtaacatttttatgtatgcatgagttagttgggttttgactgggcatccaaaactttaaagattaaaaaaagccaactttctaatagtttaaaaaaaatgcaaaaatatggaaataacgattcaggccttccacaatccagggggaaaatatggctttcaatattgttggatgctatcttacattattcattgatttgattcttaaaattgaataaatttcgcaaaattccaatgttttttttcagggttgtacggagaaggtggactacattacgcggatcaatgagctcaaaccgaagccgaaaggagaactttga

SEQ ID NO: 56340 - DNA, 896 bp, Heterodera glycines
  Genomic contig location: Contig_ID=SeqID_570; Location=2563..3458; Strand=-
  SCN-specific regions: Sequence locations=1-63,85-251,279-343,365 -462,501-530,553-896
  Gene Ontology: Mol. function=transporter activity; Cellular component= integral to plasma membrane; Biological process=transport
gacaaaaaatggtaccttgagccggttgtcatcgcactttctgccggctttcttccatttggttcaattttcattgaaatgtatgtgttttactctaattggactttttggggataggaaattgcaattaatttttgagattctttttgttttcacaggtatttcattttcaccagcttttgggcctacaaaatttattatgtgtacggcttcatgttgttggttgcactgattttgattgttgtgactggtaattaatttttttatatattttttttgttacaagccttgactaataaattgtttcatctcacaatttcagcctgtgtgagcattgtgggcacttattttctgcttaatgctgaggactatcgttggtgagtaaaatttttttttaattgtcaaaaaatattatgttttaggcgatggacgagctttgcatctggtttgtataaagaaatgaaattttgaaaatttttataataagattttaaaaatttctaaagattttcacttcccaaaaatgtttgatttaattttagccatttaaattaaaaaaaaatagttgttgtttcgacaataaatatcttctgttttttctttcaaggtgcttccgttgctttttacacttacaactacgcgttctattactatttcttcaagacaaagtgtgtgcaattgaattggtcttttttaaatgggacaaatttgaatttgcctatttttcattaaaatttgttttgtttgtttgaaggatgtacggcttgttccagaccagtttctattttgcctacatgctgctgtttgcgctcgcacttggccttttgtgcggcaccgttggctatgtgtcgagcgccagttttgtgcataaaatttactccagaatcaaactggat

SEQ ID NO: 56341 - DNA, 461 bp, Heterodera glycines
  Genomic contig location: Contig_ID=SeqID_570; Location=1730..2190; Strand=+
  SCN-specific regions: Sequence locations=1-201,223-259,295-421,444-461
atggtcccaaggattggattggttcacggaagaggccaaactcccaaaaaatggggtacccttatcataaatgaatttcgatatttattgtctgtcctttccgggaataaaactgatcccagcaaatactgcatatttaccttcacattcatcatactccgcagatgcgtaaaccaacgcaataatacaagttgaaatgagcatgagaaaagttggcttcataattaatgccatggtaatctattcaaaaaaaatgtgcattaatttttaaataaaaataataaatgaaaattacatataggtatgtaaaaaagcatataaaacagtataaagaaaaagaaagctatgcatatgtcatgcaaacgtttatgtgttatcgctcgttcgcatatcaatgtcaaccgaaaggaaaatcgttgtgaaaaaaaatttaaaaaaattatgtcgtggcaaaaaatcaa

SEQ ID NO: 56342 - DNA, 4028 bp, Heterodera glycines
  Genomic contig location: Contig_ID=SeqID_4951; Location=276..4303; Strand=-
  SCN-specific regions: Sequence locations=1-5,27-1715,1737-1967,1989 -2325,2347-3424,3446-3654,3677-3721,3743-4028
atggctcaacaacagcaagacaacaaaatcaaatcggccaaaggaccaggagcatattcacaggaaatgtcatgggattcttgggcggaaagattcgattttttcatcaagctcagagggatcaccgacccggagatgaaaaagctattgcttttcaccgaaattggcccaatttatgatgagttaagaatgatggcacagcctgacgacatccgtgatatggattttgcggaaattacagcattgatgtgcgagcgttacggcgaagcaaagtcaattgcggcaaggaggcacgagctgttcaccgccaggcaacattccggccaatcgattcgcgacttttccattcaattgcgttcacttattgccaaaacggagtggggcaaggacagcatcgacatgtgcttaagcgcattatttgtcaatggaattgtcgacgactcaattcgtgccgaactgatcaaaaaaggggacaaagatctcaaattcaaagatgccgtcgaattggcagttgtgctggagcaatcaaatgtggacgctcaagcgattggatcggactcattgaaatcattgaaaggcaatgtggccaaaatttcaggaagaggaggaggatatgatcgcgccaaaggaaccaacaatagcaaaagtgccgacagtaagccatgctaccgttgtggaagaagcggacattgggctaatatctgtcccggcaaagccgacaaatgcaccaaatgcgggagagtcggacattgggcgattgtatgcaggacaaatggaggcaacaaaaacccggccagagtggaaagtcggctatggaaaagcagcaatcgcgtgaagcaaattcagctgcagtgcgatgagaagccaccagtaatttcgagtttggagcgagagtcggctaaaactgagactgttccgccgagcttcatccaactcaaagtgcataaaggaaatgccgaattcgaattggacagtggtgcagatgtaacaatcatcggtagccaagattggagccatattggaaagcccgaattgaaggaaagtcaaggactactggcttatgggggcattccgatcaaaggcgtcctcggcatggccaatgtaaatgtggaatacaatggcatgcaaatcaacacggatatttatgtggttaaaggaaataagaggaatttgtgcggtcgtgatttgattcgcggactgcgcattgatttgaacaaagcattcggcattaacgcaatccaaatcggatccacgaataatgatcagaaagaggtggacaaaattctcgaaaaatttcaagaagtatttcgagacgaattgggccgatgcactcgtcaaatttcattgaaattcaagcctggagtgcaaccgaaaaggtgtaaggctcgtcctgtaccatttgcgctcaaagccgaagtggagaagattttggatcagtgggtacagcagggagtgctggagccgacgaacaacagtgattgggccacacctttggtcattgtaccaaaaccgaacggaaaaattcggctctgctgtgattacaaagtgaccgtcaaccaatggttggacgtgcaccaatatccactaccaagaccggacgacctattcagtgtgctaaatggcggtcagaaattttcaaaagtggatttgaaagacgcctatctgcagctgatgttggatgatgaagcaaaaaagtgtttggcagtatgcacgcacaaaggattgttccaatttacgagactcccttttggcgtagcgtcagcaccggcgattttccagcaggtcatggacgaaattttgcaaggaattgaaggagtggcagtgtatctcgacgatatactgatcacagcaccaacacaggcagaacatctttgccgaattacgcaggtgcttgagcggctcaaggcaaatggattgagagttaaacgggacaaatgcgaatttatgcgtgaaagcatagaatatttgggacaccgagtggacaaaaacggagtccatgcttcagaggaaaagctggaagcaattcgcaaaatgccaccgccccaaaatttaaaggagcttcaatcctttttgggtatggttaattattatggcaaattcgtgcccgcaatggctaccgtttccgagccattaaaccaattgcggagaatggaagaaaagtggcattggggaagtgaacagcagaaagcatttcaaaggattaaagaaattttgtcataaccgaagtgctcgttcattatgatcccggccagccattatacttggcaacggatgcgtctgattatggcgttggtgccgttcttttccataaaagtcaacaaaatggaaaggaaggcgtcatcatcgcctatgcatcacggacattgaatgcggcggagcgaaactattcgcaaattgaaaaagaaggccgcggaattatttttggagtcgaaaagtttaaacaatttttgtatggccgaaaattcgtgctacagacggatcacgaaccgttgaaaaagatttttgggccaaaaagtgaaatacccgtggtggcggcgagaaggctgcaccggtggtcactcattttaatgaacttcgactttgacatcgaatattgtccaacaaaagaatttggaaatgccgatggtctatcgcgacttccatgtccggagatagcaaaaattgatttggacagtgcagaagtgagagccgtacaattggaaaacatcgactcgctgcctgtcaccgcaaaatcgattgccagtgaaacagcaaaagaccaaattttgaagaaggtcaaagaattcattgaaataggatggccgaaaaaggtcgaaagtgatcagctgaagccattcgagccgaacaaaaacagtttggaattggtaaatggatgcatcatgttgggaaaccgaacagttattccgagaaaatttcacggaaaaatgttagaacttttgcatgccacccattctggaattgttcggatgaaagcattggctcgacagaaaatttggtggccaggaattgacaaggacatcgaaatggaacgaaagaggtgcagaaattgccaatctgatgcacccgaggagaggaaggttccattgcatccgtgggaaacgcctgacagagtttggcagcgacttcacatggatttttgtggtcctttcatgggacacatgtggctgatcatcgtcgacgccaaatcaaaatggcctgaagtgatcaaaatgaagaacatcacggccaatgcaacgatagaggccattcgaattgtttttggcacacacggattgcctcaacaaattgtcaccgacaatggacgacaattcgcctcggctgaatttgagaactactgccgatcacgcggaattgaacacacactgacgccgccataccacccgaaaagcaacggattggctgagcgcttcgtccagacttttaaaaatggacttcggcacatgatgggcgattccattggtttggatttggcagtttcgcaatttcttttgcaataccgagtcacgccgcatgcatcaacagaagtttcgcccgcagaaatgcttttcaaccggcgattgaggacattattggatttagtccaaccaaacccacaggggaatcaacccgaaatggcaaaaagtaaaagcggcgaaagaatgaaaaggaattatgataaaaaggctggtaaagcgaagaattttgaaaatggacagccgatttttgcgcgaaattaccatggtgggccaaaatggatacagggacgaatcttagaaaagattggagcagcaatgttccgtgtaaagaccgcccgtggagtttggtgccggcattttgatcagctcaaagctgatttgacttcgacagctgacaatcgtgatcaggagtccgaatcggaaagtgaggcagatgcggaatcggacgacgaacaacaaccgcaaccaattccgattgggagtccacgccaagaaattcggcagaaaattgcgcctgagggaggtgtgcctgatcaggcattgcgccgatcaactcgcgatcggaagaaaagg

SEQ ID NO: 56343 - DNA, 128 bp, Heterodera glycines
  Genomic contig location: Contig_ID=SeqID_25597; Location=421..548; Strand=+
  SCN-specific regions: Sequence locations=1-58,102-128
tatagcacggaaagacttccggtttccgacatttttggggtcggaattccgacttccgaaatttttgatgaaaagttggaaattttttaaattttttttttcaaaaaactagtaagttttctacattt

SEQ ID NO: 56344 - DNA, 388 bp, Heterodera glycines
  Genomic contig location: Contig_ID=SeqID_25598; Location=85..472; Strand=+
  SCN-specific regions: Sequence locations=1-17,39-84,146-211,332-388
atgggtgtccaaatgggatatattattaacctcacagagttagttacatttgtcgtcgtaggtctaaaaagtaaagcacatatgttaaaataattttttttttggataatttttttggaaataaaatatttagaaaaaaaaaattctgaaattcacctatcggaaccgccggactcttttctactaaaagtctttagaaaaacgcgccgcgaaaaaaatttaaaatttcaagaaaaatattaatattatacaaaaatattcatgataaaacagaaatataaaaaatataaacaaataaaatgattattatggaaattaataaatattttttcagagtgatctgatcaatttattgcaaatgacttttttgatcagtacacaaaactaa

SEQ ID NO: 56345 - DNA, 100 bp, Heterodera glycines; identical to SEQ ID NO: 51845
  Genomic contig location: Contig_ID=SeqID_25600; Location=262..361; Strand=+
  SCN-specific regions: Sequence locations=1-100

SEQ ID NO: 56346 - DNA, 1318 bp, Heterodera glycines
  Genomic contig location: Contig_ID=SeqID_25601; Location=498..1815; Strand=-
  SCN-specific regions: Sequence locations=1-25,47-677,699-1278,1300 -1318
atgaatcgacggtaaggaaatttgtgaaaaattaaaatttttgtctacccaatttttttccttgtttcagttggatttgtggcgacgtttggatggacattctgccatcttttgaccgtccccaactcggactcaaaatggcactgatttccgaccgtttcgactttttagtggacaaacattttgatggaaaaacggaattgacaatttggagaagaatcaaaattgtaaaggacgaaggaccaaaagcgaaactgtctgttctgatcgatgacaaatgcgtggcatttccatttcccgaccatccgttgcccaacaaaatccgttttaaggaccttcagatttagtaaatcaaaaattatacagaaaaccaatcttcatttttccccttttcagttacgttgaccattctgtgctcgcatttcttcgttccaacaagcaaatttgggacagaagtggcatcaaattggaattgtttgtgcctttatatatgaccgacgtcaagctcatttgggatgtttttacccgcgaaatttggccactttttgcgaaaagcattcgccattttggctttcacgatggcgattatttggacaaattgcgtcgccgcatttcaccgacacttctcactgatcttgatcaattgtattcaattgattctggtgctctattccccgatggaattgctgatgatgggccaaatggaaatgctggccaagttttggccaaatggcttcacactccgacaaaaaatgggcaaccgaagcgattgtatcgcaataatttgttgggtccactgaatctcgaatgggtcaacaacttcaaagaggtgtgtctagccatattttctataaattgttgttttttccaattttttatttagacatttcgccgtgccaccacttctgtcagttacaatattcaactttattttcttgtggaaccaatgccaattgaatcatttgaattggtgaatgaacggaccaatgagaagctgacattgaaacagagcaaagaatacaatttggttaattggctgttgcaacggtgcccaattgaggagacggcgacggcgccagttaagtgggaaaaccgtgaaaattcgggtgccaatttgaactatatcagatttgaacttcggcatgacaataattcgggcgccaatttgaacaatatcctatttgaggtgtggggtggaaatagttgcattgggtgagcagcaaaagcaatttttgattgttgaaaaaataaaaataattttaggccattgtcgctgccagcggaagaagaagaagcggatgaaagcaatgaaaattaa

SEQ ID NO: 56347 - DNA, 253 bp, Heterodera glycines
  Genomic contig location: Contig_ID=SeqID_25602; Location=1214..1466; Strand=-
  SCN-specific regions: Sequence locations=1-253
atggagaagtcctgcaaactttggagagattatatcgattgttagtgcgctaggttcgatgagactctcaaaaatataagcctacaatctttcgcaaacttaaaaaccaattaaaaatttttagattttttattcatctcccttttcgatagtgaaagcatcagagagccttatttgtcgtttaattaacatttggagcgtttcagagcgcgttgtaaaaaatatttatgaagtacttttccgaaataataaa

SEQ ID NO: 56348 - DNA, 586 bp, Heterodera glycines
  misc_feature (580)..(580): n is a, c, g, or t
  Genomic contig location: Contig_ID=SeqID_25603; Location=56..641; Strand=+
  SCN-specific regions: Sequence locations=1-37,76-165,203-287,338 -380,403-413,449-482,544-586
atgcatataatgattttttccaggtaattttaataccattaattaaatattttaaactataaaatttaaaaaaaaccaaaaagtgaaaaaatcaatcaaataattgaattccatgaaatgtttattaagcacttgatcgagtgcacggaacatcagcaatagttcaataatttaattttaaaactaaaataagaaaataattccatagcccgccaaagtagtacaaacaaatcaaactaggttgctgccataaaataaaactaatattataaatgaagctgcattggtataaaaaaaaattaaaattaataaatataatgatattcattttaataaacaactcttaattatcgtaataccttaaaaactatggacaagtgacacaaccagccaaccagccgctcaagaaaaactaaaaaatcaaataattttatttaaataattttttctgcattttaacttcagttttattttttggtttcaatttatataaaaatttttaatatataattgttttataaataatctatttatatttaattacagatgttcagccaacatgaggaactgcatatatttntattaa

SEQ ID NO: 56349 - DNA, 332 bp, Heterodera glycines
  Genomic contig location: Contig_ID=SeqID_25603; Location=699..1030; Strand=-
  SCN-specific regions: Sequence locations=1-30,88-214,258-301,323-332
atggtcgggtgcgagagataaaaaaatggcaaaattaaaatttctttgttatttaaaaactttaaataaaacaataaaaaaatattacattgaagaatcaaaaaaatttgagaaaaataatttggaaatgtataaaaatattgaaattgaaaacaaatatagaaaacgtttttcatgggttttctttcagaaaacacaataaggagacaaaaagattaaaaacaaataattcaaaattattgtatttttttaataaaccatgtcagagacacgcagaactaagaacaaacaaatggagactagcttgaaattttatataaggctctaataaa

SEQ ID NO: 56350 - DNA, 2042 bp, Heterodera glycines
  Genomic contig location: Contig_ID=SeqID_4953; Location=395..2436; Strand=+
  SCN-specific regions: Sequence locations=1-104,151-459,482-703,730 -746,787-1244,1266-1333,1365-1801,1823-2042
atgttcaacggtgagcaacaaaacgacggaaatgacaacgggcgagttgtgcgcaaaccgccacgccgctctcgcaatgccaacggcgacgtgccggcaagttcaaaattttaaaaattgaaaatttcattaaattttaattttaattttccccttccttttcctaaaggaaagcgacattgtgcggaaacgggcgcggcagaacagcacgagcaacagcagtggcgccactcgaggcactacgagcagtcaaagtggcggcggcggcaatgactggccggctttcggcggcggcaacaacaacaacaacagccgccgcaccggcacttcagcgctggacttggacatgctgctgatgccacagatggtcagcagcgacagttcggcaagttttttttgtgggttcttggccaggttttcggggccgctgatcataacaattgggggtttaattaagccctctcctcctctgcgctctgctcaagcggaatttgtacaaaaaatttaatttttgagtttcagcgcggttcaacgagcgctgccgctgttgtacaacaggtgccgcagggaagcaacgcgacttcggctgctgctgctgtcatgccaatgtcgtttttggacaacaataacatcaatgtgagtgtttgggggtgcaattggtccagtgacttatgttaaggcttttggcctcattaatttttggaaaataaaataaatttttaaaatttacagttgccggtggctttctcaagtggcagcgatggaagcggcggcggcggcggtgcattgacagtggcggggcacatgccgtggggggtgagcattgttttttgggggcacgcgaatgaataatgtccccattttaactccttttcccccgttttcagctgtcgacaactggtggcggaagtggtgaaggcggcagtgtccagcatttgcaaaacttggtctacatggcgggtgtgccgcagagcgcggggcaagcgcaggccgtgacaatgacgacggcggcggcagcgacttggacggccaatgtagggtttgaccaggaatttggggggttgctatccgagataatggttaacctagagacttatttttgccgactctggccccccaaaatggggatgggtggaccttgtcctgagctgtcctaattttaaaaattttcaagtcgggcacatttgtcagcggcggatgtgggggcactgtcgttgctggcggcatgttcgggcgcgcgagctgtggtggcagtgctggtggtgctagtgtatttggaggaatgcaggtagttgggggagtgaacgggaacacagttggcaaaatttagtgtgaatttaattaaaatttttcttcattttcttaggccctcccaccccacattcgtgatgccatcgagcgggttcacgcaaggcaaatgcagaagatgatcaccgttcaacccgacttcgccgacattttgccgccgtgtgccgacaacgggatgtcgagcctcggatggctcatgctggactggcaagccgacatggtcatggggtaagccagaattttggtcacttcatcaaaatgtttatgcaatgccccccattgctttttaaggcgtgtcgttggcattgttgtgttgtgtggcccattcacaacagtcagcgggctgaacggcttcgatgtgcggctgatgttcgaccacaacaacgcgcaacaagagatggctgtccactgttgggaggagtgcatgccgcgtctcgccaacaacattcagtgcggtgccgtcgtcgaattttgtcgcctgaaggtgcgcgaacaagggaaaaacaacaaaggcagcttccccttcacgctgctctacaacaacgagtcgcggcaccgcattctctccgcgtccagcaacatcagtgcgttgctgccttttttcatattccaaattgtacgcatttcacacaaacatttccaggtgcgaatttgatgagcagcagcaacacgccgatcattgtggaggcggtggaacagcagcagcatcttgcgggcagcagcatcacagctag

SEQ ID NO: 56351 - DNA, 1594 bp, Heterodera glycines
  Genomic contig location: Contig_ID=SeqID_4954; Location=147..1740; Strand=+
  SCN-specific regions: Sequence locations=1-156,178-179,201-277,312 -477,519-630,658-843,871-1089,1112-1594
gtgcgaatttgatgagcagcagcaacacgccgatcattgtggaggcagcggaacagcagcagcatcgtgcgggcggcagcaccacagctagtgcccgtccatcttctgcaaccggcaccactgccattgccagcagcagccatcacagcaacatgtccatcacagcggcccaacagaacacccgaggcggcggcggcagccaagacgtgcgcgtggcaaaaaacggtaagcagcggcaaaagcattactgatcagcctatgcaaagcgctcttactgatccgatcacattaaaaattatacacaaaataaatttttcaggcaatggaaatgcgacggacgtgcatgagcagcaaagtgaggacgacggaccgaatgcgacggcggccaatttgaacagtgtgggtgcgcagcgcgtcgtcgatgccgagcccgagcatgatgatgatgaagagggcacgagcgaaacggttagcggaaaataaaacgaaacgcaaagaaatgaaacgaaacgaaatgatccattgtgacatacacacacatacaacacacacgctcgcatttatcatgacaataaataattctgtcttttcacactttctcataaatcttttttttacaattttgctttgtaaatgtttttttgttgttgtggaaggccatgaccgttttttttggtgcatgggttccaataatgcgggcgtgttgtggcggtcatgcaattttcggaaatcaaaaaaaaaattcgttcacattttcaaaatgctcatttctctgtaggcatggctgtccacagcacgccccccgccgccatcatgtacaccggttggccgccctttttgccaccgccgccgccgtcgtcgtcttcttcacagcatttcgccgccggctgggcccagtcatggtcgtcgttcgtcgccacctccccagagggcctgttcaatcagcgcccagcgcaacctgcacaccgtcgtgcaacgaatcaacgaccttgaggcacaagtcgcgcgcgatgagcgcaacgcgcgtgaacgtcgtcagcgcgctcgtcgtcaacaactgctgttgcagcagcatcagcacatgcctttgtcgtcgtcatcgtcgccgtctccgtctcctcatcatgttgccaatgccgccgaagcggacgtcatcaccattgacgatgtcgaaccgctcgggctcgcgcagcaacaacagctccacaggggtgatgcgcggtattttgcgcacgaattgatgacactcgaagatgaagccggagcggcggagatgatcatcctcgacaatgagccactctcggtggccgaccgagagtggctcatctcaacagccttcaaaatgcggcagcttccgtcatctgtcaaaggcagcgttgaggtggacgagaatggcaacagcaacatcagttgttgcatttgccgcgactggatcgtttcggacgcggacagcgtggtccggctcgcctgccagcattttttgcaccgcaagtgttttgctcaggaagcaatgcggcggagcatttgtcctctctgccgccggcactttgtgactggcgagacaatgccgacaaacgaggacggcgggaactga

SEQ ID NO: 56352 - DNA, 6283 bp, Heterodera glycines
  Genomic contig location: Contig_ID=SeqID_4954; Location=1..6283; Strand=-
  SCN-specific regions: Sequence locations=1-120,146-274,297-462,502 -642,665-1658,1683-1964,1995-2081,2103-2214,2249-2565,2588-2746,2768 -2833,2855-3008,3030-3030,3103-4154,4200-5026,5049-5267,5295 -5480,5508-5619,5661-5826,...
  SCN-specific regions: Sequence locations=...5861-5937,5959-5960,5982 -6283
  Gene Ontology: Mol. function=DNA-directed RNA polymerase activity; Cellular component=nucleus; Biological process=invasive growth
cgttgctgggtgcgcgcccacagcaactccgcgctgcgtccccccgccaacagcatttgccggtcggggtagcactcccgacaaccttaattgagctcagaaattaaaacattattgtaagtgtgtgttgtgtgtgtgtgtgtgtcccaccgtgcatgtagcagccgttgaactcgatgcacaacggtcgcagtggtggatgacggtaggccacgcagtcgagccggaatccgtcatcgtcggcgccggcacagctgttggtgctgttgttgtcgcggcggcggcggtggtaggagcgcccgctgttccccacaacagcttcgccgatggaccagcgggcagtgcgaagcgggcccaggtcgggccgtacggcggccagcagcgtgaagaagcgccgagactccaccgatgctcggcgtccgcgcaggaatccgccctccggcgtgtgcaccatcgtgttggggcggaggtggtgctggcggaacacagccatggccaggctggcaattgttgttgcggccagaaagggttccatgccgtccgcacactcccccaccagctcgcggaagcgcaggcaggcggtgcgcaaaattttcacatctaaatgcataaatgggtatagccgtatgtgtttgttgtgctcccccccccccccccccgcccctaccattccaacagtagcggagcagctcgcggcggagcaaaaagggctggcgcccgggccggcgcagctcgtgcgcgtaccactccatgaaccgctcgcgttgctcggggcgcatcctgtccgggtcgtaggcagcaggtggtggcagcgtgccggccggcagctcaacatccaggttgcgcgcgtggatgtgatggtaggggaagaacggtttgtccggcaccccgcgcagcccaaacgtgcgcggcagggtggccagcgcacagtggaagtagttcagcgagtccttgcagatcagctcccgctggtgcgtgccgcgcaactccaacatgtacacgcgcaacccatgctgaaccgcctttcgcggccgctcaccccgacgctgcaactcctccagcaacagatggatgtcgtaacggccctaagcggacagagaaaagcagcataacaataaattatgaacgcatttgtaaaggcatcaaagcttactccgttatgtgcaagcatcacggtgcgcacaccttttgggccggtgtggagcataaagtcgacaaattgctccatcgcgccccgcccggtgcctggctccccgtcgcagaagaagcgcagccgacgcgggttcagcccgtccaacggcagttgttgtccgacgacaccgagctcatccgctccaatgtcgacgccgctgtcgtcgaacaactgttcaccgatgcgtgagcaccagcgtcgacggttggcgccccgccacggcacgccacactgacagcgcggtgctcggcgcaacggctcccgctccagctccaccccgtgcgcgatgcaccgctcacaaatcacttccgcacagaccagcaccggcacgtgcttcagcaacacagcgtggtcgaatgccgctggtgccgcctctccatcaccaatgccacccacgtccgcgtcgtcgtcgtaatcgtcgcccccctcggctggccattcgtccgcgaccctttcctgcaacatttgctgctgctgctgctgctgctgcaccacccgctcctgggcacactccacatcccaaaagatgaaccggaccgctttgttgtcgcgccgctgttgctgccgctgaccacgggtggcatcggccccctcctcctcctcaccgtccgattcattgtcttcctcgtcttcgtcctgctccccttgagcatcatcagcaatgccgttggtgttgggctgttgccactgacactggcgagcgaactgcttgggctggacaaagtgcggcgtgcggctggcatcgtgtggacctccgcatttttgacaatgatgttgttgctgttgttgttgttgttgttgtccaactgctgcaaccgttgctacggtagcagcagcagccggcggtaccattggagcagctgttgatgcggtagcaatggcacgcacgtgctgctgctgctgctgctgcggatgtcgacgacagtggtgtgcgccggaacgggcccacaccaccacattgcactgtgcgcacagccggcgctcctcacacattgagcgataggggcgaccacggcgccggtccaccactgcaccaccaccaccaccaccgccaccgagcagaccaagcgccggtggcgggtccacgcactgacggtgcgtcgcaaaacagtccgcattcgggaacacaaagcggcactgtgcacagaacagcccgccctgcggcgtgtctgcatcccggcgacatgggaagtgcagcgcatcatagcgcaaacacagcccacacacggcgcgacagcccaacggatgcgagcgtctgtgcacgggccgctcgcactcgacgcaatactgtttcgcctggggaaatagtttgaaattagaaacagaaagaagtgtaattttttgattccgaatgtccatgctttttttacactctgctttgatttgctttacatttccgttattcaacaattaaatttaaataaaattcgtttatgcttctttctttgaattactactttgcgtttaatgtttttcagatttatttaattaattttttcgtttcgtttgagttctttctttgaattactactttgcgtttgattgttttttcagatttaattaattaatttttttgtttcgtttccgttctttctttgaatttctactttacttttaattgcttttcagatttaattaatcaattgtttcgtttcatttcactttttggctacatttttctcaatttctgatagctctttaagactcatttctttttacatttatttcttttttacgttacttggctttttggtttttaattaactttactatcgtttattttttaaatttttactttgcgttgaattgcttttcgtatttaattaattaattaattgttcgtttcttagcggttcgttctttctttgaattttttcattgcgttttgttgctttgcgtttcgtttctttacaaaatgaaatgaaaattttttacccgaaaaagttgttgtggacgctgaatgtatccgtagtgggcactcctttgcagcagcaggcaaatgttgaagtgtgcccgattcggggccttccacagcacgcgacagccgtgctcccgctcgaagatgaccagtcgcacttgctgcgcgccgagccgcgagtcgagtgtgtgctggagtcgttgagcttccgccaccccgtagctgggccgatccagcggcagggtggcggattgaagcaactgacgggccgcctgctcaccgccatgcccatgttgtgcgagccaaaaggtgcgcaggtgcgtgaacgcctgtcggctgtcggcaccgtacaggtgctggaagtgccggtcggccaaccccaacacgacggcacgcgcaaggcaccacgcgtcatccgggttcaccaccgggaagaatgagcggcaccggacactgccccgtgcctctcgctcatccgcggcacaagcacccgcgcctgtgcggtcaaatgatagtgccaaaagtggaccaaaatcagctgccacccccctccccacccacttccacccttccctccccttcctttgtaccgctgttgcgctccaatggccacacggcgctgatgcggaacaatacagtgccactgaacaggtcgacgccgccggctgactgcgcggcgagccgctccaactcagcggccattgctgcggcggtgttctgctccggagcgcggtgtgggatgtggtagggcgaggcgaactgcggcggctggcacgacatgccaatgcgcagcggacgcacccgcccggccaatactcggtccaacagatgcgcaatgcattgcgccagcaaagtgtccgggcgccgcgcactcgcccacccattcagtgccacttcaaccgcctcacaccgagtgttgcgacttcggcactcggtgcgctcccatatgccaaccaccttgcagtaacggcccagctgtgcactgtcgtcctcgtggttctcagcggtttctgcattgctgctgtcgctgccagtgccattgtcggtggtggtggtggtggtggtggtggtggtggtggtggtggtggtccttcggtgttcgcccccgcccaatctgtggccacacggtgcgacgctaaacggcttattgataatgacaaatcgacaattccctatgcttaataccctcccctccctcctccgcattgtcctaattatgtcgaaaattaaagacagaaaactctcacacacatacacatacacactcgctatggattaattaaatgttagggtacaatttttaacaagaaattttatttaagtgatgagaaaatttgaaatggcaacaaaattttgagaaatgtccaaaaaaattttaaaaaaatgattggcaaatgaaaaaaaataaaatgtcaaaagaatttttcgcgcgctcagttcccgccgtcctcgtttgtcggcattgtctcgccagtcacaaagtgccggcggcagagaggacaaatgctccgccgcattgcttcctgagcaaaacacttgcggtgcaaaaaatgctggcaggcgagccggaccacgctgtccgcgtccgaaacgatccagtcgcggcaaatgcaacaactgatgttgctgttgccattctcgtccacctcaacgctgcctttgacagatgacggaagctgccgcattttgaaggctgttgagatgagccactctcggtcggccaccgagagtggctcattgtcgaggatgatcatctccgccgctccggcttcatcttcgagtgtcatcaattcgtgcgcaaaataccgcgcatcacccctgtggagctgttgttgctgcgcgagcccgagcggttcgacatcgtcaatggtgatgacgtccgcttcggcggcattggcaacatgatgaggagacggagacggcgacgatgacgacgacaaaggcatgtgctgatgctgctgcaacagcagttgttgacgacgagcgcgctgacgacgttcacgcgcgttgcgctcatcgcgcgcgacttgtgcctcaaggtcgttgattcgttgcacgacggtgtgcaggttgcgctgggcgctgattgaacaggccctctggggaggtggcgacgaacgacgaccatgactgggcccagccggcggcgaaatgctgtgaagaagacgacgacggcggcggcggtggcaaaaagggcggccaaccggtgtacatgatggcggcggggggcgtgctgtggacagccatgcctacagagaaatgagcattttgaaaatgtgaacgaattttttttttgatttccgaaaattgcatgaccgccacaacacgcccgcattattggaacccatgcaccaaaaaaaacggtcatggccttccacaacaacaaaaaaacatttacaaagcaaaattgtaaaaaaaagatttatgagaaagtgtgaaaagacagaattatttattgtcatgataaatgcgagcgtgtgtgttgtatgtgtgtgtatgtcacaatggatcatttcgtttcgtttcatttctttgcgtttcgttttattttccgctaaccgtttcgctcgtgccctcttcatcatcatcatgctcgggctcggcatcgacgacgcgctgcgcacccacactgttcaaattggccgccgtcgcattcggtccgtcgtcctcactttgctgctcatgcacgtccgtcgcatttccattgcctgaaaaatttattttgtgtataatttttaatgtgatcggatcagtaagagcgctttgcataggctgatcagtaatgcttttgccgctgcttaccgttttttgccacgcgcacgtcttggctgccgccgccgcctcgggtgttctgttgggccgctgtgatggacatgttgctgtgatggctgctgctggcaatggcagtggtgccggttgcagaagatggacgggcactagctgtggtgctgccgcccgcacgatgctgctgctgttccgctgcctccacaatgatcggcgtgttgctgctgctcatcaaattcgcacctggaaatgtttgtgtgaaatgcgtacaatttggaatatgaaaaaaggcagcaacgcactgatgttgctggacgcggagagaatgcggtgccgcgactcgttgttgtagagcagcgtgaaggggaagctgcctttgttgtttttcc

SEQ ID NO: 56353 - DNA, 2659 bp, Heterodera glycines
  Genomic contig location: Contig_ID=SeqID_4954; Location=2472..5130; Strand=+
  SCN-specific regions: Sequence locations=1-710,783-783,805-958,980 -1045,1067-1225,1248-1564,1599-1710,1732-1818,1849-2130,2155-2659
atggccgctgagttggagcggctcgccgcgcagtcagccggcggcgtcgacctgttcagtggcactgtattgttccgcatcagcgccgtgtggccattggagcgcaacagcggtacaaaggaaggggagggaagggtggaagtgggtggggaggggggtggcagctgattttggtccacttttggcactatcatttgaccgcacaggcgcgggtgcttgtgccgcggatgagcgagaggcacggggcagtgtccggtgccgctcattcttcccggtggtgaacccggatgacgcgtggtgccttgcgcgtgccgtcgtgttggggttggccgaccggcacttccagcacctgtacggtgccgacagccgacaggcgttcacgcacctgcgcaccttttggctcgcacaacatgggcatggcggtgagcaggcggcccgtcagttgcttcaatccgccaccctgccgctggatcggcccagctacggggtggcggaagctcaacgactccagcacacactcgactcgcggctcggcgcgcagcaagtgcgactggtcatcttcgagcgggagcacggctgtcgcgtgctgtggaaggccccgaatcgggcacacttcaacatttgcctgctgctgcaaaggagtgcccactacggatacattcagcgtccacaacaactttttcgggtaaaaaattttcatttcattttgtaaagaaacgaaacgcaaagcaacaaaacgcaatgaaaaaattcaaagaaagaacgaaccgctaagaaacgaacaattaattaattaattaaatacgaaaagcaattcaacgcaaagtaaaaatttaaaaaataaacgatagtaaagttaattaaaaaccaaaaagccaagtaacgtaaaaaagaaataaatgtaaaaagaaatgagtcttaaagagctatcagaaattgagaaaaatgtagccaaaaagtgaaatgaaacgaaacaattgattaattaaatctgaaaagcaattaaaagtaaagtagaaattcaaagaaagaacggaaacgaaacaaaaaaattaattaattaaatctgaaaaaacaatcaaacgcaaagtagtaattcaaagaaagaactcaaacgaaacgaaaaaattaattaaataaatctgaaaaacattaaacgcaaagtagtaattcaaagaaagaagcataaacgaattttatttaaatttaattgttgaataacggaaatgtaaagcaaatcaaagcagagtgtaaaaaaagcatggacattcggaatcaaaaaattacacttctttctgtttctaatttcaaactatttccccaggcgaaacagtattgcgtcgagtgcgagcggcccgtgcacagacgctcgcatccgttgggctgtcgcgccgtgtgtgggctgtgtttgcgctatgatgcgctgcacttcccatgtcgccgggatgcagacacgccgcagggcgggctgttctgtgcacagtgccgctttgtgttcccgaatgcggactgttttgcgacgcaccgtcagtgcgtggacccgccaccggcgcttggtctgctcggtggcggtggtggtggtggtggtgcagtggtggaccggcgccgtggtcgcccctatcgctcaatgtgtgaggagcgccggctgtgcgcacagtgcaatgtggtggtgtgggcccgttccggcgcacaccactgtcgtcgacatccgcagcagcagcagcagcagcacgtgcgtgccattgctaccgcatcaacagctgctccaatggtaccgccggctgctgctgctaccgtagcaacggttgcagcagttggacaacaacaacaacaacaacagcaacaacatcattgtcaaaaatgcggaggtccacacgatgccagccgcacgccgcactttgtccagcccaagcagttcgctcgccagtgtcagtggcaacagcccaacaccaacggcattgctgatgatgctcaaggggagcaggacgaagacgaggaagacaatgaatcggacggtgaggaggaggagggggccgatgccacccgtggtcagcggcagcaacagcggcgcgacaacaaagcggtccggttcatcttttgggatgtggagtgtgcccaggagcgggtggtgcagcagcagcagcagcagcagcaaatgttgcaggaaagggtcgcggacgaatggccagccgaggggggcgacgattacgacgacgacgcggacgtgggtggcattggtgatggagaggcggcaccagcggcattcgaccacgctgtgttgctgaagcacgtgccggtgctggtctgtgcggaagtgatttgtgagcggtgcatcgcgcacggggtggagctggagcgggagccgttgcgccgagcaccgcgctgtcagtgtggcgtgccgtggcggggcgccaaccgtcgacgctggtgctcacgcatcggtgaacagttgttcgacgacagcggcgtcgacattggagcggatgagctcggtgtcgtcggacaacaactgccgttggacgggctgaacccgcgtcggctgcgcttcttctgcgacggggagccaggcaccgggcggggcgcgatggagcaatttgtcgactttatgctccacaccggcccaaaaggtgtgcgcaccgtgatgcttgcacataacgga

SEQ ID NO: 56354 - DNA, 338 bp, Heterodera glycines
  Genomic contig location: Contig_ID=SeqID_25607; Location=21..358; Strand=+
  SCN-specific regions: Sequence locations=1-338
atggtcgaagtgtcaaccaattggtgggaaattgaagcgaaaagtggttattggccacgggaaacgccaaatgttggcttcgataatatgagaagagcaaatgttggccatttagtcacagaatttgccttaatttacgcgaagagcaaaagttgccatttgtccctcagggatatgagacgagcaaaatttggacatttggtcacagaaaaagcaaaagtttggcctcagggatatgagaagagaaatagttggccattttgtcacagaaaatgcaaaagtttgcctttgaggccgttagggcagaaatgagatgaagggccaggatgagggtagaa

SEQ ID NO: 56355 - DNA, 185 bp, Heterodera glycines
  Genomic contig location: Contig_ID=SeqID_25608; Location=84..268; Strand=+
  SCN-specific regions: Sequence locations=1-185
gacaatttggtcaactccttcgggaggccgtgcagcccggacaacgaacgccatctcgtcagcaccacgggtaacacggaatggcggagaagagcaagataaacaaaaaaaacgtatcaaaagatgggattgggtaaaattttggtggtattgtgccagaagtggaagtctctcgattgctctgg

SEQ ID NO: 56356 - DNA, 140 bp, Heterodera glycines
  Genomic contig location: Contig_ID=SeqID_25609; Location=840..979; Strand=+
  SCN-specific regions: Sequence locations=1-1,45-140
gaattttttgattttttaaaatcttttttgaatttttaaaatttcccggttggtccctgttcccggtcccgaagaaaaatcgaggtcccggtcccggcttctcaggtccccaagtcccggtcccggttttgcccaaaatt

SEQ ID NO: 56357 - DNA, 1062 bp, Heterodera glycines
  Genomic contig location: Contig_ID=SeqID_25610; Location=281..1342; Strand=+
  SCN-specific regions: Sequence locations=1-66,131-159,182-243,299 -377,463-927,949-1062
  Gene Ontology: Mol. function=ligand-dependent nuclear receptor activity; Cellular component=nucleus; Biological process=regulation of protein activity, epigenetic
atggcagcccatcaccagcatccgcatgccgttggcgcaggtggcatttcggcagccggactgctccagcagcagttgcagcagcaacaactgcagcagcagcaacaacaacaacaacaacagcagcagctacaaaatgccacaaacgccgtcactgctgccacacagcagcatccgatggccgccgcatttgcagcgcaagcacaactcacagctgccgcggttgctgcagctgaagcttctcaacagcagcagcaacacaacgccagcaacaacaacagtggcaacgccaacaacattggatccggcgctatggcaactgtgcacacaacactgccaaccgcaacaattgctggaattccgtcagcgaacgcgttgcaacagcagcaacaacaacaccagcaacaagtcgcagctgcagccgctgcagctgcgcaacaccaacaacaacagcagcaacagttggttgtgtccagtcaccaacaacagcagcaacaacaaaacaacgctgttgcaacacagcaacaacctccagtccaagctgtacaaccacttcagcagcagcagaccgcaatcccatcgttggcgtggccaattttttatgtgagagaaaattaaagttttcattgaccgttcatcagtactttttgaaaattatggtccttttcagtttgttttatgggtagggtgaggatttttagtgacggaaagtgttttaagaataagaaagcctttcagttaaaatctttgaaatttgggattttttaaagttatttcacaatcctattaaaatttaaacccttttagaatgaaggtggtcttattttaaggtttttttgtgtgaaattccaaagcttctgtgaggctttcaaattgcctctttgttagtctgatcacattcgaaagataggagtcgaatatttattaagctgatcttgagtcccactctcgactcgagaaaagccgaatttgtgggtatagccagcatatcgggtctcggctttttagtctcggtctagagtagcactaaccatcaattatatatttccgagagcaatgcaa

SEQ ID NO: 56358 - DNA, 252 bp, Heterodera glycines
  Genomic contig location: Contig_ID=SeqID_25610; Location=1598..1849; Strand=-
  SCN-specific regions: Sequence locations=1-25,75-152,196-199,239-252
atgggcagcatggaaattgtatgccaaatattattatttttatttggttatatttaaattttatgtttttttttcagaaagtgccaaaacatactcttggccaccgcccgtttgttgcccaatgcctgtggcattttgttgctgctgaagaagtgccaactgttgctgctgttgctgtgttggctgattttgtgaactgtaaatatttttaatttaaaaagcaaatattttaatatttgcgatgataataaa

SEQ ID NO: 56359 - DNA, 424 bp, Heterodera glycines
  Genomic contig location: Contig_ID=SeqID_25612; Location=125..548; Strand=+
  SCN-specific regions: Sequence locations=1-424
atggacagttttctggcattgtgagttcatggactatccccatggctacactttgaagaattttatgtttgaaaatttaagaaaaagtcagggagtgcacccccgtcaaaatttctattttgaaaactttaaaaaatccccagcgaggcacgacttactccccttttgaaacatgctgctgaccttgacaaaaaaatattcccttttcagtgaaaatttgcatgatttggcgccggagccccacacaaaggcaattcgcagtttccatctgttcggtgtgcgcctcttcgagtgcaaaggcggcctcgagcaccgcgtggtggaggagtaccgggacgcatcggagcaattcccaagcggcaacgacgcgagaagacgcgcgtttttggcccttttacgacgcgaaccattctacgggtgacca

SEQ ID NO: 56360 - DNA, 450 bp, Heterodera glycines
  misc_feature (15)..(15): n is a, c, g, or t
  misc_feature (105)..(105): n is a, c, g, or t
  misc_feature (113)..(113): n is a, c, g, or t
  Genomic contig location: Contig_ID=SeqID_25612; Location=1066..1515; Strand=-
  SCN-specific regions: Sequence locations=1-450
cgtgaactgtcgcgnatgcggtcattgatttcactcgcacagcaaagggtctgttggattttgagatttttgatggcattatatttatttacggcacttcattanaccattgncatgtttctgctccctaaattactcgttcaccctactttttgtgcccattttcagtgactttgtgtttggtgtgtttcccaacgacgattggctggagacggcaccccaaatggattatttctgtgccctttcttccgattgttgcggtgctcatttggaaatgtcgtcggtgcagcctcggaattctggcgagggtattttgggcttttcgcccgttttgtcggccgattcttcgcgccattggctgccgggcgagcggaaaattgtgttcagcaattcgttcattctcttccaaaacactgataaattggcaaaggaagtgaccgaagtggcgac

SEQ ID NO: 56361 - DNA, 451 bp, Heterodera glycines
  Genomic contig location: Contig_ID=SeqID_4955; Location=293..743; Strand=-
  SCN-specific regions: Sequence locations=1-451
ttacattgatcactccgtcatcgcttttcttcgttcaaatcaccaaattttcgacaaaagaggcaccaatttatatttgtggcttccttcttcaccactcaacatggatacccagcggattttggacatttttgttcgtgaaatttggcccattttttctgaaaacattcgccacttgggcttttcccgtcgtgatcatttggaccatttgcttcgtcaaatttcgccgacaattctcatcgatcttaaccaattggtttcaatccattcatttgatctgttgcccgctgcgattggtgatggttttgatgggccaatttcaacaatttctgctggccaagcattgtccaaatggttgcactctccgagaaaagatggacaacccaagcgattgtgttgcgataattacaacgcacaaacgaacactgattggatcaacaatttcaaggag

SEQ ID NO: 56362 - DNA, 659 bp, Heterodera glycines
  Genomic contig location: Contig_ID=SeqID_4956; Location=2337..2995; Strand=+
  SCN-specific regions: Sequence locations=1-253,275-375,397-659
atggcaataaaagcttcttccatttccacagttacatcgatcacttcgtcatcgcttttatttgggatgtttttgttcgtgaaatttggccaattttttcggcaaatattcgccacttgggcttttacgatggtgatgatttggacaatttgtgtcgtctcatttcaccgacaattctcactgatcttccgggggatggggtattccgaggtattttctgaaatcggaattccggctccaaaaacgtcgtaagtctgaaatttctgaaaatttccgaattttatcaaatttcggaaatcggaattccatgccatccctggtgtggccccacatttttggcaaatcactgtttttttgttttcaaattgtttagcattttcttcgtgccaatgccatttcttccgtcagttacgaaattcatttttctgttcatgtgccatcaatggaaatggtgccatttgaattgatgaacgaatggacaaatgaaaagttgacattggccaaagcaaaagaaaatgaattggacaaaagttggataatgaaacgatgcaaatttgggaagaccgcggcggttcattgggaagacggaaagtgggacaacaattgtaacaatgtgttcttttggctttttagtggcactaattgcattgggtgagcaa

SEQ ID NO: 56363 - DNA, 87 bp, Heterodera glycines
  Genomic contig location: Contig_ID=SeqID_4956; Location=2979..3065; Strand=-
  SCN-specific regions: Sequence locations=1-44,67-87
cagtccaggaaaaaaatatggatttccatgtaaatgatagccctaattattacacaaatgccttttttaattgctcacccaatgcaa

SEQ ID NO: 56364 - DNA, 109 bp, Heterodera glycines
  Genomic contig location: Contig_ID=SeqID_4957; Location=567..675; Strand=-
  SCN-specific regions: Sequence locations=1-66,89-109
ttcgtacgtttcagacctctcacagtccaggaaaaaaatatggatttccatgtaaatgatagccctaattattacacaaatgccttttttaattggtcacccaatgcaa

SEQ ID NO: 56365 - DNA, 327 bp, Heterodera glycines
  Genomic contig location: Contig_ID=SeqID_25615; Location=580..906; Strand=-
  SCN-specific regions: Sequence locations=1-103,127-327
atggcagtgcaacggctaacaccaacaaggaagagttcatcagttgccaagcgaccagcattttcttccagcaaacaaccaaaaggaaaagcagcgaatcccacaaaaacaagccaaacaaatgaactcaacagaaaaatgaaagccgtgtcgccaaccgcaagtggatcaggcgccaaccatcattgcgtcgctacattggccagaagctcggactcaacaacagtaattgataagggcagtcaacagaattgcccaaacatgagctcggcaacaatcagtaagacaccatgccaacagcactcgtccgagaagacgttaaactaa

SEQ ID NO: 56366 - DNA, 842 bp, Heterodera glycines
  Genomic contig location: Contig_ID=SeqID_25616; Location=1053..1894; Strand=-
  SCN-specific regions: Sequence locations=1-323,345-575,612-671,711 -799,821-842
atggacaaagcgttgtgcgcactgatcagttctgatcggattatctacaatttgaaggagtacatcatttggacccaaagagagttgctgcaggacaaaatgtttgacgatgagacctcatccggcttgatgagaagcatgagggtgggtaatggtgctgaccagggatggcaaggaattcagacttccgatttccgtcatttttgggggcggaattccgatttcagacttacaaaaaatgttggggctcggaattcgtgtttccgtgtaatttttggggcctcggaatgtcatccggggctgacaatgagcccggactcaaaaacaaccaaaatgaaaaataaattcgtagaagatagacacaaaacctaaaatgttttttgggttttcaaaatatttagttaaatttcattttgaaaacctataaaaattttttgaattttgggaaaacccgtaaaagacggccagaaaactcaaaaaaaaacttacttcttcaagcattttttggtgatattttttgaaagttaaaacgaaattcattaaatttttcaggctaatagagggacacttgggactaaaattaaatatttattctatattattgaataaaaccaacaaaattcaaaaattttaagctgaaacccgagggttttggctgtaaatctaattgaaaattataattaattcttaaaaactaatttttgaagaaattaatctgtttgatctttttcttgaaatttgcccacacagggccaaattttagtgaatttttgacatttcctcgaaaatttccttagtaaaatgtcaattttaaatggtatctattttattcaaagaataaa

SEQ ID NO: 56367 - DNA, 958 bp, Heterodera glycines
  Genomic contig location: Contig_ID=SeqID_25618; Location=206..1163; Strand=-
  SCN-specific regions: Sequence locations=1-298,329-518,541-922,945-958
atggcatttgcagaggaacaagcgaatggagaagccattgtcacactgaacttccgttctggaagagtgtgcccttattttcacgtgtgcatttatatgctctggacggaaatgccaatcaacgaaaatgcaatgaatgcggaaatgccaatcgaaatgaatccattgacacggaatggcaggagcacttgggtaaaaaatgtttcaatgtctaaccctttaggaaatttgttaagcagaaataaaatttttctttaaagattcacaagtttttcaaaatccggggaatatttgtaagattaattttcataattaattattattttttgggtttttgttaagcccgttccttatctgcaagatgcgatcccaaacgatgggctgaacaagtggattatgtttggcaactttttcaatctgaccattgggcccgcgttggagacgcctgaccttttttaccactttcgcgtgttttgtgatgatgataagctgaaaagtaggatgcagaaaattgacgaggaggacaaaaaagtggagaaatggacagtttctgaagagtacgatgactacaaattcaagtcgttcaccaaggggaggacgtcgaccaaagttgtgttcaacagcgagctaagacaaaagtgcgaccgctatcatatcaaagtgtgggctacgcataaggaatggatacgcatggacgaaacggcgatgacggtggggcaagtggaaaatgaggatttgtccaattgggaaatgaggatttgtccaattgggaaataggatttgtccaattgtgaaatgaggcattgaccaattggggggaagataattggcatcggagagggacaaatgggcgggctgccagccgatttacgcaccggttgcgcaccgacgtttgcggacggctttaatgagaaaataatcatttttagcaaatatcattttttggccaacaaataaa

SEQ ID NO: 56368 - DNA, 951 bp, Heterodera glycines
  Genomic contig location: Contig_ID=SeqID_25619; Location=263..1213; Strand=+
  SCN-specific regions: Sequence locations=1-951
atgggcatcgtcgttgccctaaatggctcactccctaacgtgagaagcgtccagttgcgaatgccaaatggtcaaaccgtcacgcgaccaatcagccgtctttgccccttggagaccgaaaaccagaccccggaacccgccccggacgccaccgtatctaccccgactgatcaaagccccagagacgccaaaaacaccgaaatgtctgtaaacgaaatgccgccgatcccttcactttccggagaaccgacgatcagtaagcacaacggcatgcttacgcgacgaaaatcacggcttttcgcgatccctcccaccacgacaatgatcattgccattttcgtcactcacctgtgggcccaagcctccccggcacaaggaatttggccattcgacccggaccatcccgggccacccccaacatctaattgtgtcggaaatcacgtcaattgcacccgaaaaggcgtcaaaatctcgtcaaattctgcggtacaaaaggtgacgatttgttgttcgaacgcctgctttgatcgtctcgccgcctctgagatcagctacgagttgtcctccgacctcctcgtcaacgagtatgtctgctccgcgacattcggtctctcttcgacccgcagctgtaccgccgaaattgcctgtccggcagtcgacgaatgtgaattgatcgattgttctatctgcatcgaccgacccgccaattggcggtgtaatccccggctctcccttgtcctacttctggtcattgggtcactgatcagttgtctgaccggatggattgtctgtttttgctcctccgcccgcgtcgtgctcaatcgcggctaccaaatcgccgcattcctcctctcctggcccattcgactagccttcttcatcgccggccgtccctggacacgagaagaccgggaacgggttgcagaacgcctcgaacttggtgtccaaagg

SEQ ID NO: 56369 - DNA, 292 bp, Heterodera glycines
  Genomic contig location: Contig_ID=SeqID_25620; Location=268..559; Strand=-
  SCN-specific regions: Sequence locations=1-87,276-292
atgacaaccccccttcccgacttgaaggttgcgcgtctcgaatcgctacctattaaaccaccgatggatgacattgacgagagcgatgaggaggacgaaggagaagaagaacagggcgaggaattgaaaagcaaaaatgggactgaaaaagaagtggtggaagaccagcagaagacggaggagcaaaaggagaagacggaagaaaagggaggcgagaaagggacggacgaatgtgcggaagagagagacggagagcagcaggacgaagcggagaaggccgacaacgaaatgg

SEQ ID NO: 56370 - DNA, 271 bp, Heterodera glycines
  Genomic contig location: Contig_ID=SeqID_25620; Location=268..538; Strand=+
  SCN-specific regions: Sequence locations=1-17,206-271
ccatttcgttgtcggccttctccgcttcgtcctgctgctctccgtctctctcttccgcacattcgtccgtccctttctcgcctcccttttcttccgtcttctccttttgctcctccgtcttctgctggtcttccaccacttctttttcagtcccatttttgcttttcaattcctcgccctgttcttcttctccttcgtcctcctcatcgctctcgtcaatgtcatccatcggtggtttaataggtagcgattcgagacgcgcaaccttcaa

SEQ ID NO: 56371 - DNA, 755 bp, Heterodera glycines
  Genomic contig location: Contig_ID=SeqID_4958; Location=1..755; Strand=-
  SCN-specific regions: Sequence locations=1-168,191-531,553-755
aatatgtccaacaagcacccgaggtgattcgcgagtttctcagcaccaaacatttgccggttggctctcaatccgccgatatgtacagtctcggcatggtcctttaccaaattctgttcaaaatggagcctttctatgaacgaaatttgcctctaaacagtggggaaaataggggaagatggaaaagcagaattggccacagaattattgaacaaaattgcgatggctggggacaatgaccaaatcattcggccgacttttcccaaccaaaatcaaatcgcggccaacgaagaggcgtacaatctgcaactgctttcggtaagaattggcctaattatgagttgcctttgctaattgtccctaaggcaatcgaggcgtgttggctcgaggtgaccaaattggccaatgtttgccattgcttctccacccgcagatccccgaaatgcgcccgaacattaagcggatgaaggccattgtcaatgccaacctccgctccacgtcggcacccctcccctccccataatttgaatttgcctcccttcccccagtgggtccggctctttggtggaccaaatgatgaaaatgatggaggatgtaaaaagcatctttttctttgtcgccattggataatctccgccccctttcagtacactgcgaatttggaacagctcgtcaaagtaaataaatggcgattttgacaattacaaaaagaagttatttgaaatttttcgtttttgaaattttttaataaattt

SEQ ID NO: 56372 - DNA, 1588 bp, Heterodera glycines
  Genomic contig location: Contig_ID=SeqID_4959; Location=1..1588; Strand=-
  SCN-specific regions: Sequence locations=1-169,316-1504,1528-1588
caattggtgatcactgcccatggctacgataagaaattcatcgaggacttcgaattgcgtctgaataaggtgagtcttccgaattatgaactgatagaagaaacaatgtttggatttgtttaggtcaccggaatgatcagttcgtatgtaagtccaactcatttaaccctttttcattctctttcccttatctttttttcttatttcactttccatttccatttccctttatctttttttctttatttctctccccaataatattttcttctttttttcctctctctctctctctctctcatctctcgtctctctgtcctacagtaatctgcccaccgttgcttttacagtatgctatcctcgcttatatgtctctgtacgatgcgctgtttctgtacggattggccgtaagagatgcttatgaagaaacgaaaaaccaaagcgtttttctggacggactttacatttggaaaaaaatgacggcacgacaattcatcggttttggcaatggacaaaaaaacggaataaaacagagaatattaaggcgccacggggcaagtgctgatgaataacaaggcaatccgagtgccgagttacgcgacttatcacaccaaaaatggtgggggggggggaaatgccaaaagaggaaagaaatgccgaactgtgaaggcacaatgaaaatcgtggtcgaactgacggctcggttgggcgacaagctgaagtgtgccatgtcagagaatgactgctcggaacacgtcactaattggggggggaggggagggagggccaaactcttcccgaaaaggtggcgcacgaaacgatgtcccattattactccaccggggacggctcaatgccactggacatgcccaagtgcggctttgacggcaatctctgcgactacacgctgatctacattctgttcggtgtcattcttttcctcggaggtgaaccgtaatgccaaagaaaggggcgaaagagtgccgtttagtgaccattcctctcggatatttcctccacaaaaaagagtgagtgaagtcaaaagcagcgaatggagcaaaggctttcagaaaggagcgcatattgtacgaaatgacctggcgaatcccacgggagaaagtcagacttttggagcagaggtcgaaggtcggaatttgccaagggaaagggcgacgaagcccggacattccttggattgttcagacaaagtccatgtccattcgaagtcggtcgcaggaaagtcactcgtacggtacggcaaggccaattaatcccttcgtccaattagcgttgaattcgcagacgaaagcattgggtccaaagcgaactcgagactcttggccaagcaggcgttggccaacggagtgaagtgcgccttcaaacggtaccagcagaaccgaagcatttccttcaacaaagtgacaaatcaatggagggggggggaaagcattgatcatttcccgtaaagaatgacctatcgagactgaaggagctgaagatcatggagaacgagaatttgaacaaggcaattgtggagaaaaggagggggagggggggggaagatagagagagggataatgaagagaaa

SEQ ID NO: 56373 - DNA, 2941 bp, Heterodera glycines
  Genomic contig location: Contig_ID=SeqID_4960; Location=1..2941; Strand=-
  SCN-specific regions: Sequence locations=1-19,41-307,329-439,462 -810,842-956,1031-1231,1268-1304,1326-1417,1439-1730,1766-2046,2215 -2941
ttgcccctttttggcatcgtccagcaaaagcttttcaacaaaacatcacatttcaagttaatgcgtcttcttcatatagcaggaatgaagagaaggattaaaagtgtgctaattgacggattaagctccagtcgactccgcccaaaaggcggcggcatcaatctgcttttcagcattttcttttgccgacaccaaaattgtttctctacctcaaatttggccattctcccactcgtacagtactcttctaccgtttcctcagccaatgattttttcgctggccttcgtgccacagctcattgtcagtttgcttcttctgctcctctccgtttgggcaccttcggcccacccaaacattgtcatcaaagtcgcccatcttcagccgaacaatccgagcatcattaacgaaccgcaagtgttggaaatgtgagcaaagaatgaacaaacagaaaaagaacaaatgaacgaactgtcaaaagttgcaggtgttacaacgacatgaaagagagggccattctcccgcgcgaaattcggctacagtacgcccaattagcactaattgaccatgctgatcagcctaattaatgtcttcagattgtttacgatggaatcgtgcaaccgattcagcggagttgagtacgccgcctatttgcactacatgaaaaatgtgagtggggcaaagccacggaattccgtccctttacccgtcccccccccttagacaagcgtttatttcggccccggctgcaacaatggcaagtcaatcgaacaaaaaggacattttattggaaatgcaacagcattttcataaagccagatattttatcatttcaaatttattctccgctcttttcgtcctttagaaatgctaatcatcggtcgattggtctctcgttggaatgtgccgatcattgcccatttgtcaggcgacgatgctctctccgatcgcgcaggtgccattccttcccgtgccattcccttacatgccattctctctcctccgtgccattccttcccgtgccatttcgtttttcctttttcacatttcacttcttccaaagtgttcgatacgcttggctccgttgcgctcacttcggccactgaaatggcgcgggcaatgtgcttggaattcgatgcgtttgttttgtcaattattttccatctgttcagattgacctttttacaattgtatggttggaaacaggtgaacattttttgaaggagtaaatgcaaattaattaattttaattaattataatcaattattcgcaaatgcgtgccaaaggtcggcttggttcggcccagtgtgcacttcgagcgcctttccctgcattccctgcgcaattacctcaaagatgccaacatcgagatcaacgtggagatcgagttggacccgtacatgacacccgacgaaattattgccacggggcgcctacggcacttgcgaaatcgcgcgcgaagtcatttctgggaaggaccaactcaatttgttggcatatttcagtcattatgctggagatgggcatggatcttcacagtgccaagtcgtttatgatcgctgcacttcgctcccacatgaaaacgcccgattacgtgtacattatcccgtggcttgcccatgtgagcaaataattatgagagtaaattatgctttatcctctccatgttcagcttcatgatcactatccgtgggaggcatcaaacattgaaaagcaggaaacgaggcaaaaagaatgggaaaatgggggaggcggaaggggacaattggcaaaaggggggggggaagattgacggattgttcatccatcacaccgatggagggaaaagttgagggggacaaagacgaaaaatcactccgcagatcagcctttgacgacacaattgtgatcactgcccatggctacgataagaaattcatcgaggacttcgaattgcgtctgaataaggtgagtcttccgaattatgaactgatagaagaaacaatgtttggatttgtttaggtcaccggaatgatcagttcgtatgtaagtccaactcatttaaccctttttcattctctttcccttatctttttttcttatttcactttccatttccatttccctttatctttttttctttatttctctccccaataatattttcttctttttttcctctctctctctctctctctctctctctctctctctctctctcatctctcgtctctctgtcctacagtaatctgcccaccgttgcttttacagtatgctatcctcgcttatatgtctctgtacgatgcgctgtttctgtacggattggccgtaagagatgcttatgaagaaacgaaaaaccaaagcgtttttctggacggactttacatttggaaaaaaatgacggcgcgacaattcatcggttttggcaatggacaaaaaaacggaataaaacagaatattaaggcgccacggggcaagtgctgatgaataacaaggcaatccgagtgccgagttacgcgacttatcacaccaaaaatggtgggggggggggaatgccaaaagaggaaagaaatgccgaactgtgaaggcacaatgaaaatcgtggtcgaactgacggctcggttgggcgacaagctgaagtgtgccatgtcagacttatcacaccaaaaatggtggggggggggggaatgccaaaagaggaaagaaatgccgaactgtgaaggcacaatgaaaatcgtggtcgaactgacggctcggttgggcgacaagctgaagtgtgccatgtcagagaatgactgctcggaacacgtcactaattgggggggggggagggagggccaaactcttcccgaaaaggtggcgcacgaaacgatgtcccattattactccaccggggacggctcaatgccactggacatgcccaagtgcggctttgacggcaatctctgcgactacacgctgat

SEQ ID NO: 56374 - DNA, 426 bp, Heterodera glycines
  Genomic contig location: Contig_ID=SeqID_4960; Location=1730..2155; Strand=+
  SCN-specific regions: Sequence locations=1-182,257-371,403-426
atgttcacctgtttccaaccatacaattgtaaaaaggtcaatctgaacagatggaaaataattgacaaaacaaacgcatcgaattccaagcacattgcccgcgccatttcagtggccgaagtgagcgcaacggagccaagcgtatcgaacactttggaagaagtgaaatgtgaaaaaggaaaaacgaaatggcacgggaaggaatggcacggaggagagagaatggcatgtaagggaatggcacgggaaggaatggcacctgcgcgatcggagagagcatcgtcgcctgacaaatgggcaatgatcggcacattccaacgagagaccaatcgaccgatgattagcatttctaaaggacgaaaagagcggagaataaatttgaaatgataaaatatctggctttatgaaaatgctgttgcatttcca

SEQ ID NO: 56375 - DNA, 372 bp, Heterodera glycines
  Genomic contig location: Contig_ID=SeqID_4961; Location=122..493; Strand=+
  SCN-specific regions: Sequence locations=1-61,95-244,346-372
atgccaaccccggggacaactcccgagacacttcccacccgaacgacaacaaccggtgagtgagaaaacgagaaaaagaaagaagacacgacaatttcagagccaagtacaacatcccctaagggcactcccgcaaaggacagaaaagagggcgatcagacacgaccgacgccggcacttccgatcattttaccattaatcaacaacaattggtggtggaagaacacgccggcaccacccctcaggagagaaaggagcgaaagggacggggagaaaaggagaggcaacaaggaacagaagggagggaaagaaagaggcaaaggaagagagagaggaaaaggaaaaacacagaaacgatcgtataaatcctaa

SEQ ID NO: 56376 - DNA, 1141 bp, Heterodera glycines
  Genomic contig location: Contig_ID=SeqID_4962; Location=13..1153; Strand=+
  SCN-specific regions: Sequence locations=1-243,272-376,398-830,864 -1013,1115-1141
cgtttatcaatcaattcgaaaaggtgcccgacacggacagcacaacgtacggagtgaagtacgactaccaaagcgtaatgcattacgcgaaggacgcattcgcaacggcagcgggcaaaatcacaatggaaacattggacaaacaattccaagtacaaacaaaggacacgcaattggccaacgaaatgaaaggacatttgcggagggcccttttaattgacagaaaggagcattatcacagcactaaaagagaaaaaagcaaatttaaatggcaagttccataaaacatggtactttcgccaccattatgaacatttagctgaatgaattaaacgagaaaatgccgaaaaaacatggaaaacgcacttagttttacttttcaaacagaaaatccaattaaatttaacttattacattagaaaggtttttagcaactgacttatgttggcaaattaagtgatcatttcttacgctttttactgttttctttttgcggataatagttttgtttttgtaactgttgtgagttacgcattgattcataaggcccgtcctccgtcagtttaaataggcgtccgcaaatgtctgatagccgagcagaaaaaaccattttgaggatgttatcggaagagtaaaggacgcctccccgggggactatgtgaaaatatgcaacatttacgcatgccaaacttgcatgggaattccgttcactcccggacaaagccgaccgacggaaggccaaaaggtggtcactctcgggccaccgactatgccaaccccggggacaactcccgagacacttcccacccgaacgacaacaaccggtgagtgagaaaacgagaaaaagaaagaagacacgacaatttcagagccaagtacaacatcccctaagggcactcccgcaaaggacagaaaagagggcgatcagacacgaccaacgccggcacttccgatcattttaccattaatcaacaacaattggtggtggaagaacacgccggcaccacccctcaggagagaaaggagcgaaagggacggggagaaaaggagaggcaacaaggaacagaagggagggaaagaaagaggcaaaggaagagagagaggaaaaggaaaaacacagaaacgatcgtataaatcctaa

SEQ ID NO: 56377 - DNA, 1673 bp, Heterodera glycines
  Genomic contig location: Contig_ID=SeqID_25624; Location=149..1821; Strand=+
  SCN-specific regions: Sequence locations=1-197,221-237,259-298,321 -433,455-633,671-928,989-1039,1067-1244,1267-1315,1338-1375,1404 -1487,1510-1557,1583-1673
atgtcccgaacttgcaagacattttgcatgccgctggtctccctgtgcctgacggtaccaatgatcgcgtgggtttggtagaaatttatgaatgtcaattccaataatgaattgttggcaattagctaattgattcgatgtttaggcaaatgtttttctgaacagaagtgttcaggtcgtccgaattgtgtcaattgatcggtattttttgtttccttaaaatactttttgatgtgccatttttgccctctctgattaataaattttcttcagcctaaatgctgatttatttaattgcaattatatattattataaaattggttatctaaataatatcttcttttcttggttcaaaatagcggtgccgctgattgaccccatagataattaaggcccccaaaccaaatgggtgagctcacacaacaaattattcatttcccattaaaatgaacccaaaaaaactgcccaatgaattgttttttgaaattgtcattttgcagtttcacaaaaagtgggcccaacttcgggtgtcctctgtctttgatcactttcttcttgctcacatgtcccaatttctgatcaaatacaaaaattcggtgagaatttcgcaattagcactgatcaacgggaacttaaaaattcttttattatataattttgttattatttctttgtttaaggcggaaaagtgtttaaatgcggtactgaagctgtgcaaaatgttgttaaaactgccgggcattatccgttataacggaattgaagagcctttagagcattttgtaactgaccgcgaattgttttgtaagtaaagcaaaggtcgtagaaaaacaattaaatacataatgcatcactgatcggaaaaaaaatttgcgttttttaaaagccaacattcaaaggtataaaatttttttcggcgctgcgctgaaatttttgaattttttacaaaaaaagataattataaatttttaaaatatttcaatttttgtagggaaaaaataaggtaaaaataagaacaatcgtctgatataaataagaaaaatgtatttcaatgttatttttaaaatagaatcccaaattgcgacattagatttgctcattggtcttgaacgtatccgttgtccgcccaacataaaagcgcaggtcggccttccgccagaatgggaatcggaaccattggcgaaaaatacggtacagagactgagacaaaatattgtaaaaatatggcctgatttgcaatgagaatttatataattttaatttttgctgttttcgagtaaaattttgaaatttctgtgggaatgagttgggcggaaaatttgggaaattaaattgagtataatttcctgggacattccgtcagcattttttcggaaattaaattatttatttttcaaaatttcgaaacaaaattaattgtcatttgctttaagttcctcgatatgcgggcaatgattgttcaaattgtgggcattgtctgccagtggccagaaacgacaacagaagacttggcgaagttggagagcggtaagaacttgccgaaaaatcggtgatggattaatttttattttaagaaaaaatgcgaaatacatattgaaaagctttatcttgaccttaattaagaccaaggtttcaattttagccaagtgtttgattacccaaaaataacgga

SEQ ID NO: 56378 - DNA, 114 bp, Heterodera glycines
  Genomic contig location: Contig_ID=SeqID_25626; Location=33..146; Strand=-
  SCN-specific regions: Sequence locations=1-114
atgatatcaagattgtttgattcggtcaaaaacttcaagagttatattgactcaaagttggctcggacggagttggcccgttccggagagagtgggggagaggaagagagagat

SEQ ID NO: 56379 - DNA, 267 bp, Heterodera glycines
  misc_feature (69)..(69): n is a, c, g, or t
  Genomic contig location: Contig_ID=SeqID_25628; Location=1..267; Strand=+
  SCN-specific regions: Sequence locations=1-267
cctccgtctcatacgcaagcgcttttgtgaggtataccatttaaagaaaaaagagatagacatatttcntgggatagagccttaatttaaaaattccctcaaaaataaaaggtaaattgcgcaccgccctccctatcatgctcgagagcatttgtctgtgtataaaatttatcaaaaaaagagatagccatttttctgggatagagtataaatttaaaaattccctcaaaaataaaaggtctattgcgcaccgccctccctatcatg

SEQ ID NO: 56380 - DNA, 502 bp, Heterodera glycines
  Genomic contig location: Contig_ID=SeqID_25630; Location=902..1403; Strand=-
  SCN-specific regions: Sequence locations=1-38,66-170,192-502
gccaagccagcaacagggccgaacagacaacgaaagccaacagagaagaaggaaaaagaggaaaacggagacaaagacagaccaaagtcattttgccaaaggtcaggcaaatgcaaaattaattttgaatttcaggaaagagcggaaaattgcggaacctccgcaaagagtcccttttcggcacccaacccaaatagcgttgaatctgccatcacaacttcagccagcaattcctgcaactttaaaatatggcgtccatttgcattcggcacggcactccttcagcacgtcgttgaaaagtgtttctgttgacagcgagccaagagtgagtgaccagctgaaaatcccgagcccggaaacgctgaaccggcaaatcccacctttgctgcatggcatacgcctcccaatgccggcgggggcatcgtcttcttcgtctaatgccttccaagaaacactgcgagaggaggaggaagcggccgcggcactcgcatctttgaaatga

SEQ ID NO: 56381 - DNA, 850 bp, Heterodera glycines
  Genomic contig location: Contig_ID=SeqID_25631; Location=677..1526; Strand=+
  SCN-specific regions: Sequence locations=1-199,233-360,382-537,560 -579,603-695,720-850
  Gene Ontology: Mol. function=transcriptional activator activity; Cellular component=nucleoplasm; Biological process=regulation of transcription, DNA-dependent
atgtcgaagatgggccgaatggaatcggacacggacccaaatacggtgacaattctgaggaagcaccaagcgccccagcgtgtacttaagtcggacgcggctgtgagtaattttgttttaggattaagaaaaatgctctcgataaaggtgttgtttggaatgaatgaaaaatgaggaaaaccgacctatttcacacgcattacaatttgattttttaaaaataggttaatgcggcaaaaaagcgcggcgacgacgtggaaacgacgaagaaatatttcgcaggggtcagaaaaaagggaataacgcgagaagcatgttaattgtaagtttaggtgaatcgtcagcacaaaacggacaaaaacaccgcggttttggacgcggagacggagcaattgcaccacgaaaggtgagagaaaataggcaaaccaatcggaaataaatgtttcaaaattaagggtttcgctcaaattgggcactgtgattcagcaggcgcggcaggccaaggaatggactcagaaggcgaattttcattccctctttatttacattttttattttaggagttggcaacggttggtatttttgaattgtcccatttttccccgcctaattcctcgctttagcgtgccaatgagaaagtggaggtcattcgggagtacgaaaacggcaaagccgtgcccaaccaatcggtaattcaatttaaaatttccccttttaatcggatttgtccagcaaaaatatatcgcacctcgcttttcagatccttacgaagatggagcgttgccttggcgttaaactgcgcgggaaggaacttggccagccgcttgcgcccgcctcaacggccaaaccg

SEQ ID NO: 56382 - DNA, 1114 bp, Heterodera glycines
  Genomic contig location: Contig_ID=SeqID_25633; Location=72..1185; Strand=+
  SCN-specific regions: Sequence locations=1-337,360-1005,1028-1114
tagcagcttaacatttccttgcaccgcacttcggtcactctcttttctatgaaggttaaatgctgtccttttgctttttaatttgccgttttatcaaagggcccaaatgatgccaattcgtccatgcaatttgaactgaggctggtcagtggccgaacaggtcggccaatcttctcacccgacctgcccaattagcagatcgggcacatcccttccttcgatatttagtcgggcattccccttcccgcgatcaatgcccgatcagctcgggcatccccccccccgatcagatatgaacaatgatctcccgggtccttttgcctcacaattcaatcgctttcttttctcaataaatttttaagaattcccttccgttttcctcgccactcgcgccaattttctacttcaaaaaggtgcgcataatagcattgtgatcgcgcatcaaattttaaggcgaaaatcgcaactcggccattatttcgctgagggaccctttggatgggccgcaggaagtgcacctggaactgttggcatttttggattttcattcctttggcatttttggattttcattcctttggcattttttggattttcattcctttggcatttcccgtccttttgccgttttcgtccttccgtccgtcgttcagttctctttccctcgttcagtgtgcttcgtctgagtgtccgcggaatatttgccggaaaatacatggccaatttgacggttttcgtctcccaacaaaaagcgcaaccgcaccatccgccgcaattgcagcagaaaaacagcgcaaaaagacatcggaggaggagacggacacaccgtaacagagaagaaagaggcgcaagcggacaccgtaacggaatacgtaccgtaaccgaaaaaatcggcggatggtagtcaagtcacaaatcaaatcactcactgtcagcaactgcttttaaccggccatttcggtgtttgttctgccgaatacctcaatcattggaggatgctttttctctttttgttcatttgttttgtgccgtgaattgcaaatttcattttggcatttcattttcattttggcattcgcttttattctgattagataaatcgctagagaatgaa

SEQ ID NO: 56383 - DNA, 2239 bp, Heterodera glycines
  Genomic contig location: Contig_ID=SeqID_4964; Location=108..2346; Strand=-
  SCN-specific regions: Sequence locations=1-133,156-540,562-969,992 -1335,1360-1461,1484-2239
  Gene Ontology: Mol. function=serine protease inhibitor activity; Cellular component=cytoplasm; Biological process=regulation of proteolysis and peptidolysis
tttacgaactcgcctctcttttgccccttaaaaaatgtttttttataaaaagctatttgatgcaaataatacaaatgtttgggcattgcctttctttcagtttggtgctgatcaacgcgctttacttcaagggcacatgggcggacaaattcaacgcaacattgaccaaaaaggcgcaatttcacatggatgcgaaaaacttcaaagaggtggcggacaattactaggacaattttaaaattaaaatgccaattaaaaagttatcaaagcatttgctcacgaatctggcatccatttcgaaccactgtatcagaatagaacaaaagtcaattctttaaaaaattcatttttcaaattacaaattaagcgtgaaatttgtgatgaataagaaggataacagctgattatgggactcattcactatcagtcaaaatgggtgccgaatttatgatcagtggccatgaaaacggcaatcgcttagatcaggtcccaaaaaaggactttgtctctctcactcatttttcaaaaaaaaaacaattttcaaaagtcatgaaaacatgattccatagcttttcggcgtcgctgatcacgaatccggcatccatttcgaccgattacgaaccccgaactcgaacaaaaagtcaaaactaaaatgttcgaatttcacatttttagtctaaaagccgttttaatgaccttttattgaagcccatgaaaacatttatattggcatttataattcaataaaaaatatggggaaaatttgtgggggttaaaacttcataaaatctcattttgaccataaacgaccaacgctgactttttttagctggaaatgatgcatttgatggccagcttcatttatttcgaggacactcaggtcgttcccacattttcatgcatttttcctttcacttttctgattgcttgtacagctccaactgctcggcatgccctacaaaggtgaaaaggagttcatgtttgtgctgttgcctacggaacgctttggactggccaaattgttggctcaattggacggcaaaaagctggtggaactgattaaaatgcgggacaaacacactgtgacggtaagaaaaatcacaaaaaaaaacatttattcatggcattgtctaattttggagtttggttgtgggcatgcctaaataaacgaactgtcctaacacagtgcccatgtgccatcgtttcttagatcgttgaccccaaacatcgaaagattgcgacctgtggggtgaccgaactaaaccatagcacatgggcattgattgttgacattgtattacgattattcgtttaggcaagcatacccacgaaaacttaaaagtatatatattttttcttagtcggtgaaaaaatatggggaaaaacagtttttttttgggggggggggtgtgaagaaaacggtggtggtcaactgggcgagtttatagattttttttgcgcttcttagtaattcaccaaaaaaattttttttcttgaaaaattctgttttgaaaataaaaaaaaaattctcgggggggggacgtaatgcacccgtgtccatatcgcccaattgtcctttccgggagagaacgataaatggagaaataaatgagttgtatcacagccgaaccccttcttttccaggtggatttgcccaagttcacgttggaggtcacgcacgaactgaataaaccgttgaccaacatgggcatggccaccgcgttcaccaacaacgccaattttgagggcatttccgacaagaaacctttgtacattggccaagtggtgcagaaggcgttcattgaggtgcggtgtttgtaaccaatttaagctgggatttttttgtgattttaacacttatttagccattttttagtgcttatttagtgggcaggtcgtttccccctctcccgcgcatcgtttttacccccgaaatttttttaaaattcccaaacttaaaaatttttcaaaaatccttgaaaaattttttgtaagaccattaaaaaattgttttttattttttgatgtcgggacggcggggggaaataaagtgcaccccttatttagctacgtaaaaatcagggtaatggtgagcactgatcagcgaccgcaaaactcccaaaaattatgcaaaaatgcttataattgttttttcgggcagaaaaggaatcctcttaatttataaaacgaaatttaggtaaacgaggagggcacgactgccagggcagtcaccggcata

SEQ ID NO: 56384 - DNA, 257 bp, Heterodera glycines
  misc_feature (92)..(92): n is a, c, g, or t
  Genomic contig location: Contig_ID=SeqID_25635; Location=881..1137; Strand=-
  SCN-specific regions: Sequence locations=1-257
tatgagcgctaaaatatcagagtgccgaaaatcgcatgtgatctaagcctagaaaaaaatggtctaagtaaaaatcgtaattacgctcaaanagcttctcaaacaattttagcgcttccaattccttctacaatcgcctttatacatcccattatgaacgctaaaattatcagagtgccgaaaatcgcatgtgatctaagcctagcaaaaaatggtgtaagtaaaaatcgtaattacgatcaaaaagcttctcaaac

SEQ ID NO: 56385 - DNA, 478 bp, Heterodera glycines
  Genomic contig location: Contig_ID=SeqID_25636; Location=335..812; Strand=-
  SCN-specific regions: Sequence locations=1-111,279-391,413-478
  Gene Ontology: Cellular component=mitochondrial outer membrane; Biological process=sperm motility
atgttcgtccgatcatctgccattctgctgatcgttgctgttgcgctggtgccactttccgatgccattctcttcggcggtggtggcaacaactgttgctgctgttgctcccctccgccctgccctcctccgtgccccgtccagccctgctgctgtgccccgccatgtccgcccccgtgcccttgcccacctccgtgccctcccccgtgccctcctccgtgccctcccccgtgccctcctccgtgccctcccccgtgcccaccaccgtgcccccggccatgctgttgcggtaagttgggcgaaatcgttttaaaaatttacactgaaaaatggatttaaaaatttgggtaacatatagccattcaaattttaacattcaggaggttgcggcggtggcggctgtggtggcggcccaatcattgtgaactgtgccggcggatgcggcggtggctgtggcggattcggattcggaaaataa

SEQ ID NO: 56386 - DNA, 1166 bp, Heterodera glycines
  Genomic contig location: Contig_ID=SeqID_25637; Location=367..1532; Strand=+
  SCN-specific regions: Sequence locations=281-309,423-452,477 -1029,1051-1166
  Gene Ontology: Mol. function=DNA binding; Cellular component=DNA -directed RNA polymerase II, core complex; Biological process =transcription from Pol II promoter
gtgcttaatcgactcacttacactgccacactttcgcatttgcgacgatgcaattcgcctattggacgtgaagggaaattggcaaagcctcgccaattgcacaacactcagtggggaatgatttgcccagcggagacacctgaaggccaagctgtgggcctggtcaaaaacctcgctttaatggcttacatatcagtcggttcactgcctgaaccgatcctcgaattcttagaagaatggtccatggaaaacttggagggtttgtcttttgtctcttctactattttagctatttctttttgaaatttagaagtggcgccaatgtccattgcggacagcacgaaaatattcgtcaatggcgcttgggtgggcattcatcgcaatcccgaccaactgatgacaacattgctgaaattgcgtcgccaaatggacatcatcgtttccgaagtgtccatggtccgtgacattagagatcgtgaaattcgcataagtactgacgcggggcgcgtgtgtcgaccgttgttaattgtgaacgatcgcaagttggtgttgaagaagcaccacatagaacagctcaaggagagggacgtcatggacgaacagcaacagttcacttggtccgatttggtggccggcggagtggtggagcttatcgacgccatggaagagggtaaagagcaatttcaaaaaatgcaattatttacgcgaatactgaaaagtgattaagaaactattatggttgcaatgacacccgaagacctcaaaactggtgggtactgtgaaagctacacgcattgtgagattcatccggcgatgattctcggcgtctgcgcgtctatcattccttttccggaccacaaccaaagtccccgaaacacttaccaaagtgccatgggaaaacaggcgatgggtgtttacacaaccaactttcacgttcggatggacacattggcacatgtgctgtactacccgcaaaagcccctggtgaccacgcgttccatggaatatttacggtgaaacttgttttgcttttttgtgttaattatagacgttttccagtttcaatgaactccctgccggcataaatgccatcgtcgccattctttcgtatggtggctataaccaggaggactccgtgattatgaatcaggctgggattgatcgtg

SEQ ID NO: 56387 - DNA, 366 bp, Heterodera glycines
  Genomic contig location: Contig_ID=SeqID_25638; Location=198..563; Strand=+
  SCN-specific regions: Sequence locations=1-154,179-366
  Gene Ontology: Mol. function=protein carrier activity; Cellular component=cytoplasm; Biological process=protein-nucleus import, docking
gccgaacgtaacatcatcatgcaagtgacatgcaatgcaactcagtccaccgacagaaatgtccgcgtggttgccctccagtgtttggtccgaatcatgtcactgtactaccgtcacatggagccttacatgggccgagcgctgttccaggtttgcaaaaacaaaaatatatgtcaaatgtatttaccaaaagtgtttttgacagattacgcttcaggcaatgaaggatgcaggtaaaagggctaaactaagcaggaatttgaaaaaactgtccatttttaagaggatgatgttgcactccaaggaattgagttttggtcaaatgtttgtgacgaagagttgaacttggcagcggaggttgaagag

SEQ ID NO: 56388 - DNA, 253 bp, Heterodera glycines
  Genomic contig location: Contig_ID=SeqID_25640; Location=697..949; Strand=+
  SCN-specific regions: Sequence locations=1-253
gtaaaaaaatgagaaaaaagagatagccattttttggtcaagaattttttttgtttgcgtttcaaatatcgtaagattgtttgatagggccagacaagagaaggcaactgttggtaccaagtttgcggtaaaaaaatgagaaaaagagatagccattttttggtcaagaattttttttgtttgcgtttcaaatatcgtaagattgtttgatagggccagacaagagaaggcaactgttggtaccaagtttgcg

SEQ ID NO: 56389 - DNA, 1256 bp, Heterodera glycines
  Genomic contig location: Contig_ID=SeqID_25641; Location=507..1762; Strand=-
  SCN-specific regions: Sequence locations=1-97,119-593,643-1168,1190 -1256
  Gene Ontology: Cellular component=integral to membrane
cgtgagccgatgttactccgagttcggctcttccaaactttggttttccatttgtccattcgtccgtccacttactcttctccctttttagctcgtcggtcttcttttgggctccatttattggaacactgctgtcactcagtccaccgttatgaacatcaacggactgatgtttcaagcggttgccaatatgaatttcatgttccaattcgcagctgtccatgtacacttattttctctgttattagcatcttttctttttaggttttttgtgacgaattgcccatttttatgcgcgaacattcgtccaatttataccgcgtcgacacgtattttttggctaaaaatttggcagaggttttcattttctaccgtatttgtctcccattcaaacggtgccccccccccctcactttgtttcagttggtccaatacgtcgtttaccctgtcattttctcctccattgtctattggatggcacttcgttttgtcgcctctttcgattcttcgctgttattcactttgagctgtgtttcgataacaaatgttgccgtttctttaggtgggttgggtttgtccattaatatttcccatttcattaaattctctctctttttctgttcattttcagcttatgcttccgcttgtatttttggagccaacgatgtttcggtgtttgccattttccactcaccattttcaattcatttctcgtttagactgccgttatgccaatttttgtgatccctttgctcgcatttggtggcttttacatcagtcaggtccgtccgtcccttttcctttcttttccttccatttttccttttcaggattctctgccctcttacttttatccgctcaaatacctctcttattttggttacgcttatgaaactgcggcgatcaatcaatggacgcgggtccatcaaatttcaggtgcctttttccgcatattttcattttataccgttttatatatttttgccatttttaggctgtcagtcgccctttccgcagccgcacatgaaaagcggcggagtgatcgtttgtgacccgttgaattgttgtcgtaatggcaccgatgtgctcgaagggatgagcttcagtgagaacaatttgtggagagattacggaataatggcggcgatgataattggccagtttcaccgaatttattccgccgaagtttctctttcccttcagtgcttcgattggtcgctttctttgctctttggctgcgttcactaataaagaaa

SEQ ID NO: 56390 - DNA, 472 bp, Heterodera glycines
  Genomic contig location: Contig_ID=SeqID_25643; Location=431..902; Strand=-
  SCN-specific regions: Sequence locations=1-184,238-401,423-472
atgcccaccaaacaaatgcttttgtgctccattttattaacaatacatttcgcttcacaatttctcgtttttggcctcgaaaattctgctcggtccgttgcggttcggggatcaatgttttgcaatggaaatccgtacgaagggctcaccgtcagactgtacgacagggaatgtgcgaatttcgaaaatttaaaaattttttatgtaaattttatatttttaaattttttttaaattctagcgcttgaacatgatgacatgatgacagagggcacaactgatcagtcgggcaattttgagctgatcggccacgaagaggaggctgaagcgatggcggaaatggacccgcgactgatcattttccacgtaaatttggaaacgcaattaccataaacaagctgttaatccatctttaattaattaaggagtgcaatgtcccgtgcattgtgcaaatggtcattaaggtaataaa

SEQ ID NO: 56391 - DNA, 515 bp, Heterodera glycines
  Genomic contig location: Contig_ID=SeqID_4966; Location=142..656; Strand=-
  SCN-specific regions: Sequence locations=1-133,155-515
atggacattagcaaatggggaatccgaatgttcgttcatcggggcaatttatcctccgtctcagttttggaccttcccgagttcatcgttgcgctgcacctcgtctacagggtgtgttcactttgccgaaaccatttcacatgccaaattctcaccccctcgtttttcagtccctccaaaatgagccggtccccgatcgactgtccccggcgctggtccctccctccaaactgggcattgtccgtcgcatgtctacgcgttccgtcgacccctctccgcaccattctcatcctccgcgtgagtaccgtgtaatgccatcaatcacttccctctgtttcatcagcgctcacttggagctctcgcgcctccagcgtcgcttccctgaacatccaattcggctctcccggcagtccccccactcgcccccctcgcccggcgagtcgagtggccgtctctccaccgcaaaacgaggcaaaagcaaagcgacagtcactgttcgaccggaatgtggtcga

SEQ ID NO: 56392 - DNA, 1716 bp, Heterodera glycines
  Genomic contig location: Contig_ID=SeqID_4967; Location=263..1978; Strand=-
  SCN-specific regions: Sequence locations=1-62,84-325,347-394,416 -560,583-1056,1086-1285,1307-1716
  Gene Ontology: Mol. function=ATP-binding cassette (ABC) transporter activity; Cellular component=integral to plasma membrane; Biological process=transport
tttattgtccttgtcgttgttccgttgatggttatcttcctatgtattacggtaaagttgggaattcctgtaatttttgttcttttattccattcttttagcacttttacaacgtttcttcggtccaatttcgtcgtttgaccagcaaatcgcgttcttcccatctctcttttgtggaggatgcttactccggctccgattccattcgcatttttaaggcgatcaaacaattcagggccaaaggctaccgaatttctgacatttgcaacgaatgctttatcgttgaaatattctctaacaggtaatttctttctttttttttttgcctttccttggtaaacatttctctgcagatggctccaaattcggcttgacattgtcgccgatgtttccgtttttatttgtgtggctgttgcaatttggatggcaagtcaaggcgtcatttcgttgggggttcttgcgttggtcatcggctgcggatatacggtcttttttttggaatttaagtcggcaggctacggggacaaatcatattgtgctctgtctgaaaatgaagtaatgtccttccccatcccttttcagttcaccggttaccttggcgaagttgcacgtttttggcgtgaatcggaggtgcaaatggtgtgcgttgaacgtgtgaacgagtacatcaacaacaaatgggaggccgattggcgtgcgcccgcgagtgaacgtctcgcggaatggccctcccgcgggcaaatccaattccgcgatttgtgcctccgataccgcgaagacagtgctttggtgctgaaccgtctcaactttgaaattgcttcatctgaaagggttggcattgtgggcagaacgggtgcaggtgaccaaccggtgatcattccgggaaatgctgtatttctctatgactaggcaaatcatccatcaccatggcactgtttcgcattgttgagcccgcttctggccaaatttttatcgacggaacggacatcacaacagtcggactgcatgacctgcgctcggcgttgaccatcatcccacaggtcagacaattcaaactttttttatataataaattgattatatttcattttcaggacccggttctcttctgtggctctctccgctccaatatcgacccgttcgaccaatactctgacagcgatctttgggctgcgctggaaaaggcgcaacttaaggacacaattagcggattggaaggcactttgctctacaaattaactgaaaagggatcgaatctcaggttggcattgaaataccattttgtgcattgaatttctttgctttccagtgagggacaacgccaattggtctgtttggcccgtgcgcttctccgtcaaaggacgcgcattctcattctcgacgaagccaccgcagcgggtttttcgggggtccttaaaaaggaaatgcatttgaattgtcttcagttgacacatacaccgactcatgcattcagcagtgcattcgaacccatttcaagtcggaacactcttattgctttattgtcattagcacggctaattgcttttaagccattgtacggtgttgaccattgcgcatcgtctcgacaccattttggactacgaccgtgtgatcgtcatggacgaaggcgctgttgctgagttcgacacgccgactgcgcttttggccgacggagaatcgatgtttgcgaagatggccaagcaagccggggtggtg

SEQ ID NO: 56393 - DNA, 4436 bp, Heterodera glycines
  Genomic contig location: Contig_ID=SeqID_4968; Location=1..4436; Strand=-
  SCN-specific regions: Sequence locations=1-93,115-320,341-663,685 -1075,1097-1232,1254-1262,1284-1310,1347-1754,1776-2065,2087 -2296,2319-2552,2576-2855,2878-3121,3143-3309,3331-3341,3388 -4303,4325-4436
  Gene Ontology: Mol. function=ATP-binding cassette (ABC) transporter activity; Cellular component=integral to plasma membrane; Biological process=transport
aatttgctccattttgctgtccgttctcgttgtcttttgtctttacgcaaacgccgtatttctcaggtaaatcaattacaatcggtctacattacaataaaaatataataacttccgcgagcaggtccataagcagaaatttttttgggtggggcactcgaagagctttttttttttgttgctcttccggcccaaaaaattttgtgtctaatataatttcctgaatttttggtgccttacgaaaaacgggaattttaacccttttcaaattcattaaatatgtaaattgaggaaattaaaaaaaaatatccatttttcttaaaaaaaaaaaaaaaaaaaattaaaactgccattcaatgctttgcagagtgatcgtcacattcgttgacctcggcttccctttgtggctgtccatggccgctctttgtgtgctcttttttgtggattttactggcaaagtgatgctcgcgcgtcgcgacttcgattctttcattgctttgctcagtttgcgttccatcatttcttgtgcaattcttgacaaggtttttctcctcaattttccgttttttcacatttccactctttttaagctgttcaaattgtcctcctccgctcgtcagtctttttccaccggcgaagtcgtcaatttcttgtccacggatttggtttttctttccaaatttcatttgcgtctcattgtcagaatccattttagtttcgcatttcttacttttggctcacaattcgcagctttgtctattgccctttcatggtaattttttgaagaagtccacttgaaattgtctctctcttaacccaagattggctttgcaagtttcggactttggatggagttggggatgagttctgtgttcggtttcgccgttttggccatgactttgcccatcaacgccgttcttaccaaactgatgactcactttgaggtcgcttttatccatttaatttctgtttattccttcctttttctcgtttttttcagaataagcaaatgaaaatcaaagatgaccgtgtcaaatttgtcaccgatgtgcttggtggaatcaaagtggtcaaactgtacgcctgggaggagtccatgcaaaagcgcattttcgaactgcgccacagggaggtcaaaaatctgtggatgattttcctgctcgacgtcttcatcaacctgtccttcatgctggctccgctcattgtgcggtcctttgcataatttggcatcatttgggagggggaggggctgaggattggaaccaaattaaaatcctttttctcccatacatgcgccccggggtggtaacaaaatataaaatttgaaaattttctaatttttttttctcgaatgcatgaattgcctttcctttttgcttaggccactctcgtctctttctccgcattcaccatcatttaccaccaaacgatgcgtcccgacgtggctttcgtttcgcttctgtttttcgccatgcttcgttacgccatctaccaaattccccagaccatttcttactctgcccaagctttcgtcagtattcggcgcgtgttgaaatttctcaatgcggatgagcagcagcaaagtcacattatccaagcagcgaatggcgttgagaaaaacaaaacggcaaaacatcgaaatggcaaaattacaactgacgaacgccaaattggcacggattattcatccgaaaattcgacaaattcaggttggctaaattaaatgtttgacaattagcatttagcttaactcctcactaatttgttttgtaaactagttttttgtgtaagaattttgcgtccattcagtgattttgcgtcactgttccttcacttgggaaagtgccaaaaaggaaactccgattctccatcttcgcgacatttcgcttgagattgaagcaggcaaattggttggcattgttggcaaagtcggcagtggcaaatcatcgcttttgtccgccattctcggtcagtttgtccaacatttctttgcctttccaactgattgggaattttatgtcaaatattcctttgaatttaggcgaaatggaacgggtggaggaagagggcagcaaatgcatggtgagggcttcctcaattggatatgtgcctcaaaagccgtggatccaaaacaaaaccctgagaagaaatgtgctctttgatggtccgtttaacgaggacaaatattggcgagtattggatgcgtgtgcgttgaaagcggacttgaaactgttggcagcgggagacatgaccgaaattggagaaaaggtgaccccaaatgttaaaaagacagaacatatatatatatatatatatattttggctggaattggaccgataaagtcgaaaaattaaaccttgattcagggcattaatctttccggaggacaaaaagcccgagtggcactggcacgtgcagtttacatggacgctgatttgtacgttttggacgacaccctttcagcggtggatgctcacgtgggggctcacatttttgagcgggtgatcagtaaccaaaaaggtaaaatatccgctcaaatatttgctcaaaatttcaatttccttaggccttcttgctggcaaaactcgtcttttcgcgcttaactctttgtccttcttgaaattctgtgatttgattgtggtcatgaatggtaagccggctgacaatgactcacaatatccttctaataatttcataaaaagatggtcaaattgactcggtcggaacattggacgaattgaaacagcacacggagggaccatttgcagaacttatgaaggaacacatggagaaacactttgagggacggaagagtcgcattgacagcagcagaggtacaaccctaattatccctaattaatgggtttggaccgaaaatggacatttcagaggacgacacggaagaaacgacctctcatcgtcaacttgaccaggtgttggaacagttcgccggttcacccctcagtcactctcttctcgaaatgcgtcgtcggttggagtcatcggagagtaatggccatcaatctctgcccgcgaattcctcagaacagcaggtaaaacgaatttcaattttttggcgggggcgggggaggtccccgcattttggggagcaggacaaaacgtcgccgccgccacagttgccagccgaactgtcgccgggacaaaagttaacgcaatttttttttgttttagaaaataaaaaaatatcaagaaagttcaaggaaatgaaaaaataaatcttttttttttgaaaattcagcaaattttgttttcacaagggaacattcccaactgtaagtcggaaaacctatataaatttggtatcacttacaattagtccttaaataattaaaaaaattttaattattgaaatatttttattttttgcggatgatatgtcccggcaagtttcggcaacaagttttgtggtataacagcaatttgtgtctggtagtgccatgtgtccctaaatggactccaatttggccttattctgttcatttccaatacttttctgccagcatccaatcgcttcatccgcccatccccaaccatcggaggagcatcaacaaaacaccacaaatgacagtccccacaatttgaatgcgatgtctgcttctgacctcgtcggtcgaattacggatgaagaggaactctgcacgggaatggtccgtccgcttttccgttcactttaacaatgcatttatttgttggctgtttaatttaggtgaagcgacgcgtttacttggactacgccagggcttttagcatttcgttgaccgtcatttacctcctttgtttattcattgggtccagcactttccaagtgacgacatacgccccttgcttttaccagtacaaattgttttgcttttttaagggcctttccaacgtttggcttgccaaatggtcgaccagcaattcgacaagcccggaggaatcaattcggaatttgggcatttatggagcattcagctcggtttacggtgagtgattcgtttcatgaaaactctactcacaatcagtcgcagaaaaagaaaccgtagtaagcccgaagacttatttttttctacggtacttaactttatttaattgtaagaaacttgacgactcaaattaaaaaaaagagaatgtttcttatgggtttatgtggttgtgtggtccctctgctgtttttctatcgcgataaactttttcttttcagtgttttccgctgctctgtccagcttggtcctttcctgtacggttttttcttggtgcaaatgtttttaatgcgtttttctccactttttcagtcggtgcgtaccgcgccagcttggcctttcacgacaaacttctccactcgcttttccgttctccgatggcttttttcgaccggactcccctcggcccgattctcaaccgaattggcaatgacatcgaccgaattgacgaa

SEQ ID NO: 56394 - DNA, 357 bp, Heterodera glycines
  Genomic contig location: Contig_ID=SeqID_4968; Location=3727..4083; Strand=+
  SCN-specific regions: Sequence locations=1-26,48-124,148-357
atggattctgacaatgagacgcaaatgaaatttggaaagaaaaaccaaatccgtggacaagaaattgacgacttcgccggtggaaaaagactgacgagcggaggaggacaatttgaacagcttaaaaagagtggaaatgtgaaaaaacggaaaattgaggagaaaaaccttgtcaagaattgcacaagaaatgatggaacgcaaactgagcaaagcaatgaaagaatcgaagtcgcgacgcgcgagcatcactttgccagtaaaatccacaaaaaagagcacacaaagagcggccatggacagccacaaagggaagccgaggtcaacgaatgtgacgatcactctgcaaagcattga

SEQ ID NO: 56395 - DNA, 740 bp, Heterodera glycines
  Genomic contig location: Contig_ID=SeqID_4969; Location=12..751; Strand=+
  SCN-specific regions: Sequence locations=1-85,107-208,231-300,322 -646,669-740
atggtcaaagaaagcacaaaggaagggagggacctgtggaagcgtaagaggggggccgaagaggagaagggcatggcacgggagcagggagacgaggcggaggaaccaggcgatgtgcaaggggccggagctgacgaggccagcccggacgcattgagcataagcaaaagtcgaacagagctaaacggggagacggaatgatgaaaagaaacgaaaattggagagaaagggaagactaaagacatacggaaaagacgagatcgatggtcgaaccaacacgttgttcgggaagggagatgggcagcacgaagaggaggagggagaagcgaaggagcgaaacgaacaagtcgagcgtggagagggcctgaaggaaaatgtgccgggacattcattcaaagcaatgcgcacccctttgaggatgatcagccggttaattgggaggggaatggcattcggacgaaagagccgcgcgtaaagaaacagacaaagcatcgagaagacggagacaacggctgggacgaagggaaagacgacattggccagacagggcgagacaatttcggacaaagtcgaatttgggaagacgggagactgaacggaggaacggaatatttggagggagacggaattcaaacgcactatgacaggagaggaacagagaaagggcggcacggaaatggggctgaaggcgagcggatttaacggatgcaaaagagtaaccatcaccaaaggacctaaaa

SEQ ID NO: 56396 - DNA, 673 bp, Heterodera glycines
  Genomic contig location: Contig_ID=SeqID_4970; Location=809..1481; Strand=+
  SCN-specific regions: Sequence locations=1-178,200-280,302-331,353 -430,453-580,604-673
atgcacaaatggtgtacggacatttcgcctactcgacatcatgacagtaggcgaaatgaccgattttgggttagtaggcgaaatgaatgtttttggcttagtaggcgaaatgtcgagtaggcgaaatgtcatgtagcctgcacaaatatgcacataaatcgcgaaatatgcacaaatatgcaaaatatgcacatggaaagtcatcctagaagcttcaaatcaagctaaaaacatgtttttcgtgcgttttcagggctcccgcagtccaggaaaaaaaatatgcatgtgcatatttttggcatccctagttatagaacaaaacataaaaacatatttctttttctctctttttggcgtactattttcatgtctctagcacatgtaaaaatcgaaattcgcaaattctactagttttggttagaagagtacaaaaccactttggacttttaaaatcaataaaaaagtgattagtttccgcattttggttgaaaacagcggcctcggacctgagttataacgtaatgaaaattttaaattcccacaacttttttcatatgagttaaattgcttagcatttgcttagaaaaagattctccttttcaaaatctttttttagataccaattttgttcagtttagttggagatgaagcgagttatggaagatcgaaataa

SEQ ID NO: 56397 - DNA, 1065 bp, Heterodera glycines
  Genomic contig location: Contig_ID=SeqID_25644; Location=24..1088; Strand=-
  SCN-specific regions: Sequence locations=1-295,318-1065
  Gene Ontology: Biological process=locomotory behavior
atggaagtgcgcaagaagaaactgattgagaacagcgaagtgatcgacgccgcagaacaagcaatcaacggaaacggacgactccatttgttgggtttggtgagttttataaaaaatcgttttttattccattttctccaatcaaatacaaaaatgttcagatcagtgacggcggtgctcactcgcacataggccatttgtttggtctgttggattccttcaaacaattaaaagtgccaaaagtttttgtccacttttttgccgacggccgtgacgcatcgccaacgagtggaggtaaaataaaaaattcaatttaacaaatctgcgattatatatgctcccgccatttttagccgtcttcttgcaacaactgcttgacttcttaattgccgaagactatggcgaattggcaaccattgttggtcgttattatgccatggaccgtgacaaacgatgggatcgaattaaggcactcattttcgaaaaaatatcattttttggattttcatttttcctaaaggttgcctacgaggcattggttggcggagtgggcgaacagtgcgaaccggcgaatgctgtacaattggtgaacgggcgctacgcaatccaacagactgacgaatttctgatgcccatcgtgttttcggacgaagcgcgtgtgaaaggtatgaaaaaattgctgtttttatccaggaattttaggggggggggtaaatttttcaaggaaaaaacaaaggaagaatctttggtttgaaaaaacaaacacattcatgatcaaccaccatgaaactatgtaatagtactattttcagaaatagaaaataaatgaataaaaccaaaaggatataccaatttttaggaaataaatattgctccctccacccaaaaaagcaaaacgtcgaaaaaaaaattttttgttctcggcctttttgctgtaccggctctaaagatgcttattgttagtcattcattttcaagcagaatttgcaatttcagacaatgacacattggtctttttcaattatcgtgctgatcggatgcgtcagattaccaaatgcatgggtg

SEQ ID NO: 56398 - DNA, 543 bp, Heterodera glycines
  Genomic contig location: Contig_ID=SeqID_25647; Location=36..578; Strand=-
  SCN-specific regions: Sequence locations=1-184,328-543
atgtttaattgcctcattaatttgctcagcaatttgattgccactcatttgtcaccaaatggcgcctatggcctcgtgtttggcattaacagttttgttgcgcttctgctccaatcagtcgtcacactgcttattgtcgatgtaaatggtgcttttgcattgtcacttgaagcacaagtggggcaaataattaattaatactataaatacattatttcaatcatttttaattaataattaaattatccataagaactagaaacatttatataatttaaattaaaataaaataaaattaataaattaattttaaagataattaaaaatgcatttctttttcacagtttaaatgttcattttaatttgatttgttttttcagttcgtcacctatagcatatgcatgttggtcagttcattcacatttccaccccttcaactgctcgtgaaatgtggcaaaaagtgattcaatggataaaggaaacttttataggataattacttagtttttattgttaattgaataataagggacccgtaataaa

SEQ ID NO: 56399 - DNA, 180 bp, Heterodera glycines; identical to SEQ ID NO: 51454
  Genomic contig location: Contig_ID=SeqID_25648; Location=291..470; Strand=-
  SCN-specific regions: Sequence locations=1-180

SEQ ID NO: 56400 - DNA, 205 bp, Heterodera glycines
  Genomic contig location: Contig_ID=SeqID_25650; Location=1281..1485; Strand=-
  SCN-specific regions: Sequence locations=1-205
gtcgccgctgttggccgcgactcgcgtgttgaacgtcgctttctccgacgatctctgtgagggtgcctattacgaggacagtcgcgtcaccgcgttaaaatgtgccgacgacccggaattcgtttggtcagtgggcacttccgtcagggacatgatcgtggacagcaacgcgaactccttcaacaaaagcgaaagcaccgaataa

SEQ ID NO: 56401 - DNA, 214 bp, Heterodera glycines
  Genomic contig location: Contig_ID=SeqID_25651; Location=1..214; Strand=+
  SCN-specific regions: Sequence locations=1-68,92-214
tccaaaagagtaaaaacccacgaaatgtccaaaatttttcaaaatttataaaaacaaaatgagtctaatttaggatttttagggttttcggggtcgctgaatacgaatataccatttatattaccccttgcctaaccttaggcccatctgaataataaaaaactcaaattcgagacttggacatttcgtggcctggacattttgtgggtcagcg

SEQ ID NO: 56402 - DNA, 858 bp, Heterodera glycines
  Genomic contig location: Contig_ID=SeqID_25651; Location=584..1441; Strand=-
  SCN-specific regions: Sequence locations=1-858
ttcttttcttcaaaggttgtttatgtgtccgttccctccgctgaaattggcaaacgaattgctcatgaattggtccgcagtcggttggccgcttgtgtgaacattgtgccacagattacttcagtctacgaatggaagggaaaggtggaggaggacagcgagtcattgctgatcatcaaaacgggcagagaacggctggaacagctcagagaggcagtgatcaaactgcacccgtaattaatgatcaatagggttataagttgtatgattttggatatttctgcgcatatgctatgaagaaaggggctcaaaaatagcatttctacgttaaaattttttgatttggtgaaggtttttagtgcatataaaagcatattttgggggttttcgagaataactgcatatttggccatttttgcgttttgagaacatatttcgggcatttttggcgaattttcatacgaaaaatgcgaaaatacacccctaaggaccgaaaatgctccttagcccttgttttggttttttaaaagtaattcttaatttatacacaatttttggcattttttgagggctaaaagccatttttggcagttttttaaagcatattttagtgcatatttgggcatttttcgggttttagggcatatttgggggatttttagtgcatattttatgcgcatatttggcattttttagtgcatacaacttaaaccctaatgatcaagcattaaaataaagcacccatttctttgcatctttcacagttacgaggtccccgaatttgtggcatttccaattgagtacgggtcagagccgtacttgcggtggatttccgatcagatcagtgacaaagaggga

SEQ ID NO: 56403 - DNA, 798 bp, Heterodera glycines
  Genomic contig location: Contig_ID=SeqID_25653; Location=737..1534; Strand=-
  SCN-specific regions: Sequence locations=1-221,244-798
ctaaggatgggactgaaaggaccgtcgctgatacggtggccccaaatgtgaacaaaatgttggtaccgaagcgaaaagtcactgctgacgcattgttggattctttacgggcagaagacgggtgaatgatgaagagcaattaatctcacaattagccctatacatatttagtgccaaaaagcataaacaaaatgccaaagtgtgtctccctccgccgtcggtgccatcatctttgtcctcctcatctgtcactctttcttccgcgctttgggaccatgaaaatgatgagaatgcaattgttgtcattgacaataacacctctaccactgcgcaatcgcaagatgccagcatcaacagcagcagtcatctgatcggctgcagcaacacaaccatgaacagctccacaatgttggtgccgttgtccgattcgatgttgttggatgcgtcaccgctgaacaacccattcaaaaagttgcaccgtggattatgttacaaaccctgacgtggttttcctggagtacctttttgaagaatgccggggatgtaatttccccaaaaactgttttcgcacaatttgaaatttttgcagaaagcgccactacggacacccgctgcagtctccggtgaaaaattgggaaagtcttccactactcaatcaactgctggtgacgtgggtggtcctccttcaaatcgaggcttcttggagcagtcacgtgacaatttgtcgggatttgtcgacttcttcgacacgctccaatcggcttcgtcgctgtcttcgtccacaaccgcacgaaaaaa

SEQ ID NO: 56404 - DNA, 2571 bp, Heterodera glycines
  Genomic contig location: Contig_ID=SeqID_4971; Location=751..3321; Strand=-
  SCN-specific regions: Sequence locations=1-539,578-1633,1655 -1920,1942-1970,1992-2084,2106-2571
atgggcaaatggccaattttaccattggaggtattggggcgagaaaagcaacattcggcgactaacattattagcatttgctcagaaattctcccccgcgttcaaatggccaattgcttcgcaaatggaaatttcctttctcatccgcccgcttttctgatggcttatggcactcgtcttctcgttaatgcacctcattctgctgctgcatctgatgagaaattagtggagggaaacgtaaaaggaatgcgaaaagaaagcgaaagggcggcggaagggacggcgtcacttggaagggcttttgtgccggggattggttccgaagtgtccgactgtttttactcatcgatgggtgggtttcatgtgttatgatcagaatcgcatatatcactagaaacaaattcgatccatttttgctcatcgaattgatcttacagtaaacgctgctgaatgtcctacagtaattcgttgcctcctttcagtccctgctgcccatttcgatgtctctgctcgggccctttgctgttccatcgtccgctttctccccctcgccccctcctcctcctcaaaccctttcttctcttctcaccgccgacttcgtcttttgctcaacacttttccgttcatttttctgcctcatggaacactcataaaaaagagcgaatcgaacgaaattcgcttctgttgcgtttgtgtgcaatttgacgatggagaagggacaacagaaagtcaattggccgaagctgtccttgtcacacttccccaagaggggcaacaaacgacgacgccatttgggcatttctgtgaacgactggcacttcaaattgaggtgatcagcgggtgaatcagtcaatcagcggagcaaataaacgagcaaattcatttaaatcttgtattcccatgccctgccattttcagcgatttcgcctttcttccggcctcatccactgttggctgtctcagtctctcagccgtcttttttctcgctctgctgatttgcgatggattaaacttcgcccaatcccatcagatcagctcaagaacattgacaatttaatcgtttcaacaagtcgcgtccatttggcagaagtcaaacaaacattcatggatttgattgcttctgcccgacaattgaacgctccgtggctattgtcacgtgataaatcccattggaatttacacttaccaaaagttgaaacggaagataagctgaaccaaaacagtaaaaactaacaaatcaattaaaaactcaataataatatgtacatacatattcagaaatgattaaacaaattgttctgaaattaatggatgatgaggagaaaacgcgtttaaatgccaacgatcgaattgggactcaccgtcttttttggcctctctcgcctaaaatgaccataaaattcagggtcaagcaatgcttaatttcgaaatgtcatttcattttgttcagaatgacgaagaaatgaattggcatttgccaaatgaaagtcattctgaagccaatgaaaaagatgaagcaatgacgcaataccatcaaaagtgtgtgcaaatggtcgatttcccgtgggtctttcatccgtcgtctttcattccctttttggcatttcgtagtgctcaattgtccgttctttcctctctttcgcattccattcgaacgtttttgcgctgtcgctgcttaccttccgttgttggcgcaaaaggtcaaagtgccggcgaagaagcggtggtgccattggcacttttgttgaagggaccgtgcggcagtgggaagtcaactttgttggcaaaacttatgagcaaactgcgaacaactgacgaagacaatgcatttgtaccagtcgcagcggatattgtcgattgttcggatgctggtgagcgatcaaaaaaaaagaatgccaaagtccggcctttcttttgccattttttcaattcgaaatgcgaatttttggtccttctttgaattcggttgattttttcctcctttaaaagggaattcgcttcttcgttttgtcgattccgttgattctgcgatggctgaattagtcaatcggtggccttccgtccttttgctggataattttgacatttgtattgggaaattttctaacggaggcgacccttcgtcgatgcaaaacgaagaacagacgaaacgtttgatttaccaaagtggcaaagaccaacaactcaagagaattatgtgtatagttcagaaatattcggcagattatttggagaattccgacgaaggaaagtgccaattgtttgtgccatttctggcggaattaaaatgtccgaagagatttcggcatgggaaggaccgcctttgaagtgggagacgcaccgaattggtccaatcggtgggcgttaattaggattgtttattttgttttacaatacgcaaatatcaagacaaatgcacacaaaaggaagtattgaacaaattatcaatgcacggagacataatgcgaacagatctgcgaattgaatcagcgaatttcggcacaatcggtgaactgtgccgtttggtggagagattggaattgcgaattggcacaaatcgaacgcccgcgg

SEQ ID NO: 56405 - DNA, 667 bp, Heterodera glycines
  Genomic contig location: Contig_ID=SeqID_4971; Location=1..667; Strand=-
  SCN-specific regions: Sequence locations=1-279,301-641,663-667
  Gene Ontology: Mol. function=ATPase activity; Cellular component =peroxisome; Biological process=peroxisome organization and biogenesis
gcaaacggaacgaattcggcgaaggagagttgtccattcgctttgaccaaatcgccggattggagtccgttaaaagcaaattgaccgaaattttcatttggcctgccagggtactaattgttttcttttttgttgcaattaccgttttcttacagtatccatccctttttggattgtctggcgttcgcgtgggacaccgcgcaatccttcacgggccaagcggatgtggcaaatcgatgttaataagggcattggccgggtcaatgggagccactgtgttcagtgttagggtgaattttctttttcttaagagtgcccaccaattaaattaaagggtccccaattgttgtctaaatatgttggcaaaagtgagcaaaacattcgccaactctttgccaagtgataattttgacttttttatccattaacttttcttttaaagagcaaaggcatcaaagccggcgttgatcatttttgatgaggtatttaatgtttttagagatttcattaaatttgtcagatcgatgccattgcgccgcaacgaggcagtgacaattcgcacgtgacggatcgaatggtgaaccaaatgttgacggaattggacggatttgaggggaacaccgaaggcatggacagcaaatcaagaaaaacatttgtaacatggcac

SEQ ID NO: 56406 - DNA, 996 bp, Heterodera glycines
  Genomic contig location: Contig_ID=SeqID_4971; Location=5253..6248; Strand=+
  SCN-specific regions: Sequence locations=1-537,559-909,931-996
atgagtaacagtaatgacagtgacgacctaattatttatgacgacaatgaagacattaaagacgtttcatccgattcgggtgacgaagtagcgatggaggaagtcaccaatgcaggcacttctacagctggggccttatctaacgaagaaatcagggactaccaagtagagtttcaagaaaagttcacaataatgacagaaattacaggtgctttctcagacggagttggtcgacgaactgaataagctttcatctgaaacttcagcagtgttgcgtttcaatggctcaatttgcaaggtacttcttcatcacttcaaatggaacaaagtcacactaattgagaggtagctaattttttttattgttgactcaattaatatccagattcttcgaatttcctgagacttcaaacaccgattcattcttccgcaatgcaaatcttctcgatcctacaaagcataccaaaatcgagggaaaggttgattactgcaagatttgctacgatttaagacagctgactggattgctgtgcaaccatttgttttgccgtcagtgctggtccaattacttgtcgtgcaaggtgcttaaacaaaaaattaaccactaattgtttattatagattctcggcgagggtcgaccttatgtcacttgtcctgaacttcgatgtactattgttgcggatgatgaatttgtgctcaaaaatgtcgacaataaacaagcgttgcgttcctatcacaaattggtcctcaactcttttgtggaggttgatatctttgggagcattcagctacaaattttgtttagtgtaacaccttgattaaatggtgccccgctcccgaatgtggtcgtgctgtcaaagtacctcattcagaaccgcgcaaaattctgtgcaaatgtgggtgccttttttgcttcagctgcagccaggtgggcgtaaaactttattctaattgtaattttatcattttttattctacagcaatggcacgagcca

SEQ ID NO: 56407 - DNA, 2621 bp, Heterodera glycines
  Genomic contig location: Contig_ID=SeqID_4972; Location=127..2747; Strand=+
  SCN-specific regions: Sequence locations=1-808,830-1379,1406 -1411,1433-1623,1646-1847,1891-1903,1925-2621
  Gene Ontology: Cellular component=ubiquitin ligase complex; Biological process=ubiquitin-dependent protein catabolism
atggaacaaatgcaggtcagacgttgaaaaaagcaattctaaattaaaaaaatgaatttctttaaaggtgctcggcttttcgtggattgaaacgcagtttttgcagaaggcggttgaaattcttgtcgaatgccggcgtactttgatgtacacgtaagtttcgtaaactaaataaaggtttaattcgtattttcagttacgtgttcgccttttaccttgtccaaaataacatcaccaaaatgtttgaagacaaccaaagtgacctcgagctggcgactgaacaagtgaattttaatgttagttaattgttgtgacaatgtttatgttttagttgagtgaatatttggagagagagcttccgaatgagaaagttgctgaggtcaaacaaaaggtgcgtttgttttctttactttttctacttcaattactgtttcaggtccaagacaaataccgttacgtggaacagcgtcgccaaattctgctcaaacattgtgttgagggacgcgagcgcaacgaatgggagttctgtcaggccacgattgagaacaaaacggactttagagggatgtaagaactgcggggggcgtgctatattcgatattctaattgcggagagttaaattgccgctatgtatcatttctatgaacaccttaatggatctgtcaatcaatgtttctcacaatgtcttcactgttcttttcaatgcatatgttatgatgcactaatgcttttcctatggcatgaatatattcaggagtcctctcacttttggcagtttaaactaaaaattattattccaatgtctacttttttaatgtgctttttgttttacaaaattcgtagatgggaaattactacagtcctcctaaacgagtggggcagaaccctttgtaagttgtttcttccctaaataaaatgaccgagaattatgcagcactcgttctggggcgccgccgcctaaattggtcattaggaaggacaaggatgtgccgatgcaccgagtcaatgacccggtaagagcaacaataactaacggattaggctttagtccaaatccactttcttgcccatatacgcgtgcgcccacccacctgattaaacaattggaatatgcaatatttctttagatgagtttgcagctgcatatggcgggtattaataccctatgctatatttgaatttgaattaccacagatgaacgcgttcggactgcgggactctcgaaggcggagagagagtggagagagtgagtgacaattagaacttcctccaacaaaaagttactcaaatatctattttagaaaatgggttcatgaccagagtatgcatccggatgagcctatccatgtcgacgcggtccaccggtagccatttgttctattttatatatttaaaaattattaacccaatcaaatgtatcttattagaaaaattcagccaactgaatccaatcagagtgctttatcgatggccaatggataagctttacaagcatttcttgcgaccaacttttgggaattactgggcaacgattatccgtgtctatgttcccaagttcttctggttctttatgacattcgaatttttctactacgtgtggaaatacgaatcgaaggtgcttgaaatttttattttctttaaataaatgccataaatatggtaaatgtttattataattagggttataagttatatgcactaaaaaatgccaaatatgcactaaaatatgccttaaaaactgccaaaaatggcttttagccctcaaaaaatgccaaaaattgtgtataaattaagaattgacttttaaaacaccaaaacaatggctaaggagcattttttagacaattgcaaaaatattgaaatttccaaatttataaattttattatatgctaaaacaacattacattttacatatacataaattttttttccaaaatttcttacaaaaatttaaaattttttcgatttttaagggcgtatttttaaaaaaattccaaaaagtcgatccttaggggtgtatttttcgcttttatcgcatttttcttatgaaaatttccaaaaaatgaccaaaatatgctctaaaaatgcaaaaatggtcaaatatgcacttattctcaaaaaccctcaaaatatgcttttatatgcactaaaaaccttcaccaaatcaaaaaattttaatgcagaaatgctatttttgagcccctttcttcatagcatatgcgcagaaaaaatatgcaaaagcatataatttacaaccctaattataatcattgcagagttggcaaaaacgaattggcttttccactatcaatcgaccggatcgttatgtgcttgtcaaagaccacgatgaggagacgcttaagcttggcctgacagactacagccgatctgactattttgacaaggaattctaccagcgcattaaaacggccaacatcgacttcggccccccgaagaggccgtggtgatcgctgcgatggtggcaatgcccattcagaagagagaggcggaatagaaaaatgaaattaggttatgatggcagcattgttggatttttgtttatttctgtaatgtatggttttcgataaaagtctggacagcgacttcctttgtctaaaa

SEQ ID NO: 56408 - DNA, 87 bp, Heterodera glycines
  Genomic contig location: Contig_ID=SeqID_4972; Location=3290..3376; Strand=+
  SCN-specific regions: Sequence locations=1-38,60-61,83-87
atggaaaaggcacaaatggaagaccgaactcatcgaaaaactgaaaattgcaacaaaaactgcacctgtggaattccctgtggacaa

SEQ ID NO: 56409 - DNA, 449 bp, Heterodera glycines
  Genomic contig location: Contig_ID=SeqID_25656; Location=134..582; Strand=-
  SCN-specific regions: Sequence locations=1-352,374-449
cgcccaacacgaaacttcccataaagatagctctatatatgttgttaccttctttaactcatcggatattcttcataaaaacgctacattcggtgattacattacgttaaatcacactgctgtcagtattataaacgacacatataaggttacttatgtgtgctcgaacaagagtataagtttgaccccagatatggacaaatttgggaaatatatagcatttatgtttaaacctattagatatgttcttgctctcatcaatctatttttactagctataataattttgattactcttcttggacaaattgaaggcgaattcaaatggtttatacttaacatatcaacattgaatattttcttttatttgtttactgagggtggaagatgtgttgttgaagatttatttccgctcttacagaattctcgaatatcttgggaagttgtca

SEQ ID NO: 56410 - DNA, 471 bp, Heterodera glycines
  Genomic contig location: Contig_ID=SeqID_25658; Location=109..579; Strand=-
  SCN-specific regions: Sequence locations=1-94,116-173,195-196,224-471
  Gene Ontology: Mol. function=transcription co-activator activity; Biological process=development
atgttcaccgactcaatcaacaacgacttggacgatcgccgattgcgccgtcaaattgccaattgcaacgagcgaaggcgcatgcaggttggacaaaaataaaagtgatttgtgcattttctaactttatgttttatcagtcttcattaattaatcgaatattatacccaaagaacagtcattatttaaaaacaaattgttttgtttttagagaatggtatgtcataataaagttgggttttttttcgtttttttgttagatgtccattttgaatttccattttcagtccatcaatgctggattccaagcgctccgtcaattgttgccacggaaagacggcgacaaaatgtcaaaggctgcaattttagcagccaccgccgaattcattcaatcgttgctgcgagaaaaggataaattattggaggaaaattgtgtcgtaatggcaaagaagcgacggatggacacggaag

SEQ ID NO: 56411 - DNA, 73 bp, Heterodera glycines
  Genomic contig location: Contig_ID=SeqID_25659; Location=691..763; Strand=+
  SCN-specific regions: Sequence locations=1-73
atgcactgcttgtgcgttgcttcgtgggatcatgtacttgtacgtgttcttacgttacttgctcagctcggct

SEQ ID NO: 56412 - DNA, 953 bp, Heterodera glycines
  Genomic contig location: Contig_ID=SeqID_25660; Location=156..1108; Strand=-
  SCN-specific regions: Sequence locations=1-444,466-626,648-953
gtttactcatcaccgcccctgctgtggtcccaagaattggccgcattggccaaaacgtgggcactgaagctggccgaccggggcagtgtgctttatccggagctgcccggcattggcgagaacatttttttgttgaccagcaaatgcaacggcacagccgctgacgccatttcgtccccgtccgctggcatggcgacaaattgtccgccaatcggcgaccatttgaccaccggcattgagctggtggcacactgggcagccgaagcacaaaagatggactttgcgcggccacggtggaacaatggtaggaggacagcagaaaatacaataagttttgggcgggactgagttagcacggcatttcatgtacaacaccaatccgccactcaaaaggcagattgttgtggttttcggttatttccgacacctgttgattattcattaagatcactctgggaaattttatgatggaacaatgacggtcgggacaaacttttttatgggtactgaattgtccagctctttgtatccggcatagttttctaattcggcgccaaaaaaccatactctcgaaacgaggcgccgtcactttcgtaaatgaaatttccaatcattatttatttccaaaaatttttaacgaaaattaaattcccgcgtcaaattttgacacagatttcgaaagtctcgagcactatcgattattcaacaattttttgaattatcatagaaacgaagaacttcacgcaaatggtgtggcggtcggcaatggaaatgggtgtggcacggcattggaacaccgccaaaaactgtctggcaatcggtaggcatttcaaatttgaattttttttcacttgttgcacttgttttcatggccaaaaatagacatgtaattagtaaatttacttattttacagttgccttttatcgtccggccggcaactcaaatctgccag

SEQ ID NO: 56413 - DNA, 576 bp, Heterodera glycines
  Genomic contig location: Contig_ID=SeqID_25661; Location=695..1270; Strand=-
  SCN-specific regions: Sequence locations=1-576
atgaaagaagaagacagacactggaatttgattgtgcaagattacaacaataacccacaaaatcgaatgcgtggcaggggaatggcaaggaaaaacatttacgtacagcaggaccaagcaattcgcgccattttcttggatcgtcataacagaccttttttggcctatctacgtgcaatcgcttatcgaatgccggaaccaaattgatttgattgagatatttttaggaaataatccgttctaatgacttgaaaatatttttttaaatagaaatttactgtcggattgtccacttctgtcggattgtcctcactgtcggattgtccaactgtcggattgtccactgtcggattgtccactgtcggattggccgggagccctttttaactagcgccggattatttttcaacctcctcagaaaaggggggataattagagactgggggattatgatagagggattatttttcaaaacacctcgtagactgggggataattggagactgcgggattaatagagactgggctatattagggcaattgtgtggaattatgctttagctaatttaaaataaa

SEQ ID NO: 56414 - DNA, 873 bp, Heterodera glycines
  Genomic contig location: Contig_ID=SeqID_25662; Location=114..986; Strand=+
  SCN-specific regions: Sequence locations=1-319,341-873
atggaagcgtctaatgcgaacgacaatgttcgtattacgattcctcgccttaatgttcaaaaggggcgaagaaacaattgctcactcgagaagcacagaaaggaaattcgccaaatttccaagtctgctgaattcaaggcggaagacttcgcactcgcggagcgagtgctcatccgcctggaccagatggatgatgctgaagaattccaacactttaaaacagtgtttgaagacgacggaattctccgtctgaaaaccagactggagatgagtgagaagccatacagcttctctcatcccattctttttgccaagcattcagctttggcaaagctgatcattttggatcggcaccaaaaaaggcatcaccttggagtggacaccactctgacagaattcctgagcgaattctggatgccaagcgcgcgtttaaatgttaaacgggctcttcgggactgtcttctctgtcgccgaatgaatgcacaacaatttgcattaccaaccatgccacccttgccgggtgagcgagtacgccgacacgcgccatttcagtcaattggaattgactttctcgggccaacgacaatttctttggccggagaaaaaataaaggcatggatcctcatcataacatgcctcgcaacgcgcgctgtctaccttgaggcaacattggacctcacatcggaatcattcatcaatgttctccgtcgattcataagtcgacggggaaaacccgacatcatttggagcgacaacgctacgaccttcaaactcgctcagaaaaccctggagcttctcagtgctccggggccggatcaggaagtacaaaacttcctgacccataaccgaatccagtggcgattcattgcccaa

SEQ ID NO: 56415 - DNA, 1194 bp, Heterodera glycines
  Genomic contig location: Contig_ID=SeqID_25663; Location=379..1572; Strand=-
  SCN-specific regions: Sequence locations=1-813,835-1194
atgccattcacacccggccacaacagtggagggacccgaaaggcaaaacatcgcaacaacccaagagggccaacaatgcaaaggaacaacccgcgcgtccaccaaacaccaattatggcaaggcaagccgcggatcaccaacgcatccgtgcggctcatgtggagtcggatcattggcgcacggattgccgatttaaagacgccacatgccacaaatgccaaggacaagggcacattgcaaaggcgtgccgacgcagctccaaccaagcgaaaaatcgcagagagcgatccgtccacaccgtcgttgtcaaatcccactgcatgggaattggaaccgcagcaggccgctggtggcgactcacgttcatcatcaatggaattaagattttgatgaacatcgacactggtgctcaggccaccattctcacactcaaaacgtggaaaaagctgggttctccaaaactcgacaaacccgacattgaaacgcggaactgtaatgaagttgcattcaacgtcgaaggaaaatttgtctgcaccgtttgccaacccaatcaagcacccaaaaagcttgtggcatacgtcagttccgaaatcaattacgatcttttcggactgccttggattgaggctttggacgtcatcccacatgaaatcatgtaccccgacatccgaccaaaagctcaaccagccccggcagaaatcaacgccatggccattcctcagccaacgcacaaaatttcggatttggaatcgctcacaaaggccctccaaactgatttttctgaagtttttggccccggattaggccattgcaccaaagcaaaggcccatttgatactcaagtccgatgctcacccaacattctgcaaagcacgcaccgtcccacacggcgccctcaatgccgtcaacgaagaattggaccggcttttgcagattggagccatcaaaccgattgagttcagccattgggcagcaccgattttggtcgtaatgaaaaagaatggaaagacccgagtttgcatcgacttttccaccggcctcaacaattcgctcaagttgaatacacaccctttgccccggcctgatgacatttacacggccatcagcggctccgtctatttctccaatctcgacctccgagacgcgtatttgcagatggaattggatgaggaatccaaacacctttgtgaataa

SEQ ID NO: 56416 - DNA, 305 bp, Heterodera glycines
  Genomic contig location: Contig_ID=SeqID_25663; Location=1..305; Strand=+
  SCN-specific regions: Sequence locations=1-305
taataattcaatgcgcctaggaatgagcgaagtgtgctcaagtcatgtggtggcggcatttggcgaattgcttctgatcgtccggggtaggggcgaattcctttcgcagagatgacgtggccgagaaatagcaattcgggctggaggaatttgcacttttccaattggattttaaggccaaattcctggattcgtttgaagagtttgtaaagggaacaaatgtgctcttcaagcgttttggaggcgattatgccgtcgtcgaggtaggcaaacgcgcctgggatgcctgtgacgatttggtccat

SEQ ID NO: 56417 - DNA, 1315 bp, Heterodera glycines
  misc_feature (1155)..(1155): n is a, c, g, or t
  Genomic contig location: Contig_ID=SeqID_25664; Location=97..1411; Strand=-
  SCN-specific regions: Sequence locations=1-1,42-565,587-1056,1108-1315
atggccgactacaacatccagaaggagtcgacgcttcatctttgtctgaagcttttcgggggcgcaaggacgggcaaaacagcacactactctcggagcgtaagtcatgattatcataaaaggccaccccccccccctccacaccgccgatcaggcggtcacctccttcaccgctgataagcggtccccctccacaccgccgatcaggcggtcacctccttcaccgctgataagcggtccccctccacaccgccgatcaggcggtcacctccttcaccgctgataagcggtccccctccacaccgccgatcaggcggtcacctccttcaccgctgataagcggtccccctccacaccgccgatcaggcggtcacctccttcaccgctgataagcggtccccctccacaccgccgattagacggtcacctccttcaccgctgataagcggtcccccctccacaccgccgatcaggcggtcacctccttcaccactgataagcgttctccgctttacattgccgaaaggcggagttatcacaccgcttatccgcggttttgtattcttattattttatatttagtgctgccatgagcacgaggagcagacagaattcgataaggcagattcggccgaaaaaaatttcgaagtgttgtctgcttctttgtacgacatcaaagaatgtgccgtctgtagggaagagcgcaaatggtatataattaccttcaaccaagttggaagaaatgtgatcacaacgcgtggggcaaacgtctacctccttgatgaagacgtttgggaacatgtaaataatgagcaagaaacaattgatttttaatcttaatttagtcgggctttttgttgggagacctcctggcaacaatttatgctcgggcgctggttcataacatgttggacattgctcgagctcggcaaatgtaattaattactatttttttataagttccgtaagaataaaatttatatttagtacaatcgtgttgaacaatgcgcgccaaggtttcgagattgttgacactgggaacgcggcaacaccaccacaacaacaaagacaaagacaaccaccaccacaacaacaacaacaacaacatcatttattaccctgttttttagacaaattcgttctattgcttcttanattatcgaaataggcaatcttattttctttaaagaaccgccgcatcatcaaaatgctttctcgggcatttccgaaaacccgttgcttcaaatcgcggaagaggagcaatttccggtcgaaaatccctgatgaggagtcttttggatgtaatataaataaa

SEQ ID NO: 56418 - DNA, 656 bp, Heterodera glycines
  Genomic contig location: Contig_ID=SeqID_4973; Location=397..1052; Strand=-
  SCN-specific regions: Sequence locations=1-366,400-656
atgactcaactgtttacttccaaccgtgacaatcatttataagataattttttgtcaatatggatctctaatttatttatgaggacatcagagataaaagttagcagcaacaatgatatccataaatatggccgaatcggaaagtataaggaatattgtcaatagacatcgtagtttgcagttattttaaaattaacgactaatctattccttttgtcttaggctacaaaataaaaaacgaaaaaacatgcaaaattattcgctgctgaacaattctggctgaatctgaaggcttcctgcttataggaacccaaaggcgcgttcaacacgaagcaagaaaattcctttatttattccaaagctgtgttataataaatttaattatattttgtatttttacaggaactcagccattgttattatgactcaactgtttacttccaaccgtgacaatcatttataagataattttttgtcaatatggatctctaatttatttatgaggacatcagagataaaagttagcagcaacaatgatatccataaatatggccgaatcggaaagtataaggaatattgtcaatagacatcgtagtttgcagttattttaaaattaacgactaatctattccttttgtcttaggctacaaaataaa

SEQ ID NO: 56419 - DNA, 354 bp, Heterodera glycines
  Genomic contig location: Contig_ID=SeqID_25666; Location=1..354; Strand=-
  SCN-specific regions: Sequence locations=1-354
ccgaaaacaaaaaaatcgatttttttaagtgtccggttggggtactcaaacaattatggggagcaaaatgccaacgcagaattaaagtacaggctatagggaagctattcccgaaggattcggtctccccataaatctgggcgcatcggttcggggggactgcccgaatacaaaaaaatcgatttttttcagtgtccgtttggggtactcaaacaattatggggagcaaaaatccaacgcagaattaaagtacaggctatagggaagctattcccgaaggattcggtctccccataaatctgggcgcatcggttcggggggactgcctcgaaaacaaaaaaaatcgattttttc

SEQ ID NO: 56420 - DNA, 187 bp, Heterodera glycines
  Genomic contig location: Contig_ID=SeqID_25667; Location=557..743; Strand=-
  SCN-specific regions: Sequence locations=1-39,61-187
aagaaattggcacgtgcggaatgagaggcggaggaaacagcgaaaggagaagcagcagaagagcaaacggaagacggcgacaaaggcattgcccaggggcgggcatccgaaatgggcgacggatggacgccgggggatggcactcgggacaaataaaaatgtgatcggaggaattgagggaaactga

SEQ ID NO: 56421 - DNA, 1402 bp, Heterodera glycines
  Genomic contig location: Contig_ID=SeqID_25669; Location=365..1766; Strand=+
  SCN-specific regions: Sequence locations=1-12,34-243,265-305,327 -1057,1079-1402
  Gene Ontology: Mol. function=threonine dehydratase activity; Cellular component=mitochondrion; Biological process=threonine metabolism
atggccggccatctttgggctatttattccatgcatatttcccattgtcagcatttaatatccgtgacggaatccttcggacgcccacaattgttcgtactttgttcttgtccattctcaaaagtccttaagaagtcagacgctctgtcgtcaatgtttggcgtcgatttgttcttcaaacaggtgggcaaagaaggaaaggcaaatgcgaacattcgtccgaatttgaggagtatttgcaagtgaccggcagcttcaaagagcgaggggcgcgctttgcccttctgcgacttacggaagagcaacggtaaaagtggcagcggaagcaaacaatgccaacggccttttgaatgttggcacaattcgcaaaaaattattccccgcttaaggcgaatcggagtgatcgctgcgtcggctggcaatcacgcactttccctggtagtccgacttggattatgggtttagccactcagtgattttcattcttttacctccgttaggcttaccatggcagcaaattgggcatcccggtgacgtaagcatttgtgttttttgattttgcatttcccttcatttggccttccgttcgttttctcagtgtggtgatgccgaagttcgcccctctaatgaagatttcctgctgtgaatcttacaaggccaaaggtgaatcagcagaaggccactgattcctcctccgattgccccttttagtcattctccatgggcttaacattcaggaggtgtttgtttattcactcaaatgacttcccaatggccaaacaaatattaagtcaaagatattcgcttatgagttggccaaagagaaaaacctcaaatacgtcaacggattcgacaaccccgacgtaattgcaggccaaggaacaattggactggaaatactggaccaagtcggtcgactacgtcctttttgtgtagtttttaattggttggattaaggtgggcgatgtggacgcaattgttgtccccgtggggggcggtggattaatcgccggagtcgcattggccgtcaaaacgttgaaaccggaagtgctaatcattgtaaatgtgtatttattgtgaacaaatgcatttcaatcgtaacttttaggggatgtaagtcgcattagcaaatgttgccaaaagcaaatggaagtttcagtgaatccgaaatgtgtccgtccttcaaaaatgccatggaacactcggatgagccgctttatccggaagcgagcttagccgatggtcggacaaaaacgacattcattttcaaccatttgataaagcaaacattcacaccaattgcttttcaagggctcgcagtcccttcggttgggcacaatgccgtgtttatggccgatgggctaatcgacgaccttgtcactgtgtgcgaagaaagcatagc

SEQ ID NO: 56422 - DNA, 225 bp, Heterodera glycines
  Genomic contig location: Contig_ID=SeqID_25672; Location=391..615; Strand=+
  SCN-specific regions: Sequence locations=1-225
ttttaaaatttcgaaaattttgaaaatttttcgagctaggcctaaaaaacggttttcgggtttttgaattttaggattttttaacgatttttcccagagaaacggagaccacttccaaaacatagtttttcgagctctatcgactggtatttttttcggaaaaatttcgattttttcccggaaatagaaaaaatttttggcatgagcgggacatttgagtcccgg

SEQ ID NO: 56423 - DNA, 327 bp, Heterodera glycines
  Genomic contig location: Contig_ID=SeqID_4976; Location=492..818; Strand=+
  SCN-specific regions: Sequence locations=1-327
atgaatttcaacaatttgactacgccgattgatgaacaaacaatgattgaaagcctgtctttggatgaaccatcaaacgagctacgatctgttgaggttaacctttattaatattatcaaatagaaagaatattttagaaaatggacgaagaactgaacaaaaaggaggagccgttcactctcgccgaatgttgcacagcatttgatctggttgcggttatgttcgactgcaaaattccggtgccgtacgaggaggagcagaagcgttacgtatacgagcaccaggacaagccgcgtttcatctacatcaccgaagatggagactag

SEQ ID NO: 56424 - DNA, 449 bp, Heterodera glycines
  Genomic contig location: Contig_ID=SeqID_4976; Location=1060..1508; Strand=+
  SCN-specific regions: Sequence locations=1-449
atgaccgtcacatccaactccgaattccgactcatcgaatgtgtgccaatccttgaggaagttgctcgtgaatttggctgtattacgccactaccaaaccttgggcatgtttctttcgttttacaacactaactccagcatacagtagccatcgtgactatcgtgtaagcggatgtatgatgattcgcacgctgacatcgttgaatcgactctacattttcgatgctgaagactgtattgaggttaatggaaaatatgtttcatattttattgctattttaggtgaagggtttcttaaggcaagaggacggcacgagccaaaaatggtcaacgaatattatgaaaaatatgatggactaaatggatttgctgaatttattcggaattgggcctttacctttttctgtttacatgcctttgatgatgacgacacatctgatgaagactaa

SEQ ID NO: 56425 - DNA, 314 bp, Heterodera glycines
  Genomic contig location: Contig_ID=SeqID_4976; Location=2085..2398; Strand=+
  SCN-specific regions: Sequence locations=1-314
gacagaagaaaaagtttattggcgacttctcaataacatcggggaagcacatcactatcccgtccctcggaggcgtgtccatcagaatgttttcagaggaataattctgactcatactgtgaggtcactagtgatcgaacggttacgatcaataagaatgagcccgtctgcctctccgtacgcaatcaatgtaactccctcgttgggtactgcttcagtgaatcggatgttcactgcagtacagccctctttgatcagctcaaagcctggcgagtcctcctgcgcgttggtcatttggaagacatagaggcaat

SEQ ID NO: 56426 - DNA, 858 bp, Heterodera glycines
  Genomic contig location: Contig_ID=SeqID_4976; Location=1521..2378; Strand=-
  SCN-specific regions: Sequence locations=1-353,375-646,669-858
atgaccaacgcgcaggaggactcgccaggctttgagctgatcaaagagggctgtactgcagtgaacatccgattcactgaagcagtacccaacgagggagttacattgattgcgtacggagaggcagacgggctcattcttattgatcgtaaccgttcgatcactagtgacctcacagtatgagtcagaattattcctctgaaaacattctgatggacacgcctccgagggacgggatagtgatgtgcttccccgatgttattgagaagtcgccaataaactttttcttctgtcttgtgtatctgttcggtgcggcaggggcggcagccgtaggcacctatttattcctgcgagagagaagaattcgtaatggacaacagattcatcgacagacttctctttgagaatcctgcgacgaaaaggtacttcagcggcacatatcccgcagatgggttgccaaggtgttcaaaatttccgtgcagtctgattgttaacctggtacgcttaatttttgcttcatttgctcatcgtatttccattcaggaccctgcaggtatgccgggaactcattggtgtgcgatatgggcacagtctcctgctgttgcctacttctttgactcatatggagagatgcctatcagattgatcaaaaaatatttatccgataattttaaaaacatttactataataagacgcggtttcaatcggtgttgtccaatgtttgtggtcactatgtaattactttcgtttattttatgtctatcggattgggtttcgaaaatgttatgcaaattttaaatcgttcaaataaccctgatggatttgtttatcggtttgtaaccaagagcatacaataa

SEQ ID NO: 56427 - DNA, 993 bp, Heterodera glycines
  misc_feature (441)..(441): n is a, c, g, or t
  Genomic contig location: Contig_ID=SeqID_25676; Location=125..1117; Strand=+
  SCN-specific regions: Sequence locations=1-192,216-358,380-523,545-993
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaggggattcggtctccncataaatctgggcgcatcggttcggggggaatgccccgaaacaaaaaaatcgattttttcaagtgtccgtttgggcgtactcaaacatttatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgatttttt

SEQ ID NO: 56428 - DNA, 548 bp, Heterodera glycines
  Genomic contig location: Contig_ID=SeqID_25681; Location=28..575; Strand=-
  SCN-specific regions: Sequence locations=1-100,122-207,249-393,422 -491,513-548
atgcaaaacaaccaaaaagcaatgctgcgaagaatcggagaattggagaaggaaattaagggtaattgcaaattgtaatcattaagggaaattgaagagcaaaaaaaatatttaaaaaaatcatgaaatgatttgcctgattctgatttaatgggtttcagaatttatccatttaattgttttgacgcgaaattttcatagattttgaaaaatattaattataaaattaatcaattctaattatttttcagaacaacgaaaggtttgtcaaatggaacataagcaattgatgacggtctcagaaacggtagaaaaaacattgaatttgatgctactgcgaaatttgcagtggtagtcaatcatttcaacaaatttgtgaaattttcgctattgaaaattagaaaaaaatttaaaatattaagttggaaaataaagtggacaaacattcggatttggtcactgtgctggaaatgaaaatcattgccttggagaagcagcaaaaagagctgcaaaagagcaaaaagagaggtgaagaaggaataatttga

SEQ ID NO: 56429 - DNA, 337 bp, Heterodera glycines
  Genomic contig location: Contig_ID=SeqID_25682; Location=368..704; Strand=+
  SCN-specific regions: Sequence locations=1-180,204-304,335-337
atgacggatgaagacgctaaacgtgcggaggaagagaaggaatggccgaagccgacgcggtgtttctgattctcagatggctttaactgactttcccctttagaaagcaaatgattctgcgcagttttctgccccatcccgggagcgggtcgagagcaatgccccagcgaatgtttgactattttaattaacatttgaaattcctttttctttcaggtacgtgtcttatcgcgagggcgaattcgtcttttgcgggtccttcacatcagacattgcatttatttgatgtatgctgtacatttccatattttattaaaaagtatataaaattatacta

SEQ ID NO: 56430 - DNA, 2695 bp, Heterodera glycines
  misc_feature (886)..(886): n is a, c, g, or t
  misc_feature (910)..(910): n is a, c, g, or t
  misc_feature (923)..(923): n is a, c, g, or t
  Genomic contig location: Contig_ID=SeqID_4977; Location=1..2695; Strand=-
  SCN-specific regions: Sequence locations=1-14,37-638,660-698,720 -742,764-971,994-1167,1189-1374,1397-1600,1623-2117,2152-2241,2263 -2343,2365-2695
  Gene Ontology: Cellular component=nucleus; Biological process =establishment and/or maintenance of chromatin architecture
acatctgaacacggaattcacatggaaacggcagaaattcaaagtgatgttgccccttccgagcaaaccgcaggaaaaggaggcggaagcgacatgtaacacagtgcaacaggacagaaaatattacacggaatgtgccattgtgcgaataatgaaatccagtaagaacggaaatgtcgggaagggcaaaaaaacaaaacaaaaaaaacaacaataatcagggaaagtgatgaagcacggtgcactcgtggaagaggtcataaagcagtcgcagctgagatttgttcccgatgttcaggttcttgaaatttgtttccctaaaaattgcattcggaaatggtttagttcatcaaaaagaacatcgaatcgctgattgacaaatactacctacaacgaacagaccaaaacgacgaatacgaatacatttcttaagtgcaatattgaaagtctaacaagatatttccattatgattgtcctcccttttaacttgtccagccggagattagtccatttcctctaagccaaacaattgctaatgctcaaaatattcgatgatgaagagaaagaaaacccactatttgtttttacttttttaatttgattaaattggttaagggtagaaaattcaaatgtgtactctgtggtgctgtattattttaaaatttagtcgaattgttattagctcatttactggtcattttttctctttgccatttttagttaccaattcgtaaggaatggaaaaaagagcagagaatatgaagaagcggagaatacaaataatttggacaacaaatagatacagctacaggttgaagtttggagttaaacactatccgaggggaggtactcaattgtccggtaacataatgtccttctgattgngtaaacattcgctttctatgcctntgccttcgtattncctgcgctcccacctcttgcaaatgttatgttttatgtcgtattggctgtgtgtggtgtcttgtcttgtgtctgtctttcttcacttttccatttgttttctctctccccatcatttctctaacttttaagcgttcgttcgtttcttttctctgcgaatacttttccttttcctttgttttttttcgctttgtcaatgcgaaaccaaccaaattatgtactatttaacaaagttcgattttacatttttcttagggaaatgtcttgtctcaattttctttttcgaattcaggttaacattaatgagcttaatttatcatggattttacgggaggaaatacgccaaatttgtttgaggtgcttctgcgaaatttttgttccgagtcgtcttcaattcaagaaaaggctgtttcctcaattccttcaattgagcaaaggtaattttcatttgcttctaattcaaatttaaaagacgataagagttccgttctctacaaattacagatttgctgaggttgaaacaaatgaatttaaagcagcgttcggtgaattgtcgggtgggacgcttcgtttggttgccgatgagtaaggcaacatttggcaaaagattcttcaaattttgcttttttagtcgtccatcaacatcagcagaggccaatgatcaacagtataagccgattgaaattgtaattggtgatgacgctgtgggtttttatttgctttttctctaaaaatgaattaattatgcttttccgagtcccattggtttgacaaatccatctcccctttcaggagattgttcaacagccctcttcaagttcttctctgatcagttcccatcccgagactgtccaagtattcaaaattcgacgggaatgataggctgaccacctgacttttgcaggatgcgaaggtttacgcgaggatacgcgaacttagggaggcggggctgtggagcgcgacgcgactgccaaagtgcgaagacccgccgagacggaaattgcactgggattatttgttggaagaagtgcgatggatagcgacagattttaccaatgagcgaaaggcgaaaaaggagtgggcccgaaaggtcgtttttataccaaaaaaatcggacgaaaaggaagggaattttcagttagcagtcagagcgaaggccgaatggcaccggttgctcagttcaaccaacgaagttaagaagaaggagcaggaggagaaggaggccaaacgcatttgtggtacggtcgcgaaaaagataagggaattctggacaaatgtggacaaagtcgtcgaatttcgggcaactgtgagcaattctgagtgttcatctcttctttcaacgatggaaatgttcaggaaattgttgagtcgaggaaacgaaaagcattgggccaacaactgaattttctggtgggagcagcggacaaaatcacctcacttttgcacgagcacatggccgactcggcctctgtcagcagacggagtcactcggaaaagagtcgggcgggcgacttgtcagagggcgagggaatgctaacggacggagaggacgacgagaggaccatcgacacggaggaggcgcaccaacaaaaggcacacgtcgaaatggaagtgaacgagctgtccaaggaggccaacctggagctggacgagtttttgacctcggtaagccctaatcattttcaatttatgtataaatttaaataagattccttcgcatttctctaaattcagatgcccagtggttatttggagtctttgggctataaaata

SEQ ID NO: 56431 - DNA, 1797 bp, Heterodera glycines
  Genomic contig location: Contig_ID=SeqID_4978; Location=465..2261; Strand=-
  SCN-specific regions: Sequence locations=1-104,126-388,410-843,865 -883,910-974,996-1097,1120-1294,1316-1366,1394-1714,1736-1797
atgacaaccgtgtcggaaggcgaacagagtggaagcggtgacggaggaggacgcatctttttgatcggactgacggactcgtgcgctgtttggaagtacgtggtggagctgagggacagctgggatgagaaggtgtgtatgatggtcatcaacaaacccgaaggtatgtaattaagcacttgttttcgttcccgcttttctctcaatccatttattgatgtcgttttacaaaaattgttttataggagggcaacttttggacaaatacaccgaatgttttgctttctgcgacaaggaaaaccaaattggtgtgctggactttgtcgaccacccgacaatcaaagacggttatgtgttcacgctgaaagcgggcgaaccgttgccacgtgagaaaaattttgtttgttttaacttgtactgactgagaatccatttttcataacaaattgtttaattgtaaactgccgtctgtgatttgttatttctttcagatgtcgatctgttgccgttagacggtgtcggtttgcccgagtgggcgcagcacaacgattgcattttgctgatgctagtccgtcggatggatcatggggataagcaatggaagcgccaacggatgggcatcgacacgagcactccgccgattaaaaaagttagaaaaaaagcatctaacttataaaatctaattagtacagtatccaactaaattaactaaggggggaggaaggctagctgaaaagaagagagagatatagtagatagtgtgggaaatgaataatacagaggagattcagttgcccttacttgccaagtgattggataactccgctaattttagctttcgtcttttttataattgaaattaaacgatctgagaagttattgtaatactatttaaattatttttaagcgtcgcctgtcgcccgtttcttcttccatttcaaaagtaagaagggatttaattttaacatgacgcttgtacattatttttattagaaaatacttaaatgatttactataatccttttttatccctttcccacggcctctctctttttttctttccgcctcatttttctatttgaaaagtacaaaatgcgccattttctcccatgatttccattcaaaaaatggggagtaagaatgggagaattccatccgaattgcttttcgaactcatttccaatcttccgtttgacattcgatgggccttcacccgggtttccaaggcctatgattgttttgtgtggcagaaacaaaattcatgggttagagctgagctaatccgcaagaacgcaggaaggaaaaaagtaggctaaatactaggaaaatatggccatttttggcataaaagtttttacaagtccaaggcagaaacaaaataaacaaatttttgtcaataaaaaaagataatttagaaaatcgaattggttcattgtatcaactcggttttggtctatgctcaaaacattagcgatgacgttataagggcaaatgaaggagaatgcaaggcccatattgaaagtaaatattttatgtttatcaatttttgcaattatatcttttttagatctgctttgtattcgtcgtcagttggctcgtctgtaccgcttgggcagaacgtcaccgattgacacgtcgcaggtaacaaagaaaaactgataaacttgaaatttggaatttgcttgcctgggttttccctacacatgtaaatgaatttatgttcctgatttcttttaattttctattccatgttatgttcagactgtatctgacgaagaagttaatgccgaagattga

SEQ ID NO: 56432 - DNA, 1502 bp, Heterodera glycines
  Genomic contig location: Contig_ID=SeqID_25685; Location=90..1591; Strand=-
  SCN-specific regions: Sequence locations=1-455,478-546,572-785,807 -818,841-1107,1129-1502
ggcgtcaatccaagtgctgttggggctccgtattctccgaatggtcggccaatcgattcgtcgccgtcgacggagggcggcggacggtcgaagagccgacttcggcaaatgaccatcgcagtgacgcggcgagtgaagagaagcagcaacagtcgcgactgctcccgaagcacaagcccagcgccacagtcgccgatggtaagcgaattggcacgcttctcagttttaccaaggctattttgaacaaaatgctcctttcttttcaaaggtccgtcctccgtcgatcagaagtcagctgagcagtcaaagcggtttctctctctctctatcctccgtttgccttcgctttatttcgcaatgctttaggtccccccggcccccacagtccgcttccttatctgctgaagcctcggagcggatttgaatccgcgacgggcaccgctttgtccgatgctggcgacttggactcactgtacacgccccgctcccggacgcccaccaccagctcatacgggggccgatcagtcggaggacgatctatcaaagtaggagagggaaggagagaggatggtttgatcacggggttagcatttgctctagtcgtggcggtcgcgcggtggcgaaacgcccaactcaggttcaatttcgtccagcggtggtgggcctgtgtccggcgctcttctgacctcttccggcaaagaataccaggaaaagccgatcacttttacggtatcagagaaggcgtgtcgcaattttggagaatccctttcaaggaattcgtggagttgttccgccttttctccacccgaatgcgcaaagacttgaaggatctgttccaggactttgtaatcgcagcccattcgagtgccaactcgcacgtgccaccgaagcgtgccacaagtgccgactgcaagtcgtcgtgcagcccgcgagttcagtcgcgtctcgaatccgtaagtgacgcgaaagggtgccgaactgacaaaagggttgagttttaacaaattgaatgatcagcagatgagcagttacccgtcatgcgctgagttcgtcccggacgacgttttgaccagaaacagcgcccttcacatgtgccaactgaacgacaagcagcagaagatttacaacgcgttggcattggccagcgtttgctcttccgctccgatggacacttcgcgcaattcagtgaaaaatcggccaaatttgtttttgttttttacgttttcttttgttagtttttgacctcagcagcacttaagcagttcatctgcacacagcaggtaaaaggacacttttgcgagaaagagaaagtcaaacttaagatggaatacattgacgagcagtacgcgcagaaactaatccaagagcacgagccggacccaacttaccgggccaaacaaatcatgtccttcgagggatttgtccgctttttatgcgacccgatcaattacgcatttgtgccggaacagacgaaaccgagcgaagaacaacttcaccacccg

SEQ ID NO: 56433 - DNA, 60 bp, Heterodera glycines
  Genomic contig location: Contig_ID=SeqID_25688; Location=62..121; Strand=-
  SCN-specific regions: Sequence locations=1-3,25-60
atggccaatttcaatggaaacgccgacacatttttgtgcagagacatcggagaatttaag

SEQ ID NO: 56434 - DNA, 1376 bp, Heterodera glycines
  Genomic contig location: Contig_ID=SeqID_25688; Location=261..1636; Strand=+
  SCN-specific regions: Sequence locations=1-184,246-438,461-473,497 -1021,1043-1107,1129-1218,1241-1376
aaaatggcatttgtgccgatcaaagacggcgaattcacaagcacaatttacgccatggtcagtgaatgcctttcaaatccaaatcgaaaaattattccgcgctaagatcaaagaaaacaaattcacagaatgcattcgcattttgcagtacgaattgcagcggaacccggaggtcaatttcaaaaaaaagaaaaattaaaataaaatggaaaataaaaataaacaattgaaaataaaaatgaaaaaaatattttagtcacgcgccgcactttcacttttgggctattgttaccatcatatgcaaggtcaaaatgatagggaatgatgtagcgttttttacatagtttaattttttggtcaatgaaaatgctgcgcaacagtataactttttctttttgaatttcgtttacagtattctttttgaaatggcgaatacagtacccttttaaatttttgtttacagtattcctttttcttttaaaagattccattttcactaccgttttcccttttcttacggtatccgctgtctttctgtcccttttttgccccccccccctctgaaacacttttcagattttattatggccgccgagtgttacgagaagctcagcgagttgttcccgcagcacaccgactaccgtctttgccatgcccagtccctttacaatgtttcgttcccttggccatttttcattattcgcttcgcttatttccgctgttttttcccctaatttaggcttatatgtttcccgaggccgtttcttcgcttgcattggtaaacgttgagaaattccattctaaaagcaaatgtttcatttgtaacttttcactttggcacatttatttttcattcgcttcccacagataaatgagcctaaaatggaatgcaaagtggtcaagttggacgcggccatcaaatatcgggaggaggacgtgcaaaatgcgcgcattttggtggaacagttcgacagcgacgacccggacatggaagtgcgtccctccatactgttcacattcccttttcacattttgacattttcatgctgatcactcggttataaacccatcacattttggtcatttccccgtctgatcaattctttttctgattattttttgccaattttctcctcgcttctttggcttaaggtgaatttggcatgtctcgactacaaagagggcaattttgaaggtgcgttgcgccgtttcaccgccgcaatggcacaacaaaaagtggacgaatcgccggcctcgcagaaccaactgacttatgccatcgcactttgccactaccaaatgcacaacttcccacaagcattacaaatggtggggagaaagaaaacggaaagaatcggaaatgcattttaataata

SEQ ID NO: 56435 - DNA, 450 bp, Heterodera glycines
  Genomic contig location: Contig_ID=SeqID_25694; Location=575..1024; Strand=-
  SCN-specific regions: Sequence locations=1-7,30-47,69-135,166-450
atggcttcttcttcaaccatcaaaatgtaatttgtcactcattttccaattttaaatttaatttttaagcttttccctttttctgcttgtcctttgcattggcttggccattgaacagtcccaagcttatgtgagaaattttaaaataatttaaattttaaatttgtatttcgttaagtggggtggctacgcatatgcctatccctacggcggatggtacggcaaacggcaagccgggttcggcccatccgcaagtgttggcacttttggcaatgggcacggcggaaatgccaacggaggaggaggaggaggggcaccaccgccgaccaatttttgagtgaagtgattggacagagatggaacacagaaaaagagaattatgcttaaaccttttttgtgttgtaatggaagaactatcctgatcattatgataaacatttggccaataaa

SEQ ID NO: 56436 - DNA, 1838 bp, Heterodera glycines
  Genomic contig location: Contig_ID=SeqID_571; Location=113..1950; Strand=+
  SCN-specific regions: Sequence locations=1-624,646-1024,1051 -1472,1516-1776,1798-1838
gagcctgttccggctgaggatgcttacggtggagaagatgaacaaggccttgacgtggaagagatttgggagtgtcagatccgagaacagctcaaaagagatgatgaaatgcgagcttttttcgacgacttggggaccgaccgggggcccatcgacccacgtcaaacattctacggaggcagaactgggccgcttcagctgattgcagagccaaaggaggatgagaagatttctgtcttcgatatcgtcagcctctacccgtgggtcaactatgccaccgactacccgatcggaatacccgctgtcatccaccccaccgttgaggagatgatcgtcgactggactcgacctgagcatttacaataccaaggaatttatcgtgtgcgggttattcctccaaaagggctccgaattccggttcttccactaaaaatcgacgaacgcctactgttctgctgctgccatcgttgtgctgccaaatttcggaagttgaacacacgacgagtgcacaagtgcccacacacggatgagcagcgggcttttacaggaaacttcacacatattgagctggcaagagccttggaaactggctaccgagtggacagattctggagagcttggcactacgatgaatggtatgagtttgttaagaaatcttaatatttttgaaatttaggagtgatggaatattcaaggactatgtacgtttgttgatcaaattaaaggtctgaataaccttttttttttaaagtcaaataatgtccaaattgcaggtggaggccagcggttttcctgatggtgccaacactgtggaacaacggcaacagttcgcggacgagtacagaagaatctacagtgtaaacttggacctggaaaatgtgcggagaaatcctggattgcgcttcatctctaagctgatgctcaacagcctttggttggtaccaagaattttagcaaaataaataacaaatttaggggaaaattcggcatgcgaaatgaattaggcgccaacaaagtcctaacaaggccacaggaatttttcagcctcatcatggatcataaaattgtaagttaaatgtataaatgaatttcaattttgtacattgtttaggaagtgtcggctgtcatccctttgtcagacaccgccgtccgtgtcatgtacaagagcaaaaagaatttcgtcagcgaacacacgtccagcaacattgtgataagtctgtggacgaccaaccgtgctcgcctcaagctactcgattttatgacacaaatcgatcgaacagagggagccaaactgttatatacggtaaaaggtgttttaatattgccaagtacatttgccccaacttttaggacaccgacagcgttgctgtgctccataaacgtgacatcgtgcccatccagacaggagaatacttggggcaaatgagcgaggagtatcttgactacgagatcaaaacttttgtctgcggaggtaaaaaaatatttaatctttttaacttttttattctaaaatttcaggcgcaaaacaatacggctttcgaatgttgaacaaaaggacaggagaagttgaatacgtacaaaaaattcgtggcattacattcgacgtgaacaacagtaaggcgctgcagtttgatcacttcctgcaaaaggtgaaaaattacggacggaacactggtgacgacaacgatgatgctcctgccgtgttttcctacgacaaaataatgccaacacgagacagccgaatcatcacacgtgagctacgtaaaaaatacatgccaatatgtcaaaaaggaatcatcaacgagcaatacgaagtctacccatttggatatgaataa

SEQ ID NO: 56437 - DNA, 1992 bp, Heterodera glycines
  Genomic contig location: Contig_ID=SeqID_571; Location=2078..4069; Strand=-
  SCN-specific regions: Sequence locations=1-850,873-968,990-1434,1456 -1992
atgacggttcattttatgaatgttttttacgtgggtctagtcctcagctatgtgccgttactgttgcactctgagctgataaatgtggatttgacggttgacaaccaaaactatttagacagaggcaaatatcttaccttttcaaaggatgcgacagcacaacactttggttatagttggaatacagcgtgccgaatagagaagtgtgagcgtaacagcgaatgggcagtttcacttcaaaatgtgtatactttgcacaactatcagagtgtgttttttgaaatgaaatcattggtgaaaatgtcaccattggcctgttttgaatacaatgggcatagttttaccttttttgaagacagagaatcgggtgagactgctatcttccgtggtcgtcagcagaaaatagtggaaaggcttatccaacatggacgggttgtgtttgaccacctctcgggtcgattatttctgatcgataagcatcagaggcgaattagtgaaatagagcttgaatacctggagctttggtggcttcgaacaaaccagtcttccgcccatacgattttgaagagcaactttgttgcttttcttccgcctgataaaagcgactatactctggtggacaaccatgtgtttgtgatcagagaccaacgcatctataaatttcacattgacgactatgtaaaagggaatcgtgcgctcatttttgtagccaattccagtgacgtccgctttaattatctaatttataaacctaaagaccaaaacatcaaccgcggcgtttttgctcatctacgcatgtctgacgcatggatgtcgatctcatatctgttcaatctgttcctaatcgtactgtgcacatacatacttaaacagctacggcgaaagaaccgaaagaatccacttaatgggtctggtagcaccggttattacagcaacccgttcattgacgacgcctattcgtcccaacatcaacaattgctgaatatacagtatgaaactgcgacagcgagtgatcaaaggggtggagccagtagccggagtatttaaagaatgctttttgttgtttgcattcagttggtccgcttttttcctaaattttaataaaggctattttcatttgccaaaactgacacaccatatttacctacttattgtatgcaaagggcaatccgttatttgatcgacagttacgggctaagcagtgtagacgatctgtacacctgtttgaaagacgaaattaaaagtgggcctgaaggtgggaattgtctctatcccaacccactttgtgctgtcgactgtgtacacatcgcaaacgctgaccatccgaaccaacctgtgcatatcgacgggtcgctcgaattgattgctgacgttgaactgtactcaacatgctatccgaagaagaagttcgaggggatagtgtggtaagttttctaaatattaatattttcatttacattttttaaggagcgaacctctgtatgtggagctgaaggacttgaagatttgcccgggagactcgccgctgtgtctgtcacgccattgcgaactatcgaacagcagcaacatgaacctgatagtggacgagctggatctgatcaactattggagcgacggcgaacgcgaaaacgagactacaacctggtgagagtgctgtgccgattcaacaactgtggcccataccgactgacgaagcaactacagaaacgacggactgagaaccttgcctatctgagccaattggacattgagactgtccatcttagaaaaaatattaagattattcccgatgctttgtgccccatcggtgcaaatcaggtgtttgcataccggggattcctaggaatcacggttcagcagcacctttacactcgtcatcgtgtcatgttaaagtacccaacccttccgtgtgttgttcaatttggtggtggtcaccaccgcgatattttccccattgaattgttacgtgtctccaaaactgaaaccttttaa

SEQ ID NO: 56438 - DNA, 2706 bp, Heterodera glycines
  Genomic contig location: Contig_ID=SeqID_571; Location=6077..8782; Strand=-
  SCN-specific regions: Sequence locations=1-41,63-209,232-826,849 -1075,1097-1376,1398-1535,1557-1620,1642-2706
atggaagctttttacattgtacttccctcaaacacacctggtccaggaaatactgcttctaattttacggttagacttccgcacactttagagcttgactccaaatggtccgtcgcattatcagcaataatctatccatattcattcccatcgatcagtgtggacgaggatgactctatctctgtcaaactggttaatcctaactacagggaagatgccggaaattctgacgaggaatcgcaaaaatttatcaatttgtcagtgaagattccaaatgtacaattccaaagtgtacaaagtttacaaaaaacactgaatcagataatccagaatgcttacgatacaaagtttggcggctcatcatcattaaatgatggtacacccaacaaaagagtcaaacgacaaaccgaattgtcagaatcaggcgctggagttatcgaagtagagaatttcttcactcgaaatccctttgactactggcaacagattggagaactgagaaaaaagcactatcagctcagagaaagggttgaaaaaatgacaaaggagtacaattcaacagcggatgacgaacgaaaaacacttctttcgacggagctcggggtcttccaggggcgagaaacttttctgaaagaacatttgcatttgattgaagaagaggcgaagagaagggacggtgagcagcaagaagccaatgaacaaagactcattgaccgtttctttgcccgataccccgacaattatagagagcagctggacgaatggaggtcaagttacctccgagatgtgctagatctacagacaaagatgggagagtatgaaggagttaaagatttgaaaaggcttgaagagctcaattcacaaactgaacgaatgagaaattccatacacgtttttggaagaaagatggaaatattaaacaacgcagcattgcaacgtgatcagaaaaaatctcaagaggattttgaacggttaagccatgaacaaaacctaaccttcgtccaagaattctttcaagccaatcccgttaattactggcaagcaatccagaaaaattatgaagcgcttcaacttgagtacactaagaagagggaattgagggaaaagcttgaatttgaaactgacgcaacggaaagggattcgctgcagcgacaaatagagagcattcaacggctgattgactacaggcgtaaacggtttgcagctttggaatacgaggctaaaaaaagagatgcgcagacagggaaagctaactcaggcctcagtgctgtagctgaggggtcaaataggactagctccactcgaacagactccttttcaccagatgagcccgcaaacccagacgaagctatcaatagtaaaaataaccaccaaaacaccaccactactgccaccgctattttatcatccgagacgccagctgaacaaaatttagcagatcaagataatagtattgctgataaaaatgaacccggtacgccgccatcaagtggattagaacagtccggtgatgctgctacatcagtgactcaagctgaagatggtggaaatttacctcaagcagccgcgttgtcttccaataacccaaaatttgttgctaagcaatcaaccgtagcgacagagagaaggaaggagaaaataattgaaaagctgattgacgaacaagtggaccgaatggtcgatggaacacatgcacagcagaagatgttacaagaagaaggtaaagacaacgatagtgaacaccgcatttcaacatataaactcatcgaagaagtgctccacggagagcatgggcagttaatggtacaacaacgtgaatccaaaatggcagctgaatttgcttacaatgaaataactcagcgattcggcattagaatgggccctggagtaatgcacgttgatttgagcaaacagctgtcctatgtgttggggtttgatcacaaaacacgcatttacaacaatcagtcggcaaaatatccacctgatctgtctggtggtgtccgtcagctgtacgtttacgcgcctaaactggtggaggattccatcataggtgaccgcatggcaccgttgctgcgagttgtcaacgtgtcagggacaccggggttggacatgccagaggttatatataccaatgaaatttttcattctctccaaaataaacgcatttctgaaattaacattgaaattcagacagcatttggacgttacgtaaaatttggttggggaactaccgtaatcacattacattttagacaaaaactattctagaaaaaaacagttatgacgcacgttgtttttaatccggacaacgtcaattggtccgcgtttcttgagttacaacagcagcaggagggaagtggtgagctgcagtattttgtaggcagtaaatttcagcgtggtggcggcctgttacaaaatatttcgcggttcctgatgcctgtagccacaaacctgctaaagtctgcctcaaaggagggcatttcggcaggaacacgaatgcttgacgatctcgcacagggaaaggcgtttaaagagtctctaaaaactcaggctaagcaaggttttgagaatctggccgaaaaactcaatcagtgtggaaaaggtgggcggcaacggcacaaagcaatcactcatagaaaaaataacaaaactggcaaattgagagggaaacgacagatcatcgatcagctcacatttgcacattaa

SEQ ID NO: 56439 - DNA, 800 bp, Heterodera glycines
  Genomic contig location: Contig_ID=SeqID_4979; Location=871..1670; Strand=-
  SCN-specific regions: Sequence locations=1-118,141-375,397-453,475-800
gaaaagtcttcaaaaaagagcaaaaagagttcctcgagtgatttgtgccattcgcccaaaaaggcaaagaaagagccgcaaacgccgccgtcggaacggacaaacgccagcggtaaatgaaaggaatgaatgaaagcacagaaaaaggccgaaaaaggcatttcatttgcattggacagagacaaattgcaattttttgctttgttaatttatttttcctttaaagtgtataaatttttgtttgtttttttcttttttttggggcctttttcgtgtccaaattcacccattttggcagaggatgagacgacggcaactccgatggaagtgacgacgacagcaccaataaagacggagaaggcggcggtggcgatggaggagcagggcgaggaggagactctgcgcgagcgactgttggagcgagtgaagctgaagcagctgaagagcgaggaggactgattgattgaatgaatgttgtggactgatcggaaagaaaatgggaagcggggggagggcaatggaacaaatgccatggcatgacatgaacgaacggataaacacttgaaacaccaagaagggcatggccaagctgggggccacgccccctaaaacctaaaaacaaaaacttagttgaaggaaattggtccttttttgggtaaatttgttaattgctttcgcgaatatcccccaaaaacaaagggtcttcggcttctcaaccttgtccagtgtcctgctgatgttttttcttacaaccactgaatttgtacttgttgcgttccccggatgggaaaggcaataaa

SEQ ID NO: 56440 - DNA, 180 bp, Heterodera glycines
  Genomic contig location: Contig_ID=SeqID_4980; Location=507..686; Strand=-
  SCN-specific regions: Sequence locations=1-19,41-180
gtcctccagtcacagtcgtcgttcccgctctcgttctcgccgacgtcgttcccgttctcgctccacccggtcgccgtcccgttcgcgtcgccgccgttcacggtcgcgcgatcgcaaacgctcgcggtcgcgtcgccgttctcgctcgcgcgacaaagaccgcaaaaaggccagcaaacg

SEQ ID NO: 56441 - DNA, 1430 bp, Heterodera glycines
  Genomic contig location: Contig_ID=SeqID_4981; Location=2569..3998; Strand=+
  SCN-specific regions: Sequence locations=1-151,174-339,361-420,442 -547,569-751,773-1010,1036-1048,1141-1278,1300-1329,1392-1404,1429 -1430
atgtcctgcagttggttggtgatgtgcggcggcagttggcgttggccgggcaaagcggtgatgccgctttgcaacgctgtctcctcgtcgggaatgacatctttggggaaatggcaaattgttaggcaaaaaggacaagcagtagtgatggcaaaaaggtaagaaagctcaaagcagaccccggaatacaggccaggaaatttttcattctcgggtctgataccattatgttttttgtcaggaaaccggcaatatcggaccggcacagttaatatgtctcgaagcaactgaactatttatcggggtttttcaggaaatcgttttaacacggtctaattgtaaggcccctttgccacttaattgtgcgccctttccatcatcccctatcacttgtctgtgacggaatgcagaccaacgctcggtccaggaacaccgtgttggtcaaatgttggccaacctccacgccgcgctcgtcctcaaatttgatgtaggcaaaccgaagctgctgactgttctgcaccatggacaaatcggacggataaatctgaagggttaattcacgaaatttaaatcccattttatttaaaatgttttgtgtaaggaccaccaatttgtgttcagaaattggccgacaaaccttaaactcctcaatacggccgacgtaagaaaagagcatttgaatctgttctttggtggcaaagggcgaaatgttgctgatatgcaacacttgggtagaggtcatgtcgagcaaaattcacaacaatttgctgaaaattacctgtgataaatgaatacatatgtgcttatgttagccttaggcaaaggcaattcgattgcaatttctcattttctttcatttccttgtcaatggatggaatcaaattttaaatgagaatttgtcaagagaaggattagtcattaatacatacataatgtctcatttttaagacgtaaatttttccaggaaactgaaaagcacgagttcaattacatacatactttcggttttgtttttaattatttttttattttttagtacctaaagcatagagacagagaaagaagacaaagttagtagagaagcagagaaaaagaattaggaaaagagtgaaaggaaaaggaaaaaaataacaagagaaatagtgtgtaaccttttgctgttattctttttttatatcgctttattttagagtgccacgggaccgggaatttttgccaaaaccgggaccgggacttgccgggacctgagaagccgggaccgggacctcgattttttttcgggaccgggaccgggaccgcaagaaaaaccgggaaccgggaccaaccgggaaattttaaaaattcaaaaaaattttaaaaatttaaaaaaaaattcaaattttaatttatatcaagtgaaaataatacaaaattatttggttttttattta

SEQ ID NO: 56442 - DNA, 672 bp, Heterodera glycines
  Genomic contig location: Contig_ID=SeqID_4982; Location=272..943; Strand=-
  SCN-specific regions: Sequence locations=1-250,274-672
tccaaatccaaatatttcgagttggtctccggcttctacaaaagttatgcagcgatgcaaaattttcagagaactgctgccaaagtaaagctgaaatttgattgaagcattgacagcctctttctttctttttttttgaagtgccgagttgtggacgtagacgaaggccgagtgaaagtcgaaatggaagtgcaggaagagcacacgaacacttttggcactttgcacggcggactgaccgcgacattggtcaggaaaaatgaaaacaaaaattgtggtatatcaaacaggtggacattgtgacaacgactgctttgtgcgcgacacggcgcgggtcggccggtgtcagcgtggatttgactgtaaattatttggcaccagcaaaaattggttaggtaattgtataaaaaaaagttggaaaagaaattaaatgccatccaattttctaattttttctttttgaaaaattttattttacgtaaaaaagaaaaaaaaaacacaagatttattgctgggttctttttaggtgacaccattctgattgatgcatttgtgaaccggagaggccaaacaatgggtttcacaggggccgacatcttccggaagagtgacggcctaaaaatagccaccgcattgcacacgaaggcattcccaagagaagtctccgaagcc

SEQ ID NO: 56443 - DNA, 84 bp, Heterodera glycines
  misc_feature (4)..(4): n is a, c, g, or t
  Genomic contig location: Contig_ID=SeqID_4982; Location=1563..1646; Strand=-
  SCN-specific regions: Sequence locations=1-84
accntgaatttgcgatgtcaaaccgcttcacttcctcaccgggtaaccttcgcactgaaatggcagcggaaaatgcgacaaaaa

SEQ ID NO: 56444 - DNA, 130 bp, Heterodera glycines
  Genomic contig location: Contig_ID=SeqID_25695; Location=1298..1427; Strand=-
  SCN-specific regions: Sequence locations=1-130
tttcgtcaatttgctggtcgaccgttccgtcaatttcgacgccgacgcgatgcagctcaaatacgcgctcatttgtcgcttggttgaggacgcgccgtccgcgctgaacgacggacagatggaaatgctg

SEQ ID NO: 56445 - DNA, 1301 bp, Heterodera glycines
  Genomic contig location: Contig_ID=SeqID_25695; Location=1..1301; Strand=+
  SCN-specific regions: Sequence locations=1-559,596-679,714-1301
  Gene Ontology: Mol. function=peptidyl-prolyl cis-trans isomerase activity; Cellular component=mitochondrion; Biological process =protein folding
agatttttgccgaaaattgtatccatttttcgcaaaaccagactattttagccatctgggggtccatttttcaaaagtatggtaaaatggcttctggtggtgccgtaaggcgccgctggaaaaattattggaaattttacactaatacaaattgttaaatcttcgcattgttttcagttgaaacacataatgcccggcgttgtttcgatggcaaattgcggtccaaacacaaacaattcgcaattctttatttgcactgaaaaggctgaatggctcgacggaaagcatggcaagtgaaacaaatgagtagggatgagaattaaagatacgaaaaatcccaaaaaaaatcggcaaaaatgcgttgctgaaatttcagttgtttttggtcatgtggttgagggaatgaacattgtacgacaagtcgaacagcaggggacaccgtcagggaaaccgaccatgcaggtgagtggcggacttggggattgccaatttaggcaatgtttttcaggtttacatctccgaatgtggccaaataacgagctgaagaatctcatccaacatttattttttctttatttatttttgaataaaatttgttgctgctctattgagcttgtcaagttcatttatgtcctctgtcgatggattgtgggcaattgtgtagattgtggtcccgaagaaaaattaacttataatttttttttttaatttttcctgtggtgaaaaaatgcgctgattacgaaattgattttgtctataacgttccatcaagtatttaagaatattagttgtataaaaaattataagcaaagtgttgtagaactgaaaaagggctctcgaataagctactgaatgcccggagaatctctacacaattgtcagattgtgtgattcgccctgaatttccactcgtacagcaaaaattgggaaaggatggattcttttctggtgccattggttcgattgaattgcttaactccattccataagcgaccagcataaatggagtttcggccaaaaaaatggtaaaattaatcgatgggatggggttgcgcccatacgataaccaaaagggtgcaccccaaaattttgccgcaaaatttaaaaaaaaatttggaaaatttaaagagaaaaaatcgaaatataactatggtttccaattaacacatcattttatttgtgaaatcatctccgcctctttgtccatcgattcgttccttttcatttatgccgcctcttccgtcgcgacttccaccaccggcgccccccaaaaaggccctttcgtgcaatagtcgcgcagc

SEQ ID NO: 56446 - DNA, 856 bp, Heterodera glycines
  Genomic contig location: Contig_ID=SeqID_25697; Location=425..1280; Strand=-
  SCN-specific regions: Sequence locations=1-750,779-856
gacagcgcggagggaggcggtggtcagaagagacgcgaaggtgcgcagaacggagagagagaggaagtgacgcaacgctttttaggactccttcaaaggttctgtgcccggcacccggacagtgcgaaatgccgggggaacagcggagggactgagaaagtccccggaagtgaaaacggaggtaagacggtgccaaaagcgaagcgaaagttcttttgcagaaggaggcggactgatggaacgcttttgtgctcgtcatccggagcattcaaaatgcaatggcggaacggaagaggggtgagacaggcggaaggggccggggacggaacagtggccaatggcacggcactttttcaggactgacactactcaacaaacgccgtggcattcgaccgcatcgcccaacggcgattttagcgcgtggagctcttccgccggggactacaaccgacggcccccgtcatttcataactttcggccctctttcgctatttccccaaatgcaaccgacgaacgccgcccaacgccaacagcaaacgtggacatgcatgccgcacagatggacaaaggcgagtgctgctcacttttacaaagaccgtgctgttcagatgtcaaaccggaggacccatcggtttctttcggttttttgtccgaggaagcgcgggaagcgatgctcgtcagtaattagtgatattgggggggggggattaaaaaaaactaattcggggcgggggagggaaattaattaattggtaattgttttcagaaaaattgcctcagcggtgcagtcgactgcaaagcgcagcccttcggaatgattcaaaagcggacgatggttttacaggtttcaaaataa

SEQ ID NO: 56447 - DNA, 588 bp, Heterodera glycines
  Genomic contig location: Contig_ID=SeqID_25702; Location=239..826; Strand=-
  SCN-specific regions: Sequence locations=1-2,24-81,258-317,351-588
atggcaggccaaaagatgccaaacataatcagcagaaaaaggacgacgaagacaaaggcaccgcaaaaggggagaagtgccgaaggggaaacagaagaggaggaagagacggaagaagaaagggaagaagaaaagggagaaaaagtgtacagcgaagggacggaggaggagagagaaacagataaaagggaaaagggaagagagacgaagagacggcggacggaggaagacacggagagagaagaagcggaggacgatcggtttgaaattgtttatctgccggcactgaaagcaccgaagcgcaaactgcagcagaaggcaaaggcaacaacaacaaaaaaggggcacaacgaagacagagaaagaggggaggacgagagagaggacgatctgcaacagctgcagacgacgagaggaaggcagcggaagcgcggcagacagtcgctgatcaaactgcaaaagggccaagtgatcggaggggcgggcactccttggccaatgtcatggcacgaggcaagggaaactcagtatcaaaagcccacaaaatattctgccactccttggggtttcttccctgtttttggccat

SEQ ID NO: 56448 - DNA, 1281 bp, Heterodera glycines
  Genomic contig location: Contig_ID=SeqID_4985; Location=525..1805; Strand=+
  SCN-specific regions: Sequence locations=1-11,33-518,540-874,896 -908,940-959,981-1281
atgctttgcttggaaacaccgaagcatggaaacagtcatttgttgagaggagggatcaggtggatcagcagtaaccgatcaaacttttatttgttcattatcgaaaaaatcttctttgttagcagagggttttcgtgatgccacgggaaaccaattaacgctcttaattaccccatgccccccccctcttttaattgctaatcactccccctcactctttgatcagtgggtggaattcgatttttggtggctgatcggttcgcttctgctcgtctctgtgccgcccctcttcactctgctctatttgctctaccgttgcgtgtcctgctgctgttgcagttcaaagcgatcggagaaggcacaattcgccgaccgccgctttgacagcgtccgtcgattcgtgctgaacgcactgctcggactgctcgtcgtggccaacatgtgagcaggaacaattaaacacattgattggcgaatcgtttgaaaagcgaatttcgaatgaaaaagcgatatttttggcattgtgcccctttttgccatttcctcaattctattcaaattttagcttttgtgccgccgttttgctgatcaacactcaatacgcccagcacggactcgacgaattgcccacccgtctccattattgtgccagcgacgtgttcatctaccgggcagagactgttgaggcaattaaaaattctagcaaaaaaaggaattaaaaatgcctaaattaaagcgaatccgaaaattgctccgcgacgatttttttgtgcttaacggttcactgaacttggcattggacggggccggcgaggcggtggtggaacgactgaagaaggcgactggtgccggactgatcagcgaagtgattgacaaagcgaacagtacggacggagggggacggaagcaattaattaataattaattaattacttaattgaaaccaatggaatcgtcggtcaaaatcaaaacatttttgtcgggcaactaattacataattaattgacctatcgcagcggttttaatacacttaatttacggtaaatccatttcaaattcgcagatgttggcccaatgcgaaaacactttgatgagttaagccgagagcttccgcatattttggatgcaaggcattcgctgcaaatgcgactgctgcggttgcgacaggcgcgcgacaaactgcgcgagtgcgaacggaccgccaaagtgcgttaaataacacaacgccaaaaaaccatactattttttgatttttggcggataaatttctcatacattaa

SEQ ID NO: 56449 - DNA, 469 bp, Heterodera glycines
  Genomic contig location: Contig_ID=SeqID_4985; Location=3297..3765; Strand=+
  SCN-specific regions: Sequence locations=1-294,331-469
gtcggtgtccaatttgtgcccgacgtgacgcattacgagataatgaagttgcgtctgctgaacggtggccatgccgcaattgcttacccggccgcactgctcgacatcaaattggcgcacaacgcaatgcaaaacaaactgatcagcgcattcttgcacaaattgcaggtggccaattcaattaattcactaattaccggctaattgaataatgacacaattaggcatgttactaaaaaattttccgtttcggttgccgattaccccccccccctcccaaatcatttgacgaagaaatattaattattttattatgtgttaattattaaacgtgtgattttctgttttaaagaccgatgaaattctgcccaccgtaccgccggtgcctggcattgatttgctcgactactgtaagcacgttcagcaaacggtttggcaacccgaaaattgaggacacaatccgacgtct

SEQ ID NO: 56450 - DNA, 679 bp, Heterodera glycines
  Genomic contig location: Contig_ID=SeqID_4986; Location=1927..2605; Strand=-
  SCN-specific regions: Sequence locations=1-217,239-679
atggtcgcctctacgctcgagcaattcaattcgctggatgatcaggaattggacagacgaattctgaatgccggactgccaattggacttggggaggagcaaccagcgaaaggggagacgagtcaagaagagatggaacaactttaccagcaactgacggacgaggaaaggaaaaaattcactgaattagccgacggaatatttcacgacgaattggcaatttacatattttaaaattgattttccaaaaatgtactattaaaaaattgcgtctgcaatgccataaacatcacactcgattaatgaagaatcattacacagaattgtgtttggatgtcaaccttacgaagcaccaatcaattggatttgaaatgatttaaagccacgttttttcgcgaaaacaaaaaaatgtcttacacaacaacaaaagattctcccttaatacacttgtcaattggccattcattccttcagcttttttggcggcggagaaatgcaaagcgatccagtgacagggcgagtactggaaaaacggaccggctcaccttcacacttaaatttaaaagctgtgaattttcgtattaagaaacggcaactgccagggggacaagttgactatcacacaaaaaaaagttgcttttcgtcattcagagaaggtcgtttgctcccgaaaaataaa

SEQ ID NO: 56451 - DNA, 1766 bp, Heterodera glycines
  Genomic contig location: Contig_ID=SeqID_4986; Location=378..2143; Strand=+
  SCN-specific regions: Sequence locations=1-338,361-1118,1140 -1144,1167-1179,1201-1433,1455-1766
ctccatttggctttcgttggctttcatcagtgtgtttggactgctcgctgcgcttgccatgcttttcggtgccaatgtctcccatttggtgtgccgtcctttggaggagccgctgcaacggccggactttctttcggtgtgcaatttgcgagttttaaattaattgtgttattcccgtataatcccagctgctcgaccggtttgtccatctgtacggtttggaccgtccttcgtccgtctctccccacaaatcctccccgtccgcttctgatcacttctcgcttgatcagcttttctcggctaaccgtcgcccggctgacctgatcagcgagtgtgcccagaagcacactttgtacacaatgctcgggttggacaagaagttcaagctgatcggacgtgaaggtcttcaggacgactaccaatacttggtcaatggggcaaacaaattgaaagcgtcgatcattcctttttcatggcattttttggggaggatgaatcgatggcatttccctaatttttgttttttccatcctctacaattgttgattctctgttcagcaacgttccatcatggacaacctttcctctcatcagctgatcgatgaggcactctctcgcggcattgtgccggacgacccgcggctgagcgctcgccaatggcactttttcagtggaccaatgcgcgacgcattgcaacgccttgggcaagtgcggatgccggaatggaacagcagcgacgtggagcaggtaactaccgatcagcagagatttgtttagtttgtatggtgatcattagcagggaattcttccattttgggaccgatcgattacttaaaggctggacgaaattaaattccgtaattatggagttttttcaattattgaaatcgtatggaaaattttgttctctatttcgccatttatctttctctctttgccctttcgttgttttaatcaattctctccactttgagccatttcattggccatttctgcttttaactcatcattcccatgcctctaaaaaacaatggcccagctaaaaaattggtcccaaagcgattagcactcgaacttttgtatgaaatcactcttttcatcagtccccgcaatgacttgtccagcttctgttcctcctctgctgtatttagagaatttatgtgtccacgtgtgattaagtggaatttattttggcactcagtatgtttagcgggaaatttgacaaaaaaaacataattaatttaaactatatcgttttctattccttttaggcgattgaaaaactcaagacgagctacaaagaggcgaaagaaagtccctcgtgggataacaccatcagcactgcttctctgttggcgaagctcggtgacgactcggtcttccgttttctttcagacgccgtgaacttggtaagtgttttttttaattccaatgatattaaaaaatatttggcggtcttttggagaattttatagaaaacttagtccatcatagaatttttcaaatttttttatgaaatttcctcagaatttttttggaaaaattcctttttatttttcgggagcaaacgaccttctctgaatgacgaaaagcaacttttttttgtgtgatagtcaacttgtccccctggcagttgccgtttcttaatacgaaaattcacagcttttaaatttaagtgtgaaggtgagccggtccgtttttccagtactcgccctgtcactggatcgctttgcatttctccgccgccaaaaaagctgaaggaatga

SEQ ID NO: 56452 - DNA, 513 bp, Heterodera glycines
  Genomic contig location: Contig_ID=SeqID_25708; Location=735..1247; Strand=-
  SCN-specific regions: Sequence locations=1-39,61-191,213-243,288-513
atgcgcgagaatgctataagcaaatgcattgcgcgcaagtgagattttgtgcacattcaagcgcttttatatgtgcgtaggagcaccgtaacttcgtctttcacgtagcgcgcagcactgtaccttttcgctatataaaagcccgaaatatgacgcaaaacttcattttaatcacaagattttttttgcaaaataaaaatgaatacttttaataatgttcagcaaaacatgccggaagaatctaacaacaacaacaacaacaccagcaacaataacagcgtcaacaatactaatgctcagttatggaaacttttacgaaaaaagtatattctaactttcaatctttgtcattgctgctcacaaacattgttcaattcgacaaaaaacaacaacagcggcggtaattatgctttcgagttcgatcccttaggaggggtaaaagtgcaatttcacatgtgcagtgggtgtgtttcgcttaatatgaggctgagcgacatgaattgtgcaaataaa

SEQ ID NO: 56453 - DNA, 1572 bp, Heterodera glycines
  Genomic contig location: Contig_ID=SeqID_25712; Location=95..1666; Strand=-
  SCN-specific regions: Sequence locations=1-388,410-1572
atgctttggctgaaaaaccctgcccgtcctgtctcaggctacaatctcttgatctatcgctacaaacggctagtgttcggcgcgacgtgctccccctttatccttgccgctgttctcctccaacacttcgacaagcacgagcacccattcgcccaagcgttggccgcgaatatgtacgtcgacaatctcctcatcgagtgtgagacggaagaggaggccatcgacaagtcgtccatcgccaaacaaatcctcaaagacgccgacatgaacctccgggagttcctcagccactccccaaacgtcatgggacaaatccccgaggacgaccgactcgacaaaacgccggccaaagttctgggactgacctgggacacccccagcgactgcatcaccttcagtctcccaaaagacacagacatcactgctacacggcgttcagtcttgcgcatcatcgccagcacgttcgaccctcttggactagtcgggccatgtcttctgcccgccaaacggctcttccaacgcctgtggggagagggaaccgcttgggagacacccctccccgagaccgaggcggaaacttggaatcaaaccctgtccctatggcaaaaccaaacgattgtggtcccgcggcattccattctcggcaagcaaagccgcctgcaactccacgtgttttgcgacgcgtcggaacacacattcgccgccgccgtctacattcgaagcgagactgccgatggctctgaagcgaacctaatcttcgccaaaaaccgcctccggccacgaaccgcgaaccagcgcttcaccatccctcgactcgaactcctcgccattctcgtcggaattcgcgccatgcgcttcgccgagaaagagctccgacgtccgatcgacgagcggcacttatggtccgactcccaaattgccctctcatgggtgaagtccgacgaacccaaagcccagttcgaacaacgaaggctcgtcgagatccgacaagggccgcccaccatcttccatttcgtcagaacctaccaaaatcccgccgacgtagccacgagaggctgcacacctgcggagctccgaactcgccacatttggtggaaagggcctgagtggctcacgagtccggaaacggaatggcccgacgagttaacgttcgcaacgccagccgactccccttccgccgatctcccgtttgaagaatcggagaccaagaccctcatggccaaacaaagtccgctgccccctcccctcattgatccggctcgtttcagcactatgctgacccttctcggaacgaccattctcgtcctccaattcatcgggcgtcgtcgaccaaaatggctcagaagcggcatttcatcaatcccacggagtggccctccgacgggcgattcgttcagagcagccaggactttcctcatccgacaagaccaacgaagctcgctcgacggctacgacaaacaccccactgttttcaatgaggatggccttttgtgcctcaaacccggctcctgcacgcgaacggtccgcccactctcgcctctcccgtccttctcgaccgccactcatctctga

SEQ ID NO: 56454 - DNA, 514 bp, Heterodera glycines
  Genomic contig location: Contig_ID=SeqID_25712; Location=31..544; Strand=+
  SCN-specific regions: Sequence locations=1-514
gtcagagtccagtcaacccgggcgtgtctgaggtcggcgtggatctcttggacatttagccgagtcagagatgagtggcggtcgagaaggacgggagaggcgagagtgggcggaccgttcgcgtgcaggagccgggtttgaggcacaaaaggccatcctcattgaaaacagtggggtgtttgtcgtagccgtcgagcgagcttcgttggtcttgtcggatgaggaaagtcctggctgctctgaacgaatcgcccgtcggagggccactccgtgggattgatgaaatgccgcttctgagccattttggtcgacgacgcccgatgaattggaggacgagaatggtcgttccgagaagggtcagcatagtgctgaaacgagccggatcaatgaggggagggggcagcggactttgtttggccatgagggtcttggtctccgattcttcaaacgggagatcggcggaaggggagtcggctggcgttgcgaacgttaactcgtcgggccattccgtttc

SEQ ID NO: 56455 - DNA, 175 bp, Heterodera glycines
  Genomic contig location: Contig_ID=SeqID_25714; Location=130..304; Strand=-
  SCN-specific regions: Sequence locations=1-175
atgccaactgtacgcgaaatacttgagagtctgcaaaagccaattaaaagaccccgaattccaacaaatgaagacagcgtactgaatgctgagaggacagacgcagaacaacaaatggaagacacttcaaccaggaatgatttggacgtcgctgcaagcgatgatgaagaaaact

SEQ ID NO: 56456 - DNA, 678 bp, Heterodera glycines
  misc_feature (469)..(469): n is a, c, g, or t
  Genomic contig location: Contig_ID=SeqID_25714; Location=696..1373; Strand=-
  SCN-specific regions: Sequence locations=1-355,377-638,661-678
gtgtcatttacaatgtgatatttgaggatggatccagcggtcgctatcatgcgaatcagctgaggctccgaaagacgactcaaattgtcgaggacccattaagcattttgaatgaggaattcaatttgccaattcaaatggcaccaatggcaaatggacatcaaaatgggcaggtcctagagaataggcctgacccgatcaatgctgaagatcaagtggaggaaccgccgatcagagaagagcagcaggacgtcattcaagctgtccaatcgccgacgccccaagcttgatagccgacgccacaacgccgctaccctgatcgccgacagcaaccacctgtgcgatactcgccccgttgagatcatttaaaaggggaggtgtttgggtggtcaaccccgagagataaaagtacacaaatgcattcattctccctttgcatgtgtctatttcttttcctctccattttccncactctctaattagtgtgtcttcctttttttatgtacgaccctattgatttattatgtccattgcatgtcctttcccctcattcattcagttgctttttatgcacttatttcacttcgcctaaatatttgttctcctccaatttatttattccgcttccgacttcgcatatttatttaaattgcttaatttatttgttctacaaataaa

SEQ ID NO: 56457 - DNA, 611 bp, Heterodera glycines
  Genomic contig location: Contig_ID=SeqID_4988; Location=209..819; Strand=-
  SCN-specific regions: Sequence locations=1-239,261-439,469-611
atgaaaggaatcatttcttttttgcttttatttgtaattgcaccaacaaacggagcaaagcccggcaatgaactcaatgttgttccatcagacatcattaacaacctaaaaaacgtattagaaagcgatgaacttggtaatttgctcatacaaattagttaataaattagctaattcagtgctattcggaggcaatgagtggatggcaaataccaggtaaatggtaatttcgaaatttattattttcatgaatttatgaaaagattcggaaccgctcagttcggccctcacgattcggcccccacggttcggccccagcatgcttttccactatagcttttttatttgttatccaaatccatcaatcttcgtaacattcgaaagctcttaacatgctctattagtcttaccaaaaagcggaaagtttttcaagcctggaaaaaattttattgagaaaaaagttgaaaatttcgactttttcgcaattttcatgtataacttttttgataattatctaatcgcaaagtaatagcttagaaaaagcactaaacacattaagatttcgaatgattccaacaatttggatttggttgacgaagaaaaaatttata

SEQ ID NO: 56458 - DNA, 873 bp, Heterodera glycines
  Genomic contig location: Contig_ID=SeqID_4989; Location=879..1751; Strand=-
  SCN-specific regions: Sequence locations=1-153,195-681,703-823,845-873
atggatgaaaatttcgaaaacattagaacaacgattggagtcgcgaggaaagtgatttcaatggaggctcgattgcttgattataaaaatgtaagatttaaaaaataagactatgttcaaagaaatgtattaatattaaatattttcaacctgataatatttaaataaatttatgaaaaattcaaattttttatgtttgcgtcgggatttgcgcaaaaattgacgggaatttggcggcaacggaaaaaagcgggaaacctgtcgcgcttttttcgttttccgttatggttccaggaaatttttaatgggcttcacaaaaaatataattttgccttgaaaaatatgcaatagatgattatgtatttattgcagaaagttcaagtcccaatgaatcaacttcgtgatctgatggacttgtttaaaatcggctattccaaaaaacaatcagatgtcgatgagatcaaaaatttctcagcatcacagcattcattgtttcacccattgttgaacaaaatccggcttcaaatcactaaataagcgtagaaggaaaattttgacggtttttatcaggtaaaaaactcggattattttgcgtagaatcgagttgagaattgctaatggatggttagcgaactatcagtcagtggacaatctcatatgacaatacctcagtgaacacgcagtcagctaattttggtgctgcgattttggtgcataatgccgggcacgtaattttggaacagcctttaatacctttttcgtgcctttttccccgaaattgttaagaaatatgtaactaactcctaaatattaagtaatgctcatattttagtgcatttgaaaaaaggtcaaattccaagagttttaaataaa

SEQ ID NO: 56459 - DNA, 1402 bp, Heterodera glycines
  Genomic contig location: Contig_ID=SeqID_4989; Location=1927..3328; Strand=-
  SCN-specific regions: Sequence locations=1-233,255-347,385-390,412 -741,763-808,830-1010,1032-1098,1120-1402
atgctgggtttctatgacgacattagtcctcaaaataagccttcccaaaaactttgcttcaaaaagagtgagaaggcgataaataaagtcgagaattgggacggaaaaccatcacaattgaagtattctttgatcactcaggccaagtggaagaaagcagttattttttggtgtcagctgatgagaggcgatggctgagtttccattctccttattcttgcgattaattacaaaaattagccatgtttttccttaattaatgggacggatgaatcatttgttgagcacgggtaaacattcggatttgcactttttggtggtgaacggagacgcaaaaaaggcgagtctaatttaaaatttttatttttcaatttgaattaattagccttcacatcaactcattttgaagaatgctttctatgtttttgaggcaatgttcctgtttgacgccaagaaaaaacaaagcgaaaacggtaaaaaatttgttttaaaagaaaaatttaatcagctttcattctccaattagtctatcctaattaccttagttaattttcaattagcctctgctaattgccttatggtggagatccccgacgttgaaccagcagcgttcaaagttgagattcatttactcggtgatggcatttatttttgcaaactgatcagaaaatgttgtgcaatcttctcgataatgatcgtttgttgttcagtgatgaatttgaaattttgaaagcggtaaattcgatttaaataaaattcgtcttccaaatatccttgagaagcttttttcaatatgcgtcggtaaaaatttttgaaatttgtcaattaaattggacttttccgcctcgataattgaaaaatacactcaggtcaaaagtattgtatcaaaaaaaatttttttttgtaaatgatatcatgagaggtggaacctcagcagagaaatagaaaaaaagaaaacctagaaaaatagcatttaaataaataaattcacttatattaatttgttcgatattaaataaaatgcatgaacagttttaaaaaattatatcaaaaatcaaatttaatgcaaaaaaatcatgtcaatttttagctatgtggaaaataattctacaatatttgttgcactgcttggtgcatttgtgagagcttcttgagtggaaagcgatgatcagaattatgataccgatgaattggatactgatgatttggacgaaatatcttcagcaggtcaaacagagtaggggattcgcggattttaccgatgtccgtcgttttctcatcctcgggagcggggatcccggtccatacctatcccgcagaagatgtagaaaaatttatcccctaaaaagttgcaacaaaagtgagtcaatatccatatatgaaaattcgggtttcaaataaa

SEQ ID NO: 56460 - DNA, 439 bp, Heterodera glycines
  Genomic contig location: Contig_ID=SeqID_25717; Location=201..639; Strand=-
  SCN-specific regions: Sequence locations=1-236,279-439
atgtcctccccgatcaaattttctccgtcaaagagctccgacgccaaaaatgagaccaatgttaaagccgctgtcctcacaccgaattccctaaaactccccaatcgtaagcaccaattgaacagtgcgggaaataatggggagcagccgccgacgaaagtgcgaaaagtcgaggaccgcgaactatggaaactcgccaagggaaagtacatgttgggcttctacctctgctcaggttataaaacttttattttttattttagaaattttaaaaaattcagatgattggaacagactttacaacaacaacgcaaaagtggtgcgcactgaggatggacgcttcgccgtcaactttgaactgtgtgcagagtgcacactgaaaaacgcccgagcgacagacttattggcgccgccaaagcaaaagaaaagcgccgaatga

SEQ ID NO: 56461 - DNA, 849 bp, Heterodera glycines
  Genomic contig location: Contig_ID=SeqID_25717; Location=812..1660; Strand=+
  SCN-specific regions: Sequence locations=1-690,717-849
atggccatcaacatgaacgacaagaagggattgctcaagcagatcctcggcgagtccgacatcaccgtaacaacgtctggcctgacgatcagcgggccgcgtctcaccaacccgcgttttctgccgtttgaggagagcggtcgctgccgttcatgcaaggctaccgaggtggaggttgatacgatggtcaccaaagagggcataaccctttggtgtacgcgaattgacaaagtgcagttcgtgccgtttgatgtggtctacgatttgccgggccactgctttttccgagtgaagaacaaggcgagagtcttcaacattccgtacggcgacctgctctcggacaacacctgtgatcaaattcaactcacgcttcacgctgatgaagaacggcgtctcaagcgaaaggcgaaagctgcgctcgacttggttgagcagggtcttatggaagatgcaatgcatgatggggccagctggaagaaagccaagactgccatcggggtgctgaacaaactcctgctcgtaggaacacatggcgacaacgaaaacaaagaaacggctgctttgacaacgtcggaaaaccagcaacaagaacagcaaccgccgacggcacctccgtcggaagaaatcgtttccatcgtgccatctgatgttggatctcaagtactgtccagcggtgaagtgaagctggaagaggagaagcaggcagatctcggtgacattgataagacacttgacgaattttttgcaagtctcaaggcgtcaaccaccagcatgtaaagatatttaaatcccaaaattttttaaagttccctcacatggtaaaaatgttgaattcacaagcattttcaa

SEQ ID NO: 56462 - DNA, 334 bp, Heterodera glycines
  Genomic contig location: Contig_ID=SeqID_25719; Location=1104..1437; Strand=-
  SCN-specific regions: Sequence locations=1-18,40-247,269-334
atgctcctctccatcttcggcctcgtcttcatcctcatcagtgagactttgctgttctcgagtattgaagcggacaagcatatagccaaattaactgcttattgtaatctcacatctgataatctaacatttgctctgccggaaccaatcaatgccaaagtcagagcacgttttgctatttgcatgatattgaaatacacagttacaggtgaaaaaaggaattaaaaatgaaaatgaaaaaaaacaaataatttttgttaatttgtttcttaaaattgacattcattactaaaattttaaaggtatttactatgtacaaggctgccagatctga

SEQ ID NO: 56463 - DNA, 287 bp, Heterodera glycines
  Genomic contig location: Contig_ID=SeqID_25719; Location=18..304; Strand=+
  SCN-specific regions: Sequence locations=1-62,84-160,193-287
aaatttttaaaaattttccagcaaataatggaaatttttttcgaattcccccccccccaaacgaaaatttaaaaagtttaataggcaaatttcgtaacaagtagcactcaaatttccaaaaattttttccggcggcgcctatcggcaccgccggacctacattttccactatttttacaagttttttgccttaaaacggccaaaatttggtcatttttagtgaaaaagtgcagtagttacccagcagtggaaaaaaagttattggttaaatagcaaaaaaaaaaaag

SEQ ID NO: 56464 - DNA, 570 bp, Heterodera glycines
  Genomic contig location: Contig_ID=SeqID_25721; Location=311..880; Strand=+
  SCN-specific regions: Sequence locations=1-107,130-223,266-350,374-570
atgtttggaatcagaaacagcaaacagcggaaattaatcgatgatcaattggaggatgacgacttcgagatggagcagttcagcccggattggcaactgatcggtaattgtaaattaagattcattttaatcaatgtctaggccctcaaattgcctttttcccaatataataccttaatttatgtaaatctggcatttttatgtaaacttagtaaattttgtctaaaaaacaaaaaaaaaatatttaaaattatttaaattttttgggtatatttgggatttacatatttgccatttttaatatttagcgatttttcttctaaccccaactttgaaaattaatagatatataaaaatggtaaaagtgataaataacaactataattttcaaaactgggtttagatgaaattagcattaaactgttggagaatggcatcggcacttttgagacattgcaacgcgcgttaccatccgttgtattggcacaaattgaacgaattgtaagcgttttcttttaattcataacttaattaataattaattattcgtttgatttgtgagctaacaga

SEQ ID NO: 56465 - DNA, 938 bp, Heterodera glycines
  Genomic contig location: Contig_ID=SeqID_25722; Location=579..1516; Strand=+
  SCN-specific regions: Sequence locations=1-575,611-763,798-938
atggaaaatgtcctgcgctacaataacagtctgtcgtttggccatgtcattacgcagagaagcgaagaggaatacttcagaattgtcaagtgtaacaacttgatccagtatgtcctttgggactacaatcccccggacgggtctctgccgcttcttcatggacaattatttaccatcccgagtgaacaagctgaaacccgcttaggagaaattgctgagcaatttgaattaaatgtaaaagtttaaagcaattttaaatataatcttacaattaaaggctgttttgttgtgcaagctgcatgagatgcttcgcaaattacacccgatggcaacactctacgaaactgcagcagagactttcaatcaacttccgccagatgagcgagtcaacttgcgaatgctcgtagttgggacaaaccgacaaggcaaagagcgaacactcactgaagatgaagcccagcccattgatgttcaacttccgcacgacagtttgctgaagcagatccatccgggtcggctccaagttgaaacagaagcaggcagtcaccttgtggcccaggttgatttaatgtatgtaaattattttaataaataatttatagttatttatggactctggtcagaatgtcatgccgaacatgaactatgaagttgttctacttgggcgtaaaggcacgggagcgcaacatctgaaatggtggcgcagggaaattgatcctgcaacatttccgctgatttttccaaaaggacaatttggatttggtaaaattttattaaaaactttaaaaaatttattacatttaagaggatggactgccgctcaagctcaaggagggagaaaaattcgacacaaagcaaaacgccataacaaacaagaacaacgacaagccattggacgacaacgaagaccttggcgaagcggaagaatttttgggagc

SEQ ID NO: 56466 - DNA, 1082 bp, Heterodera glycines
  Genomic contig location: Contig_ID=SeqID_25723; Location=397..1478; Strand=+
  SCN-specific regions: Sequence locations=1-565,587-1082
  Gene Ontology: Mol. function=tryptophan-tRNA ligase activity; Cellular component=mitochondrion; Biological process=protein biosynthesis
atgggggggggggggggtcaattgctcattcccattggtgcgctgtttcagttgcggttgaactgctttcgcacattggccacactgctcgcttgtggggtaagcattggtcgttgagtcaaccaatccctcagaatgttcaatttgtcggtcgattcggagaagactttgctggtccaacagagtcgtttgcccgaacacaccgaactgatgtggattttgggttcaactacgactgtggttggtctgtcgatgctcaccagtcaaatgatcaaatgttaagacgagtttgacctcgatgtcgcaatttaaagacaaattcagagggtaaatccgttgttttgtggtcaattggtgatgagtcattcatccgccgctttttgaaggtttccccaaggcgctgcccccctcggcttgcttgcctatccgttgttacaagcggccgacgttttgacgtacagagccacccatgtgccggtgggcgaagatcaaacgcagcacatggagcttgttggtgcccacgccaaacggcagattcctttggtccctttaattcagactcgtcatttggctaacaaattcaattcgcgattccattgcaatttctttcccgtgccggaaaaagttctatttgcgaggcgattcgccatatatttcattttcaggtttcaagtgtttgcactcgtcttcgaagtttgaggaatccgacagtcaaaatgagcaaatcggacacagatgcgaagtcgcggattgaattgacggacaatgcggagacgacggccatcaaaataagaaaggcagtcacagactcaacttctaacattacgttcgacccggtgcagaggcccggggtcagcaacctcgtgagtggattggcataatgaataatcattgctgcatgccccctttttgacgtttttttttgcttaatgcaggtcacgttgttcagtttgttctctgacctgactgttgatcaggtggtcacccaaagcattggaattgacactttgggcttcaaagggaaattagccgaactgatcaagtcagttcagtccattgcatttgttgtttcattgctttga

SEQ ID NO: 56467 - DNA, 1303 bp, Heterodera glycines
  Genomic contig location: Contig_ID=SeqID_25725; Location=99..1401; Strand=-
  SCN-specific regions: Sequence locations=1-191,214-628,650-671,693 -903,926-957,979-1303
  Gene Ontology: Mol. function=helicase activity; Cellular component =nucleus; Biological process=chromatin modeling
cgacttggtcgagctgtacgccttgctaaagttagccctcccctgaccaattcaaaccaaacggacagcagagtttcatcatgcgttttgcaaaactgggggatgacgaagaaggtgagaataatctcttctaattttctataatgcactttatggggacattatttagttttgtgttaaaccaaatgattataaaaattaatattttcatttgttagtgtctcaacggtttcgcaaaatctttgacaaatattgtctgcgtcgcaataaaaagattctcaatgacgtgccactctgttcggaagtgattctttaccatggcctaagcaagctccaatacgacatgtacagggccattctgagcagcaatcggtgtacgtctattatcttatcattcattgcattttttagctcgaaaactgtctaacattacatttgaacataggtggacaagggggggggaaatttcgtaaatcgtacgggggtccgaggcaatttcgtaaaatttttggccaaaatcaaaaacactggtaaagacgtgaaaattttacgaaattgggaaaaaaaatcaaaattttgtgcctaaaactcaaatttttacgattttgaattgcatatcgttaatatttttacgaaattgaatttcattatctatttcgtaaatttttacgaaattatacaatttttagtgaattttgttaataaaaatgcatgaaatcggctaaaaatggcaaaattcggtcgtttttccacaaaatctgttaacaattttggcctctgaaagggggggaggggggtgggaggtattttgtaaaggcaagtttctgacccccccccccttgtccatgtatgcatttgaaaatgcttttttcaatattctatacattttcgtcatcaattaaatttttatattttcgagatatttttcaaaacgaatatgcctcaattcgggagattttaaaatgctgcctttttcaacagctttctttgccaaaaacatgcgcacagagaaacaggcgcgacagtctctgatgtcaactttggtgcaactttgtaagtgctgtgaccatccttatttgtttcgaggaatcgaaaaggaaccatttgaggagggagaacatttggtcaacgacaggtagtgaaggagtacaaaactgacgaaaggaatggccaaaattaagcggaaaggcattgattctggacagactgttggcctatttgcacaaaaagggccatcgtgtcctcatttttacgcaaatgcaacgcttcctggacattgtgtacgacatcatgagtcttcgag

SEQ ID NO: 56468 - DNA, 565 bp, Heterodera glycines
  Genomic contig location: Contig_ID=SeqID_4992; Location=142..706; Strand=+
  SCN-specific regions: Sequence locations=1-68,91-225,247-490,512-565
cttgttggccgttttctcgagaatgatcgtgggcctcaagcaatggctgagtttcttgctttgtttgaccggtccattcaggaaacgacgactgaccaattgagcgagtaggccaagggtcgattattgggataaactaatttagaaacttttaggccggcgagggaaaaagtgcgatgtttgttcaatttgcgcgagaacaaatggggcgttgtcgcggaagtctgttttgaaacacttggtttttatttccgattctttttatagccaaatgtcggcgatggtccgctgaccactgcttcgacttcggtgggtatcattggcccggacgatgttccgttaacggaggacgaatgcgcctttatggaagaaaacttggacaattttgtcgacaattctcccggcgaatctcgtaggatttggactgatggttttaaatccaaacgttataactaatatcaaaccacacaaaaaaaacaatgtctccattaattgaatgttttcagaatgcttgaatgcatttgacgaggacaacgttgaggacgacttcgagaagttcctacag

SEQ ID NO: 56469 - DNA, 1030 bp, Heterodera glycines
  Genomic contig location: Contig_ID=SeqID_4993; Location=1891..2920; Strand=+
  SCN-specific regions: Sequence locations=1-175,197-303,334-662,695 -1030
atggatctcggcaaaactgtggatgctttagctgaagatgagtcggtggaactcttaaacgaatcagcagaatttcgggtaagacaacacatttaacagacagtgaaaataactcaaatttaattttgctttcagggcgacatggactccagtttcggttccgaccttcactcggtatctttccaggagatttcctccattttgcgtgccaaaccggacatcaacgtgttctacagaactccatgttcgggtgccagtcgattttcgcgtcgttcttcttcagcccgtacacaaattggtgttatttttcagaatgaatgaatggctttctatccattgaatgtttccagaagaccacttcagtcgtactcttcccgattcgcttttgctgcgcatttttttctatcttaacaagcgcgacttggttagtgttatgctcgtctgccgccgcttcggccaaattgcgtaagacaaattcaatgcgtgtcgggggggggggggattctgttgaattttaggattacagcttattaaagaactatttggtctgtatgatcaagggtcttgccgtacccttggcttcggggtggggcgttaaagaattaagtcccctcacaaatcaggcctcccccctctggctatacccttaatatggaacagtgtcttcatcatttttatttttctttaaaatttagaaatgacaaaactctctgggaatttatgaacttggccggccggcttctcgatgaagagtccatccatgctctgttcgaccgtcagctgaaagtgctgcggttggcatcgaccgaagtcaatgccattaaacaaattagctgaaatgaatgcatctgacaaattcagataaaacccctttctctgttctcgtggtacaactcgcagcagatgaccactgcgcagttaacgcatttggacctgagccaggccaaatttggctcaagcgacacactgctgcgtctgctcattcggtgcgagtcgcttcaggtcagtgagtcatcggcgagtggacgca

SEQ ID NO: 56470 - DNA, 134 bp, Heterodera glycines
  Genomic contig location: Contig_ID=SeqID_4994; Location=79..212; Strand=+
  SCN-specific regions: Sequence locations=1-134
actcgtggaactgaatttgtcctgggctgaggtggatgtcgatgccatgctcgccgtctgccgacttatgccctccggcgttcgtcggctaaatctatccggcttccgacagctttcgtcactaaatgaccgca

SEQ ID NO: 56471 - DNA, 860 bp, Heterodera glycines
  Genomic contig location: Contig_ID=SeqID_25727; Location=487..1346; Strand=+
  SCN-specific regions: Sequence locations=1-218,256-647,690-708,730 -805,827-860
  Gene Ontology: Mol. function=UDP-galactose transporter activity; Cellular component=Golgi membrane; Biological process=UDP-galactose transport
atgagcggcctttgcattgcggtaaatttaattaattaactcattcatataagcaatagtcccatttggatgagtgttttttttttgttattttaaaggcttttgttgtgcttttaaaaaaacaaataaacgcaaaaaaatctattaaaattttacataattttatgcaaaaattagccattttcatttctatattttctttgctttaggtggtgatcaaatatgcagacaacattttaaagacgtttgccaattccttctccatcattgtgataagcatcgcctcaatttgggtgtttgccagcatgccgaagccgttgttcattgttggcgctgcgttgatcatcaccgccgcgctgatctatgccaaattcccgtatcgggccaagcccaaggctgatcagcgatcgaacagcaactcagcaacggacagcggcagtgctgactcggacagcagcaacatgagcaattgtggcacggcaccacccaccggccgaggaggcgacagaatgccaaaggaggaggacaaagtgtcacggctgaccaaactgttcaggatgggcagatcgccaaccatggccaaactgacgccgggccaattggacgccaatggagacggaaatggcgtgcagaaattttagagagagaaatattttatcaataattattattaattaatttttatttttgtgcattttatatcaaattttgctcctctcttctctgtgtacagctttttaataagtgtgaagagcatttgacaaaaagttatcatcaatcaatgggtcattttttgttaagtgataacttcgattttgaccatttgtgcgatcgatgtgccatcattttgatggtgacaa

SEQ ID NO: 56472 - DNA, 691 bp, Heterodera glycines
  Genomic contig location: Contig_ID=SeqID_25728; Location=304..994; Strand=+
  SCN-specific regions: Sequence locations=1-410,433-564,600-651,673-691
atgacaaatggaccgaagcaaaagccgaggacaaacagcgcaaaagggccagttgtgtgcccaacgtggtcatcgaagcaatgggaggtgattgattttgaaaaaaatatttttgtaaaacatttcgtttgttaaggcggccaaaatgcaaaaaagtggtcaatgctaagcagggcagtgccagcaaaggaaaagtaaattttttgaaaattttgaaaaaattctttttatttttcataggaaaacgaatgcccagccaaagacgaggaaagtggacaaaaggcggacaaagcggaagaaatggtcgggaaggggggggggtaaaaaaatttttgaacaatttttctgggttgtaggcggacgatgaaacactgggcgacggcaaagacattgctgatcttgaaaatgaggagaaggaggacggagaagaggcggtagggaagggtcaaaaaaacattttcttatgaaaaaattttatgattttgtaggcggacgaacagccggtgccagagccaatgaagaaaaagaaaaaaacaaaaacggcgcaatcaaacgctcccgtcggaacttcaagaagcagcaaaaatgatgggaaaaatgatttaacaaattttcaatgatctttaacaattttgaaaaaactttttttttgctaattttcactaatttctcactttgttttttttgtaaa

SEQ ID NO: 56473 - DNA, 1166 bp, Heterodera glycines
  Genomic contig location: Contig_ID=SeqID_25729; Location=1070..2235; Strand=-
  SCN-specific regions: Sequence locations=1-35,57-68,91-354,375-1166
gaccaaaaaaaaaattcatgattttcattttctggttataaaaattggttaatattcaatttttcttaatgaatatttgaaaatttttcaaaaaattagatttttcaaccaaaaaaaaaaaatactgcgaaatgccatgactcctacaaatattatttgtttttctccttttatcgcattttgttaagaaaatttttttttaattccaagacaggggaaaactcgtgcaaaaaaaggttttccgaaataaagcctgacaaaaaaaaaatgctaaaaaactatgctcctgatgattaattgtacggtacttttgtccatcggttttgtttctacaaaataggtttccgagttggctgttgttgttgttgttgttgccacatcattcgacttcgacttggcttaatcagttacataatttacccccctcatttttgtgccatttacagtaataaagtgtgttagggcgcgaagtgccatcaatttctaaattcaaaaacaatagatggtacaataggcagtaggtccagcctaaagcatatgcctaagcctaggcccatcctaaaacttaggccgaagccaggcccagcctaaagcatatgcctaagcctaggcccatcctaaaacttaggccgaagccaggcccagcctaaagcatatgcctaagcctaggcccatcctaaaacttaggccgaagccaggcccagcctaaagcatatgcctaagcctaggcccatcctaaaacttaggccgaagccaggcccagcctaaagtatatgcctaagcctaggcccatcctaaaacttaggccgaagccaggcccagcctaaagcatatgcctaagcctaggcccatcctaaaacttaggccgaagccaggcccagcctaaagcatatgcctaagcctaggcccatcctaaaacttaggccgaagccaggcccagcctaaagcatatgcctaagcctaggcccatcctaaaacttaggccgaagccaggcccagcctaaagcatatgcctaagcctaggcccatcctaaaacttaggccgaagccaggcccagcctaaagcatatgcctaagcctaggcccatcctaaaacttaggccgaagccaggcccagcctaaagcatatgcctaagcctaggcctaacctgggcaattgtacgaat

SEQ ID NO: 56474 - DNA, 298 bp, Heterodera glycines
  Genomic contig location: Contig_ID=SeqID_25730; Location=12..309; Strand=+
  SCN-specific regions: Sequence locations=1-101,123-153,175-298
atggactccgttggtggcggtgacttttcatcttctgctggtaatcagggcaagaaaaatgactgaaaatatctaaaacattaaattccgtgtgccgatactcactcaatcattttctgtgtccattgaatgtaacggtccatttgctggagcgtaaaatcccaaaatttgtcagccaacggcggaagaaagacagccgaagaaaagagagcatccaatttggagagaagacaattggagaaggacgaaaggcactcatttttggagtcgtcgttgtcaaagggaatctaaattggga

SEQ ID NO: 56475 - DNA, 604 bp, Heterodera glycines
  Genomic contig location: Contig_ID=SeqID_25732; Location=64..667; Strand=+
  SCN-specific regions: Sequence locations=1-311,334-372,394-604
gcttttaccgatgcttcttccgccgtcaatttcatttttgtcgtacgatttccaccgtcttttgccaagtccgtcgtgccatttgtgctgaccaataatttgactagcgaacaattgacattgaaaagcacttcaaatagtcgtctttttgtgttcgtccgttctccaattgtacgaaatgcgagcgaatggacaaaatgggaaaatgaggcgattggctgggattttgttgatcaaccgaatcgaattgacgtgtatatgtatcgtgaggatcaaactggggacgggtgagcgaattgattattaaattcaaattgataattgatttccaattttttagacttcttaacaaattgaccggtccaattaatcggaagaagaagaagtgaatgaagggtgatccgatcaatttgaaagatggatttgggaattgacatgctcataaaaattgtcctttttttcattggattgatcaaccttggattatgttacaccattattttatttgtcgttttctgaaatgaaaaaaaaattgttcacaaaaacaccacattaaagagttgtcgggtaatactgacttttactggtcccataaaaaaaggaa

SEQ ID NO: 56476 - DNA, 942 bp, Heterodera glycines
  Genomic contig location: Contig_ID=SeqID_4995; Location=322..1263; Strand=-
  SCN-specific regions: Sequence locations=1-148,170-942
atgagtgagctcttgcgcatctccattgcaccaatggtggtgcgtctcaagatgtatattgagacagcccaagaaaacttgggcaaagagctggcggaccaaagtgtccgtgcagatctgatcgcagagagacaaaatctctgcaaaacaatttctcttttggagaaatacaatggaaaatgggaagccattttcctgagagtgaagggacaagctcttcaagatgaagagcaaaattacagagacttcaaaccagaaggcaaggccttcatgcattgggtcgaccaagcccgagggcttgtcgacaccattgaaggggctttaggcctctcggagctgggggatgcaattccccagccaaatcagccagcacaagttgtgcagcaggcaccagtggtgcattagcgtcatgatgtgacgcttccgccgataacattgcccaaattctcgggggaaccccgagaatggcctttgttttggaagctctttgagacttccgttgaaagtcttcaaattgaagacttcaagaagcacatttatttgctgggatgcctcccagagaagtcagttgctaggagagcaattgacttatacccaccgtcagatgaaaactacccaagggtagttgagattctgaaaaagcggtttggggatgaaaagacaatggtggagtccatccaagcggagttgctccaccttgccaaaccagctaaatccgttcagtctctgagacaattctcagagtccattgagcggatttgccatcagttgttggactatggagagaatgaacaaaataagttcatggcctccacaattaagtccaaactgccctaccaccttctcacccaagtggttgagaaggaaatgagggcaggaggagcctttaactgcacagagctccgaagagctatctcttccatcgttgaagtgaaagaagaa

SEQ ID NO: 56477 - DNA, 1046 bp, Heterodera glycines
  misc_feature (136)..(136): n is a, c, g, or t
  Genomic contig location: Contig_ID=SeqID_4995; Location=1717..2762; Strand=-
  SCN-specific regions: Sequence locations=1-220,249-687,727-894,918 -1046
acactcttcaaatcatccttccacggaatgcctattcccataagagaagggccgtacttctccgctagccgggttgtcatacccgaaaatgccgagattctcaatgatcgcctttttggcgatgagaatccccacncgggacccatggtttgaggaagactgggagccagtcttaccattggttcccgatcatgttgatcgccggctacgcgatccaagattggaagaggaggaagaagagagagcgaatgacgctcatctccggcgtgaacgtcgagttcatggccggattgagcctctgagttcgtggattgagcgataccatgaacccagatggtacgagacagcacttgacatgggtcacgaaatagacccattcatgccttgcctacaagaatatgtaggcttcagccctcacgaaggagggatgctcgtcgacctctacccggtcgaattggtcaacatccgaaaccgagtcggagttgcctggagagcgcctgcagtggtggaggaaccgcatcttcctccacctgaccaagcacagctaccagatggacgtttggagaatcgtcctccaagggtggctcgtcgacttcagatgaaccgacgatgaaaagaattttggcggaggacagcaacagttgccgccaccctcgaggcccggagaatgtcgccaaaagcgacacaaatttcttggaaattttcatttattttttaatccttttcatcgatcaattttgcattcgctcgctcgttaattatgagtcatcttctctcttcctcatatttttatggatttttttccatttgtttgtgcacatttttcacgtgcctggccccgcccccattgatttgtgagggtataaaagcccggcccattctccattttcctcacttcttgcttcttgcttcttacttctcacttcttgattcacttcatcttgtgagatttctacaagcacttctgcttgatcagcattaagtcgggacagttttctgtccaagcatttgcattaaattgtaattgtgcaattgaattgaataaa

SEQ ID NO: 56478 - DNA, 631 bp, Heterodera glycines
  Genomic contig location: Contig_ID=SeqID_4995; Location=3426..4056; Strand=+
  SCN-specific regions: Sequence locations=1-24,46-344,366-488,510-631
gtaacacccagatatgttcaacggcaaaattgtgcaaaggctttggtgaagttccaaagccatttggagaccttcgatttgaaggtttaattggacaggactaaatcctgtcaaggcaattacctttctcccagtatttctgagttggtaatttttgatgtttaatggaagtctcctctctggactttccattaatttttcaaggttatgtgaacggcaattgcagttcactaaacctgatgaatggtcaggtatgcaatcagtgcatgcctgaacaccaagactgcaattgaaatcaattgcttcttgccgacttttacagttaaagtcaattgttaatggctctctggttagagccatgttgctcccgtcataaacaaaatctgattttaagacgggggcgggcggaaaagttactccgatcggagtagactgatgtgttcccatttcagtgttcttcctggatagaggaacacctgagttgacttggtttttcgcccaaggtttccaggcgaattattgcaaaaacaataaattcccaagaattgcagcccatgatttcatagactgtcttggacttttcctgagcataccaacgataaaaaaggcatgcactgccgcctaagaggca

SEQ ID NO: 56479 - DNA, 3526 bp, Heterodera glycines
  Genomic contig location: Contig_ID=SeqID_4995; Location=4058..7583; Strand=-
  SCN-specific regions: Sequence locations=1-744,766-814,836-924,946 -1358,1380-1502,1546-2416,2438-3260,3282-3450,3474-3526
atggtggtgcgtctcaagatgtatattgagacagcccaagaaaacttgggcaaagagctgacggaccaaagtgtccgtgcagacttaattgcagagagacaaaatctctgcaaaaccatttctcttcttgagaaatacaatggaaaatgggaagccattttcctgagagtgaagggacaagctcttcaagatgaagagcaaaattacagagacttcaaaccagaaggcaaggccttcatgcattgggtcgaccaagcccgagggcttgtcgacaccattgaaggggctttaggcctctcggagctgggggatgcaattccccagccaaatcagccagcacaagttgtgcagcaggcaccaatggtgcatcagcgtcatgatgtgacgcttccgccgataacattgcccaaattctcgggggaaccccgagaatggcctttgttttggaagctctttgagacttccgttgaaagtcttcaaattgaagacttcaagaagcacatttatttgctgggatgcctcccagagaagtcagttgctaggagagcaattgacttatacccaccgtcagatgaaaactacccaagggtagttgagattctgaaaaagcggtttggggatgaaaagacaatggtggagtccctccaagcggagttgctccaccttgccaaaccagctgaatccgttcagtctctgagacaattctcagagtccattgaacggatttgccatcagttattggactatggagaaaatgaacaaaacaagttcatggcctccacaattaagtccaaactgccctatcaccttctcacccaagtggtggagaaggaaatgagggcaggaggagcctttaactgcacagagctccgaagagctatctcttcaatcgttgaagtcaaagaagaagtacagagatgtactcaaattttccggggagaggaaaaaccccggaattttccccctcattcaaatgaggggagagccaaccaagggagaggaacaccgttccgcttctcccgcccgttcagagaggaacggtggaggccagtggaaggaaatgaaacggcaatgaggatgtctcctcagacgaatcattccttttcggccataatccaacaacgaacccctattccaaataggggctcaaatcgcatatgcttcctttgtgaaacaaaggggcatacaccgagttggtgcacgaaatacatcactccgggggcgcgaagaaagcgcctcgcggaccaagacaggtgtattaattgcctcattatggggcataattccctgaactgcacctcaccccgcaggtgcagtcaatgtggtgaaagacaccactttatggtgtgttatggaggagaaaaacaatggaatattcctccgcaagtgcagaggaatgatttccatgggatggggacagagtcccctcccaatcagtttatccagggtcacgagagacccgacaacagaaatgattctgtggggatgatgtctcctcaagtaaacagatcatttctgacattgacaagtccccaattttctcaaagaaaaatagggacacggacaagacaaacttgttccctttgttgtgttgtgggacatcctccaagtcgatgtccccaatattccacaccaggagcacgcagaaggcggctcgcaaaacagcgaaaatgttttaattgccttatgaaagatcataaggcacaacaatgccaatctccaaagagatgcttgaagtgtggtggaaagcaccactatatgatctgttatcatggagatgctccaattgggagcactcctcaacagataagggaaggaaggactgttcagaagaaacagtcctccaaacaaagaggagagtttcctcgttcaaaaaccctttactcaggcgtatcctctagagtagaggataaaccgtctgaaagtattgctttccactgcagctcaaccagtgggttgaaaaatgtgacaaataaatcacattcatttttttgtcgtgccatggtcatgccaaagcacgaccaccaaaaaatgatcgaaaagtcagttcttttcgatcaaccgagtcagatttcataccaatctgactctcatttcggtgagcagaagacaccgaaagtaactcccacagataagaaaatctgtggctgttgcataaaaaagaatggtgttgtgagccattcagttttttccattcgtattaatcgaatggacaataaatgggaagaaactcttcctaatcgaacagagcaatcaatcatagcattgacgctttgtttttacatcagcataagcctgatggttctctcaattttaaaagccctttctattgggcgtaaaaccattgcttggctaatgatccaactcaaagtattattactttgttttgaggatcagagcacgccttgctttcaagaaggaaggcaaagaggggcaatccctcaattttgtacagcgcgccatattttgcaaataatggcgtttactgtaattttagcatgtttgttccctcttcccgttaaggggggaacagaaacaaatgcttatccaaccaatcaatgcaatgagtgcaaacttctttgctttaacaaaggcgttaaagcaaagattccaaaggaaattaataaagttgagctcttctgtgcagagaactgttacattcatgagaatgtaaagaagctcacttatgagctaccaaaggaaatcctcctaaatgacttccaatgcgaaggtcatttttggatggattcgaaacacatgttcaagaaggacattttatgtccagcagttgatgagtgtgaactcatcgaatgctatttttgcattgaacagttagcgaatccaacctgttatccattgatttcatcaatgttagcagggggactttgcttatcattcatgagcataagctttatggctttttccatattaaaagtcctgttttcaggactttatatggtcatttggctgataattcaatttatcaggccaataattatttagctggcccaaatcggcctccgaaagataggaggccaagggcaacagcttctcaaaattggacatcacgccgtgtttacagaacaatggcgtttgttgtccttatggctaactctctccaggatttgactggagcagagaccatcgcagtcatggccaaatcggaaaaatgctttaaaaatgcgacaagcatgagatgcattgtcgaaaactcagcaacgcttacgttgctgccagttggccaaacaaacactcttcttctgaaaacagaggaaggtgttctccttggctcaattaacgttttgctgaaggctttagctttggaatgccaaagcttcactaaagagtggcaacgttcatacgcaattaatgtgttggccgctaaaaggtgccctaagatgggatcctgtgaaggaaagtattgtagcgaagttcgccacaatacttccattcctgagctaaaagatgccaacgattttccaggcaattcattttgcctggacagcacagccttttggggcaataa

SEQ ID NO: 56480 - DNA, 1230 bp, Heterodera glycines
  Genomic contig location: Contig_ID=SeqID_25736; Location=168..1397; Strand=-
  SCN-specific regions: Sequence locations=1-280,302-331,353-443,481 -660,682-821,872-938,978-1109,1131-1193,1224-1230
atggcagatccattcgactcgaaatctttcggttttatgccagctattggtgagcagcagggtaagaggggaaattcacattaaaagtaagtgcttaaagccaggattttggattcgtaaaagggtaaaaagggagaattttatgtaaattcgaaaagttttgtatttctatttttttttacattgcaaaatttattaatagaaaaatttgcaaaaaatctcatgaaattttaaaaaattttcacttcggcgcctatcgtaatcatcggactcagtccgtccctctttgaaatcttcaaaatttaattaaaatccccaaattattgatgccaatttggttttacaagattttccccgttatgtacttgaaatggatttctgtacttggatcggacaatcccaaggtgctgaaaccttgattttcgaacatttttggccataactttttttaaacttaataaaattttttgaaattttaaaggctcataaagaacatttagatctatcgaatgatagcaaggattaaaaatttggtctttttagagcaaagttataagcaaaaattttcattatgatggttttttaagtaacgcccattatgatggtttttaagtaatgacatagcaccaatcccaatacactgatttaagcataagttggaaagtggttttcatttgaataaatttgcataaataggcaattctgcagatgtgttctgtttgggtcaatttgtgcggcacagtgccgccgtggtgtcgtcgtcatcaatcggtgctgctgttggtgatcatcaaaatagtggccagaaaattggacaccgcaaatttttttttattgtttgaaatatgtattttaatgaaataataaatttgcggttcatgacttataagagcacctaaaaatgggcgaaaatggcaagagaaaaaaacaaatagtgtatgcttgttaatatccaaatttaatatattttggattaaaattcatgcaaaagtcggcggtttaatttgtaatttgagtaattttagcgccagaaaaaatccatttttttgaattaatagcctgtctttttgaaaatttttcgaaaatttcagtccttatttgttggcgtgcattttattttgcaataaagccgcctaaaaaagtaaacgtacgaatctatgccagaattgcttcaattttctggccaacgggcgtataaaaatatttattcaaaaattaattttgaataaa

SEQ ID NO: 56481 - DNA, 85 bp, Heterodera glycines
  Genomic contig location: Contig_ID=SeqID_25739; Location=751..835; Strand=-
  SCN-specific regions: Sequence locations=1-85
cggcggtgctgcgctgagccgtgcgtcgcctgggcaccgatgcattggcggcggcgccgcgtgcgacgtgcggacgacggcactg

SEQ ID NO: 56482 - DNA, 155 bp, Heterodera glycines; identical to SEQ ID NO: 51421
  Genomic contig location: Contig_ID=SeqID_25740; Location=402..556; Strand=-
  SCN-specific regions: Sequence locations=1-155

SEQ ID NO: 56483 - DNA, 1634 bp, Heterodera glycines
  Genomic contig location: Contig_ID=SeqID_25741; Location=33..1666; Strand=+
  SCN-specific regions: Sequence locations=1-218,240-1048,1075 -1213,1302-1436,1459-1612
  Gene Ontology: Mol. function=structural molecule activity; Cellular component=microtubule associated complex; Biological process=N -linked glycosylation
tttttcgaaaatcaatcacttttggagttgcattacataaaagcattttccaccgatgattcagcagagcatgaagcacttaagctggctgttgatcttttcatttgggtgatgtggttcgaaaaagaaattctccagctggacaatgagcatgccaagacggcaccacggcttaccatggcatggaagcaaaaccggtggtattacgaaatgacgtacgacaaactgtttgacattgaaaaggaaaatgagcgggaagaattggcaaaaattcggcaagaaattggcattttgctgcaagagtcaaaaaattttgctgaacaaaaacggcaaatgattgatgcgaatctgaaaattgagttgcgcagcaaacggcttcaacgccttcagaagcccagcagaacggcaccgcctttcggcactttggacagggaattgtacgacattcgacgaaaagccatggcacgggacgaccaagttgagccggagtttaagaaatggcttcagcaaacacattttaatcgccttagtgattatgttagccaatgcaatgagttcaatgccaaatttgtaaaaggtgctttttttgtctgcgtaactcctaaactgtcaattgttatcttcttcgttttacagcccatgtttattcccatttttaatttttgtaaatttttaaacaatgctttaaatattttaaatgacggattttcgcgccaataattgttaatatccttggcattccattaaaaaataattaaggaacatcaaaagaaacattaaaacgagtggcggaatttgtgggcgaagaaaatgccgatgaaattaaccgaaaggcaaacgattgttttgggaaattgtcaaattttgaagaatatttagcggcggatggcacacatattcatggcatttatatgaatccaagtgaaattttggaggatattcgtaaaagtgaggaaattgataaggaaaaggaggcgaaggaggcggaggagaagccgttcgatttggatgcaacgatggcatttttgaattttgggggcacagacaaaaaggggaaaatggcaaaaaaggacgctaaagatggcacaaaaagtagtgatcggagaaaaaaaggagacaggaagaagcaattggaaggagagttaactgacgatccttacaaaacgccaacagagtcatcgataatgcctaaatcggatgaaatttgcatggaaaaatcgaaaacaaaaaaatcaaaaagcgacagtaaccaaaaggtaaagaaaaacaaagtggaaaaaccaaaacataaaaaagaaaaacctgcaagcattaagccaaaagagaatgaaaaaggcagtcgaacaccaaaaaataaaaaaattgacaaaatgccaaatgacgataatgcatccaaaacatcaaaaacgaaaaaagaaaaaactgtcattacgccaaatgataaatcagaaaaagaaattgagcaaaaaattaacgataatgtcatcactgatcagaaaaatgaaattaaagaaacaaaaaagaaagaggaaaagaaagccaaaacattaaaaaagagaaacaaaaatgatggagatgcacagaaagaatttgaaagcatcgggataattggtaataataaaattattaaataa

SEQ ID NO: 56484 - DNA, 1915 bp, Heterodera glycines
  Genomic contig location: Contig_ID=SeqID_25742; Location=1..1915; Strand=-
  SCN-specific regions: Sequence locations=1-540,562-1057,1080 -1097,1123-1128,1207-1915
  Gene Ontology: Mol. function=protein transporter activity; Biological process=protein transport
ataaaaaacgaaacttggcttattgtcatagagagagaattctttgctttgcttttccgatgcttcttcgtccgtgcccttctcttccgctcctttcaaatgcgctttctttcgttgtccatttgccttttcatcagcaaaagacaatttccacttcggtctttgccctcacagtgtttgaccctcgaattttcaccgagcccatcgtttctactgaggaggtgccatcaaatctgaattcactctgttcttcgttattatttgttttagttgaataaaccacttccgccaaatgacaagcgcaattatatgtatctgaaaccaatgttatttgaccaaactcctgttttctacaggtagaaactgaaaactaaatttgaatattctctctaattgtaagggatgaaattgtggacaaaatggtgcgcgtatttttgatggagggcaaaaaggaattgtcacgcgtaaatgttctttcggcactggaaattgtcaaacgaacgcaatacgagtaaaagtgaggaaaaggtttttggagagagagtttaattttcagaaaatggcttaatgaaaaagacgagaaaagacgtgccgaaatcattttggaccccatcgaagttgcgaaccgcgccattctcaattgtcgtcctttgatgaagttggaaaagacgatcaaaggtacaaatgactaatcgacaaacaaatgccgaaagttgaaaccaatgaatggaaatgtttctttagccggcaccctttacttagtgccaatgccaatcagcgaaaaggtcgccattttcaaagcgatgaaaacaatgcgcgacatttgccggctaaaggcgggaaagaagcgcaatgagaaaaggccgcactacccgcactttaaggcactttttcatgcattcgtttgccctttatctgaaattcctcccaaaggatgtgctcgcgtccgaattgctcgccgcgatggaaaacgaaggactgaccattcaggcgaagcaggagctgcacaaaatgtgcgagcagaacagaagttactcgagcatgaagaaattctgactgtttttctttgttttgtgatttggtctaaatttgatccgtttttattttatttatttattttttggtcgcttttccttccatttccttttaaatattaatttatttgttactttgtttctttcttttttgatggcttcccccctaaattccgctgcttcctccacgacagttgcattgcttacccaattcgagcaccaatactccgtcagtactgctggtcggttccatttcaccccttggggtgcaatttgatttctgttcagatataactgccaaaattggccaactccatcatttgggaccttccgaattcgcacagctggccaaagaagtgcgccatttgttggccgacgtggaggaactgctcgagcagatggaactgagcgcgcgcgaaattccttcgagcaggtgggaaattgtctaattattatatttatttgtttcgttagttcggaacgctcaaaatacgaaacgcgagtgaaaagttatcgcaatgacaaacgccaattggacgccgaactgagaaaggttagcgaaacgaacgaacgaatgcaccgatgaaatttaaggcaattgaaagggcgaaatcaaacgccgaacgcgacgaacttttccaatgcggcgacggatcagtgagcggtgaccaggtaagaaataaaaaaagaacaaattgcagggaagatgaatgtttgtcgccatggaaaatgtcaaaaatgtcatcctccatttccaacagatggacaaactcattacaaacaccgaacgtttggaacggacgtcgcgcaaaatcgaagacgcatatcgagtaacggtggaaacacaacaggttcagcactaacaataagtgaccttccga

SEQ ID NO: 56485 - DNA, 220 bp, Heterodera glycines
  Genomic contig location: Contig_ID=SeqID_25743; Location=663..882; Strand=+
  SCN-specific regions: Sequence locations=1-220
ttcacttttatgttcgtagctgtatagaatgaccattctttgatattccaatggtttgtgactaaatttagcatgttttaatcaatttaggaactaaagtgagaattttttaaattttgagttttagactttttgttgaattcgggtccggtattcgaaattggtccaatgaaggtcatattcgtgatcagcgaccctgaaaccccccataaacatgttt

SEQ ID NO: 56486 - DNA, 1037 bp, Heterodera glycines
  Genomic contig location: Contig_ID=SeqID_25745; Location=50..1086; Strand=-
  SCN-specific regions: Sequence locations=1-363,388-786,808-1037
atgtattcctcatcttccgaagaaggcgaaattcacgagcatccacagccaaatcccccagttcaagaatttcatccaaatccacaagcccatgaccccctcccgaaccttcaaccaaatgaaaaaatgttttttgttgctgaaacaacacagcaccgagttgttcttttggcggacggctttgagtacaactttaaagccgatagtcgaatggcggatggtgagattctttggcttttctggcaattttggcttagggattgagatttatcgctgtgtacaccgaaatccctactgtcctgggcgtatacatgtacgtggggctgtacatcataatgccgctggacgaccatacaaaattggaattgtaaaaaatggcaatcacaatcatccggcttctcatgaaactgttcgagtggcacaaatgactttgaggacatcggctgaagcagcaaatccgatggcaacgcgtcaaactgttgacaataccagagcaagcataccagaaggggtacgagctgcgcttgcgccatcttcttccgcaatggggcggtcctatcgtcgtgaagttgctaggcaacgggcagacgcaggtgacaatttgttggatgcgcaggatcccgacgcaattgtcattggccaaatttttcaaccaatgacaatttttgatggatatgttgagggccagagggtaattgtgtttatgtcggaatttggccgatacatggtacaacattatgggcagtacttatcgattgatggcacgtttaaagtggttatcccgatttaaaaatttggtccatgtttttcaaaaataggtggcctctactccgttttcgcagctttataacgtttcggtcattattgattttgctgcggtcccatgtgcatatgctttactcaattccaaaacggcacagcattatcgaagcgtaaaaattaattttagttattttttccatatacttttaggtgtttgcggccatcaaaaataccatcccgggttgggctgccgtctccatcatgtcagactttga

SEQ ID NO: 56487 - DNA, 7067 bp, Heterodera glycines; identical to SEQ ID NO: 4996
  misc_feature (7)..(7): n is a, c, g, or t
  misc_feature (23)..(23): n is a, c, g, or t
  Genomic contig location: Contig_ID=SeqID_4996; Location=1..7067; Strand=+
  SCN-specific regions: Sequence locations=1-244,266-339,367-585,608 -920,952-952,974-1493,1515-1519,1556-1856,1887-2444,2468-2601,2623 -2647,2670-2899,2991-3003,3025-3034,3074-3133,3163-3168,3194 -3456,3478-3759,3786-3888,...
  SCN-specific regions: Sequence locations=...3910-3945,3967-3972,4006 -4266,4288-4591,4614-4928,4963-5112,5137-5197,5219-5267,5289 -6022,6060-6126,6148-6152,6174-6212,6234-6504,6542-6624,6646 -6660,6684-7067
  Gene Ontology: Mol. function=protein binding; Cellular component =actin filament; Biological process=hearing

SEQ ID NO: 56488 - DNA, 5060 bp, Heterodera glycines
  Genomic contig location: Contig_ID=SeqID_4996; Location=1572..6631; Strand=-
  SCN-specific regions: Sequence locations=1-90,128-398,420-458,480 -484,506-572,610-1343,1365-1413,1435-1495,1520-1669,1704-2018,2041 -2344,2366-2626,2660-2665,2687-2722,2744-2846,2873-3154,3176 -3438,3464-3469,3499-3509,...
  SCN-specific regions: Sequence locations=...3531-3558,3598-3607,3629 -3641,3733-3962,3985-4009,4031-4164,4188-4745,4776-5060
  Gene Ontology: Mol. function=single-stranded DNA binding; Cellular component=nucleus; Biological process=regulation of transcription
atgtttcaacaacaaccgccacctcactcacaaatgcagcagcagcggaaggaaaattttctgtcctcagattcgcaggcccgggaaaagtaaaaaatttttaaataattttaaaaaatcaaattttcagactgtcacaatttgtctacgaatatttgtaccaattaggcgccacaaaaacggcagaaatgttcaagaatgagtttctcgcccacaacatgccgaacctgcaaattgacttgtccagctcgtccgggcccggcttcctttataattggtggaggtgctgatttatcaacccataaaattcgattatttttgaatttggtccccgggaacggaattattttcatggccatcgactttaaaacccatgaaaaattgtgttttagatgctgctttttaaataaatgtccaaaaaatggaaagggtacaaacaaaactattatgcgtctcataattattttctaccaaaaaagtaagctaaattttttaaaataaaaaacaaaacaaaaaaaacagttttgtggtatcttcgatacagaatataccgagttgaatcaaatgaagcctaattttaacttaaataattaaatttaataaattattggcaaaaatgaaaaattggacggcagattcggaaattctaaaatttgatagaaatttttatgaaaatggattttcaaaaaaatgcgtaatcaaaattagctgctgaaacagtagctttagaagaaagtcccatcaattatgtcaaaaaagtgctgcttgagaatcaatcctaggatgccaattctaatcgaaatagtgcccaaataattaattatgagacgactcatttgccgaatccgaaattttaaaaattcgtttaaattaattcccccccccccctttttcagtgtgttttgggacctgtattccgcccatccggacaagaaagacaaggtagacgccacctcggaggcaaaaacctatcacaaaatggtttctcatttcccgttttttgcccccaatttacacttttgcccccctttttttcccacgggcactcgctcatctgcagatgttcccgccaacaaattacaacggagtgcccgcaccggcgccgccaccgccccacgaggcggccatggtcaacgggggcggcatgtacgggccacccggctgtggcgggtaaatattgaatttttttattactggggcgtgtgttgcaaattttaaacggcgaatgaggaatcgaaaaatgacgaattaaaaaatcattttcgggcatttttttacagtggatgggaaaatgaaaaattgacgaaatatataaatgcatttttcttgtattcttttccgttgaaaaattgtgaaaattttttaattaaatttcatgcgaatttttctaaaaaaaatttctctggcttcaaatttgattatttttgctgaaaggtctattaacagagttcactccaaattttgaaatttcgatgccaaatcttttcgtaactcgaaaatttttaaatttaaaaaaattcattagtgtgtctgtattatttacgtaaatttgggattttaaaattgaagctttcaccaatttgcagttcccgaacccggcggcgatgggtcccggcggagggccgccgcagaatttcccggacggaatgatgccgaacgcgtactacgggccccggggaggcccccagccgggcccctcctccaaccaggcgtcacccatccccggtcagtgatgagtggtcaggaaattttaaatttttttgaattttccaattttcaggcggtggcggcccaccacgctacggacagcaggggaccaggtttgtgcaatggacacgaattgattcccgtcccccgcccctccaaaaaagaaaaatctcaatgttggccaaaaatgtcaaattttttaaattggatggtccatttagcgatgccatgtctatgggcaccgccggagaaattcgggcgaaattttcatgaattttgcacactgtccttgttttggggccacacatattccattttttaaattttactgggcctacctaaaaatgaataattttggccctcccttttttcaaggagtggtgcccccactccgtcgtcggtggtcggcggcggcggtccgccgcccaatttccccatgggtttggcaccgccccaaatgatggcactcaacgagcagcagcaactgcgcatgatgatggcggcacggcaacagcaggccaaccaagcagttcgcatgcaaatggtgggcgaaaaaagggaaaatcataaaaaattggcaaaaatgccgaaaatcaaatagtgcggaaaaattccatcccccacttgtgttagtagattttgaaaaattcagggaaatgtagaaaaacccatggggccgagaaatctcgtgaaatccctactttctttttttggaaaatgccgttaaatcaacatgaaattggaaatccctcgggagaaggaatgataaaatatagttacaatttatgctttatctgattcggatttattataaaccattggcacacggtttttttccaaaaaccaaaattctttctataaaattgcctgcaaaaatctgtctaataaaatgtaatattttgtgcaaccattttcatgtgctgcagcaacaacaacagcagcagcacaacaacggtgggcgagcagtgcgcggcggcggtgccgcccaattcaacaacgcccacccgtacatggactccccgtccggcacgccgccattccatgtataaattgggccgcattcttaactattttgccaaaattagggctcaaaatggccaaaatttttgcaaaatggacaatatttaccgtttttcacgactccaaaaatttatgaaaattacacgggcaaaaagctttttttggcccgaagaacagcaaaaaaaaaaaatgtttttggtgcccctcctgaaatttttacggcctggggcagggggaacgaactgctctatctcggaatgtttcaactctcacaagcaggcactcttttttcttgacccccttacaatttgccaggaaaatatggaagggaataaatcgctgttaaaaaatgatggggcgaagatttggggattttttttcaagtttcctgaaatgaataatttccaagaaccctctggcgcacaacggagtcggtggcggcggcggcatgatgtgcccgacaactgcttcgctgatgtcaccggcaggtccccacaatttttaatttgtatcggtggcgttttttggcaccgctgacactgtcggacggaatttttcaattttaattgctaaagtagactattaaaaaaaaatttgtccgatgtttaggcgccgccggcgtgggcccgcctcagcagcaggacgggggcggtcaacagcagcatttcatgatgggcaaccaaatgccgggcagcatgcagtcccaggtcgaaatttaaaaagttttatttaaaaagccatgaaaaattaaaaattttcaaaaaaaatttacgtttttagcaaaaaaataaatttcatttttcaaaaaaaatctcggacgaaattcataaaacaatttcaaattagatttttaaaccagttaaaaaatttcaacaacaggaaaattcaaaataaagttttacgaatttgttttgaaaaattagaaaatttattttcatttttaacaaaaaaaagaaaaatttaatttgattttaaaaaatatcgataaaattattacaaaaaaaagctagcattaaaaaagcccagagtctcgaccttttcccccttcaaaaaaaatcctgtcttgactaaaatgtacgttttttcagttcgccggccaccatgactcggcgggtggcgttggcacgcccggcggtgccggcaccgggccgtccagcgtttcggcacaaaatccgatgaacagcaacggtggcggcggaggaatgggcgactcgtcaggtgcaccctttcgtaattttaaaactaaaaaataaatggcaccgcctgggtcccaaaaaatcggcaaatttccaaaaaatttgtttttgccaatttaggcgatagtcgcgcagcgcccaacggcggcggaccggcgccgaatggtccgctccattcgctgctcaatggcacggccggcgacgggggcggcggcatggaaatgaaacagtcgccggcattcagtggcggcggcggtggtggggtcaacggaggcacgcccggaagcaatgtgggaggcggaggaagtcaaacggccgggcccagctcaggtgggagaggagagcattttggcatttttgccgttgaaaagtctaaaattgagtcctaaaatctcagggagatgggtttgcgtttattttggctcaacattccggcatttttggtgccggggacttcacattccagcacaatttctgagggcttctagccagaaatctgctattaaagctcaaccctggaaccgaatttttactttttcgaaattgattttcaattctctccagttcactcgcaaagcggcgcgccagggggcggcgcttcgctggcgggcgccgggaacggaggtggcgctgacggtggtccacaacagcaacaggtgcacacattaaaaaaagggcggtggtcaactaaaagggaggggcccgtccggccgtgtaaatcgacacgaccctttttttgcggcactttttcaaaaaaactttcagggagggcggagatccaacggtgccgttaggcgccacagggaaatttgttctgaaaatttgtatatttcataacattttcaccaaaaatactaattgtaagtttatagagattttaggccaattttttaagggaaaattagggtttttatggttaggcggtgcgatagagaggaaccgttggtgaatgttttttttgttgagattttaggattttattaagaaatttgttcaaaattacaatcacacatgcccattgctttattttttcagacgcctccagaggaaatcagcaaaattaaggcctctcttatggaaggctatgccggacaacagcagcaagaagattttccgcagcagcaccaattcccataa

SEQ ID NO: 56489 - DNA, 1004 bp, Heterodera glycines
  Genomic contig location: Contig_ID=SeqID_25748; Location=63..1066; Strand=-
  SCN-specific regions: Sequence locations=1-210,233-276,298-442,464 -610,632-646,673-1004
cgaagaatggttcaattcgttggccaacccccaacagaatgacggtgccattccgtcgcttcaacaagcgaaggcggccagcgttcggcaaaagtcgtcctccttcggtgccccgattgacccgtttcaggtagcagctgaccgagacgtattcggacgagagggacgcggggaatatggaacgtgtcgaaaattgtacattatagcaaattaaattgataattgttgtaatattttagtaattaggcgggtaattagcctaagattttacacatggtcaataaaaattcttttaaatactataaaacagttttggcttttttcagttctatctaaaaatgttttaaggccccgtccatccatgcggtcggtttccttttgtgccaataatcaccagcagcaacaaatgctgccccatttcgacatcatcgagcccgaaatgttgcagttggtccacagcagcaaccgtgtcccgacgaacgactgatttggcaaggtaaatgaccatttttggagatttatgtagggataaattttgaaaaaaacaaaccagtttctattatatgagtaaactttttgagattctctttaaaaaaacccttgggggaatattggaatttttgacagatttcaccgaaaattggctattttagattaaattttaaaaattttcggggaattgagagcgatggcgcttacttttactgatctcatcttatcaaacagtttcagatgaacggcatctggcggagaaatgtcgtaacaaaaacatccgcaacggcaccaacattggtaatgatgaacactttggcgacgctgatgccggcacgtcggctgacgctgttgaacggcgaggttggtgccgttttgctgcgagtttcggcctattggctcgacttcggcacgcgcccagcaactttcaccgtgaaattcggcacctcaacttggcccagtgccgtgaagtgcacaaagtggcggtcatttatgcggccaaggaccaacaa

SEQ ID NO: 56490 - DNA, 1321 bp, Heterodera glycines
  Genomic contig location: Contig_ID=SeqID_25750; Location=1..1321; Strand=+
  SCN-specific regions: Sequence locations=1-85,107-331,354-361,384 -391,414-481,504-511,534-541,564-601,624-1040,1074-1125,1165-1300
aggactgaacccaccagcatttcaatcactggggactcaatccaccaacattccaatcactgggactgcattccaatcaccaggacagaacccaccagcatttcaatcactgggactcaattctcctgcatttcaatcactggcactcaaatcaccagcatttcaatcactgggactcaattctcctgcatttcaatcactggcactcaaaccaccagcatttcaatcactggcactcaactcaccagcatttcaatcactgggactcaacccaccagcatttcaatcactgggactcaattctcctgcatttcaatcactgagactcaacccaccagcattccaatcactgggacttaacccaccagcattccaatcactgggactcaacccaccagcattccaatcactgggactcaacccaccagcatttcaatcactggcactcaacccaccaacatttcaatcactgggactcaacccaccagcattccaatcactgggactcaacccaccagcattccaatcactgggactcaacccaccagcattccaatcactgggactcaacccaacagcatttcaatcactgggactcaacccaccagcattccaatcactgggactcaacccaacagcatttcaatcactgggactcaacccaccagcattccaatcagtgggactcaattctactgcatttcaatcactgggactcaacccaacagcatttcaatcaatgggactcaaccgtacgggggcctttcggccccactcaccaaatttttgcgccaaaggtactcactcggccgcttcgcggcctcgtaactggggccttcggctccattccagtcaccaaaattaaatctcaccaattcttaaaacccaataaccggaaatgaatgataaaaccgacagcggctcgaccacttagcggcctcgtactcttcttttggcattttcttatggcataacagttcttccttgtttcttgactttttcttacgcacaacatttttcttctatacaaatttttcaaacaaattctcattcattcatttaaaatttcattaccatttacataagcaaaacaatatctttcatatcaaaaccaaatcaatttataacacacacaacaaagaaagaaaaagaaacattttaagactgttttttatacaaaatgacaaaagaaaaaaatgtaaaacaaatacatttcatttttcaaagcatttatacaacacaacacaatgttaatattataggattttcttagtgaacaaactaaggagtgtcctctttcttttgttaaatattttataca

SEQ ID NO: 56491 - DNA, 1874 bp, Heterodera glycines
  misc_feature (1798)..(1798): n is a, c, g, or t
  misc_feature (1869)..(1869): n is a, c, g, or t
  Genomic contig location: Contig_ID=SeqID_25752; Location=365..2238; Strand=+
  SCN-specific regions: Sequence locations=1-146,168-271,293-349,392 -1180,1202-1236,1258-1543,1568-1874
atggaagaaagagataacatgattaaggggggatgtaagactacggaagaagggatgaaacggaaagagcggatgattggagtggaaataacgggtgacgggcttgcttccccggtttgggtaccgtacagggcgtacccgcagaacaatgcggatgttattatgcaggagattaataagttggggcagagcggggacggagatgaaaataagaaaacgcttttgttgtcggagcctattatgatgaaaattacttgcgtcacactgcccagtggagacgggccgaggaatgtacataaatttgatttcggatttaaggaacaccaacggataaggtaagttttttgagaaaaaaaaaagaaaaaaaggaaaatagaaaaaaaagaaaaaattataattatttattaaggatttcgaatgtggataaattttgtttgttttacgcactggcgtcgtcgatgaattatttaattatggaccgttttgcatttaatcgatttatgaacaatattatgagacagagggacgcagctactgagcttttacgtaattgtggaattgatattaacgaatatagctatggagtggagcacttatcgagggttcagaattatttggtgggttctaaaattttggaaaaagtgataaattaatggattttcaggatgagatttaccccggaaagtaccgagtggtggcatttgaaaagtcagctgatccacggaaatcaatccgtggttttgtggaagggccctatgggacgtgaaaatgtagtgccgatatttttggagaatggtcactgggatggtctgaagaattacgtctgtttttttaatcgtgggaggaaattttgcgttgattgcgaatgtttttattcgcgggatgtttttcatacgttggagtgccgggcgagatgttattattgcaacagagtgggcggagtgccctgtggaaaggagagtggagtgaagattgaatgcccgaagtgccatcgttacttttacaactgggaatgctacaactatcatcaaggacatacttgcaaattatggaaacgttgtgtgatttgtgacaaaacttatcagttcaacccgaagaaggaccatgaatgtggagagacttattgccagctttgtagtgtgagccacgaccccaaacgtggatgttatattatgccgatcgaagaaaaagaagacaaggacgtgtacagaattgtcgtttgggtgagattaagctaaaaaatatatacaaaatatgtcttaatttttaggattcggaaacatcgcaggattcgatttacaagggggaccagaaggagcatgtgattaattatatttcggtgagagtgacgtgtacggaatgctgtgatgataaaaatagggcgaattgcaaaatatgcggggaggagaggaccaaggattggagcgaggctgagggacatgagccgacgaaggattttgtggaatggattttaacggcatttacaaattatgatacgtacatttttgcgcataacgccggacgatttgacggtaaattatcgtttaaaaatgttttttattttgaaaatttcaggacattttgtatttaattatctctgccgtaccgggaagaacccgataccgcttatcaatggactcaaaatttatgaattcaaagtgcagaattcgaggaaacattcaatgctgatatggagagactcatgcttattgatgccagtgaaactcgagtcgctgaaggcgacatttaatttgggctgtgaggacaaaccctttttcccctactactacaataaganagaaaattatggaatacgattggaacatctaccaccgatggaggactattcgccgggatctatgaacaagngataa

SEQ ID NO: 56492 - DNA, 65 bp, Heterodera glycines
  Genomic contig location: Contig_ID=SeqID_25755; Location=802..866; Strand=+
  SCN-specific regions: Sequence locations=1-65
atggctatctcttttttctcctggggatttgaccgcaaacttggtaccaacatttgccttctcta

SEQ ID NO: 56493 - DNA, 59 bp, Heterodera glycines; identical to SEQ ID NO: 52421
  Genomic contig location: Contig_ID=SeqID_25755; Location=200..258; Strand=+
  SCN-specific regions: Sequence locations=1-59

SEQ ID NO: 56494 - DNA, 59 bp, Heterodera glycines; identical to SEQ ID NO: 52422
  Genomic contig location: Contig_ID=SeqID_25755; Location=330..388; Strand=+
  SCN-specific regions: Sequence locations=1-59

SEQ ID NO: 56495 - DNA, 59 bp, Heterodera glycines; identical to SEQ ID NO: 52421
  Genomic contig location: Contig_ID=SeqID_25755; Location=460..518; Strand=+
  SCN-specific regions: Sequence locations=1-59

SEQ ID NO: 56496 - DNA, 59 bp, Heterodera glycines; identical to SEQ ID NO: 52421
  Genomic contig location: Contig_ID=SeqID_25755; Location=590..648; Strand=+
  SCN-specific regions: Sequence locations=1-59

SEQ ID NO: 56497 - DNA, 59 bp, Heterodera glycines; identical to SEQ ID NO: 52421
  Genomic contig location: Contig_ID=SeqID_25755; Location=980..1038; Strand=+
  SCN-specific regions: Sequence locations=1-59

SEQ ID NO: 56498 - DNA, 1594 bp, Heterodera glycines
  Genomic contig location: Contig_ID=SeqID_4998; Location=604..2197; Strand=+
  SCN-specific regions: Sequence locations=1-884,943-966,989-1058,1083 -1492,1514-1527,1550-1594
atgtcggacaatccgaagaaagcaaataaagaaatggagaaagcgatgtaaatacctctctaaatttgaattttccatgctaataattttgcttttccattttcagcttcatctctgccgactgttggttggaggtgttcaatttgcttccgccatctcaacttggccttggcattgctatgattagccgccgttttgactattacgtcgacgaacattttaaaacgcgcaaatggaaattgggcaaaatgaaaattcgacgcaaaattggacagaatggcgcaaatgaaatgaaaattgtcaatgccaatggaaaagagctgccaatccctcaaaatccgttaccgaacaaagtcatcggattcagaagcatttggatctagtaagaatcatttgtgatcatcacacatactctttttttcagcttcatcgaccaaaatgtgatcacttttcttggccgttttgaccgctttttcgcttcatgtacaacaatgttgtccattaccactggaaatgttcgcattttggagtttattgtgctcaacatttggccgatgttcaaggacaccatttatctgcttagcttggacatcgtcgcttttcgtcgaatgcgtcaattggcgccgtcaatgctcaacgattgtccatcccttcgttttgtcaatttctttgacggcatttccctcgaatttccgcccgatgatagtgccaatgcgtcggatggccaaacggtgaccaaatggctgttcacgcctcgtcccgacaatttgatgaatgatctcattgtcagcattcaggattcagcgatggaacagcaatggttggcaaccgtggaacacatcaaagcggtgattagattatttgattattaccaatttaattagtctttttctattttgtcttcgttttagtcattttcctctgcttcttctcctgtttctttcgacatttatatagacttttcgctgtcctcttcaatttcttccattgtgccatttgaattgaccaacgaattcaccggagaaaaattggcactgtccaaagaagatgaagaagcagattttgaagatgaagaaaaatattacagtcttttttcccttagtcgttgtccaattgggtccgatgataagaaacagcagaagttcgagaaatttgacgaattgtacgaccgttggaacctaattgacatttggatcggagacgacggattcggcgatgggtaattaatacgattaacaattttaaaaatccaaatgcttatttttgtttttcttttcagtcttctcgacggttcgcccgggccgagtgatgatcactgatcagaacagcggaaatgaattgattgattggttattgatgcgattattatatgacccaaatgttgggcaaagatatttaaatattgttgtatttgattgttgctcataaattcataaaaacgagtttggtatttttgcgaattttcttcggattttgaaccggtacaaaaggcaatttttatttttagcaaaggatcttttaagtcattttgggtgcaaatgagtttgctgggaacaggatttagctgattttaacaatactttctcccagaaca

SEQ ID NO: 56499 - DNA, 422 bp, Heterodera glycines
  Genomic contig location: Contig_ID=SeqID_4998; Location=2263..2684; Strand=+
  SCN-specific regions: Sequence locations=1-221,249-422
atggtaaaagtgaagaaaacggacacctcggatttttatattaaatatatcaattggttcctcttaacgagagaagacgaatggtaccattgttagggcgtggcaattattccgaacagagttacgggtctgtatcgtttcggcgctagcccttgtttttgaactataacttttttcatcgtcgatcaaatctaacaatcttgatatcattcgaaagctgaaaatgtttaaaagctatttataagcaattgcttagcgattagtcgcttactaaaaaagttctaactgaaaattgcaaaaaagtcaaaatttttgtgatttttttaaataacttctttacaggtcattttttttttttggtttttgtagggctaatagggcttctgaagggctttaaatgataccaagattatggttgtcaa

SEQ ID NO: 56500 - DNA, 390 bp, Heterodera glycines
  Genomic contig location: Contig_ID=SeqID_4998; Location=3074..3463; Strand=+
  SCN-specific regions: Sequence locations=1-25,47-93,116-390
atgtcggacaatccgaaagaagcggagaaagaaatggaaaaagcaatgtaaataattacctaatctaaatttgattttctaaggtcattttgcttttcccttttcagcttcatcgctgccgactgttggttggaggtgttcgatttgcttccgcctgctcagcttggtcttggaattgcgatgattagccaccgatttgactattttgttgacgaacactttaaaacgcgcaaatggaaattgagaccaattgtaattcaacgcaaaattggagagaatggcgcaaaggaaatggaaattgtcaacaatttcggtggaaaagcattgccaatccctcaaattccgttgccgaacaaagtcatcggattcagagccattcagatcttgtaa

SEQ ID NO: 56501 - DNA, 1608 bp, Heterodera glycines
  misc_feature (1537)..(1537): n is a, c, g, or t
  misc_feature (1585)..(1585): n is a, c, g, or t
  misc_feature (1602)..(1602): n is a, c, g, or t
  Genomic contig location: Contig_ID=SeqID_4999; Location=353..1960; Strand=+
  SCN-specific regions: Sequence locations=1-48,78-436,458-622,644 -1061,1084-1115,1137-1166,1190-1493,1516-1608
atgtcggacaatccgaaagaagcaaataaagaaatggaaaaagcaatgtaaataattttatttcaatttaatttaatgacaatcattttgcttttcctctttcagcttcatcgctgccgactgttggcttgaggtgttcgttttgcttccacgctctcagcttggtcttgaaattgctatgattagccgccgttttgactatttcatcgacgaacatttcaaaacgcgcaaatggaaattgagaccaattgtaattcaacacaaaatcggagagaatgacgcaaaggaaatgcaaattgtcaacaatttcggtggaaaagcattgccaattccgcaaattccgttgccgaacaaagtcatcggattcagagccattcagatcttgtaaaaactgaatttggaaattgttgtgcccatcacactttcggaaaactgtagtgatcaccccgctgagaaaagggttaaatgatttaccaatcgcgaggagttaattgtaaggaaagctcttgagtttccgcaagtcgagacttattttttcgtcttaactcctcgagatgaagcaattgattgggatataatttaacctttttctaagcgggccgttcactacagttcccgttacaatttcttatgattttcagcttcgtcgaccaaaatgtgatcacttttcttggccattttcaccgctttttcgccaaatgtgcaacaaatttggccattaccactggaaatgttcgcatttctgagttcgctgtgttcacaatttggccaatgttcaaggacaccatttatctgttgattttgaacatcgtcgcttttcgtcaaattcgccaattggtcccgtcattgctcaacgactgtcaatcacttcgctctttcaatttatgtgacggcatttcccttgaatttccacctgatgacagtgccaatgcgacggatggccaagcattggccaaatggctgttctcgtctcatcccgacaatttgccgaagaagctcagatgctatatgaattcaatcatggaagaacaattgtcggcaacagtggaacagatcaaagcggtgatttgtacaaattaattcattttttcctatttttaaaatttttttaggcattttcctctgcttcttctcctgtttctttcatcattttaattgacttttcgtcttcctcttcactttcttccattgtgccatttgaactgaccaacgaatttactggggagaaattggcactgtccaaagaagaagaatatgaagatttaattggcttcacccttattcgttgtccaattgtgtccgatgataagaaacagcagaagttcaaggaattggacttgcgatggaaccgaattggcattgatatcgcagatgccgaagcagcgatgggtaattaacaattttaaaatcgaaaatgcttattttggttttcgtttttctaggcttctctgcggttccccggggccgagtggtgatcactgatcagaaacagcagaagtaaattgattgattgatgcaattatgtgacccattttanatattttgtatttgagtgttgttgctcataaattcgtaaaaaatgagnttgtttgaccaatattnttgtaa

SEQ ID NO: 56502 - DNA, 659 bp, Heterodera glycines
  Genomic contig location: Contig_ID=SeqID_25758; Location=56..714; Strand=-
  SCN-specific regions: Sequence locations=1-256,278-309,351-659
atgtactcgtttctttacgctatggctattgtacacggagacaagtcgtacgtttcctacccccacttaacacagcgaatcaattttgggcctcccaatgcaaataattcgaattttttatttaataaagcagaacgccaaaacttgcaaaaacttgaggatgtcaaaatatgggcctacgcataatttcaagaaaatctgttcatatggaaaaatttttcagcataccaaatattttgtgcccgcctttctcgctttatttttatttgctcaaaaatttttaggcaaaaagtcccgagttattcaattggtgctgatttgattgggcatttttctcgtcaattttcttcatcctcaccaaatgttggggcttcgtattcctcgaaattcgccattgttgttcaactgttgcgtgtcaccgcctaaatcggaggttgtctgattggcataatttcaataatttcaaattttaatttccactttttttagtttgctcgtttccatgtcgcccgttcgatgaccagtgggcccagcaatttccgtcatgcatttgaccatttgatcaaaaggttttctctttttttaacgagatctcatggatttattgaccggtcatttgtctggttttttgtaagagtccgggcaggatcggtattaaa

SEQ ID NO: 56503 - DNA, 908 bp, Heterodera glycines
  Genomic contig location: Contig_ID=SeqID_25762; Location=95..1002; Strand=-
  SCN-specific regions: Sequence locations=1-175,198-908
  Gene Ontology: Cellular component=small nuclear ribonucleoprotein complex; Biological process=mRNA splicing
agcatttcaatcactgggactcaactcaacagcatttcaatcattgggactcaactcaacagcatttcaatcactgggactcaacgcaacagcatttcaatcactgggactcaacccaccagcatttcaatcactgggactcaacccaacagcatttcaatcactgggactcaacccaccagcattccaatcactgggactcaacccaccagcatttcaatcactgggactcaacccaacagcatttcaatcactgggactcaacccaccagcatttcaatcactgggactcaacccaccagcatttcaatcactgggactcaacccaccagcatttcaatcactgggactcaacccaccagcatttcaatcactgggactcaacccaccagcatttcaatcactgggactcaacccaccagcatttcaatcactgggactcaacccaccagcatttcaatcactgggactcaacccaccagcatttcaatcactgggactcaacccaccagcatttcaatcactgggactcaacccaccagcatttcaatcactgggactcaacccaccagcatttcaatcactgggactcaacccaccagcatttcaatcactgggactcaacccaccagcatttcaatcactgggactcaacccaccagcatttcaatcactgggactcaacccaccagcatttcaatcactgggactcaacccaccagcatttcaatcactgggactcaacccaccagcatttcaatcactgggactcaacccaccagcatttcaatcactgggactcaacccaccagcatttcaatcactgggactcaacccaccagcatttcagtcactgagactcaattcatttcaatcactgtcactcaacccacagcatttccatcact

SEQ ID NO: 56504 - DNA, 1357 bp, Heterodera glycines
  Genomic contig location: Contig_ID=SeqID_25763; Location=258..1614; Strand=+
  SCN-specific regions: Sequence locations=1-183,205-213,236-413,440 -662,696-835,857-1357
  Gene Ontology: Mol. function=serine C-palmitoyltransferase activity; Cellular component=mitochondrion; Biological process=gametogenesis
cggtcaatgggttccattgcccgccaaaggaaacgaaaaattgggaggaaaaaaaagataaaacatcgcaggaaaaggaagacggagagaaggggaaagcgaacggacaacggaagaaagagcaaattgagccgaaagcgtgggaagaggaggaagaattcgaaaaggtgggaagaaaacggaacaaatggacagagaggggacggacaatcgaaaataaattcaaattctattttcaatttcggatgaatgccatccttccccctcccccctcttttagtgccattccctcgtcgctttctccgtctatttcacttggttcgtcctcactgtccatgcgtattttcgcgagtttctgcgccgttacggaatcgagtcgaacaaagcggccgttgagcgcactgagctgagagtaataataattttattaaatttataacgaatttattgggttagagacggaacacagaaccgataaacccaattcgtatttgaatttaagggatttgcgccactcgtcgattctttcgaagcgatttacgcccgaaattgttacatgcgtgtccggtgagtgagtgttccttttactttggtttttgcttattccggtgaatttagcgatgtttttgagcggccaattggcggtgtgccaggggcgaaagtgtctgttcattcttttattccttcaaaaaattgataaattttcccgccaatttagcaaattggtcgaccgacaaacagatgacttctgctggacgttcaagtgctttttctgctgtttatgtgcttaacttaccaatttgaagcttttttgttcagatttcccggctctcaaacggaagtgataaatgtgagcagttacaattatttgggcttcgctcaaagcgacggcccatgcgcggaaatggcggcaaaagcagtggaaaaagggggactatcgacgtgtggcagtgcgcttgaagtgggtgggttggtttgcatctgattacaatatttggatggaaatttatttcaatctcccatgtttattacctgtcccgatattttgtggggcccaaaactcacatattccttaatttcaattttgacagaaaattgggtgggagaactgatgccattttcgagtccatttttgcccttttcattcacttttgacgaattatttaagtttattttccaattcaggtcagtgctcaattcagtccgacttggagaatttggtggccaaatttcttggcgttgaggaggcaatttgcttttcaatgggattcgccaccaattcgatgaacgtggcatgtcttgtggacgaggtgggcaagacgtacccaggaatttgacagggaaatgtcacttttta

SEQ ID NO: 56505 - DNA, 448 bp, Heterodera glycines
  misc_feature (422)..(422): n is a, c, g, or t
  Genomic contig location: Contig_ID=SeqID_25765; Location=813..1260; Strand=+
  SCN-specific regions: Sequence locations=1-273,295-448
atggcgaatgttgatttggcattggatgaaattatctcgaagtctcgccctcctcctcctcctcccgcaccacaacaaagaaactttggtggcaagcgaccatttcgaatgaatgctaccaatcgtcccgggttcggtcgacgcaattctttgggtggtggccaacgttttatgcgttccggaagtgacaatgttgtttggattaacatcgccaaccttcccgacactgtgcttactcaagaccttcaggtgcatttcccatatacctaaattacatttccattctgtctcatttaaggaacttttcgaagattacaatgtttttggaattggtgtgcattacgacgaatttggcgctcatatgggaactgctgatttatttgtggatactccgtcagcggagtcaatcattcgggattttntcaacgtggcaattgacgatgcgtga

SEQ ID NO: 56506 - DNA, 1439 bp, Heterodera glycines
  Genomic contig location: Contig_ID=SeqID_5001; Location=2085..3523; Strand=+
  SCN-specific regions: Sequence locations=1-157,190-376,398-894,916 -1055,1083-1133,1155-1221,1243-1337,1360-1439
atgagggaaactgacggcgtattggcaaaacgagcaaatgtacggtttttcgcctgtgtgcgagcgatggtgaacaatgcgagcggaggatgtgctgtcaaaaaggtaagtccaatttgtgatttacccatagcaagtttttgaaggcactatcaagaaaaaaattaatatttttaaatgaaatttattgagtaaacttattcaaatttataaattcccgaaatgttatttggtatcattatttcattaatttggaagtcttgttaaattatttaaaacccaatacaatgttcccccccccatttaatgtatgcatttaccgaaatctttttgaacaaaaagcgcatgggaagggcaattcaccggtgtgaattcgatgatggacaagaagattgtgccgaaacaaacgtttaccacacaccggacattcaaccttttcgaaaattgctttctctgaaaaaacaaaatgaataagccaggtcagttattagatggtggatagttttttgatgcaaaaacaaaaaaaggctcaaggattccgcaattcgggatatatatttttttgccgagacaaatatctcgcagatcgaccattttttgttccagtgacgccttttctacttctgtaatttacttaaaattttggctaattggtcaccgtaatttggtgaattgtctccttttgccgcagtcttcttcttacaattagcccttccatttacggagtccgctttttcttttaattgactttccaatgaaacgaacaacgaaagaaagcctaaaaggaaatgcatgaaagttttgtattcttcaattagcaccggatttgctgctcaacaatgtcggttcaccgtcaaaatgaagctcctctaagcttgaaaaactgtctgttttagtgagttgaatgaaaatattaccaccatcaattcccatacgataggcttggctaacggaaattgaattatccaccaatggcgatgtttggaagctaaacttacaaaagaccgttacaatacatgcggccaggaaatttgcaaacccaaaatggattttcaaaatgaaataatttcagataaacaaaactgcttaaaaaaggctctattatagttcacataacattacttagtgtcatttgaaagctcaagctctaagagttctttattagactgcaaaatttttgttgtttttcgaaaaattatcgccagaaaacttaaaaaaactttataaacatttttggagacacaaagttttttgttacagagactaatagaggactcttgtggtcatagaattaccaaaaataatttatttagatgctctaggaaatggtatggtgcattaaagttgccaaattattttatggaatgtcttttttatggtcgtataaactgtttcaatttgaaacatttggacataggtatgtacaggaaaatgggtaa

SEQ ID NO: 56507 - DNA, 2262 bp, Heterodera glycines
  Genomic contig location: Contig_ID=SeqID_5001; Location=1934..4195; Strand=-
  SCN-specific regions: Sequence locations=1-26,48-209,231-375,397 -752,775-869,891-957,979-1029,1057-1196,1218-1714,1736-1922,1955 -2102,2126-2166,2188-2262
atgttctttacctttgccgcaaattctgcttcttcaaatgtttatcattacatttctgcagttgaacaacgctttttaacagatactggttgcattgttggagacacatcggctgaggacggtcaacttggccaacttcccagatacaagcaaccaattggtgagtttgtactagtaaaagatagacacaaagcccgaaacttaaattgccaggcaaagtgcaatagaatcgctttgttttctccatttctctatcagtcgtattcagtgcttgatcatccacaactcaattcaattgttcaaatcggcggtggagttgtttcctttttcactgatcgacaagttaattgttttgttgtttcttcactattttcattttcacttattccaccttttagccttctttttctgccgagtgtttgcattttccttcttcgtcctgcaatttgttgcctcattctgctcatttcacaaattttcgacctgtaaaagtgccattggcaaggaatattcgccgtcccatttttacttgccccgaatgccgaaggcgctttgacaactcggaccaatttcaagcacactttgagccttgttggataaatgcggtggaaagagaactccgtagacagcgtaaggaaaggtgggcattttggctttatttaatctgtttatttacccattttcctgtacatacctatgtccaaatgtttcaaattgaaacagtttatacgaccataaaaaagacattccataaaataatttggcaactttaatgcaccataccatttcctagagcatctaaataaattatttttggtaattctatgaccacaagagtcctctattagtctctgtaacaaaaaactttgtgtctccaaaaatgtttataaagtttttttaagttttctggcgataatttttcgaaaaacaacaaaaattttgcagtctaataaagaactcttagagcttgagctttcaaatgacactaagtaatgttatgtgaactataatagagccttttttaagcagttttgtttatctgaaattatttcattttgaaaatccattttgggtttgcaaatttcctggccgcatgtattgtaacggtcttttgtaagtttagcttccaaacatcgccattggtggataattcaatttccgttagccaagcctatcgtatgggaattgatggtggtaatattttcattcaactcactaaaacagacagtttttcaagcttagaggagcttcattttgacggtgaaccgacattgttgagcagcaaatccggtgctaattgaagaatacaaaactttcatgcatttccttttaggctttctttcgttgttcgtttcattggaaagtcaattaaaagaaaaagcggactccgtaaatggaagggctaattgtaagaagaagactgcggcaaaaggagacaattcaccaaattacggtgaccaattagccaaaattttaagtaaattacagaagtagaaaaggcgtcactggaacaaaaaatggtcgatctgcgagatatttgtctcggcaaaaaaatatatatcccgaattgcggaatccttgagcctttttttgtttttgcatcaaaaaactatccaccatctaataactgacctggcttattcattttgttttttcagagaaagcaattttcgaaaaggttgaatgtccggtgtgtggtaaacgtttgtttcggcacaatcttcttgtccatcatcgaattcacaccggtgaattgcccttcccatgcgctttttgttcaaaaagatttcggtaaatgcatacattaaatgggggggggaacattgtattgggttttaaataatttaacaagacttccaaattaatgaaataatgataccaaataacatttcgggaatttataaatttgaataagtttactcaataaatttcatttaaaaatattaatttttttcttgatagtgccttcaaaaacttgctatgggtaaatcacaaattggacttacctttttgacagcacatcctccgctcgcattgttcaccatcgctcgcacacaggcgaaaaaccgtacatttgctcgttttgccaatacgccgtcagtttccctcattttattttatatttgtataattttagtgcacaacaaaaagaaatttggagaggcatgtgcatattgtacacttttcaactccttcgattgcacaaaaaacgacggaaaccgaaagagagttggaagagtttacggacgaaagtgccattga

SEQ ID NO: 56508 - DNA, 1707 bp, Heterodera glycines
  Genomic contig location: Contig_ID=SeqID_5002; Location=112..1818; Strand=+
  SCN-specific regions: Sequence locations=1-584,606-923,945-967,989 -1142,1166-1327,1364-1707
gctcgccttttaagtttctttgaaagcattgggtggaaggtgtacaccgttcctgagaccgcgtcatttttcctcggtcctggacgcattcgttttcccgacctgagtagtgagcaggctgctcaattccagacagatttgctcaaagcattgatacaaaatgaggatgtactgcgttttctaatgcgcaactcatttctttacatttttaggtctttttcaaccaggccgaactcagtgaagcggaaaaaattatgatcattttagaccggggtaggtaacataaattagaaattagagtaatactaccgattgtatcacaccttttttgaaaaaaaatttgttttcaaaaatcatgaaaatgtgtttccacaggattttgatgttgctgaacacgaatcttgccttcctagtactgatgctttcagtttatttccaagtgtttaaactaattatgacccaaaaattagaagatcttaactctatcttttgtgcgaatttgggtccgggttaagcaattagttgaaatggcccaatcgtgatcagcgaccctgaagacttcttgaaacaagctttgattaattttgaaaacaaaaaattgttttcaaaagtgtgtgataccaccggtagagtattacctaaattagcatcagtaatgagcattttcgctaaacaaatattgagtttaggtgcgatggatggaagtgcttatatcgacatggaatcttggtcaaatgtattgtcagcatgtggcgtggacaaccatgaaatgcgtgaaagataccaccaagtgagacattttcgctcattatttacaaataatatccatttctaacaataagatttgtcatctcgtcaccgcagcggatggtgcacaatcattttatcaacttgcgaataaccaagcccgaaccgaagcaatggaggaagccattgagattgacaaaaagaccagagaagtatttttattattttattagcatccaatgccgaaattaaggcatggattgggcatcaatgtctatcaatagttgataattcaaactgttgttcgtttgacgaaaagatctccaaacttattgctgttgtttgtgaacgtcttggcattccgatttcggatcgtttggctccaaatagcaagtaaatttttataaatttggtttccataaatctaaaattccaaggaaacggaaatggttggtcagcaagatcgttgacaacgatgccttcttgcaaattaagcaggaaaagttttcgttacaacatgattatctcaatacggcgggttcgagtcaggtaaattttacttattacagcgtgaaatttatgtcaaccattttcttttacaattttcatttctggaatcgttttgcgtttctcattatcgtttaaatttttcgcgcatttttaccagaaaacatcggaaactgtaggtccccatccctttgtgctacacctgggctacaagtttatctttgcaggttcgacttcgctcgcgtagccaaaatggaaagtacacgtacacacttacgacccgaacctttgaagacgctgatggcaagaagtaattttcgcctttaaaaaaaattctcttttgcaaatatagacttccccaaccggttgaaacacggaagcagttggacaggcgcgagtatcagagctacttgaaacttcttgacagaagccgtcaatcaattcacaagaaac

SEQ ID NO: 56509 - DNA, 707 bp, Heterodera glycines
  Genomic contig location: Contig_ID=SeqID_25766; Location=348..1054; Strand=+
  SCN-specific regions: Sequence locations=1-89,111-707
aatttggcgcatcgctttagagcactttctgaaaaaaatatttatgaaacaaaaaaatcgattttttcaagtgtccgtttggggtactcaaacatttatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggagggactgccccgaaaac

SEQ ID NO: 56510 - DNA, 1156 bp, Heterodera glycines
  Genomic contig location: Contig_ID=SeqID_25768; Location=561..1716; Strand=-
  SCN-specific regions: Sequence locations=1-43,65-207,229-371,393 -507,529-659,686-998,1024-1105,1148-1156
aaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaagctaagcctaaactttttggcctgtttaaaaaggaattaaaaatttttaaaaattttattcatctccctttttgatagaaaaagcatcagagtgcctaaactaacatgtaaataaaatttgggtgcgtttcagaaccctttctgaaaaatatttaagaatttaatttgcaaaaaataaataaaaacgaaagactcagattttcgaaaaattttttgagcaagctagctcggcgctcatttcagtgtaagttagtcctttaccggggagtatccctgcaaagtttggtatgcttctgctcaattagcaaaaaatatgagtgatcaaactttcactaaaaagttaagcctaaattttttggcctgtttaaaaaggaattaaaaatttttaaaattttattcatctccctttttgatagaaaaagcatcagagagccttattaacttgtaaataaaatttggtgcgtttcagaaccctttctgaaaaaatatttatgaattaattttgcaaaaaataaataaaaacgaaagact

SEQ ID NO: 56511 - DNA, 1809 bp, Heterodera glycines
  misc_feature (735)..(735): n is a, c, g, or t
  Genomic contig location: Contig_ID=SeqID_25770; Location=68..1876; Strand=+
  SCN-specific regions: Sequence locations=1-103,126-312,370-423,454 -483,756-1056,1084-1295,1326-1474,1496-1809
atggctgttttccccgtttttcccattgtttggcattctttgcgctctttacaccatgggaaaatgtcgctttatcaaactgccattttttggtagagtccggaacccccaaaaaagtttctcggaatcagtctcaaaaaagttccggaaccgaaaccccgatcccaataaattaattttctattattttttcgaagagttgtcgcctttggccccatgcccttttgtgtgctttgctcataaattttcaacggcggctccgttgtgctgggcgaccgttccgcgcatcgggtgaatttacatttaaatgccaaattaattttaatttattttttctaaattattttttatgtattaatttttatatttggcaaagttttgttttttgctgcaagacaaaattatttttatagcgtcatttaattaaattaaaagtgggagtgaacatattttgtttatcaatttttaatttttcgcaaatacattataagaattaataaatttaaattaaattcaaaaaatggaagtgtaaattttaatttttatatttacattttaaatcattttctatagtttaatttaaattaaaaattcgagaaacttttttaaactttctacatataaaaaaagtatttttcattcacttaaaatgattattaattaattttcagtatttctcttaagtaaaattatatttttctctttttaaattatttttcatttaatttatattanataaattattaatttattttcagtgtttcccttcttcgttttgctctccctgcagcactttttgttgctttttcattgttctcaattgtccatttgttcacacttgagcacccgtatttgctggcggacaatcgccacttcactttttacatttggcaacgcctttttcaacggcattggcttgtcaagtgattggaattattttttcggcatttttgccatcatttttttcccaaaggtatgccctcgtgccggcctatgccatttgtgccctgttcatttggcacacaatggaaacagacactgtgactaaagtggagcaaattatttttaatttttaattttattcgctaattggctcaataatttatgaaaaggccagagaatttctcgagttgagagtcgagcccagaaacagagtgtgatatttagggatcggatttttagtgataaaaaatcccaaaataattaactaaatagtgagaaaaaaattccaaaatagtggcaaaaatagtggcgaaaaagttccaaatttaggggtgtaattttttaaatagctgttttttaatttgaaaataatttaaaattaaggaaaaagattttattcactgattgcagttacaaaatattttcttagaaaatattgaacaagaaaaaaaaatttgggggaagaatttttgtgaaatttttccaattcttaggatgtatttttgaaaatttttaggtcgattcttaggggtgtatttttgaaaattttttaggtcgattcttggggtgtatttttgaaaattttttggtcgattcttaggggtgtatttttgaaaattttttaggtcgattcttggggtgtatttttcgtttttattgcattttttgggaaattttccaaaaaatgccaaaatagtggcaaaaataatgacgaaacgccaaaatagtggcaaaaaattattttagtggctaacttccgaaatagttttttttagtggcgaatttcgtgcatttctcgtcgagttaaagccgcagaaaaaatagttaaaaaactaagaatcagatccctatttatgagtccaacaa

SEQ ID NO: 56512 - DNA, 1044 bp, Heterodera glycines
  Genomic contig location: Contig_ID=SeqID_25771; Location=339..1382; Strand=+
  SCN-specific regions: Sequence locations=1-1044
atggaatggccagcattttggcagagtttcgagagtgccgtcgaccgtgccgcccttgagcccgtcgacaaactcaactatcttcacggttgcctacgcggtaaggctgctcgtgccgtaaccgcctaccgtggaggggagaattacgcccatgccgttgccgcactcaggcgactcttcggagatccacggaaaattgccgaagcacttcagtccgaactgatcaatctccggcctgtggacgatagcgttggatcactgcaacacttcctcgagactttggagcgtgtgtgccgccaacttttgaacctcaacatgccggatgacagcccattcatgtaccaaatcatccgcagcaaattgccgtcgactgttctgtccgaactcgtcaaaatggaacgtgcggcaggcattccatggggtactcctcagctcagagctggacttgccgaagttctcggagtcagagaagaggtcgaacggtgcctgcgcgaaaccaataccgacagacaaacacgatttcggcatgaagcaaggccaagtcgaccgcagcgaccagaacggcacgaaaatgcgcgtgttttttccgttgctcagtccgttgtgaattccggtgaaaagcgagtgccttcttgcctgttttgccctggtcagcactgggccgcagaatgcaacaaagtgacggatacagagaatcgaaagcgatgccttttgcaacagaaccgatgccttaattgcctacggaaggatcatcaactgaaggagtgccgatcaaaacaagggtgccgcatatgcaaggaacggcatcattcatccatctgccctagtgcaaaagggacatcttcggctcgccaaaaacaacctaagcccttgcacaagaacaaacagactttcggaaccgagcgtaactcaaggccattggtgtcatccgcggttgccaatgatgctgactcaatccctgagccgaaaattgttaacacaatcatggcaattgtctccccatccgttcctcatctcgtcatgatcatggccctccgagctcct

SEQ ID NO: 56513 - DNA, 925 bp, Heterodera glycines
  misc_feature (48)..(48): n is a, c, g, or t
  misc_feature (74)..(74): n is a, c, g, or t
  Genomic contig location: Contig_ID=SeqID_25772; Location=1..925; Strand=+
  SCN-specific regions: Sequence locations=1-128,150-201,223-292,314-925
tggttcgtttcatcacggcaccgaaccttttggctcgtttaaagtcgntgcttaacttgccagatcggacgggngcccttgattccactgttccaagcaccccaccaaaagcaaaacgatataaccaaaatataaggaaaaattttttctccatcttcctttttgatactaaagcatcagagtgctaaaattaagttgtaaataaaattttggtgcactttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgagggattcggtctccccataaatctgggcgcatcggttcggggggaatgccccgaaaacaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcggggggactgccccgaaaacaaaaaaatcgatttttt

SEQ ID NO: 56514 - DNA, 81 bp, Heterodera glycines
  Genomic contig location: Contig_ID=SeqID_25775; Location=649..729; Strand=+
  SCN-specific regions: Sequence locations=33-33
atggtggggagaattaaaaatgtgtattcgaaagtctacgatgtgccaagacgtccgttcgagaaagagcggcttgaccag

SEQ ID NO: 56515 - DNA, 378 bp, Heterodera glycines
  Genomic contig location: Contig_ID=SeqID_5003; Location=515..892; Strand=+
  SCN-specific regions: Sequence locations=1-29,51-185,208-239,262-378
atgctggaattgaattcgaacaaaacgaagaaagtacaattagaagaatttataatgtgtagtaagttaatttgttcataccaaacatcggccgactcgttgacaaagtcctgcaactaacaaatgtctttgctggaagtcgcttgaacaatgagcaaaagcgaattgttgttgaagccatttcgatttaaatttaatttaaatttacaccctaaaagtttgaaaatgggctttaagagaaataaaataattaaaaatttagttggttttatttttgtttgcagtttgtatctccgctgtggacgaaccgttcaaaagaaaagttgattgattgtttacttatcgactggctaatgaaatggtgtgcgtaaacataaa

SEQ ID NO: 56516 - DNA, 1885 bp, Heterodera glycines
  Genomic contig location: Contig_ID=SeqID_5003; Location=1483..3367; Strand=+
  SCN-specific regions: Sequence locations=1-449,484-589,613-1085,1108 -1157,1181-1885
  Gene Ontology: Mol. function=thioredoxin peroxidase activity; Cellular component=extracellular space; Biological process=response to oxidative stress
gttgtcaaccgctgaacgcgttagcaatgttgggcggggcccgactgtgccaccacacgccaccaaactgcatggacgccattcgtccgcttggtccgaaaagcagtgtgccgagttttaaggttttcttccctaaactgataaaaaaaataatatttgaatcacatttaagggccaggcaattgtgaacgcggaaatgaagaccatttcgtacgacgactacaagggcaaatggttgatcttcttcttctacccactcgactttacggtactttgcaaaatattttctcgggaatttcttgtcgtaatttatctgaacttgacaaaatttcagaaatttgactgatttatagagaaaactcaggaaatttgagagatagagaatgtttaggctcttgtttctggtttcctaaatttggtgccatacaatttttacgtgctataatcaattaaagggtcccctttttggttttagtaaaatttccactgtaagtagcgccatcaattgagccgtttttgtgcaaccccgaagttgaactttacttttagttttgctttttaagttccattcttttcaccgtcccttcagtttgtgtgccccaccgaaatcattgcgttcagtgaccgcgtcgccgagttcaagcagctcggctgtgaggtgatcgcctgctcatgtgactcgcagttctcgcatttggtccttatttgttccattttctgttgatttaatacgatccgccgtatgtttttaggcttgggtgaacacaccgcgcaatgatggcgggcttggcaagatggaaattcccgtgctcagtgacttcagcaagaaaattgcggctgactttggcgtgctggacaaggagaccggactgtcctatcggttcgtttttctcggccaaattctaatcggtaattgaaaaaagtctaaacttttcccctcatttcagcggtctttttctgattgaccccaatggcactgttcgccattgtttggtcaacgatttgccggtgggccgaagtgttgacgaggcattgcgcattctgaaggccttccaattctttgagaaacatggcgaaggtccgtcatttattttttttttaaattttggcataataaatcgaaaactgactcaaattttgcgaaacgcacttatttacaaaagttttgctttagaaatttaaatttttctgctcccctcggattacacgggcttgggtccggtgcaccccaaaacgtcgtcggccgaaacgtcgtcggaagactttttgaaccataactttgttcgctgtcaatcaaattaagaattgttggtgttgttcgatagctctatgtgtttattattaatttgcaaaatctcaaaaattttcgttaagttttaaaaaagttatggccagaaggaactcaaaacccagtaattcgaactttttttgctcagatttttttgtgcataaataaaaatttttgaaaatttgcaggctaatagcatttttcgaatgctttcgaataataccaagaatgtttaatttggttgagaaagaaaaaagttatggtcgaaaaattcgttcgacgacgtttcggctgacgacgttttgtcctactccggcttgggtccacggatttcagacggattcgctggctgtcctaagaaatcactgcttattaaagtagtacatttttcgcaaattatcaagtgcaaacaataaattggattttgattaataaagactcctctaatcactctaattaccctccttcataatcgcatcaatgcccctctaattaccccctcccctccatttttcagtttgtcccgccgattgggaggagggcggtgaaacaattgacgtcaaatcgcccaaggagtacttcaaaaagcaaaaatga

SEQ ID NO: 56517 - DNA, 1078 bp, Heterodera glycines
  Genomic contig location: Contig_ID=SeqID_25778; Location=1..1078; Strand=-
  SCN-specific regions: Sequence locations=1-47,88-200,222-656,678 -864,886-1026,1077-1078
atgcgattaaaatatttgagcagtgtagtcagtgcatcggtaaaaagttattttaaattatttaaaattatttttatttgttttttaggatgaaatttcgtgtgccggtgctttgtgctattcaccaaatggtcggaagttggcggttggaacgccggacagacacattttgctgttcgacgacaaattccgccggcgcgacaaattcggcacaaaaccaatggaaccgaaggtgttaagctttttctttgttagcatttagtaagccgaacattttatgggcaattattgaatttttatttgttttttgtttttctcagttcggcaaaatgagttatctgatcaaatgcgcggtgttctcgcccgactccgccaaattggccgttggtcaaactgatcacatcgtttttgtctatcggctcggagacacttggcaaattaacttgaaattgttgaattttatgcaaaaatgcatattccaggaatgagaagaaagtgatctgcaacaaatttgcacagtccagcgccgtaatggcacaatgttggccaaccgagagcaaattgatcattgggtgatcaatcggggtgaattaataggttttaaatctgcaattttgcaataagtttattggacggaaaagtccgttgtgcgtccgcttcttccaacaaatgttcaactttgtatcgggcagaaacagcggttactgtattggcccaacagtaaccattttacaattaaaatataaaaaaacccttcaaatgttcagccccaatcgaaagagttttttgtcgggtcattctgatggcactatatttttgtactccttcgaaacgcgctcccatgccagggtaattaatttgaaaaaagggtaaaatttaatcattgaaaagtcaggtttgtgtccatccgtgtgccccccaggcgcttttgttgtccgccgttggcattttggcagcgggcaccgaccgacgcatcgtttcttactcagaacatggacggcaatgcaacagtttgactacaggtgcattaataattataaaagagtttaaataataattaatttaattgtttaattgc

SEQ ID NO: 56518 - DNA, 1058 bp, Heterodera glycines
  Genomic contig location: Contig_ID=SeqID_25780; Location=41..1098; Strand=-
  SCN-specific regions: Sequence locations=1-545,567-1058
atgagtttctcggcgatcgtcaacaatctctcggcgaaagtggacaatctatcgggcgtcgtcaacaatcactcggtgaaactggacaatctatcgggcgtcgtcaacaatctatcgggcgtcgttaacaatctctcggcgaaagtggagacgattgagaaaaaaatggtttgttttcggaagaaccgataaataaattcatgggttttctcaaacattatcattttggtttttagtatttttttctgctttatgagttggaatgctaaatgccaatttacacagtcaagtattaaattgtagttttccaacaaaatgttttttattacgagtacaatggttttttgttagggtatctccggtgtcgtagtttgcccaaacatcaatttacatatttgttttaaatatcgaattacattttgtcgggtgaattttttgtaaacatgcgttttttccttctaatttgatcattttttattaaaataagggagaaacgactggcaaggcgccaaacgaacaaaaagagcgaggaaatggacacaaagtttgtaaagaaaataataagaacaaaagatgcccttgaattgccaaagccagggcccgaattaagaaaggaataattgcataaacctggccaggattaaaaatggcattaccagtttgtcgggtgcttttttaaaagaggccaaatgtgaaacttttgaaatggtctaaatttaaaaatttgcataggttatgttagtttttataccatttttttcgtttaggcggtgatgggcgcttacaacgaaaacaatggcaccatcgaagtgacattacatggttacaacgtcggaaaggcgattgttgaaaggattttgaacacggaaaacgggacggtgcatttgcacggaatgcgcgaaccaatgtcactggcaaaggccgtcgaaattggcttttttgacaacctgtcgctgactgtggttgacccgaacaccacgcaaaaggctgtttttggacgaaacattggaacggaaaagaaatatttttgccaggcaagggtcattttctttttttaa

SEQ ID NO: 56519 - DNA, 499 bp, Heterodera glycines
  Genomic contig location: Contig_ID=SeqID_25781; Location=184..682; Strand=-
  SCN-specific regions: Sequence locations=1-106,288-454,476-499
  Gene Ontology: Mol. function=protein binding; Cellular component =axoneme; Biological process=eye photoreceptor cell development
atggtaaactctccagctccaaattttttaaatttaaaagaagtatttggcaatggaagtgataaattaaaaatggatgaactgacaaaagacgggggaaaggaaaaagaagaaaacgaagaggaaaaggaagaggaaaaggaagaggaaaaggaaaaggaagaggaaaaggaagaagagacgaaagaggaagaagagaaaacagaagaagaggtaacggaagaaggaaatggagaggaaaaggaaaaggaagaagaaacggaagaggaagaagaagaagaggaagagtgtgaaaatggacagaaaagggaaaccgacgaagaagaagacgaaattgagcggatcatcatgagctcgtcacacttgttgaaatgtgaggaagtgaacagacggacaatgagcctggtccaaagttgttcggcacatgccaatttggttggtttgcaaaatagggagggaatggagagagatttctttggttattagggtgtgaaataaa

SEQ ID NO: 56520 - DNA, 1113 bp, Heterodera glycines
  Genomic contig location: Contig_ID=SeqID_25782; Location=35..1147; Strand=-
  SCN-specific regions: Sequence locations=1-370,531-745,767-796,825 -924,946-990,1017-1113
  Gene Ontology: Mol. function=protein binding; Cellular component =secretory vesicle; Biological process=regulation of protein activity, epigenetic
atgacttgcttcgaatgcggaactccgtatgtgctgaacatggatgggagcagatcactcgcaccattcaatgtgatctgtgatggaagcaaatattgtactggcaaatattgtgtcactcgtaagtgattgggaggagaaggacgggggaagagaagggcacaaacgaaactgacttagggaagggaggggggggggggcttaaagctaaatgaatttgtttaggaaagtctcagtatcctcgctcattctgtgccacatcctgggaagatccaaaggctatccagtgccaaaaagtgaatgatccgtatgatgatcaggagtgcatctgcgaccgcaatttttgcaattacccatacgatccgatgaatcctccgcctccaacgacgactcttccgcctcctcctcctccaactacaactcttccgcctcctccgcctccaacgacgactcttccgcctcctccgcctccaacgacaactcttccgcctcctcctcctccaactacgactctttcgcctcctccccctacaacaaccaccattttggcgacaacctcggcctatgtgattacttgtcctgatggtcgccaatttggccctaatgatttggcggtttatatgggtcaaattcttaaacaggttctaaatcagaattggggattttaataatttagggttcagtttaatagagcatttgataatataattatggtccggtggatcgaaggcaccgccgggaaaattttcacaaattttggatgaaatttgcgatgaaaaatggtataactttattcaatttattttaatttatagaaaatatttcgagggttcgattccctcccaattttaccattttgctttattataacttgccaaaaacctaaatggtgaaaaattcataagttctttcaattctttttgctaaaccatgttaaataacttgcctaaatgtgggcataatcggagacactcttttaattaattgtgagtttattttcatttatttaggctattctcggcacttattccaatgcgtttggcaattcggcattggacagttacaaagacggaatcaacacgcacatttgcaattatatgtaattaaaataaa

SEQ ID NO: 56521 - DNA, 107 bp, Heterodera glycines
  Genomic contig location: Contig_ID=SeqID_25782; Location=2231..2337; Strand=-
  SCN-specific regions: Sequence locations=1-107
agaatgatcagtgtagtttcgacactgaaaggaccgtcaaattcagtcctcaaattcgagtcgctttctgcaggccgttggccgaggtgttcaagtcgaagtgcaaa

SEQ ID NO: 56522 - DNA, 380 bp, Heterodera glycines
  Genomic contig location: Contig_ID=SeqID_25783; Location=37..416; Strand=-
  SCN-specific regions: Sequence locations=1-24,111-118,140-380
atgcgtggatttggtgtaccagaaataatccagcaaggtaaattattaattttttaagtcatctttctttaaaataagttattttagctttgttttgttttttcaaaccatctatttccgagattttaacttaaatttaacttttttggagtaatttggtatattttaccctaaatttagaaaaaattatgtgtatatgaattttttgatagtcggtacactctgaaggaactatatgattatgttgttgtataagttttttttaatcttcatataaagaaacatttacctgattttttattatgtttctttaaaaaagtgtccttataattttggaatcaatggcaactcgaacattgggcgactcgtacaataataaa

SEQ ID NO: 56523 - DNA, 441 bp, Heterodera glycines
  Genomic contig location: Contig_ID=SeqID_25783; Location=758..1198; Strand=-
  SCN-specific regions: Sequence locations=1-117,169-249,308-441
atgaaaaatgatcagcagaagcaagaacaactttttggaaaaatcactgaattggaaaagaaaatgaataaacaacagattaaaatggtgtgaaaaataatggggatgtgtaaattgaaaaattaattaattaaaagcaaaaaaaaaaaactattaacattaaaaaatcctaaaacaaagtaaaataaaacctcaaaaaatttttctattaacgaaaagccaataaattacctgaatgtaatctttaagaatatttaatttaaaaaaaaaataatattttaaattaatttacataaacaaatttaaagacgcttttaactttgcgaggaaattattgggatgccacagcttgtaacaatggcattgaaatcactgataaatttgacagttgctaatgaatattattatgatggtaaattgtaacaaaagtcaattaataaa

SEQ ID NO: 56524 - DNA, 757 bp, Heterodera glycines
  Genomic contig location: Contig_ID=SeqID_25784; Location=271..1027; Strand=-
  SCN-specific regions: Sequence locations=1-122,144-432,455-504,535-757
  Gene Ontology: Cellular component=membrane
atgatcgatggaatattgtccaagcatttgcgaaatattgaccaaaacaattcggtggccatggcacagctgcacattcgtcttggtacaattccttccctttttttttaatttttcgtcactcattttctttttaaacaatctaataattaatagaatattaaaacataatgaaatgaagtaatttaagcttttctgcgcaaagtccttggcattttggccttccaatttctggccacaattggactcggagtcgccttttacataacggacggagtcaaagtgttcatccaacaacagttcgtataaaaacactttattataatggaattgtaagagcttccaattgttacaccgaacaaatgggaaaaatacaaaaattaaacatttaaaaaaactcataggtattttgaatcggtcaaaaaatacgcattttaaacgggtttatttttacgatttttagtgttttactcttgaattaaagttttctcaaattttgattggttttccccattttttggttttgtgggtttccgaaatctctctaattggtcactcactttttcttttttcttacgctttcctcgtccttttgtcaaatgcttctccacttttaggccatggtttccgttcgcttctttcttcggctcaattgcccttcttttcgctatgtttgtctatgctcgttctgtccccctcaattattttctgctcagcggatggacaattttgcaggcggtcaccgttggaacgattg

SEQ ID NO: 56525 - DNA, 840 bp, Heterodera glycines
  Genomic contig location: Contig_ID=SeqID_25785; Location=174..1013; Strand=-
  SCN-specific regions: Sequence locations=1-814,836-840
atgtccgctgggagggcactccgcacaagtgtcctctacaaaattggtgttgatcattttttgctacgactaaccgtattccgtgtacaagtgagcaaaaattgccaactcgaaaaccggaatttcgtttttcgggaataactctgcgggatttgcttatatccagtgcacatagaaaatgattatgtgtaattttttgagctctatccaaccgtgtttttggatttttaaaattttcagaaattttcgagctaggcctaaaaaacggttttttggttttttaattttctgattttttaacgaattttccaggaaaaacggagaccacttccaaaacatagtttttcgagctctatcgattggtgacattttcagaaaaattttggtttttttccggaaatagaaaaattttttgctctgaccgggacatttcagtcccgggcctataactcgtcgggagttgattttagccaaaaatcttgcaagagcatttttgtagagaattttaagctctatccaatgtgttttatcccatatttttaacatgagtataaaaaaagttataaaattaattgtgattttaaaactcaaaaccataggggggaccccatggttttgcatttcatgaaaaaattttttgctcctaaattagccaaaatgcatttttatggcataatttgaggtgctgaatacgtatatacgctttattttgtgtttcagactttttggaaggtggttaaaattttttgaaaaatcgtcaaaatttgagccccggaaaatcctgtgaaatttcgaaaattcataaatctcttcgtttttgatcaaatttagtggaataaa

SEQ ID NO: 56526 - DNA, 1211 bp, Heterodera glycines
  Genomic contig location: Contig_ID=SeqID_5006; Location=1023..2233; Strand=+
  SCN-specific regions: Sequence locations=1-951,973-1143,1165-1211
atgttcccaaatgacgatggctacgaatcggaagatgatgaaattctcttgccacctccgccgattcccccgcaacttggccaccctccgccaaatgtgccggtaatttcggtctcgcttttcgttgctttttctcaatttccgagtgcttttttcaggcagttcgtgttcagccaatacatgttgggcagcagcggctgccgctgagagacttgccacaattcgaggaccatccacaaaatgtgccggtaattttggctcgcttttgttctttttttcaagatcccgaatgcaggtaattcgtgtccaaccgatgcaacaaccattgccgctgagagacctgccgcaaattttccaccctccaccaaatgtgccggtaattttgggtctttctttcgattgctttttctcaattcccgagtgcatttttcaggcaattcgtgttcaaccaatgcagcaaccggtaccaatgagagccgtgccacaattcccccaccctccgccaaatgcaccggtaatcttgagtctcgttttcggttgctttttcaaaatcccgagtgcattgtttttcaggaaatttgtgtgggaccaattcatgatgggcaacaaccactaccactaagagcgttgccacaattcgcccaacctccaccaaatgtgccggtaattttggctcgtttttttgttactttttttaattcccgaatgctttttttcaggccgttcgggtccaaccagttcaacaaccgataccactgagagacgtgccgctatttgtcaacccaccaccaaatgtgccggtaattttggctcgcttttgttactttttttttcaagatcccgaatgcattttttcaggtaattcgtgtccagatgcctcaaccgttgctgagagacatgccgcaaattcaccatccaccgcgaaatgtgacttcaatttggatcaaattgtggttgctttttctcagtctctgggtgtttcttcagggaattcatgttcgacaaattcaacgggaatacgccgtaccgcaatttgcccatccgtcaccaaacttgccgtatcatccaccagaaaacgttccggtagttgggtcttgtttttcaagcgtttctcatattttcggatgtttattcaggcaatccaaccacggcaacaaccgcgccagctgagagacgtgccactattcgaccacccgctgccaaacggacag

SEQ ID NO: 56527 - DNA, 3315 bp, Heterodera glycines
  Genomic contig location: Contig_ID=SeqID_5007; Location=331..3645; Strand=+
  SCN-specific regions: Sequence locations=1-967,989-1405,1427 -1634,1656-1844,1866-1907,1945-1965,2001-2424,2446-2858,2882 -3262,3284-3315
atgttccccgatgacgatgggtacgaatcggaagatgatgaaattctcttgccacctccgccgatccccccgcaacttggccaccctccgccaaatgtgccggtaatttcggtctcgcttttcgttgctttttctcaaatttaagagtgcttttttcaggctgttcgtgttcagctaatgcatgttgggcagcagcggctgccgctgagagacttgccacaattcgaggaccatccgcaaaatgtgccggtaattttgggtcgattttcgctgtgttttctcaaatttctgcgtgctttttttcaggctgttcgggtccaaccagtgcaacaaccattgccgctgagagacctgccgcaaattttccaccctccaccaaatgtgccggtaattttgggtctttctttcgattgctttttctcaattcccgagtgtatttttcaggcaattcgtagttcaaccaatgcagcaaccagtaccaatgagagccgtgccacaattcctccaccctccgccaaatgcgccggtaatcttgagtctcgttttcggttgctttttcaaaatcccgagtgcattgtttttcaggaaattggcgtgggaccaattcatgatgggcaacaaccactaccactaagagcgttgccacaattcgcccaacctccaccaaatgtaccggtaattttggctcgtttttttgttgcttttttttaattcccgaatgcttttttcaggccgttcgtgtccaaccagttcaacaaccgataccactgagagacgtgccgctatttgtcaacccaccaccaaatgtgccggtaattttggctcgcttttgttactttttttcaagatcccgaatgcattttttcaggtaattcgtgtccaaccgatgcctcaaccgttgccgctgagagacatgccgcaaattcaccatccaccgcgaaatgtgacttcaatttggatcaaattgtggttgctttttctcagtctctgggtgtttcttcaaggcattcatgttcgacaaattcaacgggaatacgccgtaccgcaatttgcccatccgccgccaaacttgccgtatcatccaccagaaaacgttccgggtagttgggtcttgtttatcgtgcgtttctcatattttcggatgtttattcaggcaatccaaccacggcaacgaccgcgccagctgagagacgtgccactattcgaccacccgtggccaaacggacaggtaatttcagaccctggcttctacctaacaccgaaacatcttttcttaagcaaatgcatgccaaccccccgagagtgctggaagtgatccgacggctgggcgagtggagaggaagaccaagggacccaagacgtccgcctcaatgaatgaatggaatttggattttgataaaatttgttgttttaattttttgaattgataagggttaaatcccgtcacctaaattgtttcaaaattattaaaattttaagaaattagatgctaaacctaacctttgacatagattatgaaaaaatgaaaagaaatgacgaaatttttggaatgttccttctttttattatctatggattttttttcatgtgcattattttggtgctagtaagatattgccgaatgaattaattggttttttctcttcattttaaaacatttcacgtccccatgccctgcccacttcccgcggaattgatcaaggaaataattgacgctctcccccctccaaaaacacatcggcttttgcgcgtaaattttgttttggcatactttgttaaatgtcggttttattccatgatgagaagattgtttcgcccagagcatatatcaataccaatggcccgaagaactggaatttatttctttttcgatgttcatactccccctatttattttccactctaccaataataacatttaaataaaattataattttttatttcttatctgattaatttcgatcaatattttttgataattaaaaaaaattgtatttttcccaaaagaattttctcgcagtagcaactcatcggcttttttttactcccttcataaaatgtctcgcttttgccctatcgcccaaatcaaggaatcgggtcggcttaacacaccaaaggggaaatttagtgagttccaaacctaccaaattaaataaagaattttgataatcgttttaggtcttttttacgctctggaaaatgctcgaaactaccaacttatggggaaaagcataacggaagataaatttcgttatttgatgaaaacggagaagaaacaaaggcaattggccatgtaattgatggaaaaggcagggataagcacggatgacaaaacttttggtacccaacaccttgaggctgtacaaaaatactgggacagggaattcccggatatgtttcgcattgtggcttttgaaatggtaaccaaattagcttgaaattaacccattttttacattttttttagaaatttggacttaggccaattttcaaaggggaaggtgttcgaagaaatgaagtgggtgtgataagagaaggaggccattgggatgggatcaaatcggcttcttggttttttggtgttcgatacttctgtgtcagctgtgaagtaacatttgatggtccagtccgccatagtctcatatgtaaggaacgctgcaaaaaatgttgtcggatggggttcgggtttccatgtacggatgtctgcgatgagattcactgcggcgaatgcaatctcaagttttacaacccggaatgttttgaagcgcacaagaaggcggcctgtattgagtacaagaaatgtgaaaaatgcggagagacacacaatactcggaacaaacacacgtgcggcgaaaagttttgcaaactttgcaaagtttgtcacccagggcggcaatgtttcatcaaaaaaatacatgtgcgaccacagaaaatgtatagaatagtggcatacgacctggagacgactgtagaggggggagaacatcggcctaatcttgttagtgcggcactttcttgcagcatttgtgcgggagaggagcgggaatgtgatatttgtgaaggccccaggaaaatcacatggtcggtagcggatggttttgacccaatgagcgagtttgttgtttgggtaatggggtttcaacgatttgaaacggttgcttttgcacattatgctgggaggttcgattcccactttgtcttgtccgagctaacgaagaaggaaatcgcaacggagttgatgatggcggacctgaagatctatcaaatcaaagcaggaagggtgtgctttcgggacttttggatgctcagtcaga

SEQ ID NO: 56528 - DNA, 790 bp, Heterodera glycines
  Genomic contig location: Contig_ID=SeqID_25787; Location=170..959; Strand=-
  SCN-specific regions: Sequence locations=1-208,231-790
atggacacaaaattgagcattttggccaaggaattgcccaccaaaagggaaatgttcgaaaatgccaaaattggagacatcgaattggccacatttatgctcgatttccatgccgaattaagccaggcggggcaaacaaattcatattgggcaaatgaatcggaccaaactatggtaagcataagcgcaattaggaaataaatctacgtaataattttttaaattttttacagaaggactatctgcaaaaagcggaagaattgtttcggttagcaaatgaattgataaaaccgttgaagaaaatcgcaggccaacaaatggaagaactgattaaacggttggaacccgaaattagcaaactcattagcctaattgacgaccaagaaaactcagaggaactgagtgaacaattggagaaaagagtggacaaaatcaaagaaattggatgcaaagcgatgggaattgtgctgacaattgacacgccaaaaaaagaggaaatttgcaaaacggtggaagaaattgaaaaagtgaccaaagaattggagaaaaacacgggaaaaagcgacaaagtgaaggccaaaatgagaaaactgaagaaattgttggaaaacgacaacaaacaatttgtggagcgaccgtacaaaatggaggtgagtactgtaagggcacatactgtgcaaaaagattttgttgaaaatctttcagttgttaattaaacttagggaaggcattaaataattaggaagttcaatttttaaataaatttcagcggaagaggaaaggcatttaa

SEQ ID NO: 56529 - DNA, 530 bp, Heterodera glycines
  Genomic contig location: Contig_ID=SeqID_25787; Location=856..1385; Strand=+
  SCN-specific regions: Sequence locations=1-84,106-249,280-530
tcgagcataaatgtggccaattcgatgtctccaattttggcattttcgaacatttcccttttggtgggcaattccttggccaaaatgctcaattttgtgtccattatgcgatttttcaaaatctgcttgattcttatcaccgccccgtcttttcctttttcacggcttccaattctttttttgccatttccaaatatttcacctcacaaaatgtttcatttttctttataaattcgatgagattgcccaatgtttgctcaatttcatttttatttttcacggacatttgatcaaccaaatacgcctcaacttcaaccaccaaagtgtcaaattgccttccaaactcattaatgattgcccgcatggacgacagcaattcggcgttactaaagacgggaaaaggtcaaatttggcatcgctttccgccggcgttaggccgtggaaaattttaacgcagaaatcctacaaaataagaatgccaacattaggaaaaaagaaaaaactatgccagtttttgatttattcctttt

SEQ ID NO: 56530 - DNA, 645 bp, Heterodera glycines
  Genomic contig location: Contig_ID=SeqID_25787; Location=1124..1768; Strand=-
  SCN-specific regions: Sequence locations=1-50,72-370,393-645
atgaaacagtttttatttaccttttttaacattttaattttttcattttcatcgttcaaattttccgtttcgacaagggacgaagaatgggaaaaatgggaagaatggaaaacacaaagccaagaaataatcgaagaaattcaaaaagtgcaattggaccagaaataccttctaagaatgaatatcaaagtgagcaaattaccgggaattgttgccaaatttccgataaacgaactgaaggcaaaatgcaaccgccgcttgtgggggccagcgaagcgagcaaatgccatccattttggcaaacagttcagttaaaggggcttagtaacgtataaaactaaacgtaatactgctgctggacccatcctactttaagacaacaaaaaaggaataaatcaaaaactggcatagttttttcttttttcctaatgttggcattcttattttgtaggatttctgcgttaaaattttccacggcctaacgccggcggaaagcgatgccaaatttgaccttttcccgtctttagtaacgccgaattgctgtcgtccatgcgggcaatcattaatgagtttggaaggcaatttgacactttggtggttgaagttgaggcgtatttggttgatcaaatgtccgtgaaaaataaa

SEQ ID NO: 56531 - DNA, 1266 bp, Heterodera glycines
  Genomic contig location: Contig_ID=SeqID_25788; Location=756..2021; Strand=+
  SCN-specific regions: Sequence locations=1-294,316-751,774-974,996 -1008,1033-1083,1163-1169,1226-1266
atgggcttctacagtttggtggaggacaaactgatgaaagaaatcaatgggttgccaacattatgccaaaattttttcaaaaattttttggaaaaaattgatttcaaacaaatgatggacgatttgatgcactatcagcagattagagcgtcacttaaacacccaaaaatgaataaaattggcgacacagtaaacatcaaagtgaccgtagtccaacaactggcctctctactatattatggactactgtatcaggtaagaacggtacttagtagttggtataaaacggaatgaaattttcttaaaatttcaatcattgtgggttcagggtgactgatcataaagttaaaatttatttcagcattctgggacccaaatgaattaagtcataaagttgggatttttcgatttgccggtttcacttgttgtattgtcaagacatcaacaaaaatatgggtttcaagccatttttaagtggatttttcatcccaaaaatatatttttaactaagaaaattttgcaaaattcgggggaatttttcgttgatttaatgaaaaaaaaaaaagttcaaaaaggaatttttcggttgaatttttactaactgttcctaaaaattttatgaaaaaccccaagaaaaatttgaatattataatacaattttaatgcaatttattggtgattttagaaagttttcgaaatatttttgtaaataaaaaaaactattatttctccaggcactgcttgacgagcttaacaagccaaaaaatttgtcaaaaagggatgccgcaaaattttggatcaaaaatttcctgattttttcactggctgccattagagcagagttcaacatggccaaatacgagatggagaatgggttggatgatgacagaattaatttgctgccaaaattttcgattggacggcattacaatgaaaaattggcaaaaaaattggcggaatggaccgacagaatgcaaaaaagacaccaaacatagtgcaaaaaaaagctttgttattttatatttttgttattttaggaatttgaaaacacaaagattgctgaaacttctgttactttaaacctttaaaaatgataaaatttgtttttatacaatttaaaatatgcaaaaaaaaaatctttttatatttttttaatttataaggcaagcaattaatatagaatttataaaaaaattcattattcagaaaatgattattattttttgcaaaaaatgcaaaaaaatttgcaatttaagttgttttaaa

SEQ ID NO: 56532 - DNA, 1049 bp, Heterodera glycines
  Genomic contig location: Contig_ID=SeqID_25790; Location=26..1074; Strand=-
  SCN-specific regions: Sequence locations=1-140,163-542,567-922,945 -1049
atggtcttttcccgagacaaatctggattggcaaagcaaatgaacagcttatctgcaaaagcaagacgaaagcggaaggaatggcgccaggatcgggctcaaaaaggcggctcgacgccaaaaagtgacgaaaattgaccaaaattaattttattttaaaaacactgcattttttaggtctaaagcagaccttagccgtgccaacagcagatggagaggagacatcgacccaagccgccgaaagtggaccatcaacgtcaactttggaccttcgtaagtcaaaaaagtcactattttagaagcaaaaattaaattaaggcccgcgttcaagcacaaggccattgtcagcgactccggtcaggcaccatgtgcgtgtccgtccaaaaactaccgacaaagcaacaaatatggactttaaaactaccgacaaagcaacaaacatggactttacaactaccgacaatgcaacacacatggatttgacaacgatggacaaggcaactgacgtggacttggcatatgaggacgccgcgacacaaaccgagcagttggacaaacagctgaaggagcaggaacaaacgatcagctttctacgactgcaggtccgcaacagagacgcaatgatcgctgatctgcgccgtcaattggaacagcaggcgcagaaggaccagccaacacgtaaaattctgcagaatttttaaagccatttatcatccaaattgtttttagcttccacacggcgcaaaaagaatgctgctacattggagcagacctcgcggcgaaatctggccaagaaaatcgctgatgtgatcgatcgagatcggtcgcggtcagtgagccgatgttcgctgcaatctctgcatcgtgaagtacgtcacaaatttggacactacacaccgatgaagaaggaacaactccgacaacaacaaacaatccacgaagaagatgggctgtttttgctgtcacagctcgggactcaaaaagcgtatgagaggatgaaggcactcttgcgtcttatcggcggaaaatttgatgtttacagaccatga

SEQ ID NO: 56533 - DNA, 904 bp, Heterodera glycines
  Genomic contig location: Contig_ID=SeqID_25793; Location=118..1021; Strand=+
  SCN-specific regions: Sequence locations=1-269,292-305,327-456,493 -628,650-682,752-904
tttcgcttaagtcagacgcggttcctaacgtgggttatccaaacgcaacaccaacgccattggacaaaaaagcaaaaaaacaaaaacggcgtaatgatgggaattcggctattcatcaaacggtgaagcaaatgattgttggggaagtcgcgaagggaaatggcgtaagtaaagcgagaatttttttattatagtaaaacagcttctaattgagctaattagtcgttttctgtttctttcgttttgcacagattgccgccagcaattgctaaagaaacaatttccatattttaaaaatagcgattcgtaaataattataaataaattgatttgttgatttcaagaaagcaaatcgtcataaaggaaaacgaaaagttactttctcatctgaaagcagtgggaacgaatattatgcggacaattccgaacaaaagtcagaagttgtaagaaagggtgagttgaattttttgaaaaaataagagttcaatttaattgaagaatcgaataaacgcatgaaaatgaccattgaaacggattctgacgcgacttcgaccgctgagggtcttacaaaaaacgactaattattcacatagcaaattgtgtttaagatttgattgctacaaatggacagttttctgaagacagcatggaaaacgaggaagaaagccttgacgatgatttggaggaagaggaagaagaaataggggaagacttggaggacgaagaactcgaagaagcagacgacgatgaactgagaaatggcaatttggaggacgaagaggaagcgaactcttcttttttcacgtcagacgacgaatcgcttgaagacgaaattggagaggaatcgggagaaggtccaaccaacccaaccattttaatcggattgaattactctaatgtttag

SEQ ID NO: 56534 - DNA, 769 bp, Heterodera glycines
  Genomic contig location: Contig_ID=SeqID_25794; Location=658..1426; Strand=+
  SCN-specific regions: Sequence locations=1-133,155-189,211-264,295 -512,553-581,636-673,746-769
atggccttaaatctgacctatcttttaaccctgagcttgtactgctccaactccatgcatgaagttggagctgtacaggtttgttgagaacccagagaccaaatctaaagccatattcggactcagcgtggtcaatttatttagtttaattaaattcggaatttccaaaaccacttttaaaacattttgttatttgatggtcttgaaaaatgccgtttttggagacatttttagactcggccctccaataattcatttttgaagtaataaaatttttttcttataatttttatagtcctaactttgctctatttactcacgttttctctgcctctgtatctcttttcattttctttaaatcagccatcaaaaatacatacctcgaaaatgaccatttttacattatcaactctaactccttaaatacttttctaatgggatttatcccttgcccaataaatagcaaactcattctcaataataatgtcagatatttcggatcatgattgtggttttttaaatttatattcataaaaaaattctttaaaaaaagtgtgcggaaacttatgttacaccctaagtaaaattattataaaaactttatttactttcttaactttttatttaatttttatgtccttattattttaggtttttgaatttttctttgctgttaaaatttaaaaaaagattttaactttattgaattatcacttttttatatcattaatttattttttaaattggaaataattacttgtttttttta

SEQ ID NO: 56535 - DNA, 1835 bp, Heterodera glycines
  Genomic contig location: Contig_ID=SeqID_53; Location=277..2111; Strand=-
  SCN-specific regions: Sequence locations=1-17,116-126,503-662,684 -831,854-899,921-1021,1046-1106,1129-1154,1210-1243,1266-1377,1399 -1412,1448-1529,1551-1589,1621-1718,1741-1835
  Gene Ontology: Mol. function=myosin light chain kinase activity; Biological process=N-linked glycosylation
aaaatttgaaaaaaggaaagaagaaaaagaagtgaaagtgaaaaggaaaaagaaaaaagcgaagcaaaaaaagcaaaagaaagcagcagaagaaaaagaggaaaaggaaggggaaaataccgtaataggggaggagagagaggaggggacgaatacggtagaaaaggatacggtagggaaggaaagtgatcagaaagaaggaaaagaaaacgaggaaagaaaggaggaaaaagcgggaaaggataaggaaaataccgtaataggggaggagagagaggaggggacgaatacggtagaaaaggatacggtagggaaggaaagtgatcagaaagaaggaaaagaaaacgaggaaagaaaggaggaaaaagcgggaaaggataaggaaaataccgtaataggtgaggagagagagggggggccgaatacggtagaaaacgttacggtagagaagggaagtgatcagaaagaaggaaaagaaaatgaggaaagagaggaggaaaaagtgggggcctattcagagggaattacggagattggcgagaataatttggtcgaaaataatcggaaaatgaaaatgagggaatttggcgatggcaaatttttggcagcgaaatacgacgaatatttggagataattaacaaagggcaacaacaaaatgagcagcacacagaagaaatgggaaaaagcatcgcattgctaaacattggcgttttgtctaacgaaatttcaaatcgattggaagcgaaggaatgggaggcaaatggaagccaaaggaaaagcattggggaacagtgggagaggctgaaaaggacggaatattcgcaggcagagagagagggaaaggaggaaaagcatttggaaaagatatgccaaataattggggaaattgtgggggcaatgggggaaaatagggaaaaaggtggggcaaaatgtgaccaaataattggacaattgcaccagcgaaaattgggggaggcaataaaagagggaaaagtgaaaaattgggaagaaatgggcgaaagcagcaaaaagatggcacttttgaacctttataacggcacaatggcagagaaaaaaagtgaaacaattttagagaaattcgaaagaaatttggaatttttaaaaagggcggaggcacagcgaaaactgggtgaaaattaaataaattaattaatgaatttaaatttaattattctattaattattaaccttagcgtaaattaaaacccaaaaaaatcagaccaaaaattattttatgaatacaaaaacaatgcgaatttaacaacaattgccgaagagaaggacaaatgccaatttaaagagaataattcacaattattccaaacagaaaaattccaagaattaaattcagcggaagaaaagaagagaaaattcagagaaactgaaaaagtaataaaaataaagaaaaataaaaaattttttaaacatttcaggtgaaaaaagaaataaaattaaaaaacggacaaaaaaatggaagagaaatggccgaaataaaacaaatatttgacgaatgggtaattttaataatcaaaattgaaatttattaatgctaatttcccccccccccaaaaaataaaaaataaataaacaaaaaatttcagtccgacgcggcgcactttcaatttccgagtttattctttttgagggatacgcacagcaaatttgcgacaatttgcattttgccggaagaatttgaagaaaaattaatttttggggaatcgaattgtgacgaaaaaacggagcaaagagcggacaaatgttcagacaattcgcttttttgtgctctttgcaaagtcatggaaaactaaataaa

SEQ ID NO: 56536 - DNA, 2151 bp, Heterodera glycines
  Genomic contig location: Contig_ID=SeqID_54; Location=2422..4572; Strand=-
  SCN-specific regions: Sequence locations=1-100,137-925,948-1178,1211 -1485,1522-1553,1689-1817,1852-2151
atgaaagtgtcgttaaatcacttgacaaatggcaaatacttaactttgctggaaaacgaattccccgaggttttgcgcattggtaagtgccaaaaatattttagacaaggaaaagtttctttttaaagatattttgacgaagaaatcggtcgtttatcgggttcaacaaatgctgatgaaccgaagcaactccgagctgtacatcaacaactttgtgctgttcgtcacggcactgttggtcgaccaaatggcgcgtctccactcgcaatttggcgccaccgctcggcccaaagcgtcgcccgcccttcgcttgctggcggacaaagcgaatgccgcggcggaagatgccctccggcacttcggctcgacttcccaactgtgcgtaatgaacacaattttgatctttgtgtgggaagtgaacattgagaaaaaggcggaaaatgtgacgaaaaaagcggtgaagaaattggggacgagcgaatgcgaagagtggcgagtgcagagacaggcgatggccgaggcgatgggcacgcgactcggcactctgatcactgctgcgatcgccgagctgttgatgatcgacaagaccaaagtccaatcggcacttaaataccccggggcacagatacgccttttgcgattggccggcacagtgaaaaggacggaccaactgacggaacatttcgatttggcacaactctttgtgaataatggtaaaaagtcttttaacaataaactatgatcattcgcctttctcagcactcaccaacgatgatgatttctgggttcattatttgcaagcgatgtgccgagccgacaaaatcgagcgaaaaagtcacaaatttggcgccgatttggcggcgtttgtgcgatggcttcggcagaaacttacggtcgaacgccggctcaattctcactttgtgctgatcagaaattacatttctgatcagatttataatccgatttttgacgctgaagaaacgacgctaatgggcggggaggaatttttggaaaaattattttgggggacgaaaaaaatggtggaaaaattaaaagggaccgaaaaaaagagcgaaaatttattcgaacgatggaaattaattgccgaggaaaaaaaagaggcgaaaaaggcaaaaaacggcgaatttgaggcaaagaaacggtgggtgggccaaattcacgcggaggaaatgagaaaactgctgaaaaacggaaaactgagccaattgagcgaaggtaagcgaagaacaaacggaggagggaaaaacaaaaataaaaaacggaaaataaaaatgggaaaaatggaaaaacaaatgggaaattccattttgaaataatttaaccccaaaaaaaacgatgatggataagtaaaaataataattatagtcaataaagcatttccaaattaagttctgaatgtgtttggctccaaaacaattcgcgaaggattactccaattttttgatgtcaatgaaatcgacgaactttttaaagattttaaattaaaagaaaataaaaaaacgcaaattgaaaatttggaggattatttcagtgaggacgaagaaagtgaagaaatcgaagaagaatttgagcagagtgaagaagaattggatgaagaagacgaagaaggagaggacggaagagaagacgaatttgaaggggacgaagcgccaaaaaaacaaaaagaaattgtggcaccggagaatgccaaagaatgcgcaaaaagaatgagtgatcggaaggagggcgaaattttggaatgtgatcagacggaagacaatgcgttggccgatcaccgccaaaatgagtggcgttcggccgttccctccccctcctctgccaatgtttccgctttttctgttttgggtcagttcaaaattgtgtcttcgctttaatccgccgttgcgattccttctcagatttcgatttgctttctctgacggatcatttcgtcaatttgttttgccaaatggacgacgatccgtcgcgactttcgaagatcggactaatgagaaacaccgaaatgagagcgatcattttctattatcggcactgcgttgacggactgttcaactttggccagttaaagtgggaaaatggcattttcaatgaatggattggcacttacaaaaagaaatgggacaaaataaa

SEQ ID NO: 56537 - DNA, 1009 bp, Heterodera glycines
  Genomic contig location: Contig_ID=SeqID_54; Location=6902..7910; Strand=+
  SCN-specific regions: Sequence locations=1-158,192-245,274-309,332 -341,371-1009
  Gene Ontology: Mol. function=cystathione beta-synthase activity; Cellular component=cytoplasm; Biological process=cysteine metabolism
atgtcttctccaaatgacgtcgagcaaaatgaggaaaaagggccaatgaaatgccaatcatttcgatggcattccgatggggcggaggacgaatatggacgatatccattcactgaatatccgtaaattaacaaaataagcagattaattatgtgaacttatttttagaaaaaagcgccaaaaaattttaagcacagttttggaagcgatcggaaacactccgatggtaagggaaaagcaaagcgaaatttaaaaaagaaataaaaataaaatgctttttaaaggtaaaactcaacaaaatccaatcagaatttggcattgagtgcgacatttgtaattcgattaaaaacataaaataaataaatccaaatattaaattactttcaaagattgcaaatgcgagtttctgaacccgggcggctctgtgaaggacagaacggcacttcggctggtcgaaaatgccgagagagtgggccgacttcgcgcgggaatgaccgttattgtgcccttctcgggcaatgtcggcatcggagtggcgatggtttgtggcgggcattagccaaaatcccttcgggggaaaatggcacagagaaaagtgtcaaaacgaatgataggcgaaaggagcagcaaaagttttatatacgtgactatttttatgtgtgtgctatccgcggctatcgctgcgtcattgtgtcgcccggggggacggcgaattggcaaatcgaattggcgcagagagcgttgggggcgcgcgttgcgagagcggacgacgccgcgggggacgacgaggaaaagtgccgaaggaaggcacggcaaattcagcagggcattgtcaattccgttctgttggattatgtccgttttggggaccaaaagaggggagagattaattttccaacaaatatactgcagaacgaagccggcaccgcaatgtgccattttgacgggacggcggaagagattttggacgcgttggacggtgccgtcgaaatggtggtgatcggagttg

SEQ ID NO: 56538 - DNA, 836 bp, Heterodera glycines
  Genomic contig location: Contig_ID=SeqID_54; Location=4778..5613; Strand=-
  SCN-specific regions: Sequence locations=1-51,78-272,295-327,357 -784,806-836
atggtatttgaacaacgaacaaaacaaacgaattttgccgcaattaatgtcaaatttttatttattttaatttttttgatttgtttatcaaattttgtgttaagcggcaaaaaccaatggaagaagcaaaacaaattggaagaagaaacggagcaaaaaacgctgtggaacattccgccaaaacaaaaagtgatcgacgaaaggcaccgatgccccgaaaaagaggggaaaaagcgaacggaaaaagcgacggaagaaaatggtggcatttgaattaaatttaaatttaaaaaaggctttttctatttttagacgacgaaagaattgaattaatgaatatttttaaaaattttattcgcaatgagagcaaaaataagagaacggaaaagttgaaaatgcgaatcaattcactaaaattggttttggagcggacaatcggcggaattttggcatttgcgcgaaaaattggcacaaaaaatgagcaaaaaggggaatttattgaggaaattgaaaaatgggagaacaaacggagagaaattgaggaaaaagcgggccaaaagaaaatggacggcaaaatgaacaattggttaatgtggatttgcttaatgtacgaattgggcacaaaaatggtcgaaggaatggcaaaacacgcggcggcacaaaaaggcagcttaatggtggaagcatggagaaaatacgcgaaggaaaagcacatcgcggacattctcaaagtgggagggggaaatggacactaattggccaaaacaggacaaaaaattaaataatgagagttaaataggttaattaactaattgtccaactgccaaattaataaa

SEQ ID NO: 56539 - DNA, 1867 bp, Heterodera glycines
  misc_feature (1666)..(1666): n is a, c, g, or t
  Genomic contig location: Contig_ID=SeqID_55; Location=1..1867; Strand=+
  SCN-specific regions: Sequence locations=1-166,188-394,424-461,483 -776,798-1236,1259-1355,1377-1440,1462-1867
  Gene Ontology: Mol. function=cystathione beta-synthase activity; Cellular component=cytoplasm; Biological process=cysteine metabolism
cattgcttttcatgccatttccgccgccattggcggcacgcctttggtcaaattgcagaggctgccgagggaagacggcattgaggcggaaattcgtaatgaatggcatataatcaaattggggatgtatcagtcaattactattactaattgagcatcgcttcagtggtcaaatgtgagtttttaaatgccggtgggtcggtgaaggatcgaattgctcgtaaaatggtcgaattggccgaagcgaaggttggcaccccaattttttgggaatgtccgtcccgatgggtccgaattacctcagggcattctccgtgccggccaaagtacgatcattgagcccacctcgggcaacacgggcattggcctggcactgatggccgccattcgcggctaccgctgtatcattgtgatgccggagaaaatgagctgggagaaggagtgcgttctgcgcgcgttgggcgcccaaattgtgcggacgccgtcagagaagggatacaccgatgcggacagtcacattggggtggcattgcggctgcagcgggaaatccccggggccgtcattttggaccaggcaaaagaagcgggtggatggggaaacacgccacgggggagggtaacatccgcagaacagtaagtaatgcaaatagggatacggtatcaaccaaatagggatacggtatcaaccaacgaaaaatgatgggaaatggcacgggggagggcgaatcccttacagtaaacgaggatatataggcaacaaaagcgaaaatattagatacattaaacagagtaatttcagtacaggaatgatgggaacccactcgcccattatgagggaactgccgaagaaatcatttgggcatgcgatggcaaattggatgccgtggtggtcggcgccggcaccggcggaacaatgacgggaatagcgaagaaaatgcgacaaaaacttccgaattgcaaagcgagtcataattaaatgcattcatttgagtttggcaatgctttcgctgttatgtattcccttttagatcattgccattgatcccgagggttccattttggccaatccgacaaatcgccaaacgcacgcctacgaagttgagggcatcggatacggtagctcaaacgatgcattagcatttgtgccacgaaattttttgcacaaataagcaccaccaacaaatttataattatctgaagttatgcagcgggggattttcggggtaataattatgaatttcacaattattggcctaaatgggaggctatgcgatcaatcagttagttaattaaaggccatttttaccaagtgtccaattgtcccactgttttttgtctgattttctccctatgccttcccttttccgccaaattttgctgttttgccggttttaccattgtttaactaatcaacctaattccgttctaataattacggcaattagctttgtctgttcctttgacttttttcatgctaattgtcccttaaattggtccattctttgctcattttccctcttaaaaagactttgtgccgtacaccactgatcgcaatttggtggacgaatggatcaaaacgaatgatgcgaatgcctttcgcaccgcgcggcgactgatcagcggggagggattgctgtgcgggggttcttccggcgccaatgtttgngcggcgatggaagtggcaaaacggatgggcagagggaaacgcgtggtcacaattctgccggacggaattcgaaattacatgtgagcaaatgaagagaaataattacaattgttaattaacataattaggagcaaattcatcgacgacgaatggatgagagttaagggatttgaaggaatttgaaaaaggggacagaaaaag

SEQ ID NO: 56540 - DNA, 1190 bp, Heterodera glycines
  Genomic contig location: Contig_ID=SeqID_45; Location=823..2012; Strand=+
  SCN-specific regions: Sequence locations=1-147,169-1082,1104 -1133,1156-1190
atgaaagtatttactgttgggctggaccagaaaccgccgctggaggaggccaaggggagtccagaaaaatcaggtaaaacgagcagatagcaaggagcaagcagaacatgatttttttgtcatttcaacaagaaatttcccaattttctgaaatcacaaaatcttcgaaataaccaagaagctctatcttattcgccttcaaaattttatttatgaactcctatttaatccaaattcctaattacggtgtccattacaatacctaccgtattcatttggactccatttctccctgtctaattaattttggctttgattatctgaagtttaccatttgctcaaccattagacacgcctccgccccgctactccaccaccgaggcgcgcattccgcttccgctcgggccccaactgccgcgtccgccgttgccgccccagccgattatcatgcgcaaggcgcgcggctacaaaggcattctgttggtgctgatcgccgtctttttgatggcagcttttgcgctcactttgtccgaaatggcgtacaacagacaacgcgaggagaacttcttcaagctgcgctggtcagtcaagtaaagaaggaacgattctgagcttaagcagttttttttgtcagtcaatcggtggcaaggcgtacaaagcataaattgactaaatgattgggaaattgagagagagagagagagggacggctaaatgttttatgaaatgccaacaaactcttttggcactgtttcaatttgggcatttttcagtagaaatggcttatcatattttgtttattggtttgatattgaatcggtcttttgcttgagcggatcttcactaaattaaacctacttcgaatcttcgtttctttaggcttaagtttcctgccgctaaatttcatttgatggttttttatctcactgatcagtttatttccgttttgaaacaatattggactgatcattggattagtagggctcggatttttaagcgcaacaaagtctaaaataaggccgtaaataagggcgaaaaaatcgcgaaataagggcaaaaaagttccaaatttaggggtatacttttttaaattgctgttttttatatgaaaataatttcagattaaggcaaacaaaatattttggtcgattcttaggggtgcatttttcgtttttattgcatttttgtta

SEQ ID NO: 56541 - DNA, 555 bp, Heterodera glycines
  Genomic contig location: Contig_ID=SeqID_46; Location=11..565; Strand=+
  SCN-specific regions: Sequence locations=1-140,163-304,355-410,432-555
atgggctatgaaaacgccggtccctacgactattaccatcgagcatcatcggctattggcgagaaatttgacagattgttcagcctagcaaaaaggtaaactgacttttaattgtttttttaataaaaagtttgctatctgggttactgtaactgaaatttctgtaattgacaattgcatgtaaatgacttaaatctctgctggtatgtagcgaatatgcattgaaaataaatattttcataatcctttggggaaataaaacacagaaaaagagagtgtggcataaaagttatgacaacatatcaatttataataataacctataaaattttaagcttttttattttaatttttgcagtaatgaattgccaccatcgctgcccatttcggcgtccatggaccgcgacccgtccaccaccagcacaacatcggcaccggcacaaccgtcagagcccgtggtggccatcgactccttcccgcaatttatgggactcaacggccgcagagtgcaccagccatttggaccccaacaaaactccgtggaggtgtgaaata

SEQ ID NO: 56542 - DNA, 1278 bp, Heterodera glycines
  Genomic contig location: Contig_ID=SeqID_46; Location=715..1992; Strand=+
  SCN-specific regions: Sequence locations=1-378,400-589,612-645,678 -906,928-1014,1068-1122,1150-1236,1272-1278
atggagcaaccgatgccacaaatgttcggcagcaacggcatgaccaacagcgggccgttctcccaggtgcgcgacgcacgactgcagtttttgcgcaacatcctgcagaagatcaaacagcacgcggaggacattgggtaaagggctgcacgagcgtacggttgacagttgggtctaccgtacccatttgctacttactatacatactgtggtgcatttgagccgaacccgtataaataatctgtttatgattataaatgatcaaaccaacggcccactgttgtattcattttggatacacacgcacaaattaccatgaaaaaataaatgatattaaagttccccttatagaatacagtattttctacaaaatgtaccatgctttgtgtctcattttgacaaattttccacaaaaaatttaccgtatctcacttcaaattagactaatagatattttctaaaatatagaattaagcacgactcttttaatttaatttgcagctttgacggcaccatgcaagtgtccatcattgaggtggagccgcaaaacggtgccgacggcgccgagacggctgcccaagagaacggcaacattaacaacaacaacaacatttggggcccgcaacaacgtggcgtcgaaatgggccagcagccccagcaacagcaacaacagtcactccccgctcagatggcatttccgatgccgcaacatttcttcccacaccctcgcccactgattgacgatttcaaggtgggcagggcatcatatagccattggcaaagatttttgccaagttcatcggaggatttttgcataatttcggaaatgcactatttcaaattttggcaaaaaatgccattttttaatttttaggttctatatactgaattttaaactactccaatgaaatgaattttttaatgaaattggtttaaaaattgaaaaatagataaggctttatattttatagtaaatatgggacagaaccataaaaatgcaaatggtccatatacaaaaaataaaaaaaatgttaatgaatttgagaattatttattttttattttttgaagaattcgcgctcttttctcgacggattcggcgagttccatccgcccagctttgtgcaacagcagcagcagcagatgaacaatcatatcacggagccggaggagcgaccgcgcatgtttggcccatgggcacagcagcagcaaatgccgaatatgccggacgagttccaacaacagcaacagcagcaacaacaacaacaacagccgaat

SEQ ID NO: 56543 - DNA, 689 bp, Heterodera glycines
  Genomic contig location: Contig_ID=SeqID_47; Location=31..719; Strand=+
  SCN-specific regions: Sequence locations=1-77,140-166,191-325,434-689
atgaacctccgcttcccgcccattcagcctccacaggtgtccatcacaaattgccacgctttatcatttcaattctctaaaaattattaaaaaaatgttttaataattatttaatattaaaatttaaatataattaaatgtcataaaaggttaacaatgaatgggcccaacaacagcaacagcaacaaaatgcgttgcagcttcaacaaaacggggccgctgcgttgccgcgcccggccgcgttcgaccgttggaacggtggcccaccgccatcatcttccaacaatggttttttcgtgccaccgccgccgtcgccccaattcgcgcaacaacagcaacaggagcagacggagcagcaacaacagccgcaaccgcaacaatcagttgtccagcaacaacaacaacagccacagccgcaaccactgcagcaacaagttgtgtcgggcggggattggcattcatttttagccacaaaaactcaatcgtccaaagaattgaaacaataaattttgtccaaatttaccttgaataatcgggccgtttcaatctgtggtgccaattttaatagaaaaaacgctttgtagtaaataggcacttcagactctaaagctcctcagactgaaacgaactgactgaaatcggccagattcaaatgaccccatcgaatcttgaatactccaaatttaaaa

SEQ ID NO: 56544 - DNA, 2005 bp, Heterodera glycines
  Genomic contig location: Contig_ID=SeqID_48; Location=69..2073; Strand=+
  SCN-specific regions: Sequence locations=1-29,56-482,505-551,573 -715,737-888,910-956,988-1067,1160-1259,1302-1326,1348-1600,1623 -1787,1809-1914,1936-1951,1977-2005
  Gene Ontology: Mol. function=potassium channel activity; Cellular component=integral to membrane; Biological process=potassium ion transport
ctgacaagaccgaccccgacaacagcaaggacgatgatgataatgatgatgatgagaacagcaacgccaaccgtggcaccggcacaatgttcggcgccggtccgccatccgcccaaccgtcggacattgttaaatttcccactgtgactgttgttgaggcggcaaagaatgaacacgacgatgctgtggaggtgcatatctgattattaaatgaatgccataaaatttacgacgatttttccccgtttgccttaggcaatgatcgatgggtgccctggtgttaaacctatcgattattgttcgagagtcctggtctcgacttccttgatcgggaccgacactttttacactatcccctaaagaattttaagccgaaattccaacataaatttctggcacccgcttacatctcccctgctaattacttcgtgtacgggttccgcccccccccccccccctcccaatgtaattgcaaccggcaaacgagttcaaaaacctggacaggccaaacagcaagccgacaattgcaaaaatatggaaaaaaactattgaatacttttgcagccaattcccacctcgttgggcactgaacagccggcggcaccacccgctcagcccacgccagctgcggcaacacctcaagttcaagcagcgggtgcagctgtggctccctcccaaactgagcaccagcaggagaagaaggaggtgtggcatgtctcccatatacctttcatagataattaaatcgaaaagtaatgaactaattaacccagccactgtttcgctgaaagcgaaatttccgtgcactaatgacatggcttttcgttcggcttttctttaatcatgacgctaaaatattatgtttaaaaattgctttattgtttcatggaaaatttaaccaaattttttatttcgttcaattcgcattgaacttcgcccaatccctgaaaatatgattttctaaaaattcatcacatttcaaaaattaaacagcagtccgccgatgagttggttgaggtggacgcaccgccgcagccgattgtgccacaacagaacaatcagccggcgcaaccacagcaacaacagccgcagcagcagcaacaggaggagatgaccaagacggagcaggaacaaccgcagctgaaccagcaacagcagccatccccgcccggcatttcgccattccaacagaaatggttcccggaagtgccgtccgtgtttttccaggtattattttttgaaagggactaaaagatggcatttttttagaatattctttaaattatgtttaaataatttatctatctcattaacggatgcgttgggtgggagcaaatgaatgaaaaagagaagagggaaataaggaatggaccaccaaggaggaatgtaacggaattccgacatatttggctgaattttttttggggcacggaatttcgacttccagagagactacggtagagagagagagagagagtggaaagaaaacagacagtttaagtgtgtggcgtttaacgggagaaatagttaggcaaaacggtagagagaaaacagacagttagaggaatgccaactcttccgttaatggggtagcacccaaaaaataataacaatcaataatacaataattaattacctaacttattttatctttgtaaatctccgatccctaacacttaatttatcagttgataaatgcttgatcttaaccaaatgttagcaaaaacactccttaatttagtgctagcttagcttttttcgtgctaaaaatttgtcctaaaaatgcttttaaaaatttcagaaggacaattcaagagaagaaattgagaaaactgagaaagtgttcgagtcaatggtgcaaaatatgaagagaatgattgggaaaatgttcaaagtggacgattctgactccacagaaattgtccaggttaagatcaaacccatagaagcattttaattttattttcaaaaattctgaagaaaccttggattggccaaagataga

SEQ ID NO: 56545 - DNA, 501 bp, Heterodera glycines
  Genomic contig location: Contig_ID=SeqID_48; Location=2623..3123; Strand=+
  SCN-specific regions: Sequence locations=1-55,90-501
aaaaaaaataattttgtctcaaagtgccaaaaattgcaaaaatttaacccaccaaaaccccttttatattttgaaaatgttaattctattgttcaaccaccaaaatcacaccacagtaaatgtgtcaccgttaaagtgatatgcatccattccttcgttgaattctgtgttttttttttaaattttcccggatgctttggcataacgtcgtcccgtgttccccgtttgaaaatggaattgattggagctgatcagaagttatcagcagcaggacagtaaatccgcacattagctgctgatcacttaagactcggctccctctcccctcccccctgcttttgctctctgatcgcaccgttgtgagcctcgaccatataaattaattagcccataacacactcactaattgacccaaccaattattattgctcgtatatatatttggttattattatatttttcattttttgtagcataaatttttctgaaattattttaaaa

SEQ ID NO: 56546 - DNA, 62 bp, Heterodera glycines
  Genomic contig location: Contig_ID=SeqID_49; Location=265..326; Strand=-
  SCN-specific regions: Sequence locations=1-62
gggacccacgcgtttcggcgctcgcgtttcggcgctcccgtttcggcgccagctcgtttttc

SEQ ID NO: 56547 - DNA, 933 bp, Heterodera glycines
  Genomic contig location: Contig_ID=SeqID_49; Location=806..1738; Strand=+
  SCN-specific regions: Sequence locations=1-19,41-84,116-216,238 -461,483-501,541-610,633-650,672-933
atgggtcgaaatggatatcgggttcgtgattctgatcagcaaaacggatcatccgtcccgcagttccgtcccgggccggttccgtaaaaagtacatatttcaataaaaattttatataaaacaaagtacaataaatacacgacttgattgaagtttttggtgtacttcgtctttctatgacctttttacggactttattctcatcttctcacaatttgttttttcttcatttgtattatgtgaatctcttttatgcaattacggtttttgttttgtgtttgaatacaattctgacatgggttcgtccacgtcgcccccgcaaaatcagtattttttcttttcttgcatttataagattctgattaacaaagcatttttaaaatggggcagaaaatgcgacgacgacttaccgtattcattgttctggtcgtactgctcgcgtcatacggtgggtgctgacatttttgcacttgaatattattattgactctcagtttagagaaaaataaattttaatttttaaataaattaaattaaattgttccttcggcaggtgtttgtgcggaaggcaatgcgactgctaatgagccgacgacagtttcatcctttgacacaacgccaacggaacaaaatttggcggaagaaacgaaaagcagcgaaagcacaacacccaaaggagaagaagccgaagtgacaacagaagtagcagtaattaggaataataataatggaccaaattgttagttaattaattaatgccgaaaaattaaaattaaggcaaaaaatgaaacggaaatcggagatgacaataaatcggcacaatcagagcacgaaaatgagcatgagaagaagccgaacaacgaaatgagcagaatcaacgggggagacgaaacgaatgaaagggaaacgaataaaacggagtcagaggaaaag

SEQ ID NO: 56548 - DNA, 2790 bp, Heterodera glycines
  Genomic contig location: Contig_ID=SeqID_50; Location=25..2814; Strand=+
  SCN-specific regions: Sequence locations=1-140,163-277,299-566,597 -865,887-890,914-998,1020-1356,1395-1780,1803-1810,1833-2253,2320-2790
actttgacgggacaaattggcaacacaaagtaaagacgagaaagccaaaagtcccaatggtaaaaatgatcagcagaaagagctttttaattgttaatttagtaggcgaaagtgaaaaaaaaaaagccaagggtcgaacggagaaggggaaagaaaaagccattgttttcccaacagaaaacgcagaaaatggcacaacgccagccactccagaaaaggcatctttggcacttttccgagattaattacaatttaatttagcctaacattggcaatgccaacgaaggagaggaggagaaaatgccacagccggaacgggcacagatcactcacatgagccgagagggggacaaaatgccagagaaagaaaaagtgccaaattcaaaaatcaaaatagaaaattaaaaatcataaattaattaggcgaattccaactccgacactgctgaacaacaaccaaagcatcagcacgaactcgaaattggtcagttcagaagtccgacggcggaggcaaacgacggaagcgaaggattcgaagtgataacgcgagaagagaacggaggacaccaaacggaggagggagaagaggaacagaaggccaacgaaggcgagaaaatgccaaagtcaagtggaaatgccgaaaacacaggtcaaggagaggggactcagtcggctgcgaccaccacaacgtcggcgttggcatcgacgacaacgacaagcgaaactgaaacggcaaaacagacggagcggacgacagagcaaccacaatcgtccccaagggaagaaggcgcgggcggaggagcggccaacggacccgcggacacagaagtggacattttggcaccacggggaccacccgccgcgggtttgacagaaagacaaaaatggacaaattaaaaatatatattaattacagatgaaacagacaaagaaaaaacggaagtgccgttgttacccgcggaggagaaaccgtcgacgacggcaccgacagaacaaacgcaaacgacgccaaagacaacggaggcggaagaagaacaaacgacgccgacgccgacaacaacggcaatttcagcgggacatggcgtcgaaacggtggcggaagaaacttcggaaaatgcgcaaaaggaggcggaagaggagcaaacgcaacgaggcaattagaaacaatgaaaagcaattgaaattgaaatgggacaattgggtaaaaagggggggggggtaattaaattaagcgaagggtcattcattccgacaaaataaagacacataattaaactaataatggtaattaattaaggggatttgcccatcgacgagacgacaaaaacgaaaacagaagcagaggaggtgaatttgttaaatttaaataaataattattaatataaaatataatgattttgccaatttaaaaattcgttttccatttttcgaacgaaacgacgccaattccaacggcagccgaagaaggcgaaaagggagggaatgaagtgaccgaaaaaagcattgagcaaacgacgggacaaagggaggacgaaacggcggagaaacacggcaaaaacagcggaaaatggcaaataaaacgaccgttcgcctcccaattcagaattggaactcgcccgagccttccgcactcccttccttttgcgcctctccaaaatcgaatggcgtgccgaatttggcgatctgtcgagcggagcggcacggaagttgcaagagcaaatccgagcagatgtaaggcgattaaaccttcattttaactcccgccggaataaatccttcccatttctcagctccattccgcactctccgccgccattggtcccggctttttggactatcaaatcgaagcattgcaccaaggctcagtgattgtggaggggcaattgttgagccgagaagagataagcgatgcccaaagtgtggccatggccttggaacaggtgccattgagaagaatttgaaaataaatccgagtttatttggttacttcgcttaggcaattgtctcccgaggcggcgaattgggcggaaatgcggtggacacggaagggatcagtgtggcgggtaaccaactagcgatcatctgctgatcagcttatgattttcaaaattcacattttcaggccttcccgcccacgggccaaatggtaacggagtggcagcgaaccaaaggcagcaggaggaggaggcaagccaattcggaagcaaatgctcatttctcggctttgaaattcaggccgagagtaccggctacatcatcggtggtgccgtcgtcgtcggcgttctcatcgtcgtttttgccatttttgccattgtcgtttttggggtaagccatgggaagaacgattttgacattattccattaaaaagaaatgcttcattcgacagatgaacaataggcggaacaatggcactttgaaattgaaggaggaaatttgcatggtcgaaaatgggaaagggacgcaagcgacggggcaccgattcaccacaacggcggatggaaatggcgtcaatctgtacggactgactgaaattggcattttgagtgattaatcaatgctttagcaccggactgaggacgacaatgcccggcacggacagtgccaccaacggacaaagcatcggcggaaggctcaacggaatgaacgggcagcagcagccgatcatcctaagcggctcgcaattttccactccgtcggcgtacacttcagcgaacaacagaccctgaggggtggcgatcggatcgcccgctcggtgattgatcagcggattgtgatctttgaactctga

SEQ ID NO: 56549 - DNA, 304 bp, Heterodera glycines
  Genomic contig location: Contig_ID=SeqID_51; Location=183..486; Strand=-
  SCN-specific regions: Sequence locations=1-27,49-304
agaaagagacttaataacatccaattaaaaaacaaccatcaaaaacaatgaaattcacaaaatgccatcgctttgctcttctcctctccgtgttcatcggctcaatggtcgtccaacggcacagccaatgcaatgtaagcgaagaagcaaatcatttgccaacattgattgcccaaagtggaaatgccaatatgacatttggattttgattttaaataatgccatttgtttaggcgtatttgcccgtcgcgcaaacggattggcgcgcgcagaaattcacgccacggaacgtgcaccactcgtg

SEQ ID NO: 56550 - DNA, 923 bp, Heterodera glycines
  Genomic contig location: Contig_ID=SeqID_52; Location=359..1281; Strand=-
  SCN-specific regions: Sequence locations=1-172,255-261,283-418,440 -648,670-789,819-872,914-923
atggttttggcgcagacaatttgcatgggaaaactttgggaaggaagcgaaaaaaaacattcgcatggaattggcaatggccgtaattacgccgacattccccgagagaaatgttgccgaaaaagtgaacaattcgagtgcaaaagtcctgaaaaatgaactaaaaaaaggcaaaaaataaaaaatgcaatttaaaaagaaaataaaaattaaatcttttaattttaatacaaattaaaaaattattttttatagcattggcgaaaataagaaacaaaaaagacgaaaatgcgatcattggaccaattcgaatgaccaaattcagtgaaaaagtacaacatgattgctatttgctacattttctttattttttcattttcagtttgaaaatttcgtcgttttcaaatgctttggcacttcgtttaatgttaaaaacttttgcggatttgtcggaaaacgacttcgttacgagctgctcgaatttgtcgagaatcctttggccttttgggtcgatttttgccatgttttcccgaaagcgattgctttgtccaaatgtcagaccgatggatcgaaaatatgcgaattggcatggatcgtcggcattcaaatggcgcccaatcagaaggccaatggcacatttaagagaaaactgaacgccaagctgagcaagaaattggaagcgaaactccaaggggactttgagaagggatcctttcacaatattcagctaaaagcggaaatggcctcgggggaaactgtgcggaattggtaagaaaattcgaatttggcattttttaattgaaaaaaataataatttaggatagccaaagaagagagagaagaagatgaagaagaataatgcgattttgcacaaatattttatttgattattacaattattattaatttatttccacaataaa

SEQ ID NO: 56551 - DNA, 370 bp, Heterodera glycines
  Genomic contig location: Contig_ID=SeqID_572; Location=31..400; Strand=-
  SCN-specific regions: Sequence locations=1-370
atgttcgccgcgtcgtcgccaccgcccgacggcttccgtccgctgtttgcggaggagcgacgcgacgcactcaaagagcgaccgctgcgcttttggagggattgggacgagcggaggagccgaattatgggccaagggttagggcccaaaaacgcgtgggaagagcaaattcagtggacagagcgcggaatgatgtggccatatcccatcgacaacgattacatggcgggcgaggaggaaaaggtaaggcaacggaaggggaaaaggcgactgaattcgaatttactcattacccaccagtcaggtccatagccacggcgtgggaatcccccccccccaaaaaaaataagatttccaggaaaacatgtaa

SEQ ID NO: 56552 - DNA, 1245 bp, Heterodera glycines
  misc_feature (48)..(48): n is a, c, g, or t
  misc_feature (64)..(65): n is a, c, g, or t
  misc_feature (78)..(78): n is a, c, g, or t
  misc_feature (128)..(128): n is a, c, g, or t
  Genomic contig location: Contig_ID=SeqID_574; Location=1..1245; Strand=-
  SCN-specific regions: Sequence locations=1-153,175-508,532-637,659 -690,712-1245
  Gene Ontology: Mol. function=calcium-dependent phospholipid binding; Biological process=vesicle-mediated transport
ttggttctgcgctcatttccgtcccagaaactcgtcactttacgccangcacagtttcccgtgnngaacggaaaaaanggaggcaaaaaaacgcctcaaaaaaaagacaccgcccgccccttcccccntcaatggtcagctgcggcacattgcgctttctgctggctgagtgccgtcgtgagtacacttggctcgactttgtcggcggagggtacgcgcaaaaaacattttaccaattgtaaattaaattttattggatcgaaaagttacgctaattttaattgcgatttttgctgtcatttgggcaattgttaccatatatttaattgtccctaatcgaatgaggcgattactatcgaattggttcgttttgcacagaatgcaactcgagttcatggtcagcatcgacttcactgcctcaaatggcgacgttcgcttgccaaattcacgccatttcatcgaccatttgtgcctcaaccaatacgaaattgccattcgatcggtgttggaaatttgccaacattacaacgactccaagcagttcgaggcgtttggattcggcgccaaagtgccacccaatcagacgacggtcagccatttgttcccactgcaagcgaatgcccaacccgcggcacgtggcgtcgacggagtgatggacgcctatcggacgacgcttcaagtgggcgggagggcaaaaaacaaaatttttaatataccgtactgtaccgtatatttgacaccatttccccttcagagcgttttgctgtatggccccacttattttgagccgacggtgcgctacgcctctcagaaatgcgccaattttccacgcgatggatcacgatatcaggtgttgaaagttgtgcaaatttttgcacagatacagtacctattgggtcatgcaatttgttaggggtatggtaattgtaccgtattgtaagactcgtttatttacttatgtgctgttgccgttaagattctgctcttaatcacggacgggctcatttacgacatggtgaagaccaaattggccatcattgaggtgcctttctccgcccatttggatgccaatttgccacttttttttaattttaggcttcgtcactgccattgtcaatcattgtaagtgatcggcttcttgtcctggtccttttctcgacctgttctttgggattagatttcctttttcagataattggcattggtgacgaagacttttccaaaatggacgaatggacagcgacg

SEQ ID NO: 56553 - DNA, 1313 bp, Heterodera glycines
  Genomic contig location: Contig_ID=SeqID_575; Location=1..1313; Strand=-
  SCN-specific regions: Sequence locations=1-1266,1288-1313
  Gene Ontology: Mol. function=calcium-dependent phospholipid binding; Biological process=vesicle-mediated transport
tcagcccgacattccgcacacgcgggtggagttaatgctctcggccaggtgagtaccgccggagagagtacgaaaaagtggccaaaaaattcacagggatctgaaggacaaggatttgttgtccaagtcggacccaatgtgtgtgatttattcgctggtgccgggcaaaggcggcacggggcctgagtatgtggagatcgggcgaacggaagtgatttggaacaatttgaacccgcgatggaacaccaaagtgacgctgaattacttcttcgagaccaagcagcagttgcgcttcgacgtgttcgacatcgacacggagaacacgcgcgacttgagcagccaggactttttgggtgtgttctgtgctgggaagagtggtcgagtttgggaacggacaatgcgaagaatgcgaagacagagaaaagggaatggcacgacaattttataaacatttgtcgtggaaattaactccgccgatctccgaaacaaaactcaaatcccaacgtgttgaagcagttcaatgcttttacaactccaattgcgcattggtcacccctctttttcgagtcagcatgtattggcattttgtcctaggaatcgggcgtgcatttagactgatttttcggattttggcaattgcatggcctagcagctgtgcagtaatctaagttcggaccagactgaacacgctgcttttcaggccgctgtgagtgccatttggcggacattgtggccgccgcacacggcgtattgacgcttaagctgaagtaatgaaaaagcacaaattgcggaaagagggcatgaaaaaagtaccaaattttggggatgagccaggccaagagggcaaattgatcatccgagcggacgaagtcgacgagggccaaaaagagatggtgcgcatggtgtgccatgggcagcaggtggcctccaagggcatttgctggtgcctttccgcgagggaccctttcctcgaatttcaccgcctctacgcggacggatcgtgggttttctgttcccattggtcacttcccccacatcggttgggacaggaaacagctcgtctaccggacagaggtccaaactcggacggtggaccccgaatggaagcccatcgaaatttcggtgcggcacctttgccagggggacaaaaacaggtggagttaggctgagaaaagagaggggtcgtctatttgtcacggtgtttatttgtttaagggactttttggtggaatgtttcgactacaaattggccggcgggtgagtcacttttcgattaattatttaaattccagtggaggacaaaaatggggaga

SEQ ID NO: 56554 - DNA, 824 bp, Heterodera glycines
  Genomic contig location: Contig_ID=SeqID_576; Location=414..1237; Strand=-
  SCN-specific regions: Sequence locations=1-314,353-824
atgtacaagcccttcgtgcgcaatggatttggtcgatggcacgcttcgctggctgtgttcgccacctcggcattctttcacgaatatttggtttgtcatccgccattattctcctcaattaacacttagttttctcatacccttttaggtgtccattccgttgaaaatgtttcgtctttgggcctgcactggaatgcttgcccaaattccgcttggcatgttcacggaccaatacttgaaggtgccgttgaatttgttaataatttgcatcccatttgaacaaatatttaaaaaaacaattacagaaattgccgattattattttgataaaaatatttttaattaaaaaaatgcctccggacaattttaacaaatttcaaaacataatacgaccatttttcatccgtttttccagggcggtcgtgccgggaatattgtcgtttggctttcgctcattctcggacaaccgatggccattctgatgtacgtgcacgactggtacttcctgcaccatcccgaactccacgcggcgcatcggcagaatctgaccattgctcatttttgaattgggtattcgaaatttattatcatgtgtcgacgtttctgagttccttctttctccccatcttctcaccggcgggttggcagaaaaaaatgtgccatcaaaccacaaaccattaattcgttaattatatgccagtggactaatttaatttttcaaatgatattacagacttttaattcctcctttattgctcattaaattatttttgctcacataatttatttgaatgggttctgaatggacggactattgcaataaa

SEQ ID NO: 56555 - DNA, 2240 bp, Heterodera glycines
  Genomic contig location: Contig_ID=SeqID_579; Location=95..2334; Strand=-
  SCN-specific regions: Sequence locations=1-500,530-616,638-906,929 -1768,1801-1952,1974-2240
atgattcgtaataaacttgaaagtctacaagaaagtcggaagaagcgttatttgtcagacatttcaaacacaactgaggaggacgtgaatttgggagtgaaattcgtcgaaccgaatgccgtgagaatttctgacagcgttgaacaaccgaatttgaacgaggctgaactttcaacaatgacctttgagcgcggaaaaatcaattttgggtgagattgtctatggttgaaaggtatgtttgaagcaccgcaaaaaatttatttccaaactattcaggatttagattcacacaccactcaggaaatcgctgaagatgcacaaatcgagtttttctcaattatcttggccgtcttctcctggaatgccaatgttcttcctttacttctctcgaacatatatcggcttgacacagcgccagatgttggatggtgttaacgcattttgagataatccactcaattttcacccaccggcaaccattgtttgttagatttatgcatttatttccaaaaattaaaatttttagctacactcgggacaataattttgactatcaactcggaacaagctatgcggctacccctagagttcggcaccggctcaccggcaccatcaactcttacatggccaaccactgtgagtccacgtgagcagcttgttcaatatttgttgagttcgctatcgacttcgacagcgccttcaggcagaattctttaatcaattaaaccgtttaaactcaataaaaagattcatttacagcatgggaggacgaaatcgttcgggcaccacattttccaattccgccggcactctcaaattgagggatatgcaggaaaattgaaggatttgaaaattttgatgattcagttgtccatgtcccgtaatgaattttattgaatgtttaataaaattattttttcaatgtgtgaagctgagggtgggtctatagagggaattcggatcacataggagccctaaacttgtacgaattttgatcagcaccctttgtaagagctttgaatatttttttgctatttaatctttatatttgggtctagggttaggcaaggggctatataaatgtcgtattggtattcagcgaccccgaaaaccctaaaatagacccattctccggctttctatgagttttttagacttttggacaattcgtgggtttttactcttttggacaattcgtggcttggacaattcgtggcttggacaaaacgtggcttggacaattcgtggcttggacactttgtgggggcgccgaaaattttaaacaaaagtttatctgaaaaaaatgtattttagggaattcatttttgagaaaatttttcaattcttagaggtgcatagatattgttagaaaactaacaaactacccactagacaaagaatacactaacaaagggaaaagtagcggcttatccgtatcttttggataggtagctggggatcgaactatccccagtcgtattcagagttcggaatacgggttttgagctgtagattaatcgatctgcagctaccatagctacagctagggatatgcggatttttaaccttggcattgtgaatatgagcatctgcacagtggagttgacccatagtgctgatcccgcgtgatcccgcaccaaaaatcaaatttgcgggtcccgccgctgcggaattggaacttcaaaattttgcgggacgtataatcccgtaatgattgcggactgggatcccgcaaaatccgggctctagttaaagatatcgtcttcacattttaaaattaaaatttatttgtttatttttgtgatgatgttatttgtctgattcgtatacatttccggacaattctaatcattaataaaaaccaaaagtaggtattttattttggtaatgtcttccggatcatcatcatgcgtcaaagatttaaagaatgggaattctttttgtcaactttgttcaatgcaatttaaaactaaggtgaaatcatttcctagagttctagcaatttatgaaataactaatccatcccagcaactttatttgtagattaagggaggggaaagacgattgactatttggcacttccttggacaaatatatttcaaatttcattcagacacttacggcacacataaatggacggaagcacagagaagtattgtcaaaattgaaggacaaagacaattcgctgaaaaaggcaaaggaaacaacaagcgaagtaaatgccatcaacagcagaaacg

SEQ ID NO: 56556 - DNA, 780 bp, Heterodera glycines
  Genomic contig location: Contig_ID=SeqID_579; Location=1277..2056; Strand=+
  SCN-specific regions: Sequence locations=1-130,153-421,443-529,559-780
ctagacccaaatataaagattaaatagcaaaaaaatattcaaagctcttacaaagggtgctgatcaaaattcgtacaagtttagggctcctatgtgatccgaattccctctatagacccaccctcagcttcacacattgaaaaaataattttattaaacattcaataaaattcattacgggacatggacaactgaatcatcaaaattttcaaatccttcaattttcctgcatatccctcaatttgagagtgccggcggaattggaaaatgtggtgcccgaacgatttcgtcctcccatgctgtaaatgaatctttttattgagtttaaacggtttaattgattaaagaattctgcctgaaggcgctgtcgaagtcgatagcgaactcaacaaatattgaacaagctgctcacgtggactcacagtggttggccatgtaagagttgatggtgccggtgagccggtgccgaactctaggggtagccgcatagcttgttccgagttgatagtcaaaattattgtcccgagtgtagctaaaaattttaatttttggaaataaatgcataaatctaacaaacaatggttgccggtgggtgaaaattgagtggattatctcaaaatgcgttaacaccatccaacatctggcgctgtgtcaagccgatatatgttcgagagaagtaaaggaagaacattggcattccaggagaagacggccaagataattgagaaaaactcgatttgtgcatcttcagcgatttcctgagtggtgtgtgaatctaaa

SEQ ID NO: 56557 - DNA, 520 bp, Heterodera glycines
  Genomic contig location: Contig_ID=SeqID_5008; Location=182..701; Strand=+
  SCN-specific regions: Sequence locations=1-520
gtcacactaaactcaaataacgaacactaatgtttatcaaaaacatgacacacataattgtgtcacactaaactcaaataacaaacactaatgtttatcaaaaacatgacacacataattgtgtcacactaaactcaaataacaaacactaatgtttatcaaaaacatgacacacataattgtgtcacactaaactcaaataacaaacactaatgttttatcaaagacatgacacacataattgtgtcacactaaactcaaataacgaacactaatgtttatcaaaaacatgacacacataattgtgtcacactaaactcaaataacgaacactaatgttttatcaaagacatgacacacataattgtgtcacactaaactcaaataacgaacactaatgtttatcaaaaacatgacacacataattgtgtcacactaaactcaaataacaaacactaatgtttatcaaaaacatgacacacataattgtgtcacactaaactcaaataacaaacactaa

SEQ ID NO: 56558 - DNA, 1067 bp, Heterodera glycines
  Genomic contig location: Contig_ID=SeqID_5010; Location=197..1263; Strand=+
  SCN-specific regions: Sequence locations=1-30,81-345,367-403,438 -615,638-704,734-791,820-1067
atgatcataagtaagattatccaaatctacttaatatatttgtttattatattaaacaaagatgaaataattaaaaaattgggattgatagaattatccaaatctacttaatttgttttccattcattcgctgtgtcaattgtcgattgcaatagcttttaccttttccaaatttacctgttcttctttggctttttattttgcattttcatacaaattttcattttttacaaattcttccagaaaaatgcactgacaaagaaaggtccccaagtgtccgcggagtttcggaacccaaatttggtaggttttggtaggtggctagagcacccctgggtccttaataaaagtgcttttaatttttgtggaatgagcttgagtgaagagttatgatgtgccaaagtttttaaattaattaacaaaagaaataattattagtactcctttgcattggtttctagcttagaggcagtgcgcagggcgtacctttttaggtctcaggttcgaatcctctgcatgcaaattcattttacaataaatttctccaggctaattaagaaaaaattcaaataaaaatggatggatttttatgttaaattacgcctcaaacttcgcgttttttaaaaaccattatttgcgtcaatttaaataaataatgttatttgttaacttgtgtttctatggggtgataatatttgaattggtataaaattatatttaaaaaactaaaaatccttttaataattgttttggtgtgactttttgaaatttgattgcaccaggagcaaaatccaaaacaaaccacagacacagaaccaacaacttgggattatatttctcttattatcatcaaagtgaaaaaagcgacactccacgcggcgcttggacggagtaagaaaataaatcggaccgaattgagcgggatcggttttctgacatcagcaccgcaaaagattttcagccacttcttcgacgaggcaccggaaggtgttcaacacggccaaaatcggttatgcgcacgtgaagaaagtcgagtgctaggcgaaggcgaggaactaggaaattga

SEQ ID NO: 56559 - DNA, 1820 bp, Heterodera glycines
  Genomic contig location: Contig_ID=SeqID_5010; Location=2085..3904; Strand=+
  SCN-specific regions: Sequence locations=1-101,144-274,296-424,453 -456,491-509,537-590,626-740,827-836,865-948,1002-1129,1151-1768,1801- 1820
atgaaattaccgttaccggtttgtctagtaccggtaccgccggtaaaaatttgcactggtaagaatgggggtctggtcgagaaaagagtaggaaattggtgaagaaggagaaatttttgagaaaaaattaaattttatttcatttagtcatgggattacacacatgcacatatggtgtagtggttaaactttctacctttcatacatatgcttctgaacaattctaattctaaaaaacaggtactcgcgcgataactgaataaaaattttgtatttggaaaattttgtccaaaaatttttatgttctaaaattaccggtttttaccggtaccggtaccggtaccgttttttgcagtaccggtcagtaccggtaccggtttttttgcaattaccgattaccgctcaactctaatgccagataatgttttttattaatttttaaaacaaaatttcgctttaaaattgctttatttaaaaatttatttcaaaactttctaactttttaaattattacgtttataattgaaataaaacttctttcatgctatttgcgatttttttgtgccaatattgcgcatattttacgattgtaaaaatttaattaattttatgtaaaaaaaattttcatgaatatgagtggggggtatgtatgcctcatttgttgtcattatgagttggcatttttgcgtgtgcatcgattttcaataaagacctttattagttttttaatgctaatacgcataaaaatattaaatgaattttttattatatatgtaataattgtaaaatattataaaaattgcaaacaaataatattaaatattttggctgtattcttaataatattttttactttttaaaaaacgaggtttttttttcaaaattttaaatgattttcagaagaaaattttaatgaattttttctgaaattttcgatttttttaacacttattttgaaatttaattacaaataataggatttttaattattataaatatttgtcatgatcatcgtagcatttcaacgctgcttaacatttctcagaaaaaaaactaaattaaacattctgtagactattcaatagggctccctctatctacttttatgctattagtcacaaaatttcatgaattttcgttaaattaaaataagttatagccaaaagattgtttgttatccactctaaaaaaatgcaattttacgaaatacttaaaggaacaactttttatttttaacaaactttttatgaattttcgagctagagaaccatttgaacctgaaaaataatatatgaaaaatgttgcatctaattgctaatcacaaattcattcgagaattctttttatattttcaattaaggattttaggaaatattatttattattgttccatgcttattattccattttggattattctgttcttaaatgtggccagatggggcattctttcaatgcccgaaaaaatggttggaaatggactaaacatgggccaattgattcaaaatgatcaaaatcctaatcaaatagaaaaccaaaatgggccaaatctggaccaaatagcaaatcaaaatgactcaaatctggatcaaatagatctgaatgcgccaaatccggacgaattaatagaaactggcaaacttggagaagttccgattttattgccaaggaaatatcaagaccgaacaatacaagttgaattcattgctcacaagatcatttcggatgcagaaactcgtcaaaaattctttaaaccagttgagctatgaaataattatttatttttttgaaatttatttagatgtaaaaagttaatgaaa

SEQ ID NO: 56560 - DNA, 496 bp, Heterodera glycines
  Genomic contig location: Contig_ID=SeqID_25796; Location=463..958; Strand=+
  SCN-specific regions: Sequence locations=1-31,53-69,92-134,183-496
atgttcactaatttcccattgcttttctccgctttttcaatttttctgctccttttgaccctgcaattccctccaaaagtgctgggaatgttttctaattacaatgttttgcctttgtatcagaagaataacggtaaataaattatctatttaatatattaatattttttaatttatttaaagcattaatagctgggatttttaggctttaacggatagtgtttgatgatagaagaatgatttagagcgactttttatcacataaaacacctaaaacgggggtatgcaccaggggtgtgccttgtccccaaaaagacgagagcgagagtttggcgagaggcgagagtccccaaaaagacgagagttggcgagaggacgagaggcgagagtttttcaattttctgtagccttattttttactccaaaaaatcacaatgatcgttcgaattttagcacctattttagcctttttcagaaatttcatagcaaaagtgca

SEQ ID NO: 56561 - DNA, 287 bp, Heterodera glycines
  Genomic contig location: Contig_ID=SeqID_25797; Location=52..338; Strand=-
  SCN-specific regions: Sequence locations=1-287
catttgttcgacctcagtaacagcataatatgcacaaatggcagttccatggccaacgcaagtgttatttcaatggcggcagcaatttccaaaggttctcttctctcgcagtgccaatctcagcagacgaccaaacaaagtgaacgtccaaatgatttcgatggtcattttgtaggggcaacagattgtgcgagtcggcagagaacgtacgcattgagcgactcgccggtgtcatcgccgctgaagcaaccggccgaagcggcgggcactgtgaaaataccgaagga

SEQ ID NO: 56562 - DNA, 506 bp, Heterodera glycines
  Genomic contig location: Contig_ID=SeqID_25798; Location=498..1003; Strand=-
  SCN-specific regions: Sequence locations=1-38,60-190,212-347,406-506
atggcgattcattgtcccgcttcacccatcgctgctccttttcttctcccactgcttttgcttctttcccctttcgtcgttcagctgaatgggatttctttcgtcccatctcccctcggtttcataaatccgttcatcgaaggaaacctccgatttggccccaatggccaatttgaagcttcgccaatttctccaactccgttagtttctcaaacggtgccgggatggcttctaagcagaaatgtcagaggggtaagttagccggtgctgtgtcgaagtgacaaaagtgcgaatgagtggtgatcagaagaggcgggtcatttcagtacggaagagttgttctaatgattaattaattgtttaaatttataattgaataataagctaataataataaatatatttggctctatttcagtttacacgaccacgaaaaaagacatgaccatgtaatattttgataagtttcatacaccataactttttatagaagcacccaaattaaa

SEQ ID NO: 56563 - DNA, 1044 bp, Heterodera glycines
  Genomic contig location: Contig_ID=SeqID_25801; Location=27..1070; Strand=-
  SCN-specific regions: Sequence locations=1-128,150-664,686-936,966 -1044
atggacgacctaatggacgaaggagtgaccgacgaggagggatttttccatctgagcggaaaagagagcgaaatcactccgatagagccaaaagtgaacatttatcacgtgaggagcaaaggaaaagcggacgaagaaaggaagaaaaacgcattttaagaattgcaacgacgacgaaagtcttaacccgctgaagaaagtgtgctacaaaaaaatttccatcgacgtgtgttttccgccgaattaattggcactttcccttttaatttctttggcacttttctttttaattgccttcacaattggcactttctcttcatttaattgttcagcttcccgccagttatatcactgatggacccgtggccgaaaaagtgtttccgctgggcacccttaatttggccgggtcgttcaaaggcgaaacgcgcgactgtctcaactgatctgccgaggcgattgatgtaaagagaatggcacaatgaaaggctgaaaggcatttttggccacacaattcttttttcaattttcactcagtcgaataattaatgattctgtcgttggtatttacaaaattatgcgaatttcgtcaatttcgtccgtcggcattcttttgaaaagcgaacactttcataagccattttaatccgcacgtgactttttcgtccatttgtctccccaatttgtcccttccttttccaatttcgtttattttacgaaatgtgatatttttgtgccaatctctgaactttcatcactaaacagctttcactcaaaagtctgttcagtcggccaaaggcatttaattaacagacattttaacaattcgccgaaaaagctcactttaataattcaaaaatggcatcgcttacgccgatggcatttggaaatgaattaaatgtcggtacagtcaaactgtgcaccgtttggctaaagatgagaagccaaaaaagaaaatggaaagtttccgaaaatgacgccgaacaaattaaattagtctgagaagagtttcatgaaattggcacacaaagaggggcgattaataaa

SEQ ID NO: 56564 - DNA, 351 bp, Heterodera glycines; identical to SEQ ID NO: 53910
  Genomic contig location: Contig_ID=SeqID_25802; Location=214..564; Strand=-
  SCN-specific regions: Sequence locations=1-20,51-351

SEQ ID NO: 56565 - DNA, 423 bp, Heterodera glycines
  Genomic contig location: Contig_ID=SeqID_25804; Location=2..424; Strand=-
  SCN-specific regions: Sequence locations=1-290,313-423
atggaagacaaattcaaggaagatttgctgcaatatttagtctcagctggcaaagctgaatcggcctcttttcgtttaaatgatcaaatcaacgcacattctgcagatcattcagccctaaagcagcttttcctttcgcttgaaagtgtcattgagcctttgtgagtttgtccaaaggaaatttctctgatcaattaatgggccaatcgacgatatatttaattaagcaaaacccaatcggaagtgatcggactgatcggcactgagttgggctggcggccggtgatcaaattgctacaggctttgctgatcaatggttttgccaccgctgacgtagtgctgaaagagcgcgcactgaaagtgctggccgaactcattccaatgtacacaagcagcgcaattgggcctcactggagcaaatga

SEQ ID NO: 56566 - DNA, 1174 bp, Heterodera glycines
  Genomic contig location: Contig_ID=SeqID_25805; Location=45..1218; Strand=-
  SCN-specific regions: Sequence locations=1-1174
atggccaatgatcaaccacttcaaacggttcttcaatttttgagaaatggatggccagcaaaagtcgctgattctgaaattagtccatattttccaaaacgggacaaaatttttgaagtggacaattgcctactgtatgaggaccgtgtgatcgtcccaacttcgcttcgcagtcgcatccttaaggcattgcacatcgctcacccaggcattgtgcgcatgaaagcacttgctcgacgtcacgtgtattggccgggaatggactcagcgatcgaaaaagttgtgagcacttgcgaagagtgccaactgggccagaaaaacccgaccaaagcgcctctttcgccatggccaacgacggacaaagtgtttcagcgagtccacatcgattttgctggcccctgctcagacggtcaccaatatttgattttgatcgactcattttcaaagtggccagaagtctatcgtatgaatacaatttctgcttatgccaccgtatttgttctccgatcaatcatttatcggctcggaatcccagaggaaattgtttccgacaacgggacccaatttcgatccgccgaattcgccacattctgtaaagaatttggaatcaagcacattttcataccgccatttcacccacaatcgaatggccaagtggaacgattcgttgacaccttcaagcgatcgatgaagaaaatgtccaaaggtggaaaggattggatcgaaaagatgctgttctcctacagaaccactccccacgttgccttaaatggcttttcacccgatcaattatttttcggcagaaaattgcgcacgaaattgtcgctcgttcatccgaatggagaaaaagccgaaaattttgatcaaaactcattcaaaaagggacaatcaaaatacaccgacaaaatggctcaaaattttgatcggaagcatggatcaaaagtgatcaatttttccccaaatgatcatgtcctactgatcaattaccgcaacaataagacggagtggctccagggaaaaattgttgaaaggcttcacaattcgcccacatatcgtgtttatgtgcctgttctgcgtcggcttgttcatcggcacgcgaatcagctcaggcgacgacatcttttggaagacgaagccagaaaaagaggcacctcaagtcgaacagccgccgccg

SEQ ID NO: 56567 - DNA, 1328 bp, Heterodera glycines
  Genomic contig location: Contig_ID=SeqID_5012; Location=1..1328; Strand=-
  SCN-specific regions: Sequence locations=1-778,800-1061,1083-1328
  Gene Ontology: Mol. function=ATP binding; Cellular component =cytoplasm; Biological process=protein amino acid phosphorylation
ttaattaatttcgtgcagtgatgaaatgcccttatgagaatggctggaggggatttgtccgttgggtgccaatggccggggtcgaaagatgagtacgaacttcaggacgcaattggagttggtgccactgcgactgtgtttaaggtgaggaggccattgctattggaaaggattggacaaaactggttaaggcattctgcaagtcgaagaacgaaatgtgcgccataaaaagcataaatttggaaaagtgtcagacttcggtggacgaattgtcgcatgaaatacaggcgatgtcgctgtgttcgcatccaaatgtcgtcaattactacacttcctttgtgtgttttgggaatgaacgcccttttgccaattgtcagacaaagtgcccataattcttggaccaattgtccgttttgttatccctgtctaccatggatagtccccttttcttattcgtaattttcttctaatgccttaaaattgaacctttttaggtcgtcggggaggaactttgggtggtgatgcgtttgttgaactgtggttcaatgttggacatattgaagagaaaaataaaggcatggtccgtcattattttccgagagaattaaccaaattctaattaggcaattggcaaagaccaggcggcctacggagtgctcgacgaagtgataattgcgacagttcttaaggaagtcctccggggcctcgagtacttccataattctggccaaatacacagggacatcaaagcgggtcagtcattagctgtttaggcctacttttccagttgcttgttaggcaacattttgttggccaacgatgggaccgtgcaaatcgctgacttcggagtgtccggttggctggcggccagtgggggagacctttcccgacaggtgggcatgccgccgtttccggacttccgatgtatgcccttaagaaagttcggcacactttcgtcggcactccctgttggatggcccccgaagtgatggagcaggtgtccggttacggtcggttgttcagtcggtggtgtgctggttgtttccaattcgtctcttagatttcaaagcggacatttggagctttggcattctgtgcattgagctcgccacaggcaccgccccttaccatcgctaccccccaatgaaagtgctgatgctgacccttcagaatgacccgccttcgcttgagacgaacgccgaccgaaaggagcagtacaaagcgtacgttccctttttgggtgggaaatggaaattccaattttaagatacgggaagagcttcagaactgtgataaaggactgtctgcaggtttggaacggagcgaca

SEQ ID NO: 56568 - DNA, 638 bp, Heterodera glycines
  Genomic contig location: Contig_ID=SeqID_5012; Location=1587..2224; Strand=-
  SCN-specific regions: Sequence locations=1-638
  Gene Ontology: Biological process=nonselective vesicle transport
ctgttgccgacacttatgctcgcatttcgcatggattggagaaatttggccaattggaggctgcgagtggagagaaggaatttgggcaatttctgggaaaggtcacaacttcctttgaaaagctgaagaaagctgaggcgagggttggcaccgacgaggaattgaaggaggtggacacgttgcgttattttttgggcgaaacgcaagcggccaaagtgagttggcttaactcatcatcccccaaatgcggtctaactgttaaatccgtggtcagaacctgctctaccgaaggacgcgatgcttggcaaattacgaaacggcaaacaaaaacttggagcgctgtcgagcacgaaacagagacattctgaaggcggaaaatgaacaggccgaggcatgcaagaagttcgaaatgatcagcaaattggccaaaacagaattgacagagctgaagaaggaacgcatcgcgtcattcaagaagaatttgtccgagttggccgatttggaggttaaacagtcgaaggtaatttaccttcgagactgaaaaaatggtcaaaatcggagaaattaaggcaaagatcgtaatccttcagtctgcaatcgcagcattaaacgaaatgattggagcacaaaacaattga

SEQ ID NO: 56569 - DNA, 1512 bp, Heterodera glycines
  Genomic contig location: Contig_ID=SeqID_5013; Location=1..1512; Strand=-
  SCN-specific regions: Sequence locations=1-46,68-567,590-636,671 -744,766-1000,1022-1128,1151-1368,1390-1512
  Gene Ontology: Biological process=nonselective vesicle transport
caaatggaaatgtgggattttcagaaataatttgtgtaataaaattgaccaggacactgaggaaggcaaaaccgtggaaactcagcacccaattgttgtgaacatatccgatgctctttcggaacgtgagaaggtattgaaaaaacatgcaacaattcgggtaatggtaaagaattgtggtccctattttaactttttattttggactaaaattcagtttctgggggttttcaagggtgctgattatgaatctgaactcggatttgcccaattccggacccgaatacgaacaagaagttgaaaaccaaaatataagttataattttggcgaaaattgcgcatttttacacaataacaatagaagcattgctttacatcaaaaaaaagttgttaaatgattagaagcatttaccccaagaaaaatgtaatccttggaaaaaaaatttcaactttttgttcgggtccggggttcggaatcattgcccaattcgaaccatggctatcaaatatgcttttttagacttattgtcaggtaatagtacggagccacccccgctcccctcgttcaaataaattttttataaatttacggagccgagaaaaattcgaccaaattcgaaccccgaaccggactcgaataaaaattcaattttctacaaaattaaaaattgtgcaataaagtacacgaaataagacggaaaatacgcttctgaaagcaagacaaatatttcgtacatttaaaacttttgttgcatattttgttatattgaaattcgaattgtaatacgataaaatgcttttaggtcaaatacactgttcaaacaaagacaaatgcgcccgaatttgctagggtggaaatgtccgttgtgagagagcatgacgaatttatttggctacacaattgtctcgaagacaatgaggaatacgccggattcattgtatcatgttgacattgtctcctttcctcccgtctcataatacggtttctttttttcagattccccccgcaccgcctcgacccgattttgatgcatctcgcgagaaacttcaaaaacttggcgaaggcgaagcgacgatgacaaaggaggaatttgtgaaaatgaaacaggaattggagcagtgagtccttttttgtgttactttttaatttacttaatttgtctgtgcatttcaccagggaatatttggcaacgttcaaaaagactgtcgcgcttcatgaaaagtttttgactcggcttgctgctcaccccgtttttcaaaaggaccaaaactttcgcgtgtttttggaatatgaaaatgatgtaagaaatctttgttttcaatttactaattatttgcaactttcgtttaattttcagctctcagttcgaagtcgaaacaagaaagaaattgttggttccattttcaaaaggttcactcaaacggccgacgaagttttcctctctggccaagtgctgtctcttttttcgtttttgttttttttgtcattcgccttaaatgcagaaaaccttt

SEQ ID NO: 56570 - DNA, 1871 bp, Heterodera glycines
  Genomic contig location: Contig_ID=SeqID_5013; Location=1787..3657; Strand=-
  SCN-specific regions: Sequence locations=1-366,388-679,708-803,826 -911,933-981,1003-1017,1040-1564,1587-1871
atgagtgccaccgtgtgctttctctccgggtggcatttgctgcagggaaacaccgccggaattatggcaaccgacggaccgcacacggaaattggcgtcggtgagcaacgaatggagtcaagtcaaatttacttgagttgaggagaaatatttcggattaatttggctaaaccgactacgtacacctttttcttgcgttttgattttgctcaaactgtcccttttagcacttctttgtctctcaactttgcttctgttcgcttatttcgtttggttgggcgtcactttcttttaccatctccgcgattatcgttcatggcaagtgcaaaattgggtcagtttgttatatgagtgcactttctgtcattttttatttcttgtttttgcccaatgcattgtttcagaattatacggtggtcgaccagctcagcatggaagagtcgatgatggtcaacgggacgagaagcgtcgacagagggcgacgccgcaagcagagacggacgaggagcacccgtcgattgtgagtgccgtgggccttcgcggcaatgccattgctcgccctctgtcactctttgatctctctgtctgtgtattggaccgcaatttccctcttttcccacatccgcgcaatttttaacaattataattattttgtccatttccaaactaaatttttgtctttttattataatttatgaatttttttagtgacccgcgaacttatgcaaatttaagataattatttgattataatgtcaccattttatgaacagttttattaattacttcgattttattcctgtgatttcatttaaaaaataaatactggttcttttcggttttgtgaccccccctgaaattttcaaataaaaagtcatttctagggtaatttggggcgctgatcacgaatatgacatttatttttcaaaattccgaatcccgaacctgaattcgaacaaaaattcgaaattcataaattacaatgaaaacatatttttggggttttcgaggtcgctgatcacgaatctgacctccattgcaaccaatttcgaaccccggacccaaattcgaacaaaagtcgaaaattcatttttttcaaaaattctcatttattgtccaaaatcgattacgatgctcgaacgggattaaattttctccaaattcaaatcggctggtcgacaacctctttgttaattgcagctgcattttgaacatcctttgtgtttgtcagtgcgaactaacgtcttttttgaatgggtgttaggggcggggaggggggacttcacagcccattccatttggccaaattcctggcattagacctattcctcaccccctaatggctattcattataagcaattccgaccacgtagcggaaacactgcaaacacatttgaaagttacttccccgagtttatgtggcgcaaccattttggcgataccgttgatgttttttataatttttggtctcatgtcactgattttggacaataaatgagaatttaaaaaaaaatgaattttcgacttttgttcgaatttgggtccggggttcgaaattggttgcaatggaggtcagattcgtgatcagcgacctcgaaaacccccaaaaacatgtttcaatgaagaaaaaaaatttgaattttttttttttccaaaatgggggggggacaaactacactattacccacttaagcttccggaagatgccggttggttcgataggcgtcctggtggagtttttctcaaaatgcttttgcacatttctctggcctgctttgctgtttttatgattccctacacttacgaaaaagtcgtgcccgaagaataccgttgcaagatcaaatacaaaaagaacgacggacaccattag

SEQ ID NO: 56571 - DNA, 693 bp, Heterodera glycines
  Genomic contig location: Contig_ID=SeqID_25807; Location=535..1227; Strand=-
  SCN-specific regions: Sequence locations=1-118,141-149,178-238,271 -324,352-357,382-693
atgacaagcccaactgatcaacaagaaccgatccagacaacagaagcggcagacgataaagccaaaagtgatcagcatcagcagaccaatgaagaacagacaaagtgcaaaaagcgtaggattgaggagaaagaaaatttggtaaaagcaataatttaattaaaaaataaataatttcgagttttcaaaaattattttgatttttttttaaagagtttcgataaatggaagggttcagaaaaatttcaaaaaaattattttaattttaatgttcacttggggagtaaactatcgtaaagcacttgaaaaaaaagttagaaaacgaaaaattttattattttttaaaattttccgcggcctggggagcgggaggcgggggaacaaacacctcgaaagttttatagaaggctttttatgaattttttcttcattttccagggtcttccaattgcacagtccactccgctggtgccggggccctctcgtgccattgctcattgtcagccaaatcagtccatcgttgttgcgcagaaccatgctctgcggcacagcccaccaccaacaatggcaccatctccaatccttggccattactttccatttgggccaaactcggcggattcatctgccgtttccatgttcccgtctccaggtaggggttggtagcagagatgggccaaattgaaaaataaa

SEQ ID NO: 56572 - DNA, 870 bp, Heterodera glycines
  Genomic contig location: Contig_ID=SeqID_25808; Location=644..1513; Strand=+
  SCN-specific regions: Sequence locations=1-262,312-436,502-870
atgaaaaatccagaagaaattggtgaggaagaatccgctgaagaattggttaaattgtgtgaaaaatggaaaatgatggcattggcagtcgatgcatttgtggggggagatttaaatgtgaaaccacaatttgaactggtggtaaaacagcagctggacagaacccatcatcaactcctaatgagctcagcaatggaagcgatcaaaacagttaaccgggacttattcacatggggcaaagggaatggattaaaagtcgagctaatttttgatttttttttaattttatagttatttttttagattattttggtaaatgagaaggattgcgaccttgatcaattgttatggactgatacgagaaaaaatttggatgggttaagtgcaacattaaagtgttgtagaaggtttcggtgcaactcgggctcggtaattgaaaattataataaaatcttttttttaaagctaagatttattattaaattttgaaaaattttaaaacctgaaaattggtcaacaatttgcaatgctggaaaggatcacgagaaaaaagttactaatgaaccggattattctttgaaaaaagactttgtattattgcgccaattcgaccaaggaaattctctgaaacttgaaagatatattggcgttttgttaatggaatacaaaactcaaaaacaaatggtagcaacggacccatgtgaggaggccaaactgaaagtgatcaaactgatgaaagatgtacagaaatcattggacaaaaaggaaaaagatggagtgaccaaaactgacaaaggcggactgaacgaactgatcaaaatggagaaactgaagtcgaaaaccggtacacgcaatgacaaagcaaagtga

SEQ ID NO: 56573 - DNA, 806 bp, Heterodera glycines
  Genomic contig location: Contig_ID=SeqID_25808; Location=947..1752; Strand=-
  SCN-specific regions: Sequence locations=1-31,53-608,674-806
atttacatgtccttacattccatcctattgcttagcaaaatttaaaagttttcattgatccaatcggattaaagcatttggtcaaggaaatggaaaaatttatgctagaaagaaaagccacccaaaagaaaagtgatgatgatagtgcacaaaacagactaatgatctaaaaactcttcacttcgtttcctcactctgatcaccattttgacttgtgatcagtcttttttcatctccgatcactttgctttgtcattgcgtgtaccggttttcgacttcagtttctccattttgatcagttcgttcagtccgcctttgtcagttttggtcactccatctttttcctttttgtccaatgatttctgtacatctttcatcagtttgatcactttcagtttggcctcctcacatgggtccgttgctaccatttgtttttgagttttgtattccattaacaaaacgccaatatatctttcaagtttcagagaatttccttggtcgaattggcgcaataatacaaagtcttttttcaaagaataatccggttcattagtaacttttttctcgtgatcctttccagcattgcaaattgttgaccaattttcaggttttaaaatttttcaaaatttaataataaatcttagctttaaaaaaaagattttattataattttcaattaccgagcccgagttgcaccgaaaccttctacaacactttaatgttgcacttaacccatccaaattttttctcgtatcagtccataacaattgatcaaggtcgcaatccttctcatttaccaaaataat

SEQ ID NO: 56574 - DNA, 63 bp, Heterodera glycines
  Genomic contig location: Contig_ID=SeqID_25809; Location=822..884; Strand=+
  SCN-specific regions: Sequence locations=1-63
gctatagggaagctattcccgaaggattcggtctccccataaatctgggcgcatcggttcagg

SEQ ID NO: 56575 - DNA, 608 bp, Heterodera glycines
  Genomic contig location: Contig_ID=SeqID_25812; Location=686..1293; Strand=-
  SCN-specific regions: Sequence locations=1-608
atgtcgggtctgactgcgcattttgaaccgatgatccctcaacagaacggaggaaggtaagcggagtcggagagcggatgaaccatcattaaattgaatagaacgggataaattacggtgaaaagggggtcgtaataacttcccggactgaaaatgtagggactgaaactgactttcgctgccttatctttcctttcatccaatgatctcaaagccatcactgccttttcccctcaatgcttttcctctgcccccttccatttgcaatggtttgtttgttcagaccgctcaacggtctgtctcttctatctggcgttttgtccgccgcttctctgcccgactcgccgctttcgccgtcctccgtcggcggcggactatttccgcccgcctttccgtcgtcccttcttttcggcactgtgccgtctccgttcttcgctcagtcggccattgttgctgatcagcaacagcaactgatcgcccagctgatcgccgcccagcaaaagttggcctccgcgctgctcggctcaccgcccgccgcgcagcaaaacgcgacgcaaacggcgacaatggccgaagtcggcgacacaaatcagcagaaaatgttctga

SEQ ID NO: 56576 - DNA, 1657 bp, Heterodera glycines
  misc_feature (8)..(8): n is a, c, g, or t
  Genomic contig location: Contig_ID=SeqID_5014; Location=789..2445; Strand=-
  SCN-specific regions: Sequence locations=1-285,310-657,679-1554,1577 -1657
  Gene Ontology: Mol. function=dynein ATPase activity; Cellular component=cytoplasmic dynein complex; Biological process=mitotic spindle assembly
atgcctcnggggcagcaattctttcaattggccatgggcgaaagtcacgccgaatgggacgttgtggagctgttgcggcacagtgcccttgagggccattggctgtgtctgtacaacgtgcatttgacccccgccgtcgtcaaccgtctgatgaccgaacttggctccctctccggccaactccacgccgactttcgactttggcttaccaccgaaccggacgaccaattgccggtggtttttctgcagttgtgcctgaaggcggcatacgaaacgccgccggggcttaaaaagaatttggagagaaatttcatcggcggaaggacagagcaaaaggggacgaagcgggggacggacgaagcggcgaaagccaaggcggcatttgtgttgcattggctgcacgcggtggtgcaggaacgacgcaatttcatcccgcaggcgtggcttaagtcagaaattactcaaataggccaaaaaaacaagcatttgaatttcattcagggcctacgaattttccgaagctgaccttagaagtgccaaaatcgcgttgaattcgctgtttggcattgcgggaaaaaacaatttgaaaggcgtcgactgggaaatgttccgcggattgatgctaaacgccatctacgggggccgaattgatgtggagctggacaaccgcgtgctgctcgcctttctgctggaactgttcaattccaaaatgatcgatggggccggcgacgaattggcgcccggactgaaaatgccaatgtttggggagcaaaaagtgccagaatgtttgtccattttggcaagtgtgtcatcatttgcttcaggatttcatggattgggtctcctcgacattgcccgaaactgatcggccggaattgctgaatttgcctcggaatattatgctttcgtgggatttggcccaaagtgacgccgccatcgccaaacttcggcgactgttcgccgccctttctttgtcccagcaaaacgcctccggcgtcggcactttccctcgccgagacatcgcaaaggcattctcgaaacatttgtggggcgaagctttggcgccgctcttgtcactttggaaaaggctgaaccagcaaaagccgcaaatgctgcaaaatgcgcaggaaaggcaaaaagaaatgccaaaattggaaaaagaaaaagcaaacgcaaagggtaaaaaagagagaataaaaagtgggaaaagtgaaagaaaacatttggaggagaagccaacgcggacgaccctttggtcgaaatgcttcaattggaatttgcgtacgccttgaaattgttgcaaaacattcactcgtccctttcggccataagccgcgcaatcaaaggcaccaatttgcctgaaaagcaaaccatcgaagtggcccaatcgctgatcaatttccaggcaaaagcaatgcaaatagactttgttgatcaatccttttttttgtcagattccgtctttttgggattccctttgggccggtggtccgtcggtgccatcgaaatatttggaggaattggtgttcaaagtgcacagcacccaaacgctgctctccctggcccagtcccagcaattgctgctttccccggtcaatttgggccagctttttcgccccgtttctctgctgaatgcttttcgccaattctccgcccg

SEQ ID NO: 56577 - DNA, 1792 bp, Heterodera glycines
  Genomic contig location: Contig_ID=SeqID_5015; Location=320..2111; Strand=-
  SCN-specific regions: Sequence locations=1-197,219-552,580-991,1013 -1792
  Gene Ontology: Mol. function=microtubule motor activity; Cellular component=cytoplasmic dynein complex; Biological process =ciliary/flagellar motility
atgggcattttggacacttcctgggagtccatgcggcgcttcttggccaaaggtggcgtcaaggaagaaatcatcaattttgacgtccgccgcatcactccgtcgaccgccaaaaaagtgggcgctttggtcaaatcgaaggccgcttcgttcgacccggtgaacgctaaaaacgcatcgacaggtaattctacggctttttctatggaatttccactcgaaagccgaaacattcaaattttggctaacatttaagcgattgctccgctggctgcttgggtaaccgcaaatttgcagtacgctttgattttggagaaaattgcgccgctcgagcagaaaaaggagtcgctggtgaaaaatctgaacgcggcggagcagcaaatggagcgattgtccaagggactgaaatcgctggacaaaaaagtggcggagctgaaaacgaacttcgaaaattgcatgaaagaggcgaccgaaatcaaaatcgacttggacagggaacaggcgaccattgtggttgcggggaaaatggtggagagattgggcggagagtacgcgcggtggcagcagcagcagaaggagttggaggacgagctcagaacggtggagcactgctgtctgatcggtcagattttttgctgttggattcgattttgattggttgatcggttttaccattattcggctgatcactcactcattagatcatcactctaaatttatgttggctgatcggtttgacattttccgatgatcgattggtctgatcagtagtgatcactttagtctgatcattcgttgatccaatcgtcccaatttgcttcttcaggtgcggcattcgtaacttttctgggcgctgccactgaggaaatgcgtgcccaaacgatggccaattggcgcgaaatttgccaattacccgccgcttttgacctcctcaattttctcgcctccgaaactgctcagctcagatggaaatccgagggattgttggccaacaaattggcaatggaaaatggcgccattttatttgccgtcaaaaacactccgttcgttgtcgaccccagcggcacagtgtgcacttttctggccaatcacttcaaaggcaattcgacagaaattttacgagcgaatcaaccggatttaatgaccaaagttcggacggaaaatgacgctttttgcaattgtaatttaattgttgaagatcgaattgggcgtgcgctttgggaagactttgataattgacgaaatcgacgaacgaattgagccggcattggtccctctcctaaggagggactttcacacaattggcgcgcgattggccgtacaattgggcgaaaaacaggcgagcacagagcaaagaacagggacagctgacggagtttggcatttgcttttggcatttttagctgttcatttgttcggcttttttgggtttaatcgtcgattttctcaggtcgatttcaacgaccaatttcggcttttcctctgctctcgaaatgagcattgccatttggcttctcacgtcagtgccgtggtctccgagatcaatttctccatcactcgatccggcttggcctcccaatttctgtcattggccattgaattggaaaagcccgaattggaacaaagttcgacacaattaagcagccaaatggaggcgctcaagttggaaatggacaatctcgagcaagtactgctcgaacagctcgccgtttctgacggctctttgctggacaacacggcactgctcgagtcgttgaatgaaagcaaagagaaagcggacaaagtggcacga

SEQ ID NO: 56578 - DNA, 201 bp, Heterodera glycines
  Genomic contig location: Contig_ID=SeqID_5016; Location=417..617; Strand=-
  SCN-specific regions: Sequence locations=1-120,142-201
atgcagaaaaaggcggcgaagaagtcgaagctgctggcggagaagcaagcggaagcgaacggcgcattggcggagataacgcggagtatgagcggagcaacggaacagaaggaggacatggagaagctgaagagcaccaccgaggcggagaacgcgaacatcgagcagcagaagaagctgatcgagcagcaattggccgac

SEQ ID NO: 56579 - DNA, 2245 bp, Heterodera glycines
  Genomic contig location: Contig_ID=SeqID_5017; Location=502..2746; Strand=-
  SCN-specific regions: Sequence locations=1-238,267-849,872-1714,1736 -1833,1855-2245
  Gene Ontology: Mol. function=dynein ATPase activity; Cellular component=cytoplasmic dynein complex; Biological process=proteolysis and peptidolysis
atgctacttgacgctgacgcaggcattggccattggcatgggcggcaatccgtacggaccggcggggacgggaaagaccgaatcggtgaaggcattggccggactgttgggcagacaggtgggaggaggcagaaaacggaatggcataagcaacgctgcccacttgaggtgctggtgttcaactgcgacgaaggcatcgatgtgagggcgatcggtcgcattttcgtgggactgatccaatgcggcgcctggggctgtttcgacgagttcaatcgcctcgggcgcggtgttctgtccgccgtctcctcccaagtgcagttgattcaggaggccgtccgtgccaaggcgtccctttgtcgcatcggcgacctttccgtccccgtcgacttcaactcggccatttttgtcacgctgaaccccgcgggcaaaggctacggcggccgacagcgattgccggacaatttgaagcagctgttccgacccgtggcaatgtccgtgccggacaaccagcaaatctccgaaactttgctattctccgaaggatttggccaagcgaaagtgttggccaaaaagttggtgactatttttgagttggccaaggaaatgctcagcgaacagcaacattacgattggggactgagggcactaaagacagtgctgaagggatgcgcagatgcaatggccaaacgacgacagaaccgtggcggaacggcggatgacgagacggaaatggtggtgcaacaactgcagctgaacacgctgtccaaactgacatttgcggacgcacggcgctttcgcgtgcttttggacggcattttcccgggaacgaaaagagaggcggtgagttcattttcaaaattgaaaagcaaaaagaaaattaaggcccaatttgccgatcttatcgaacccatcagaaaagcgtcggaacattttcaaatgcgcacgacaaatgcccaacttcagaagctgttccaactgtacgagcagttgcgccagcgcatcggcgtgatcatcgtcggtcctccgggctccggcaaatcgacgctttggcgactcctccaaaaggcactttctctgagcggagaacaaccgggggacgtgtacaggtcaacaacattttttgaaagaaggtgaaatttggatgtatttcagcatgaacccaaaagggatgccgcgcagccgacttgtgggccaaatggacttggacacgcgcgagtggacggacggcacgctgacccaggcggctcgcatggccgccaaaggcgcaacaaaccggcatggattgtctgcgacggggacgtggacccggagtgagtggggcggcggagagaagagagggggggggattatctttaattaatccaccccactcatctatacgcatatattaatatagtgtagacgaattgagtggcacatgtaaaaagaggacgtcgtttcaatgatttttctctctgatgagtaaccaatttttgcctcagatggatcgaagcattgaattcggtgttggacgacaacaaattgttgacccttccctcgggggaacgcattcaattcgggtcgaatgttaattttttgttcgaatgcgtcgatttgagccacgcgtcgccggcaacgatttcgcgcatgggaatgattttggtcagccacgaggatttggaaatgcaaacgctaattgacaggtgaaggaatgggcaattagtagtggatgggtaatcagaaacagaaagactgattactgatcggaaagtcacggcaatttgcattaaaaatgatcagacacagactgattgatcactactgatcggaaaggcattgggagcagcttctcagtaatttaatcttttgaagattcattcaccaaaatgaaaaggaattgcccgcccaattcggcgattggctaaacaaaaatttggtgccgtcgttggaatggacggtaaagcagcgaaacggagcattggcattcagtcaaattggtaaagcaaaagacaatgaatatttagaaaattaattaaaggcattttgaacaacgctttgtcactggtgcaaaatgccaagtccaaaaaccaatttctcgtcgcccttttgcgtgcttttgcccctttcgtttcgtcggacaaacgcagcgaattgtgccaaagggtcttttcgcaaaacacttgtgccattcccgacacgaaggtgccattgaatgtttactgcgatggccgaaccgactctttgctcggttattccgatgactttg

SEQ ID NO: 56580 - DNA, 1178 bp, Heterodera glycines
  Genomic contig location: Contig_ID=SeqID_25816; Location=184..1361; Strand=+
  SCN-specific regions: Sequence locations=1-577,600-1178
atgaattgccaaatatggttcggccaattgatgtgcattatgttgctgatggtgtccacggattatgttgtatcccaagacgattcatctacatcctcaagctcgtcaacgagtacgtcaacttcgaccagtactagcacgagcacatcgaccacgaccccaagcacaactttgaccagcacgtcgaccagcactgcaaccacgcccacttcgacttcgaccagtacctcgaccacaccgacttcaacttcaaccagtacgtcgcccagcacttcgaccatcccaacttctacttcgaccagtacctcgaccacgccgacttcaacttcaaccagtacgtcgaccagcactttgaccaccccaacttcaacctcgaccagtacatcgaccacaccgacttcaacttcaaccggtacatcgaccagcacttcaaccacgcccacttctacttcgaccagtacctcgaccacgccgacttcaacttcaaccagtacgtcgaccagcacttcgaccaccccaacttcaacctcgaccagtacatcgacatcaacgagttcttcgacatcaacttctacgagcacctcaactacaacacccacttcaacttcgaccagtacatcgaccacaccgacttcaacttcaaccagtacatcgaccacaccaacttcgacttcaaccagtacatcgaccagcacttcaaccagtacttcgaccacaccgacttcgaccagttcttcgacttcaacgagtacttcaacgactacaccaactacgaccagcagttcgtcaaccacaactaatccgtcgtccagcagctgtaccaacgcggctggtgacagagcgtgcaacttttacaagaataggtgcaaccgattttcggcatggcttaaacagcattgtgccaaagcatgcaacatgtgcccatcaacgaccaccagcacttcaactacaacctcgacttcaacaagcacctcatctaccacgaccaaatcgtcaggtggttcatccggtagctgcattgaccgtattggtgcccgactgtgcagccgttacagtaggatgtgcaaccgttttggcatttggatgagactgttctgtgccaacacttgcaaaatgtgttgaaaaaacaatgaaaacagatggatgtgaggaggaatttgtgaagaaaaagataaaaa

SEQ ID NO: 56581 - DNA, 1267 bp, Heterodera glycines
  Genomic contig location: Contig_ID=SeqID_25817; Location=95..1361; Strand=+
  SCN-specific regions: Sequence locations=1-121,154-754,776-1003,1025 -1267
  Gene Ontology: Biological process=positive regulation of growth rate
atgggcaatgttgagcagcagggcaagcactgcttgttgctccgccagcaacaaccgcctcgggggaaagaagcgcaagtttcttccgactcattaacatccattaatcctccgagcggcacatcatcatcaccatcatccacatcattatcaaccgccgctgatgtgccgtcccaatgcaacgcaaggcattgccaacatccggcaacgccgacaacggcacagattactgatcaggaagaggtggcagcagaagcatcgtcggcaagagctgctgatcatctgcagctggatatcgatcagaccagcatgaatgcctcctttgacagcgatcagaccggcaaggatgaatatgatcagagcactgatcagagatgggtgcttgatcaaactgtaggcagcgatcggatcagtgatcaatatttgagggctgctggtcaaaatcgaagggctgcccggaaatgggagattgatcacgatcagagcgctgatcagaactggaacagtgatcagagccaaattcctgtgcagcagatatggaagagagatcgaaatcggagcccatatagaaatgatcagagtcggagcactgcgcagaatcgagcgactgatcagaatttgagaaatgatcggaattgggcgattgatcagtctgagaatgctgatcataaatgtggtgccgatcagcgatgggtcaagattgatcagaatgggctggacaataatcggctgtcgtcttctgatcacacatttgtctccccttctccaccttccactgatcatcatcatcatcatctccatgcttccaatttttcccatcgctttttcggccactattttggccctctgctcctccatccgatcgttcgtgcactgatcactgttggctacatggcttacattggcattgcgatcgctggctgtatgaattttcgcgaggggttggagccaagccacttggtcacctctgatcattacattgcccgctactttgatgacatgaaaacattttggaagatgggcccacagcttcatattgcggtgatttggggcaaaagcatgggactctgatcactttgttgattacaattagtgttaagccatgttggtctcggttccttttggtttgcatttatccgatccccgaaatattccgcctcgaaaattccggaaattgtgaccattttgtttcgagataaccctaaacggttactttattaattagtagtcaatgataatcagagggagaaaagaccaaccgatcaaa

SEQ ID NO: 56582 - DNA, 799 bp, Heterodera glycines
  Genomic contig location: Contig_ID=SeqID_25818; Location=448..1246; Strand=-
  SCN-specific regions: Sequence locations=1-173,212-359,421-799
agtgaactatatcgcgaaacaaaatgccccaatcctaagcagagcaatatttttgagcctgacatcaattataacctggtcattcataacaatggatcatcgacagaattaaaatggaaatgctttagaacaaaaaaatattccgattcaaaaagtatcaaaaatatttttggaataaattattttatttttaatttactaaaaaaaattaggacgccgaattaatgatggaaccgatggggcaggaccaagtgaacaaagagaattgccaaatgaaaagcgagtgccaaaaataacgcaggatttgttggcaaattttaccggtaaacaaaatgatcagaatcagcaagagaatgaggtaaaaaaataataaatattaaaatcattttaaatacatttaatattcaatttgtaaatattcagagggaccgcgccataaatgagactttggatttgctggacaattttgggagtgaagatcatcagaaagcaccagcagaatgagaaatttgtggtttttttttgattgtcagaaaaattgttgttggttcatagaagaagtaaaattaaccctttctgaacattttgccaaatttaaaaaccttttttttccataacataacttacattttcagctttataaatattttatgtgaattatccgctctatttcaagaacaagcaaaaattttttattaaatgatccatgaaagggatgaatgcactttcttcatggatataaacataataacaattcaatttatgttttttcttaaaaaaaaccaaattaaataataaa

SEQ ID NO: 56583 - DNA, 590 bp, Heterodera glycines
  Genomic contig location: Contig_ID=SeqID_25819; Location=893..1482; Strand=+
  SCN-specific regions: Sequence locations=1-312,344-590
atgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtcgtgctctgaagggcgtgggaggggggggggcgaaggcccaccacgaggccgcgaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttgttttttgcataattaattcataaatatttttttcagaaaatgctctga

SEQ ID NO: 56584 - DNA, 673 bp, Heterodera glycines
  Genomic contig location: Contig_ID=SeqID_25819; Location=209..881; Strand=-
  SCN-specific regions: Sequence locations=1-56,78-673
aaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaac

SEQ ID NO: 56585 - DNA, 1173 bp, Heterodera glycines; identical to SEQ ID NO: 25821
  Genomic contig location: Contig_ID=SeqID_25821; Location=1..1173; Strand=+
  SCN-specific regions: Sequence locations=1-249,276-544,566-982,1006 -1173
  Gene Ontology: Mol. function=calcium ion transporter activity; Cellular component=integral to plasma membrane; Biological process =calcium ion transport

SEQ ID NO: 56586 - DNA, 189 bp, Heterodera glycines
  Genomic contig location: Contig_ID=SeqID_25824; Location=1..189; Strand=-
  SCN-specific regions: Sequence locations=1-117,140-189
ttttagattcaaatttgttttcgttgtttcatttcctttcattcgcaatgcctcagtacaatctgttcgcaaaccgatcgttgctcttcactagttcgtgttcgtttttatttatgacatatttcgattttgactattttcacagaacgtttcttcgtcgtcggtcctcccggcactaagggattgaat

SEQ ID NO: 56587 - DNA, 310 bp, Heterodera glycines
  Genomic contig location: Contig_ID=SeqID_25825; Location=1762..2071; Strand=-
  SCN-specific regions: Sequence locations=1-7,62-216,238-310
atggttgtgctgctgctgatactgttgttggtgctggtggtgttgcagttgttgctgctgcctttcgctcggagttggcgacgagaaggccaacgcggcagaatttttcgtggacgacatggacgaactgcgccgactgctgccctcgcccattgcgccggcggcgatggaaagcgacgccagcgactgcgagtcgtccattacagaagtccgtttgctgctggtgctgccacggcggccgaactgttgcattttgcgacggagacggtcgaatttcttttcttgaggcattagaaatttgtaaaataaa

SEQ ID NO: 56588 - DNA, 896 bp, Heterodera glycines
  Genomic contig location: Contig_ID=SeqID_5018; Location=3..898; Strand=+
  SCN-specific regions: Sequence locations=1-185,207-336,365-896
atggtcaaccgaagcgattgcgttgctgttattatctgtcagagcatgcatttgtcaacgttttcaaggaggtgtgtccatagtttaggttgtcagaattggaatgtttgggagctctaaactggaaaaaagccataatttctagagcgcgggatttcgaaattgccagtaccggggtcgggacttgaaaaatggaccggggcgcgatttcgggaccgagactcccggtcccggtggtctgtcaaaaaaaacgggatcggggccgggagtcccggcaaaatcccggcgggccacggtcccgtccgggctctaataatttcttaagcgactgatttaattactttttaatttccgttttcccatcaattagaaatttatccgtgccaccacttccgccagctacgaaattcatttttttgtttataagtcaactccaatcgagccatttgaattggtgaacaaacggacaaacgaaaagctgatattgataaaagcaaaaagaaatgcaaggcttaacaaagggataatgaagcggtatccgattgggaattcggtggcggttccgtggggaaaaaacggaaatttgaacaatttgaacaatgtcagctttatgctttgcgatgccaaacgatgcaacgggtaagcaacaggaatagcaccgaattcgactcccgaaaaaactttggacgtcggaaattccgatttcggaaaaaattatgatttaaaaaatgggaaaaagtattcttcaaattgctccgaatttttaggcctttgtctctatcagcagcgaagcaacgaaaagggtgtctaattatgtgaaagtggctactcaacttttgaggaccagacatttgaggatatccccgatttttgaggacataaaccatttcaaaaaa

SEQ ID NO: 56589 - DNA, 114 bp, Heterodera glycines
  Genomic contig location: Contig_ID=SeqID_5018; Location=1295..1408; Strand=-
  SCN-specific regions: Sequence locations=1-114
gggctatcgtatgataccaagattgtgcaatttggttgcgtctgagaaaagttatgagtggatttagtcaaaaatttagcaaattttgcactttttgtccttcgaccaccacgg

SEQ ID NO: 56590 - DNA, 282 bp, Heterodera glycines
  Genomic contig location: Contig_ID=SeqID_5018; Location=924..1205; Strand=-
  SCN-specific regions: Sequence locations=1-105,127-128,151-185,207-282
atggtacaacatttgaggacatacataatttcaaaaaaataaatggaattttattttatagcatttaaaatatagaaaatacacacaatcaaattggctatacggaatttggttgaagactttgatgcaaatgagaacccaaatggggatgaaattctcacacattccttatcgtttcaaaaccgtcttattctcaattcttttggaaactggcatgatccagataatcaatggctttatattcgctctcgttggcccttgggaaactatttttaaaataaa

SEQ ID NO: 56591 - DNA, 857 bp, Heterodera glycines
  Genomic contig location: Contig_ID=SeqID_5018; Location=1705..2561; Strand=+
  SCN-specific regions: Sequence locations=1-377,411-668,690-805,827-857
atgggaagagcaaaagaatggaaaattgacatttttgacagaaacggaggacgagaggagcacctgctggacaaaaatgggtggcggaattaaaattaaatatcataaaataggtagtagaatattctggcatatatttttcaggatttgcttattcttaatcttttttcgtattaattttttgattttaaaattgggaaatttaaaataaaattctcctccctttaaatttaaattatgcgcacatttctgagaagtcaattttgataaaaattggtattctttaaaaaaacaccacatacaatacgaaaaaatatatctgctgaagagtggagaaaagataggacaaaaaggtgagtttttaacgtgaacttttgtttttaaattttttaaatttagatttttaaattgtcgataattaaaagttaatggcacggcaggccgtccagcaaagttgcattaatattggtgctaaatcgttctttcaaaaaaaaaaaaattataatgggcaatcattaaaaaacatcaaaataaaaaaatttgctgatggccaaaaatgttcgaaaagcaaggtttttgagctcttttggtcataactttttggaatcttaaccaaatttttttgaaaattttcagactgatagagaacacttagggatatgattgataaaaatgttttatataaattatggccaaaaacagcgaaaaattacgttttctagcttttttttggcgccgtgtgccatataaacgctaacaaaaattatcaattaaaaaaaagttcacgccgcattctcaaaaaggtaaacaaaaattaattaatattctctgtggaaagaacccgattcattaggtaa

SEQ ID NO: 56592 - DNA, 1982 bp, Heterodera glycines
  Genomic contig location: Contig_ID=SeqID_5018; Location=2624..4605; Strand=-
  SCN-specific regions: Sequence locations=1-16,102-141,234-563,585 -617,647-698,720-745,771-965,988-1077,1099-1124,1146-1484,1506 -1521,1556-1982
  Gene Ontology: Mol. function=cAMP-specific phosphodiesterase activity; Cellular component=insoluble fraction; Biological process =signal transduction
atggaagccaaaaaagtaaatattaaaaataaaattttttgagtaaataaaataattaaaaacataaagaatcaaataaagaatattaaaaaataaataaaatatatccttaatatttgggttttaatttaaaattcaagcaaaaattaattaatttactttaataaaacaatattatataataaattaaaatacttgaaaataatattttttatttacattaattaaatttaggttcttcgctcggccattcatttggccgatttgtccaacccgacgaagccaattgagctgtaccggcagtggaatgagcgcattttggaggagtacttgcgacagggtgatcgggaaaaacaggtgggttttttggccagggccttttagaattttcaaaaactttttaaaatttttagctaggcctggagatcagcccaatgtgcgaccgaggcaatgtcacggtcgagaaatcgcaggcaatttttgggatttttaatatatttttgattgggaaattttcaaactgattcgactcccattggctgcatcatttactttaaaatccccggaaaataatttgtaatttattaaatcgagaaaaaattgataatttttcttggaattttaattaatcttaataaaaaatatacttaatactttggtagagaattagaaaattttacgaaaaaatttctgtctgaaatttttaaatttttcaaattcatcaaatgggagagctgttttaccggagcgggggcggggttaaaaatatcctataggttagataaaaaaaaaaattgacacagatttaactcgcaccaaatatttttttttaaatcttagatcggcttcatcgacttcattgtgcatccgctgtacgagacatgggccgagctggtgaatccggacgccaacgccatcctggaccagctggaggacaaccgccaatggtacatgacccggctggaggagatggaggacgaggaggagtgcagcgaaagtggtgagtcaatggaaaattaaaattccccccccccacccacggcgcccttgaaagaaaaaaaaaaaaaaattttaccgaaaaatgtacaattttttaaattttactcaattaataaattggatctaaaattttttaaattttccccggcggcgtctaacgctagcgccggatcccaattttcctatatatttttttttttcaaaatttggtctcaaaatggccaaaatttcccgttttttctacggcgccaaaaaatttaaatcaattcactggacaaaaattttttgacccgaagaacaaaaaaaaaatatcgtcggttgcccctcccgattttttttctggttacaataagggcattggcatatgcgatttgttggcatcgaatagattttttctcttttgaattgttttcattctatttataccgatttttttttcaaaattttcatttttgtgggcttgaccaaaatgttaaaaaattaccatttaaatttaattatttttagacgacaccgatgacaagcaacgacaacaacagcagcagcagcagcaacaactgctggagaagccgttcccgaaaagcgcctcacttctgatcagcagcggacagagcacaccgcagcggagcagcgacaagccgagcgcacccggcacgccgaaaatggtgtgatcggaccagcggatcgagaacaaaaaaaaatcaatcatcggtgaccagtctcggccggtaccacccgaacagaacacatcaatcaatcatcatgccaacagtcgagttgtgccgtcacattttgacgagcagtgcacggcttcggcacccaaatcatatggcacaatgtatctgtcgagagtctcatgtcttgaatttcgaacccattctcggagatatatttgaatagacatatctttcgagactttcgatacatcctttaattgagtgtctccccgagaggtggactgacactctcgagcgccaattaaa

SEQ ID NO: 56593 - DNA, 1165 bp, Heterodera glycines
  Genomic contig location: Contig_ID=SeqID_5019; Location=168..1332; Strand=-
  SCN-specific regions: Sequence locations=1-235,283-338,381-396,434 -595,617-733,869-923,1020-1165
  Gene Ontology: Mol. function=cAMP-specific phosphodiesterase activity; Cellular component=insoluble fraction; Biological process =signal transduction
ggcgtgttctccgatttggaagtgctggcggcgatcatcgctgctgccattcatgatgtgagtgccatgcttgtaggacaaaatgactttatcatagggatcgtaaagtttattatcatccatgatttggtcattttctttttcagcgggttcaaaacctaattaaaatccgtttatggaataaaattctttttttcttattaggtcgatcatcctggcttcacaaatcaggtacaataaaaattttaaaaataaaaaatttattttaaatttaaatattttcagtatttgatcaacaccaacaatgaattggccatcatgtacaacgacggtgattgattattttcaaaaataaaatttaattaattcaaaatttaaatggctgaaaacgaaaacatttaaaaatttcattataattcaaatttaattttatcgccaatttggtctttttatctttttgttatcattatttttgttttaaatgaatttaggcactttaattgtaaaaaaaaattatttttacacttattttctttttgcattttggcactttttccatattatttcattttataacgttttttatgaccttttcttttttatattattaattttacagaatctgtgctggaacagcatcatcttgcggtggcgttcaagctgttgcaggaaagggattgcgattttatggccggggtcagcaaaaaacagcggcaaacatttcggaaaatggtaaaaattgaaattgaatatttaacttaaatattttataattttttatttattttaagttaaaataaatagaattttcgataaaaaaatattcaaaatgtctcttttttattaaataaacctaaaaatttataaacttgcgctcttgaattaaaaatgctattcatttggcttttgttagttgaattaagtttttttttacataatttttttaataattttggttttttaatgtatttttttattaaatttttttgatttttattgtattttttatttttattttttcaaaaattttcaggtcatcgaaatggtgctggccaccgacatgagcaagcacatgactttgttggccgacctcaaaacgatggtggaggcgaagaaggtgtccggcacggacacactgctggacaaataccaggacagaatattg

SEQ ID NO: 56594 - DNA, 507 bp, Heterodera glycines
  Genomic contig location: Contig_ID=SeqID_5019; Location=1210..1716; Strand=+
  SCN-specific regions: Sequence locations=1-457
atggatgataataaactttacgatccctatgataaagtcattttgtcctacaagcatggcactcacatcatgaatggcagcagcgatgatcgccgccagcacttccaaatcggagaacacgccctgaggcgaagggaggtaagaggtgatcagcacggtgctgagtcgttatataaaaaccatcaaatggaaattttcaacctaaaactgtccataacttttgtcaaagtcaacagaacagaattaaacattcttggtatcatgcgatagccctaacatttctctattagttcatctaaatttcaaaaaatttggtcaagcttaagcaaagtatggccaaaagtacacaagcaaccaggttttcacagatttttggccataactttttttaaacctaacgaaatttttttaaattttgcagactaatagagggcacatagggttatcgattaatagcaaaaaaataaaaaacaaaaataatttctaacagaaattttttaattaaaa

SEQ ID NO: 56595 - DNA, 807 bp, Heterodera glycines
  Genomic contig location: Contig_ID=SeqID_5020; Location=235..1041; Strand=-
  SCN-specific regions: Sequence locations=1-55,100-153,191-254,317 -435,499-651,698-807
  Gene Ontology: Mol. function=cAMP-specific phosphodiesterase activity; Cellular component=insoluble fraction; Biological process =locomotor rhythm
tgtgcaaaggctacgtaatacccaatctgtgccatccgaatttggggtcagttacaaatttaaaaaatatatttaaaaaaaaattatttttatattttaggtgccctgtaaaaaagaggtaagccaagccttgaattaaatgtcaaacgaatctttttttatatagaaaatttgtatattatttattttacagatcgaagtttacatgcaacgaataaatgaatggggtttgaacatctttaaaattcatgaggtcattttaattttaaatatttttttcatttttaaattgttttaattttattttatatttttaaattattaaatttcgtttgccatttttagtggggattcccatttgattttttgagtctcgaggaattttcagtctcgaaaggcctaatctctgtgcttaacagtgcctaaatttctttcaattttacaaaaaataaaataaattaaaaaaaaaaaatttttcattaaatatttcaatttttagctgtccaaacagcacagtttgaccaccgtcacgtacacattgctcaggaagcggaagctaatgttcaaatttgacatcaatccgggcactttggtcaactttttgctgcatttggagcataattatcggtcggaattttgtgacggaacgccaataaattttttttaaattttagtttaaatatatttaagtaattttggtatttccaatttgccccctcttttaggaataatccatatcacaaccaaatccatggcgctgatgtggcccagtccatgggcgtgctcatctccacaccggcactcgaa

SEQ ID NO: 56596 - DNA, 470 bp, Heterodera glycines
  misc_feature (404)..(404): n is a, c, g, or t
  misc_feature (464)..(464): n is a, c, g, or t
  Genomic contig location: Contig_ID=SeqID_25829; Location=72..541; Strand=-
  SCN-specific regions: Sequence locations=1-45,67-69,91-204,226 -248,270-278,300-470
atggtagtacactggtcaattctggttagagttgaccgggaccagccggaattcccgggtctcccaggtcacggattttctgatcccggtaaatccagtcccggttttccccaaagttttagtccgcccaacgctacttctaatgatctaatgattgatggttggcacactaatttttgcaacaaaatgccaaattgtgtgttattttcattttcaactttttctctccatgaatttccaattcagtgcaactaatcatttccatttatcaattttcaacattttctttcttttccaacttcaaaatgtccgatggatttgccaaaatgtcgcggtcggaccaactcaaaattggccgtgacagattgttgcgctgtttggccaaatgcggcggagaataccanagtgtacgccatttggacgtgcagaacaaatatttggaggaatacaacgcccaactcagncaatcg

SEQ ID NO: 56597 - DNA, 1174 bp, Heterodera glycines
  Genomic contig location: Contig_ID=SeqID_25831; Location=176..1349; Strand=+
  SCN-specific regions: Sequence locations=1-110,132-337,360-790,864 -962,984-984,1006-1090,1112-1174
atggacgttgagttgatgaatgaatttgcgatgggacggattggccacgcgatgggcggtgggggggggtgagaaaatgggaaaatgcgaagggattgtcgccccccacccctttttatccctttgtctttgcccttctctcaatggcctaaaaagcttcgagaaatttaatggaaaatattaacagaattctttcccaataaatcaattttcacaaatattcttcatccaattactcattttaatctcttttttctttttgcctattttctgatgacgtcatttaaattttttttcatgctaatttcatttttagcaaatgcgtaacggcagaaaaaggacagccaaagagacggcagcgtcgcctcacaatcagcaggggacgagcgacgaattcggcacagaacgaagcgaagggaacggcggagggattggccaaggaattggccaacttcggaacggactcagttggccagtggaggtcataaattcaaaaaattgacttttgttctccagtacttttacattattttcagtggttcggcacttttcccattcgaaaagttacgtcagaaaatgtggcaaaacgattggacgcactgctcgaatttgaggagggaagcaatgcggacggagcatcgggcgggagaacagcacggcacgggagaagggcatttttgcggatcagggaaacggggattgaagtggcaggggaaacggaggacggaatggaaaaggtgggacaaaaggatggggagaagggggaaatgaacggacgaaatcaaaattagagggggaggaaaaaaaaggggggaaaggggcaaaataagaggggggggggggggggtgaaaaaaggggagggataaaatggaaagcaattagcaaattaatcagcatcatttatttccaaatttggcataattctctccgtttccattgcttccgccccatttgtctgcctttctctcctccctttgcttctcaatttaattttgggttcccttttctttctccccccccccttttttcccaacctttggccgaatcattcgcctaatccttcccccccccacccttcacattttctttaaaaagcatataattaattatctctggaagaagagaaaagagaatatttttcaattaattttcattttcaaaaaaagacggaaa

SEQ ID NO: 56598 - DNA, 125 bp, Heterodera glycines
  Genomic contig location: Contig_ID=SeqID_25834; Location=25..149; Strand=-
  SCN-specific regions: Sequence locations=1-125
atgatcatggagacggaagaaggagagaaaaatgagggaatgccattcgtgacagaaatcctgaatgttgttaatgaaatgtgtggcacggaaatgccagagaaaactcaaaaagagggtttggg

SEQ ID NO: 56599 - DNA, 908 bp, Heterodera glycines
  Genomic contig location: Contig_ID=SeqID_25834; Location=442..1349; Strand=+
  SCN-specific regions: Sequence locations=1-406,455-468,494-524,546-908
atggttcgtccaacgaaaagcacaattcaaaagcgcaatgccgcagcggcgggttgcgccgtcattgaggcacaaaaggcaaggatggccgctttaaaagcgattttggataggagcgtgccggcggagagcggtgatccggcatttttcgagatttgccagcaaatctgggcaattcttggccaattcctgggtaagttttgccttatttggatggggaaggcgggagatggaggggtgggggggggggaaaggaaaacgccaaatgcaaaaatgaatgattgtaaggatggaaaagggaaaaaaaatgggaaagaaaaattgcgagatgactatcagtggatcggtgtaatggccgagaaagccattaggggaggggcataaatgtgtgcaattaatgtgtttgtatttaaaatgattaaaaatgattttaaatatatatatttatttatttgagggaaagtttcgaaattataattaaattaaattaattgtttgggtttaaatagtacttgaattgtccacaaataattggctaaaggaaaagttgaaaaaaatggaggttactgtaggtcactttaccggtccggctttaaggggaattgtggccagtgactttcggctatttgaccaagccagaggaactcgcaacggcatgggcaagcagtctgccggcgcaagtcggcctgcacccgctgcaccattcgctgccaatgaagcgactcgtgtcatctgtcgcgcacgagggtcttcacctcctggaatgccaacagggaagacagtggccgcgtgctggcagcagcacaaagcatgatcatggcccattttttcgtgcaaaatgtgcagaattgattgagatgtccggtggactgatccagccggaattcaaagagtttgaccatttgtga

SEQ ID NO: 56600 - DNA, 707 bp, Heterodera glycines
  Genomic contig location: Contig_ID=SeqID_25835; Location=197..903; Strand=+
  SCN-specific regions: Sequence locations=1-46,69-161,198-427,454-707
atgaaaaatggggaccaaaataattgtaattggaatgaaagtgataaaaatgatgaggaaaatgaacaaaaatcgcaccaagaacagcgcgaacgactgagactgattttggcgggcattggcgacggaagcattgggccaatgaaaattttgtcaaaaagtaaatttaatttgtttttaatttcaatttaatttttcctaatagtcattggatgaaaaacttagttttttaagtattttttctgcagccttttttcttaccgaagtcccttttatggctaactatgaacaggttgtaagctttctaattgtggctaaattgggttattcaggtaatcttttttttgggtatttgaggttacacgtttctaattatgtttaaatttggttatttgatgacctaaatttggctattagagtgcatgtcataatattttaattatttatataattgaagtattaattgttcataattaatcacagattccaaaagtgacggttcgtctcgcaaccgacgaagacgcaaaaaaagaaatgacatgctaattgcgataatagtcgtgttggttgtcgtcattgtggctctgatttcatgctatttcggccgagcgtgtgatgggagcagttcggcaccggctggcaccagtgccaacaaatcggccagcaaaagtgccatttcaagcaaaacggaaggagcaagaaaatga

SEQ ID NO: 56601 - DNA, 375 bp, Heterodera glycines
  Genomic contig location: Contig_ID=SeqID_5022; Location=50..424; Strand=+
  SCN-specific regions: Sequence locations=1-375
atgtggcactttctccgaaccattgagctgcacgaaatgcctgaattcttcatggatagccatctgaaccctgattactaccaccgaaaaaaacggacgctctaccatcgctgtattttcgcaggatgtcgtgcgaaaatgtgagttgttttttgcccaattgataagcttgttatttcaacaaatgggtttagaaaaatcgctcagtcggcaggaatccgccgggtgtactacaacgtggcgcacatgcacgggggacaaattcatcattaaaaaatgtgcgaacaggggaaaaaagtgggaaagatttctagagcccagatttttttttaaaaaaggatattttctagatgcctttaaaatatttggttaaga

SEQ ID NO: 56602 - DNA, 334 bp, Heterodera glycines
  Genomic contig location: Contig_ID=SeqID_5022; Location=597..930; Strand=-
  SCN-specific regions: Sequence locations=1-290,325-334
atgacaaaattgaaaggatcgatggtaattattgaaaaacggtcaaaagagggtctccaaaaggagtgcaattttcatatgactgcaaaagcaatgggaaagcatccggaacaaatacatcaaggagatgagcaaaaaaaaagtgagtaaaactgcaaatgtacgcatatttaagggcaattaacaacaaaaagggcatttcaatcaaaatgttttattggcagcaaaagtaaatacaacatcaaaatgaatggcataactaaggcccagatgtttttaaacatttatcgtaaactaagaacctttaaaaagatatttctaaatgcctattaaa

SEQ ID NO: 56603 - DNA, 1017 bp, Heterodera glycines
  Genomic contig location: Contig_ID=SeqID_5023; Location=646..1662; Strand=+
  SCN-specific regions: Sequence locations=1-280,302-925,948-1017
atgtcagacaaccgaaaagaagcagagcaaaagatggcaaaagcaatgtaaatttaaaatgccagttttcaatttcaattttgttttcgcttttttcagcttcatctccggcgacggttggctggcggtgttcgatttgctcccaccttctcaacttggcctgggaattgcaatgatcagcccccgttttgacttctatgtggacgaacatttcaaaacgcgcaaatgggcactgaaatttatgcgaattcgaagcaaaattggagcaaatggcacgaaggaaatggaagttgtcaattacgatggaaaaccgttaccaatgccacaaattgaattgccgcgcaaagtctccggattcaaacgcattctcatcaagtaaaattgtggctatatgtaaaaattttcggcaaaacttttccccattcattttcagtttcatcgaccgcaatgccatcgcttttctccaccatttgcgtccacttttcgcttcatgtccaattaatttgatcatcaatgcggccagtgatcacattttggagatcactttgcatttggccactgatcgtgaaaaatatttgtggaatgtttttttcctatccaattttcaaacatttgcgacaatttgcgccataacttctcaggacgggggcgtgaagactgaaggtgggggtagaaaaatttacaattttttttcttcaattttttttaacaataaaccttttttcttgaaaaattgataagtttgaaatttaaaaaaaataaacggtgaaattttgcccggcgaaattttggggtgcacctcgaataagcttgcactaacaataaatttcaccctaactgaatttttttttaaatttcaaaacagaaatttttccagaaaaaaataaaattttctagcgtttattccttgaattaccatttttttcaaatgtttccaaaaaatttttcggaggatgggacgaagcgatacattgagggagtggaaacgagctgcccccgttaacgacctgctccgaa

SEQ ID NO: 56604 - DNA, 121 bp, Heterodera glycines
  Genomic contig location: Contig_ID=SeqID_5023; Location=1868..1988; Strand=+
  SCN-specific regions: Sequence locations=1-121
atggtaattattgaaaaacggtcaaaagagggtctccaaaaggagtgcaattttcatatgactgcaaaagcaatgggaaagcatccggaacaaatacatcaaggagatgagcaaaaaaaaa

SEQ ID NO: 56605 - DNA, 695 bp, Heterodera glycines
  Genomic contig location: Contig_ID=SeqID_25836; Location=674..1368; Strand=+
  SCN-specific regions: Sequence locations=1-131,153-529,569-665,687-695
atggcgtgccgatgtgtccggcactttgacgatgaaaaaatgggtggacaaaatgccggagggcaccgacccgaggaaattggacgaacattcgatgggggaacagaagttctacgcgaacaaagaggtgaaaaaacaacaaccacaattattccgtatttttcccttaattattcccatgccattttggtagattttcgcccaaaattaccaatttgtcggtgattggcaattttaacagcgcattaagggcaacaaaaaatttgtttgaccgctttaaatatttggcctaaaaaattgcaaaataatttgattttttccaccccacgcaatacaaaatatggggggggggaggttcaactaaaagttttgcgaaatggtctacccatgtaaactgctaacgacctttttttaaaggcattttttgggcgcgcttttttcaaaaaaaatattaaatgagattttgggctaattttttaagaaatatatgtttctggcgggccgctggtgccgataggcgccgccggggaaaattttaagaattattaataattttgttaataaaatagccaaaattttcagaagttttcccttcgccggcgacccccctcccccacctcttttgggtgcaccccaaaatcacgccgggacaaaatcacgccgccaaaaatttaaaaaaaatttttcaaacttaa

SEQ ID NO: 56606 - DNA, 370 bp, Heterodera glycines
  Genomic contig location: Contig_ID=SeqID_25837; Location=82..451; Strand=-
  SCN-specific regions: Sequence locations=1-95,117-120,146-370
atgggaaatttgccccttatttccttcattttctttttttccattatcattcctgttgctaatggtgtgatcactcgatcactaacacctcgacgtggtgctgctggtggtaatgccgtcgttttattttggttttaaatgtttggttgccatgaaaaaaaatgcaaatttaagtgaaacgttgtcatagtcctttaactttcaagcaaagttcttgaaagtttttttaaaattaaatctccaacgcttttatttgaaaaatatagcgacagataccaaaaccaaggacttttatttccagttctttttggttttcaaggacttaccattcaaggacaaatgacaacaacccgcagattataataataaa

SEQ ID NO: 56607 - DNA, 1140 bp, Heterodera glycines
  Genomic contig location: Contig_ID=SeqID_25839; Location=351..1490; Strand=+
  SCN-specific regions: Sequence locations=1-8,37-394,416-1010,1032-1140
atgttggtgtggtggtgctgctgctgctcaccttcctcagcaagctgtttggtgccgacatggccattatccattggagaagctgttcaatgccttgccaaaagaatggtaaggcattaccaaagaaaacgaaaacaacggatggaaatcaaaatttcatttttatagtttttttgcaccttcggcttcgccccccttcggcacaaatgtgtgaaagttttccgccaaattggcaccgcgcaatttgcggcccaacgtccgctcgttgaaatagcgcacccgcgaccggcccagctgttgtcgacgcgtgcggtccaacgaaaactcgccgatacagccttaatccgaagggggtacggtagggctaggtctcaagagcgaaggtgtacggtagaattttggcatttggggaaaacggtggcaatggcggagtttcacaaatcccggccgcaaccgcccgtcctaaggccacgaagctgccgaaaattcccaacaatccacaatatttagaagcgcaaagcgcccgtctgaggccgcgaagcggccaaatgagtccacaatatttagaagcgcaaagcgcccgtctgaggccgcgaagcggccgaatgcacttgcctataacttatcaaacgcgcatgcactagcaacgaagtcctttgcgcgaagcgctcatgtcagcgcccgcccatatataccaaaagtatactgtctacaccgagcaattactgtgcaaagcatactgtctacaccgagcaattactgcgcgacacgctagtttatattaccatagagaaaaagggggactcgtcttaaaaactaatttgagtcgaacggctgtcgggaggggtctgaaagtggtggaagggtcttacaactttttgaggcgcattcaggaaaaatatgggttttccgctccggtggacggttcagcgccggcggctaatttctcacttttgcttgcgtttgatggcccgtaactttttttaaaggacagggagcggaaaattcttgctggtaggattttaagttgaagtcttttctaattttcaaaaaaaattccaggcctctacctatacttggaagggctgcagaaattggcaacttttcagtaccaactttgcccagttcagtccccgttga

SEQ ID NO: 56608 - DNA, 952 bp, Heterodera glycines
  misc_feature (4)..(4): n is a, c, g, or t
  Genomic contig location: Contig_ID=SeqID_25840; Location=40..991; Strand=+
  SCN-specific regions: Sequence locations=1-43,65-114,136-176,207 -449,471-810,837-929
atgncctttcagtgagtttattgcagttttgtttcatcgaacatttttgtgaaaatcccaaaaatcttaacaaattgtgaaatataactcacaatatcccatccggtcttaatgatcacaaaagtattataaagattccggccaccccaattagttcctcaatgaacatttttcggtttttttttaattaataaagaaaatattttccttggtttttcttcaataatttatcggcgaattaaacatcggcgagttcggttgtctgtttgcccgtattgatgtaactgatcaatttcacgcacttcattaaggtcaatcatatccatgtttatatcttccaagtcaatcaaatcaaaattaataacattttcttgttcagtgtcttgcaattttcttttttttattcaaatgttcgttttcaaaagtttttaaccgctttttttctccggagctttgaaccggttcatccgcttttttgaacgggagctttgaacccgtttgatcatttgagggtcgtgaatcattatcatgcaatgatgatgaagaacactgatcctcggaaggaaaagattgcttaattcgtaccattataaatctaaataaagatacaaaataaaacaaaaaatttacactcaaaaaacaatatcaataaaataggacgattattatgtaagagaaatttctaatatggacaaaaaatggttcaatttcactttgtgcgtcgaatcatttttatgcgtccgatcggaattttttcgctgatcaatgattacgaatataacgatttattaatccaaatccattcaaaccaaattaaattttatatttatttttttcagcttagtttccaataataacgaagttaagtcagatttagcaacaaacggcatttattcgtgatcagcgacctgaaatcccattcgatatgttttatttgattttttaaaaatta

SEQ ID NO: 56609 - DNA, 546 bp, Heterodera glycines
  Genomic contig location: Contig_ID=SeqID_25842; Location=256..801; Strand=-
  SCN-specific regions: Sequence locations=1-546
atggtactccctctgactgctgccctatccaaactgctaagctgtaaacccgaaaatttagcagaatatttgaacaaccccgaggcagtgaacaaagcgaacgcttacttggccggcaaaaaactcaaaacaacctaccagggtcgtgattccaagaccaaagaggtcaagttcggcacattttcggtgaaacccgctgcggaaacctacgcctttgagggatttcttggcaagtttccaaaaattcagtttcggtctaacacatatgcgttcagaggttaaagtccaccagtatttctacataaagcaccggatccgcctactgtacccacagctgaagtgcgttgttgagtaccacaacaagggccactgcaaatactacccattgggtatacaattttgtccggaaaaaatcaataatcattttcagagttgttggccgttgaggaaggcggggagagtcaacccgtcgaaagacctgccgctgaaacggactacctggactacttgaactttcgcagtgggtggcaatcaacactctactga

SEQ ID NO: 56610 - DNA, 1276 bp, Heterodera glycines
  Genomic contig location: Contig_ID=SeqID_25843; Location=93..1368; Strand=+
  SCN-specific regions: Sequence locations=1-332,355-881,903-1093,1115 -1247,1271-1276
atggacacgggcggcggcaacatcaaaaaggcggccgtccagcggacatcaccgacgcccaaattgggcttaacccaaaggcacaaatcgctggaggaaatggccaactgccgattgggcaccggcaccggcagcagtaacggcggcacaaagttgggcggcaaactgttcagggcgttggccggcaccggcaatggtggccatggggacagtctgcagcaaaagctgtcattggcaccgccggcggcggttaacgatggggccactaatactgtagctgcggctactgtaaatgatcgtaattataacaaccgctatcaccaccactatctgcagcagcaacagcatggcggcaataatgaccggaacatggtgctgtccggtgaagtgactgtacagctgaaaaaggtgatgggctgaccatccccggccgagtgatcgctgatcagaagagatcactcgagcgatgactgatccgaaattttattaattctcggtcagacagtggagaggatactgatcattagtgctactagagattattctcacctttcagtctcgggatcaagctgcccggggtcttgtgccgtgttttggggtcaaacctcaactctctcttgttttttgggctctcgggcccttgtcgagcgcgttttttccgtctagagcttcgggacccgtggaaaattttcggtctctggcagcctggtgattgctgtgtgtttgtaatggtgaaaatttggcaaaatgccataaaacggttgtccgtccgacactttcgtccgcccttaaatttttttaaattcttttcacgggcctatgacaaaacaccaaattaaaagccattcaaacaatttttgagattagggccaacaaatgccaatgtttaaaacccatttaaaacccaattttttggattaggaccagcactttttggccaacgaggaaaggcggcagcaacggcatccatcgtgctttaagtccgcctttttgggcaccaatgacaacgacgtcagctatgtttaagcagcatcaaaagcggatctaatttgaaagcggaggatgaggagatatatatttgatcagtgccgccttttctttttctaataattttatatgttccgatcagtgcggcagaacaaattggcaattttccctttccgatcactgataatgattgctaataattatgatgataaccatcgccgaagtcatccaaatattccatcacacaacaatcacatgccatatacataacatacatatataatttgaa

SEQ ID NO: 56611 - DNA, 521 bp, Heterodera glycines
  Genomic contig location: Contig_ID=SeqID_5024; Location=1229..1749; Strand=-
  SCN-specific regions: Sequence locations=1-377,399-500
atggttcgtaaggagaattataaactaacacccggttagtgaaagcttttgaacacgacaaattgactctacaaagacaacacggcaacgatacaaccggagaaaatcgaataaacaggcagaaaggcaaatcccaagcccaattgcaggtccattgctgataacaacgtccgctctggcaataaaagtgaacatattagtttcaaacttttttttaccgttcttgataaacgagtttaaaggagtggaagaaggcaacgacagtactcccgagggaactggaattaagtaattattgtaaggttcatttacggcattcgcgtcggtttgtgtcccaccacatcgttacacacggcgattcaattttgggctccttgtacaattaagttggttttttcgtcttagtggtctgtgcgttagtcaccaaaagggggtctcaggttcgagtcctccttatgttgtatgttaatttcaatttcttcttttacagaagaaggcagaattatttttttattaataaa

SEQ ID NO: 56612 - DNA, 772 bp, Heterodera glycines
  Genomic contig location: Contig_ID=SeqID_5024; Location=2151..2922; Strand=-
  SCN-specific regions: Sequence locations=1-772
atgactttgtctaatgtgccaacaataatctcccgtactgtcaaacccgtcatatcgcataatcagtctgaagccaagagaaacgtccttatcatgtacaaaaagttgcaaagaagtgtgaaagtatattggtgggatttcggtgagtgatttccttccgttatatattaaatttcaatctaagaattttgggacataccgattcctgttttccgtgaagtgttgaagaaacgtatgttcttttttctgttaattgaaggtactgaacaactgatttttaatgaatatccgatccaattcctcctgtagagaagttgcagatccacttctggaatgttcaaaaaacttaccgtaaaatcaattgaatcagtgctcttcaatgttttttttaattatacatccctaaatctgttaagagttcacaaaaaatgcccatatctctgatcttcgaatcattgacagaaaagttgaggagtgccggcatcatatgcagtcgatgaagtagcgacagtaattgcatggaaatgggactcactttccatttttaggcattattactacaatgactatcacgttcgaaacatgctttttgctgaaaacatcgaaccgaaaccgaaggtacaacagtttacgaggttaacgctaattttggtctttaggacttcctttctaaatttcttcgcgggaaagaatagtgaaatgagaagatccatattcgcctccaaggaatataacgttatgtataggtttcgttttttgcgaaaaaaataaa

SEQ ID NO: 56613 - DNA, 328 bp, Heterodera glycines
  Genomic contig location: Contig_ID=SeqID_5024; Location=1555..1882; Strand=+
  SCN-specific regions: Sequence locations=1-258,280-328
atgttcacttttattgccagagcggacgttgttatcagcaatggacctgcaattgggcttgggatttgcctttctgcctgtttattcgattttctccggttgtatcgttgccgtgttgtctttgtagagtcaatttgtcgtgttcaaaagctttcactaaccgggtgttagtttataattctccttacgaaccattttatttcttttatttagggctaatttactatttccgaatttctcacgcgttcatcgtccaatggaagaatttgcaaaagaaatacccaagaagcgaatatatgggcaggctcgtttaattttcatgcttgct

SEQ ID NO: 56614 - DNA, 257 bp, Heterodera glycines
  Genomic contig location: Contig_ID=SeqID_5025; Location=427..683; Strand=-
  SCN-specific regions: Sequence locations=1-257
atggttgcgtcggaaagggggcacgaaagcctcattgaactttcaagaagcttttggcgcaaattatggatttcaaatgtacacctggaccatgaggagtttctcgaggtaacaacttgggtaatattaaaatcatttatttgaatatttagagtctcagacaattgaatattcaaattccacccgatgaaattattttcaataaccgatgggggaaattgatcgaacaatggcattgtgagcttctgaatcgacag

SEQ ID NO: 56615 - DNA, 1014 bp, Heterodera glycines
  Genomic contig location: Contig_ID=SeqID_5025; Location=1350..2363; Strand=+
  SCN-specific regions: Sequence locations=1-355,377-477,520-1014
  Gene Ontology: Mol. function=v-SNARE activity; Cellular component =cytoplasmic vesicle; Biological process=vesicle-mediated transport
atgagcattatccttactctgattgctcgagtgcgtgatgggctgattttggctacttcaattgagggggctgatgacgtaaattttaattcattataatttttcttcagaaatgaaatttagcctgagcacaacactgtcaagtacatgacacaagcgaaaatgctgttcaaaaagttgaacagtccggggacgcctcaggcgcaatcagtcgccagtggacaatatttctttcagtgagtgcatttgttgtaatgaattccatttgaaaatatctgtcatcatttgagctacattgtcaaagacactgtgtgtacgctttgtttatgcgatcagacgctcccgagaaaggctgccttttcctatttggaggaagtcgggagtgaattcctcaaccaacacggcactcaaatcgacgctacggccaggccgtaccattttctcgaatttggtattcctttccttttaatttattgggatccatttgtttcttcagactcatatatccagaatatcaaacgaaaacatttggacaggggccgtaacggtgatcctttctttctcactttttgttagttaaaattcaaaggaatttaacagcgatggcagcggttaacagtgagcttcaggatgtgacacggattatggtctcaaacatcgaagacgtcattcatcgaggggaggcgttgaacagtgagagacttgttaataagtgaagtgtgggagcggcggttagataaaaacgaatattcctattttacactctttaactttcttggatcagaatcgcttttgccctctcccaccctcttaattcaatttgtttcactatttagtcattctaattaacaaaatttagttttggagtccagggcttccgacctttcggatctgagtaaaaagtatcgagaggacgcgagacagttgaaccgacgaacggccatcttcaaactgttcgtcggacttgcagttgctttcgccttcttcatgatcttccgctttgtctatatgtaa

SEQ ID NO: 56616 - DNA, 2011 bp, Heterodera glycines
  Genomic contig location: Contig_ID=SeqID_5027; Location=293..2303; Strand=+
  SCN-specific regions: Sequence locations=1-209,231-738,760-912,934 -1983,2006-2011
  Gene Ontology: Mol. function=amylo-16-glucosidase activity; Biological process=glycogen catabolism
ctactctatcgccgaattcgatcagctgaatccgccgattgaggctaacttttccgatttaaagcatttggtggatggaattgagcatgagtggcacatgttgactatccaggacgtggtgtggaaccacgctgcaaagaatgccaattggttgcaggtgtttgtcacttggctcataaaatgccattgttcccaaaatttgcgtccaaggaccaccctgaatgtgcctataactgtgccaattcggcccacctaagaccggcgtatgtgctggaccgggcgttgaatcagttcagcagggaaattggggaggggaaatggacgagcgaaggaattccgacggacattcgacacgacactcacctttcggtgggggggggggcattcccgtggattaatcggaaagtgccaatgggaaggctcttcggaatgctctcgcttcaaaagtgtttccctccattcgattgcacgagttttttcaagccgacgtgaaaacaatggaaaagcaattcaaagctaaaattggattaagttggtttgataattgaacaattcaaaacttacagttgagacaaataaacggccaattaattaactttcctcagcagaaacccctgagaatggcaacacaggcggcgattccatcgaattaatcgctgacccaaactttcgtcgtttcggatgctccgttaatttgacccaggccgtgcaacttttcgcaacaaaagagtgggacttctttctttctgtttttcgctgattccgtttttccattggtcagtgctgacattggcgaaagcattggccaattcgttgctcatttgaatcggctgaatgaggacgcccgacggaccgttgagggacacattttgaaggcaatcgaagcgatcattggccacgtgcactacgaagtgggggacagacagcagcaggagtttgctccgttcacaacaaatttcagagagtggcagcaaatgggccgcgaaaagaagcagtgacactcagtgaaccgctggtcacaaagtgatcggatgcctttcccggggaacgaatggcctttcccccaaatgtttcagctatttttaccatccttccgaattcggtctcaacgcgtgggaggaggacgaaaagttcgccttcgatccttcgacttccgcccggctgatggcctgcaacggttgggtgatgaacgcggacccaatgtccaacttcgcggagtggccaagccaagtttaccttcgtcgcgagttggtctgctggggcgacagtgtgaagctgaactacggccaacagcccgccgactgtccattcctttgggaatatatgcgccgctacacggagaaatgtgcgcggattttccatgggtttcgcattgacaattgccacagtacgcccattcacgtggcggagtatttgctgcacgcggcgcgcaaagtgcgcaaggacctttatgtagtggccgaactgttcaccggcagcgaacagttggacaatttgttcgtaaatcgactcggaattacctcactgatcagaggtggtcaaaaaagcacccaaaacggatcaaaatgaaagtttagaggctcagaatgcgcatgacagtcatgaacaggtgcgttcggcgtgggttaatgggaaatggcaaagcgtgcttcttcaagggtcgctttgtttaccgctacgggggcgacccggtcggtgcctttcgctgtaaggcaacgcgccccgccccgtgggcggtggcccatgcgcttctttacgaccaaacgcacgacaacccatccccggcgcaggtgccgtctcttcgcccctaatctctctcttttccggccttttgtagaaacggacgccctatgactttgtgccgactgcggcgatgtgttcgatcagcggaagtgcgtgtgggacggtgcgtgggtacgacgaatttgtggcgcacaatatcgacgtggtcaaagagcagcgaatgtaccgcaagtggtcggagttcggggaaaaggcaaaggaatggtga

SEQ ID NO: 56617 - DNA, 1079 bp, Heterodera glycines
  Genomic contig location: Contig_ID=SeqID_25847; Location=29..1107; Strand=+
  SCN-specific regions: Sequence locations=1-17,39-981,1003-1079
atgaacttccgtggtgcaacggaagcatatgccattgttcattcaatgccatttgcccgtctttcgcatcatgttgtcaaattggcaattcatttgccaaaccaacagcccattgtatatagggcattccagctggtgagcaaagctcaacaaatccagcaaggcgaactgccagaaacgcagtgttcagcctattggaaacaatggcaaaatgagtggaagaatgatccaaagtttaaggacattcttttcgaaaaagtcccagagcggttccgatgggcaaaggacaaatgggtcctgtacaaaaggcagcaaattaaaaggccacctatcggccgaattgttcctgtacccccatcggacccggaaaggttcgcgctctattcacttatgcgtcactttcctggagacccagaccatcttaagatggttaatgggttgctttgtacctcattcactgaggctgcaataatgcatggtcttcttgaagacgacaaaatttgggacaaaactctggcggaggcagctctgtcgcgctggccagatcagatgagatggctttttgtgagcatcctggtctatggccagccgagtaatgccatagaattgtggaacaagtacaaagaccaaatgtacaatccgcaaggcattattactctggcacagcataaagtagcagagcttgaagccctagccgacattgattggcggctgcacagctgctttaacttaagctgtgtgcattttagcctgccagacccgccaacttcaattgccaaaaatactgacgcggcaattgaagagtttttctttggcgatgatgatttgaatttgcctccagggcaaccaaatcctcgtccacagccaaatacccctccgccacttaacagcgaccaacagaaggtctttgatgctgttttgttggcaatacagtcgaaccctagggattcgactgtcccccgccgtttcttcatatacggcgatggaggcacaggaaagacattcctgtttggccaaattattaggcgcttgcgaaaggccccatacacctacaaagtgcttgctacggcatccactgg

SEQ ID NO: 56618 - DNA, 279 bp, Heterodera glycines
  Genomic contig location: Contig_ID=SeqID_25848; Location=794..1072; Strand=+
  SCN-specific regions: Sequence locations=1-153,196-279
atgtttgcattttttttggcttaccaaaacttcatcgaacctggttctttctattctctttcaaatcgccccaaattttttttacagccacgaggccgcgaagcggccgagtgagtacattgggcgcaggaaaattattaaggaggagggttcattatttatttatttttgcaaaattaattcataaatttttttcagaaactgctctgaaacgcaccaaaatttatttacaagttgaataaggcactctgactcttatattatcaaaaagggagatga

SEQ ID NO: 56619 - DNA, 438 bp, Heterodera glycines
  misc_feature (349)..(349): n is a, c, g, or t
  Genomic contig location: Contig_ID=SeqID_25848; Location=22..459; Strand=-
  SCN-specific regions: Sequence locations=1-1,24-160,190-321,355-438
aaaatctataaaaaatttaaaaatgagaattcatgcgagattttctggaaataagcttaattgggcctagttaagctgtaaaaaaaatttggggcgatttgaaagagaatagaaagaaccaggttcgatgaagttttggtaagccaaaaaaaatccaaacatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaatccaaatatttaaaaatctataaaaaatttnaaaatgagaattcatgcgagattttctggaaataagcttaattgggcctagttaagctgtaaaaaaaatttggggcgatttgaaagaga

SEQ ID NO: 56620 - DNA, 366 bp, Heterodera glycines
  Genomic contig location: Contig_ID=SeqID_25849; Location=38..403; Strand=+
  SCN-specific regions: Sequence locations=1-274,311-366
atgttgggcagcgtccacaagtcatctcgaacgacctgtgcccatcagcggacgggggcatttggtggtgccaacgctagcccaacaggacagcaggtaggtgggtgaataggaatcacttgggtaatgatccagcatcaggttcacctacagctaccttgttacgacttttgcccggttcaagccactgcgattaaatcggttccggtctgcataccgaccgaagccggaacactaaccggccccgaatttctcgaaatggctcagtcccgggcagcgacgggcggagtgtacaaagggcagggacgtattcagagcgagttgatgactcgcccctacaaggaattcctcgttcacggacaataa

SEQ ID NO: 56621 - DNA, 353 bp, Heterodera glycines
  Genomic contig location: Contig_ID=SeqID_25849; Location=1..353; Strand=-
  SCN-specific regions: Sequence locations=1-6,43-353
tctgaatacgtccctgccctttgtacactccgcccgtcgctgcccgggactgagccatttcgagaaattcggggccggttagtgttccggcttcggtcggtatgcagaccggaaccgatttaatcgcagtggcttgaaccgggcaaaagtcgtaacaaggtagctgtaggtgaacctgatgctggatcattacccaagtgattcctattcacccacctacctgctgtcctgttgggctagcgttggcaccaccaaatgcccccgtccgctgatgggcacaggtcgttcgagatgacttgtggacgctgcccaacattaaggggcagctccctcacgatccatgcttttggggt

SEQ ID NO: 56622 - DNA, 141 bp, Heterodera glycines
  Genomic contig location: Contig_ID=SeqID_25851; Location=253..393; Strand=-
  SCN-specific regions: Sequence locations=1-141
atgacctccgaagaaatgacggtggcggtcggtcaggcgatgcttgcggtggtcgaacgcgacgcatccactggatggggcgttgtcatccacacgatctctgcggaaggagtgaccgcaacaatgattaaatcgcgcatg

SEQ ID NO: 56623 - DNA, 679 bp, Heterodera glycines
  Genomic contig location: Contig_ID=SeqID_25852; Location=997..1675; Strand=+
  SCN-specific regions: Sequence locations=1-263,285-528,550-570,627-679
atgttaaaaacattacattttgtgatatttaactttgaaaagtaatttaacaatttttcttattgaattatgttcaattattttattaagcaatgcaaaataaccaagcatgggcagttacaccaattattatataagacttttttataaaagcatttttcagtcttttcatacattctctttataatagtgttaagcataaaaaattattattgtgattcaatatttaaattattatgctcaaatctttatgttctaaaatgatttatataaataataatttagttttcttattaaggttgtagtgtcctttagagaattaaaaccgtttcatttattttaacaagtgttatggcaagaattaattggttttttcgttcctcttttcttgactgattcttatgtttttgatttaattaactgtattaattttttctaccttcaaaaattgggtataaatttggtatcatttgatagagcaaggtcgacttctattgtggttttttaattaaaattaactgatttttgcttattttcactaaagaaaaatatcatattcattttttagtctaaaaatgattttttaaattatttagttatattatacattaattaaaatttaatttcatttttcagttatttaacaatttcgtatctttttttatcttttattttatga

SEQ ID NO: 56624 - DNA, 445 bp, Heterodera glycines
  Genomic contig location: Contig_ID=SeqID_25854; Location=475..919; Strand=+
  SCN-specific regions: Sequence locations=1-29,51-64,96-292,334 -355,379-445
atggaggcaatgatgaagaatacagacgagagggcagcagcagcaactcagggagccatgaccacagaaaagcacacaaaacaaacagaagtccggaaaaaccaaacaacaggtaagctggcaatgaggaattttttgaaatcaaatgcgaatttattgcttaatagggtaattttcgagaattcaaaattctaataaattacctactttttgttcgagttcggggtttgatggaaaccagattctgacatccgttttgactctgagctgaaccaggattcgaaaaaactagaaatttaatttcaagcaaatttttattattattacagcttatttattgtatcaaaagattgtgattttgtttcgtgaatttgatccggttttgttgcataaatgcgattttgacttaattcgaattcgggttcagagtccggaacgagtctaa

SEQ ID NO: 56625 - DNA, 690 bp, Heterodera glycines
  Genomic contig location: Contig_ID=SeqID_25856; Location=199..888; Strand=+
  SCN-specific regions: Sequence locations=1-78,366-462,487-515,566 -647,669-690
atggcgtgggacttcaacttcatcggaaggatcaagctcacgctcatcctcacaatcgagccgatacggacgatctccgggaagaaaacagaagggaaaggaaaagaggaacagaaagagaaacaggagaggaatagagggaaaaagaggaagagaaagtaagaggaaaaagaggaacaaaaggcgaagaggaagagaaggggaagaggaacagaaagagaaacaggaggggaatagaaggaaaaagaggaagagaaagagcaacagaagggaaaggagaagaggaccagaagaggaagagaagcaaaagacgaacagaaagagaaacaggaggggaatagaaggaaaaagaggaagagaaagaggatattcccggccattaaaaaatctaattgccctcttataaaagctttttggcgcgtagcgccctctagagacagtgtttaatagcgaagctatttcaattttttaaaaataaattaaaatcgtcactttcagtgcccgtagggcactggttattatgaataaaaatttactctaaattttcaaaaaaaaattaataattcgcattctgacttaactccgagtagttgttcggtctcattcctttttcaattacattagtttatataatttttccattaatttatatatatatatatatatatgtctttttgaatattgaaaaaa

SEQ ID NO: 56626 - DNA, 4518 bp, Heterodera glycines
  Genomic contig location: Contig_ID=SeqID_5028; Location=160..4677; Strand=-
  SCN-specific regions: Sequence locations=1-429,451-531,554-688,710 -970,1000-1224,1256-1309,1332-1749,1772-1874,1896-2041,2064-2195,2220- 2520,2542-3045,3085-3399,3421-3668,3690-3706,3728-4052,4091-4518
atggtcaacagagagactgttgatatacgcaagagcaaaataccgattaaccatgcttgtccacaaattttaattggtatcgaccactattggcactttacgttgccaaactcacaaattcaaatacttccctccgaatttttttcaatcgatacaaaattaggaaaaatattatccggaaaaggtactattgaagacaaaatattaatcttgtgaaagaaaagcgaaaaaaggatgagacaaacgaaatccttcaaaaattctgggaattagaaaatattggaattaccgactctccacatttgacggacgaagatacagctctcatacactttgacaaaaatgtcatttttgaagaaaatagatactacatccgatggccatacaaaagagaaacaccgaatttacctacaaattttggattatgtttgggaagattaagaaatgtagtcaaacaattgattaaaaacaaacagttggaaaattataataaaatactgcaagagcaaatggacactaacgttaatgaaattgctgatttcaaatccaaaaatttaattcactatctcccacatcaccccgttataaaagagagttcaaataccacaaaaattcgaccagtttttgatgcttcggcaaaattaagaggaagcaattccctcaatgacgaaattcaccaaggaccaaaattattacctgatttgtgtggaatgattctccgattcagactcaaaaatttcgtcttaataggcgacttagaaaaagcttttctaagagttggattaaatgaaatagacagagacacaacacgctttctatgggtaaatcagtcatatttggacgaaataaaccaaaaatatcgagaaatcgaaatgagagacgtagaattaagacgtttcacacgaatacccttcggagtcaatgcttctccgtttttattaactgctgttgtgaatcttcatttatcaaaaacagatgaaatgtttgaaaagtttaaaacattacaaatagatgaggaattatgtattagtggaaaagagaaacaattcaaagagctatgcacagaacttaaagaaaatgcatacgtcgacaattttgtaatgatgtgtgacgacgaaaaggaaataaaattcaaacattactggagcaaagaaatattcaaattagcatcaatgaatttgagagaattcgtgtctaatcatgaacaaagtaacaaagagattcaaaaattagaaggatctgaaatacccaaaatgacaaaaatgttgggtataaaatggaatgtcgacacagatgaactcgaacttcaaataaaaataccgctaatgagtagagacacgacaaaaagacaaattttgacaatgatcgcaaaaaatttcgacccaatgggttggatatcaccagtaatactcaaatacaaactatttttccaaaaactatggagatcaaacaaagactgggacgataaattaaatgatgaagaaataagagagtggaacaatatttcaaatatagacgaagtttccataccacgctcaccatttacaagtcaaaatttaaaatgtgcttctttacaccttttttctgacgcttctgaattagcctacgccactgccgcatatttacacgcaaataataaaactgacttattattcgcgaaaacgaggcttaccccactcaaaggcctaacaatcccaaagcttgaactattgggactattaatagcagcaagagccgtcaaatttatcattaaagaatcaaaattgaaatttgaaacgatatgtatctggtgcgattcaaaatgtgtactcagctggttaaagtgtaaaaagaatttaccaatatttgtaaaaaacagagtggaagaaataaaacaaattgtctcagaatttcacatcactttctattacgtaaaatcaacagacaacccagctgatttggcatcaagaggtacaacaatgaatgaaatgaaatacaacgaattatggtggaagggaccaaaatggcttaaattaggaaaagaaaactggccagcccacagtttctatactcctgagcaaaatgattcactttatgatgataacataatggaaatcgaaaacactcagacaaatttagtcaaaatggactaccaaggatttattgaatggaaaaaatacaattcatgggataaagtgacaagaatttgtcaaatcttattaaaatttgtattttttacattaaaagactctcccgaattcaaaactaaattcaaaatacagaaatttcaaaacgaattgagcttaaaattcatggcacaaaaaatgctaatacgcataattcagaaagaaatggaaccaaataatgaggaagagagacaattgggaatttacagagacaatgatgaaattttgaaatgcggaggaagattaaaaaatgcacagataaaagcgacaaatccaatattcttaccaagaacacattttggtactcatttaattattatggaccatcatcgaagaaatttacacgctggtacaatgacaacattagcagaaattcgtaaaacttattggattcccaaaggaagaagaattgttgaccaaatcagaaaacaatgtttctattgcaaaagatataacgcaaaaccatatcagcaaccaaaaatgccgcaattgccaaaatcaagagttcaaataactgagccttttcaaaacgttggccttgattacatgggtccacttcaaattaaaagtttcactgaaaaatgttggataatacttttcacatgtttctccacacgtgggatacacctcgaattagtgacatcattatcagttcaacactttctcaatgcatttcgcagatttatttcaagaaaagggacaccgaagaatatttggagtgacaatgcatcacaattaaaacttgcatcaaaagtattacctgaagtcctaaaattaaaggacatacttaaagacgactcaattaaaaactatttcgaaaaggaaaacataaaatggattttttcaattgaattagccccttggcaaaacggagcaatagaacggttaaatcaaaatgtaaaatcagcaatgaaaaaagcaatcggaaggaaattgatagaatttgattcatttcaaactcttatttgtgaaatcgaagccttagtaaattcacgaccaattacattcatttatgacgaaattaattcgtaccaaattcttagaccaatcgattttatactcccacacaaaaatttatgtattcctccaattttggaagacgaaactaatgatccaacctacttaccaaaaccaacttattatgaccaaacaatagagttatggaaaaagacaacaaaaatcttggatgactattggaaaatttggacagaagaatatttgccgagtctgagagaaagatacaaaacagaaaataaaaacccaaagaattgtgtaaaatcttttccagaaccaaatgaagttgtcataattcacgatgagacaccaagagcaatgtggaaaacaggaattattaaaaatgtcataaaaggaaaagacggtatcataagaggtgctaatattgaactaccaagcaaacatgtcattaaccgtccattaaaattactatatccgttagagattaacaaaattgactgtgaagagaatgagactatcacaaacttaataaaaaccactgaacacaaacaaattggtacaaatcgaaagagaaaacaaagtgtcctatcatccccaaaattaagcaaagtatttttaaacacactcacgtttcttctattatttatgcaactcttaccatgcttatcccatttatatgaatgtccaaaaaccaatgaaaaatggagaacgaagtatacaacattttgtgttgaaaatggatttactatcaaacaaaataaattaacaatggaattttgttattgtaaaatattttgtcacaaacaacacgtcataaaaaatcacccaccctattgtggaccacaatgcaaatgtcctgattggactaattcttgtagttttgcctcatatcacagaataaaaagagaaataactgatcaggaaaacattcaaaaaattatttcattctttaaaccaaacgtttgttcattcaataaaacggaaaaatgctccctaatggataaaaatatatttagttcaataatgctttatgataatagcattcattcagtcaaaagtcttaatttacttcatacacaagccaattctcgaattgattatcgttgccttggggagggcaatctgacgattggtacacaaaaattctgtcaagaacacgaatgcactgacacacatggaacaaaattttgcttttacgagccacacgaaaaaacttatcttgtgaaatcagaccgagaaattatcccaataaaagcatggggaagcatcgaaagaattttttatttggctaatgacacattaatggatgaactcaaacgtaaaaaaagagaattcgatccgttcgaaaacgaacaaatatccgctgaatgtacaaaag

SEQ ID NO: 56627 - DNA, 472 bp, Heterodera glycines
  Genomic contig location: Contig_ID=SeqID_25857; Location=145..616; Strand=-
  SCN-specific regions: Sequence locations=1-472
atgctgtacaatgtttttaagccccgccgtgaggcgggacagttccaaaattttgtaccacattttactgtggaaagtccaagtaccttattggacaactacgtgtcaatgagcacagtcgcctttggccagttgtggaacggaaaaatgggaatatcagatggggtgcgctcttttctaaaaattcctcttttcgtctaaccatccctcccttttgtgcactatttcgtttcaaaattgaatcatttttttttgtcttttgaaataaattgtgaaaaatatacgaaaattattttaggttttaattatgctgtacaatgcttttaagccccgccgtgaggcgggacagttccaaaattttgtaccacattttactgtggaaagtccaagtaccttattggacaactacgtgtcaatgagcacagtcgcctttggccagttgtggaacggaaaaatgggaatatcagatggg

SEQ ID NO: 56628 - DNA, 388 bp, Heterodera glycines
  Genomic contig location: Contig_ID=SeqID_25857; Location=595..982; Strand=+
  SCN-specific regions: Sequence locations=1-367
gcttaaaaacattgtacagcataattaaaagctaaaataattttcgtatatttttcacaatttatttcaaaaagccaaaaaaaatgattcaattttgaaacgaaatagtgcacaaaagggagggatggttagacgaaaagaggaatttttagaaaagagcgcaccccatctgatattcccatttttccgttccacaactggccaaaggcgactgtgctcattgacacgtagttgtccaataaggtacttggactttccacagtaaaatgtggtacaaaattttggaactgtcccgcctcacggcggggcttaaaagcattgtacagcgtaattaaaagctaaaataattttcgtatatttttcacaatttatttcaaaaagccaaaaa

SEQ ID NO: 56629 - DNA, 216 bp, Heterodera glycines
  misc_feature (14)..(14): n is a, c, g, or t
  Genomic contig location: Contig_ID=SeqID_25859; Location=1066..1281; Strand=-
  SCN-specific regions: Sequence locations=1-54,76-100,129-216
tgcctaaaataacnttgtaaataaaatttggtgcgttccatagcagtttgtgaaaaaatatttatgaattaattttgctaaaaaaataaaatagtgaagctttaaaaattaataaaaaattttaaattcagaattactggagttagcatcatagcagtgcttttccttgtctttttgatgccctcgcaaaatctggttcgcttctgatcagtttat

SEQ ID NO: 56630 - DNA, 446 bp, Heterodera glycines
  Genomic contig location: Contig_ID=SeqID_25861; Location=91..536; Strand=+
  SCN-specific regions: Sequence locations=1-158,184-233,255-446
caaaagcaaaacaataagcaaccacaatttgagggacagaatcatttgacagcagaaaatacggcacaaaaaataaaagaggagccaattgaaattggaaacgaaatgccaataattaatgaaaaaatgaaaataaaatacgaacaagaagaagaattcaatgtaaaaacagaaccaaatattggagaaattaaagtcaaagaaggagcaaatttgaacaaaaaagatttgacaccaaaagaaagtgaaggaaacaattcatcaccaattaaaatgggattattatatcaagtcaatatcattctacaaatttttgaggataatgaaaatgcctaagagacaaaattttcttggtttttagcaggccggttttatgtcgctagaccaaagtgatcaatattttgtctaaatcttcgctaacgagtcacctaagctcttcaagctca

SEQ ID NO: 56631 - DNA, 720 bp, Heterodera glycines
  Genomic contig location: Contig_ID=SeqID_25861; Location=592..1311; Strand=+
  SCN-specific regions: Sequence locations=1-254,287-316,388-720
atgcgcttactttgtttgattggatttagtaaaaatgagcaaaaagttattaatgtattcttaattgatttacatcaccttatattcaaatttgtagagaatgttgatcttattaatgagtaccttagcaaaggaagtgaacaaatttctttaacggaacccgaaaaccctgacaatgaaattagcgttgattttggagatgaaaaaatggacaatttttcatttaatgaaactgtagaaaacatttttgaacatttaaatgtggaaaaggataccaaaataaattgtgaaaataatagaaaaacaaaaaaaggtgaaaattaattagaaatatttttaaaattcattaaacgaaatttggaaaaaaataaaaataatttttaaattcactattaaggcaaattatctgttgaagagaagaaacaaattgttcagcaatatattaatgctaaaaaaagtttggacaaaaaattagaaagaaaagaaattaaaaatttaaatgaagcaattgcccacaaattgggagtaagcacaagacaaatcagagattggaagcacaaatatcaaattggtatatatttgttggttaatagtatggcttttgttattaggatcttctataaatagtcaaaataggcaaaatttatacaaaattggtaaaaaaatttagccaaattagtagggatgagattttaggcacaaaaaatcgcaaaataggca

SEQ ID NO: 56632 - DNA, 372 bp, Heterodera glycines
  Genomic contig location: Contig_ID=SeqID_25861; Location=1424..1795; Strand=+
  SCN-specific regions: Sequence locations=1-88,115-198,220-334,357-372
atgctcataataccgtacttttttaaatacaataataacctacacattcttcaactaacagatttttcagtcagtgtgtaattttcgcgtttgttttttaatctttattttattacggtaaattataatttttcagaatccattcgcaaatattcgcaagaaaaaaagctcaaaattattagacaatttgacgaaatgttaaaggaacataagagaaattcgagcaaaaaatacacttacaaaacagaaaatcaaatcgcaaaagaaatgggcattaaccgtgcaacaataattcgttggagaaaggaattttgcttatcaagtaagaaaaggaattatttatctttttaattttgctcccgccaaaaaaaa

SEQ ID NO: 56633 - DNA, 210 bp, Heterodera glycines
  Genomic contig location: Contig_ID=SeqID_25862; Location=846..1055; Strand=-
  SCN-specific regions: Sequence locations=1-210
aaaaaaaatcgattttttcaagtgtccgtttgggggtactcaatcaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaaca

SEQ ID NO: 56634 - DNA, 534 bp, Heterodera glycines
  Genomic contig location: Contig_ID=SeqID_25864; Location=47..580; Strand=-
  SCN-specific regions: Sequence locations=1-126,148-294,317-534
atggacaccatttctctgcaagtactgctcgcatttgcgatgtttgccaccactgcgttggccggactgcttccgatcaaagtgatccaaaattattaatcgtggattttaattgagagaatttttagaagaaatttattttgtatattataggactgctgataatcttgaccaattttgattaggaattaatggatttttacaaaaatttaacagaaatataaatttaaaaaaatcgaatagaataagcattaattattttaaatccaattttaatcaaaacatttgatcagaattttaattaattttcagcttcttcacgcgatcacacgtcgtcaggacgaaaatgatgagcagcggagcagaaaatcggattacattttgacgcttttgtcctgttttgcgggcggtgtgttcatgagcacttgcttcctggacattttcccacatattaagtcagtttccgcttatgaatcccgattacattgtctggatatgtcttcgagagtctcgagacaaggattaaaattttaa

SEQ ID NO: 56635 - DNA, 366 bp, Heterodera glycines
  Genomic contig location: Contig_ID=SeqID_25864; Location=673..1038; Strand=+
  SCN-specific regions: Sequence locations=1-366
atgccggtcagccaagcaaattcttggatccctttggtattgtcactggtcttgagattaaggggtataaaaatggttgataaatatattcgagactcaatcaaaaattacagagactcgacacactgaaagcaaaaatttctcgggtcgagactctcgagcagcaaattttaaagaaatatatcggtcagagcagttcaaaatttccgctctccttaaagatacagctcacaatcagtaatttttcctcaaaaatctgccgctattttatatacagatatatggtagggacgtaaaaattgcattttttttttccccctaaatttgggacgaatggtcgccgggaaccaattaattggcaaaaaa

SEQ ID NO: 56636 - DNA, 453 bp, Heterodera glycines
  Genomic contig location: Contig_ID=SeqID_25866; Location=1363..1815; Strand=+
  SCN-specific regions: Sequence locations=1-20,42-138,160-309,332-453
atgcttttttttctgttgctcctctctctgtccctttttctgctgctcgtgccaaatgtctgctgtcataatgccgaattggtgctgctcgacccctctcagatcggcttctttctgcccaattattttgttaaaaaatttgagaaaaaacttttcgtgaaatttgccagagaatttcggcctgtttttgtcgcatttgcaatgctcgaaccgccttatttatacgtggaccaatcggaaaacattcgatcggtggaccgagcggaggttgagaaattaatgaagttcaaattggtgtcacgactgaggaaggagaagaagctgatggagacggcacagtttaatctgacgctagcacatgacatccaaggcgcactgttctcagttccggttccgtcggttgaacgatcgcgggaacaagaaacatttggcatcactaaattaccatattaa

SEQ ID NO: 56637 - DNA, 899 bp, Heterodera glycines
  Genomic contig location: Contig_ID=SeqID_25866; Location=175..1073; Strand=+
  SCN-specific regions: Sequence locations=1-47,69-86,109-223,246 -616,659-899
cgttgatctgatgcatgaacccaatttggtgctgacaaagactgaccctccgctcgctttgctcgcctccctttggttttatatgacccctcagcccccaaagccgtcaatgcacgacataatcactggtgaggaggcaatttgaaatggattcgtgcattttaataataatttccgtcaaaaggacaatgggaggcgggcgaaataaatgaagcggcgggcttttcgggcccaatttttgggccgacgagtttagtgattaacaacgaatgtgcgggagaggatgaaaaagcgccggggggcggcggcgaaaaccgacggatcaaagcattcaaatggctctgtcggcattttggagtttcggctggaaatcagacgactttgagttgcaaaagtgatttgactggtcaagattccttgtcttcaaaaacagtttttcgcagaaatgccgcggcacttcgatgagatgatgcacaatgtcagctggcagcccgactggtcctccacttggcgggaggatcggccgtgcgtttgtgcccccgccgcttacgggggttggctgcatgtgccgttttacaagtggcatttccccattatcaggtgccattccctacttccagcctggcttttacccttcccaatttgtggaagaaaatgaggccaacaaagcccagtgtaaaaagatgctctccgaacagccgcaaaacttcggcatggatccgatgaccagcggctgtctgaaccacacaaaggtggcggagggagcgaaagtgccaccggggacaacgacgctgacggaaaaagtgccaatgagtacggcgggcacaaaagtgccaaggatggcttacggaactgtcagctatttgcgaccaaatctgacgataattgccttgggatag

SEQ ID NO: 56638 - DNA, 317 bp, Heterodera glycines
  Genomic contig location: Contig_ID=SeqID_5030; Location=56..372; Strand=-
  SCN-specific regions: Sequence locations=1-317
atgcaaaatcgccacttggaagaagtcttgcatatttggatgaaatcatgcagcgtcttcgctgaagagtggaaggaacggacttatgaaccagttgaattgaaagaaattctggtcaatcgaagagcaatcggagaagagccatccctcggatgggaaagctggctcacggaactcacaaaacgctttggacaggcgttgacagcaattcgtgccaaggcattttggccaaatgcctattatgtcctgaaggaaaccgttgtcgtgggagacaatttggccgagcttctcgcgaagcaaattccaaacgctggatg

SEQ ID NO: 56639 - DNA, 633 bp, Heterodera glycines
  Genomic contig location: Contig_ID=SeqID_5031; Location=205..837; Strand=-
  SCN-specific regions: Sequence locations=1-110,148-301,323-495,517-610
atgttcaacggcgagcaacagcaacagaacgacgggaatgacaacgggcgagttgtgcgcaaaccgccgccacgccgctctcgcaatgctaacggcgacgtgccggcaagtttaaaaattgaaatttttcatttatttttaatttttcccttcctcctttttttgaaggagagcgacattgggcggaaaagggcacggcagagcagcacgagcaacaccagtggcgccaatcgaggcgcgacgagcagtcaaagtggcagcggcggtggtgatgactggtcggctttcggtggcaacaaaagcaacaacagccgccgcaacggcacttcagcgctggacttggacatgctgctgatgccgcagatggtcagcagcgacaattcggcaagtttttttgtggatttggggtcgggttttcggagtcgcttatcaaacaattgagggtttaattaacctccccccctcctctgcgctttgctcaagcggatttgtacaaaaaatttaatttttcaatttcagctcggctcaacgagtgccggcacagttctccaacaaatgccgctgggaagcaactcgacttctgctgccgttgctgtcatgccaatgccgtttttggacaacaacaacaacaat

SEQ ID NO: 56640 - DNA, 65 bp, Heterodera glycines
  Genomic contig location: Contig_ID=SeqID_25867; Location=241..305; Strand=-
  SCN-specific regions: Sequence locations=1-65
atggctaaaaaacgattaccattgtcggagaatcagcagccgactccgccgaagagaaaagaaat

SEQ ID NO: 56641 - DNA, 162 bp, Heterodera glycines
  Genomic contig location: Contig_ID=SeqID_25867; Location=1237..1398; Strand=-
  SCN-specific regions: Sequence locations=1-30,52-162
ggaaaaatatgcgcaggaattggacaaagttttgggaatggcacgggaaacgaatttggaaatggaggacaaattgaggaaaatgcaatggcaaacggaggagggacaaagcttagaaacagtgaaaagccgaagagattcagcggaaaagtgccaaaatga

SEQ ID NO: 56642 - DNA, 1088 bp, Heterodera glycines
  Genomic contig location: Contig_ID=SeqID_25868; Location=54..1141; Strand=-
  SCN-specific regions: Sequence locations=1-163,185-266,292-541,563 -644,670-897,923-1032,1054-1088
atgtgtctgttaaaatgcaaaactgttgtgaaaaattgttataactcctttcagagaagagatagaaaaaaaataaaaatagggttagagagcccgtgaacagctgcatcggatgcaagtgccgccgttgctgtacgcctaacagttggtgagcaatgacggaaaattgcttaaaaaagaaaccaaacaaactcatcaattgttagctcccgttgacaaaccgaagggtacattggggcaatggatgttgggctaccgtatcagttattaaaatttttgtttttcaaaaaggatactaaaactgggataaccccattcagagactagtcaaaaaaaataataataggcttggactactatactaattagaaattttagaatgtgtctgttaaatgcaaaactgttgtgaaaaattgttataactcctttcagagaagagatagaaaaaaaataaaaatagggttagagagcccgtgaacagctgcatcggatgcaagtgccgccgttgctgtacgcctaacagttggtgagcaatgacggaaaattgcttaaaaaagaaaccaaacaaactcatcaattgttagctcccgttgacaaaccgaagggtacattggggcaatggatgttgggctaccgtatcagttattaaaatttttgtttttcaaaaaggatactaaaactgggataaccccattcagagactagtcaaaaaaaataataataggcttggactactatactaattagaaattttagaatgtgtctgttaaatgcaaaactgttgtgaaaaattgttataactcctttcagagaagagatagaaaaatcaattgttagctcccgttggagaaccgaagggtacattggggcaatggatgttgggctaccgtatcagttattaaaatttttgtttttcaaaaaggatactaaaacttcaattgataaccccattcagagactagtcaaaaaaaataataataggcttggactaccatactaattaaaaatttttgaatgtgtctgaaatatgcaaaactgttgtgaaaaatgttataactcctttcagagcagagatcagaaaaaataaa

SEQ ID NO: 56643 - DNA, 566 bp, Heterodera glycines
  Genomic contig location: Contig_ID=SeqID_25869; Location=337..902; Strand=+
  SCN-specific regions: Sequence locations=1-370,392-566
atggaaattggagccgcaaatgttcggcaacatttcgaattgtctctcaaaagagcggtgtggaggattttaagagagaatacaatgaaacagtttttaacaatgaagcgaagtcttgggggaactatttcatttcttttgcggtgagtggaaattaattagttaatttacattttaatattgtaatggcaaattaaggaattaatggacccaagcaaagggttgtacaacaaagacgaggacaacgtcaccttggcaattgattttacatgtgaatagcgtaaacatttcgagaaggattgaaaagggaaaggaaggaaatcagcaggatgagaagagagtcttggagggcacaaaattttcttggtgcttaaattttatatttttttatgttttgtaaagtattttggtttcataaagcaacatattccaatgatagggatggatttttatgtgctaaaatcgagaaatatatatacctaaagagttgataaaaaaggcagaaaaatttgctaaaatgcagaaaaatgccaaaatagttttcaaaaaattggaaaaacatgtca

SEQ ID NO: 56644 - DNA, 348 bp, Heterodera glycines
  Genomic contig location: Contig_ID=SeqID_25869; Location=1128..1475; Strand=-
  SCN-specific regions: Sequence locations=1-123,153-231,253-296,329-348
atgtccaaatcagtgattgatgagataaagttgatactgagcacagctgagcattcggatgtccactttttggtggacaaaatcttctaccaaatctcataaaaacaaaaaatatttctctcctcaattagttttttaaatcaagccttaaatcagcaataagttacatctttttatattcttcataaatttatttagcaaatgaacataaattttcagttttcccggagcgcctattggccctccggacgcttgctttgtaaattggtttttgacgagaattcgttctttctcagatttttaattttaattttatttttgaatttttcttttgcagctaaaattaaa

SEQ ID NO: 56645 - DNA, 408 bp, Heterodera glycines
  Genomic contig location: Contig_ID=SeqID_25870; Location=1160..1567; Strand=-
  SCN-specific regions: Sequence locations=1-387
atggcagaacaatttgtacaacatgaaactgcggaggagcaacaagtgaaagctaagaagccaaacgttgatgagcgatttctttggaaaatcacgagaggccaatttgtgcttgcgattcggctgtgctcaggttaatcaaatttttgacgaccaaattaattgacagctttcagaggactggaacaatttatttcacaacaaagacaaggcacgtcggctggaagatgggcgagtggcgattggactcgagatgtgtgaagaatgcgctaaacttaattgttgtgtcagtgatctgatcgctggccaaaaaaagaaccagaaaaagccggaatgaatttgttttttaccgattaatatttttaataatcactcccactattttgaatttattttgtttttaataaa

SEQ ID NO: 56646 - DNA, 443 bp, Heterodera glycines
  Genomic contig location: Contig_ID=SeqID_25872; Location=172..614; Strand=+
  SCN-specific regions: Sequence locations=1-418,440-443
aacgaaatagtgcacaaaaagggagggatggttagacgaaaagaggaatttttagaaaagaacgcaccccatctgatattcccatttttctgtttcacaactggccaacggcgactgtgctcattgacacgtagttgttcacagtagttgtccaattaaggtacttggactttccacagtaaaatgtggtgcaaattttggaactgtcccgcctcacggcggggcttaaaagcatttgtagcgcaataaaaaagtttattgttttgaatttttcacaatttatttaaaaaagccaaaaaatccggatccaattttaaaaacgaaaatagtgcacaaaaagaagccgcctcacggcggggcttaaaagcattgtacatcataattaaaagcgaaaataattttcgtatattttttcacaatttatttcaaaagacaacaaaaaa

SEQ ID NO: 56647 - DNA, 595 bp, Heterodera glycines
  Genomic contig location: Contig_ID=SeqID_25874; Location=617..1211; Strand=-
  SCN-specific regions: Sequence locations=1-413,435-595
atgtgtacgcagacggcactttcagtcggcgccacctttttcaggtaaatttatgtcctcgcaaagtaaaagcctaatttctttcatattttttttggtttttaaggcgaattaattggattttttattacgtactgccttctcacttcaagtgtgaagcgttgaacacgtatgcctcaactgattgtcaaagatgaccgaatttttcgcctgaaacttttcgttggacttcgaggtggtgatatcgccgatgcgagaattcttcaactcttacgggcatgccactgtcaatgttaatcccgatatcatcagcgattttctcgttggtacattatctcgaatttatgaaatgtgcccgtaatgatttttcaatgtttttttttattggaaatacattgataaatatgttctagtattaaattaaacattttttgaaaaaaaatcagattagaatccatatggcacaaaatcagcttgccagactaaaacgaccccctgactaaaacgtcacctcagactaaaccgacccctcctgacataaaagaccatttggaaatggcaatggtaaagttttgtgttttttttgaaaaataaa

SEQ ID NO: 56648 - DNA, 303 bp, Heterodera glycines
  Genomic contig location: Contig_ID=SeqID_25875; Location=57..359; Strand=-
  SCN-specific regions: Sequence locations=1-303
atggaaagacaccgtctaattcctggacaagagttggttgaccgaaatttagctgagctcgaatttcacgactattttgcaactgatcatcatggcaatcgatttctattggtcgactctcgcactgctgaacccgaaaatccggttttcttcattttctgttcggatgctggaattcagcgactacgtacatatcggaattgggcatgcgatggaacgtttaaaagtttttatgctgctttttttgaattgtttgtttttttaagtctctccaaaggatcttcgacagctgtacacatttag

SEQ ID NO: 56649 - DNA, 848 bp, Heterodera glycines
  Genomic contig location: Contig_ID=SeqID_25875; Location=487..1334; Strand=+
  SCN-specific regions: Sequence locations=1-79,103-161,206-206,234 -539,585-685,707-774,796-848
atggacaagattattcttcatgccgatctttttttaactcttgctatagatattccaaatatgtaattaatatacttagttttattatattcttttttatttatcatagcaaatcttagaaatttttattttgtgattacattgtgtaatcgattgaattgtataaattaaaatataatcttcaatattttgatttttatattttccggaatttatttatttattattgttacacaaaaatatctcttttattaaaaagcgatctctaacaatgttaaagagacttttaaataattatgaaaaattacgaaacaaaagttaaaagaatttaaaagaagaaattcacaatttcgaaccaaaagtcaaaaattcattttcaaaaaaattcacatttcctgcaaaaatcgttttagggtggttttcagggtggaaaatacaattatggtatctattttggttctcttcgagccaggaacctgatttcgacaaaagtaggaaatcccagtttttcagatttcaaatttttgttcaaatttggtctgcacttttgttgaaaaatgaatttgtacttttttcaaatattgttcgaatctgtgtcagggttcgaatatggacaaaatagatagcagaaccggttttccgaccctaaaatccccctaaaaagcgtttttgtgcaatacatgtgaattttagtgaaaaatgaattttcgacttttggttagaaatcgggtccgcaattcgaattgggctaaaatcaatgtcagaatcggtttccccgaccctgaaaacccccaaaataagtttatccccaaaaaattgtttttttttatgaaatctaagtacagtta

SEQ ID NO: 56650 - DNA, 297 bp, Heterodera glycines
  misc_feature (225)..(225): n is a, c, g, or t
  misc_feature (249)..(249): n is a, c, g, or t
  Genomic contig location: Contig_ID=SeqID_25876; Location=1391..1687; Strand=+
  SCN-specific regions: Sequence locations=1-132,154-297
cacacccttctgccggaccaagccctcgaattggccaaggccgcttctcaagtgacgacagcgaacgcaaatcgcaatcagcgaacggcacaacaacagctgcaagcgcccactcaaaatggtggggacacttcctcctcttccacgtcttccgttgtcagtgagcgaaggacatcacaaatggcttatttcgaatttcccgaggtaaataattcatttatttanaatccagaaacaatttgagattanatgatcccctttcaggctgattttgacagtttggaagcactcgtttga

SEQ ID NO: 56651 - DNA, 786 bp, Heterodera glycines
  Genomic contig location: Contig_ID=SeqID_5032; Location=255..1040; Strand=+
  SCN-specific regions: Sequence locations=1-190,216-258,280-290,315 -592,618-692,717-786
atgccagggggagaaatgtaaaaaagaaaggcttttaagcgtcgtgctggaaaattggaaagtacaaaaaaactaattttaattttatcacttatttttgcctaaagaagctaacgtgccaattttatcgacaggaattttaagggatgccgaaaaacttcagaatggcccgaccaaaactctatacgaacatgtatgcatatgcattttaatttgtcaatggctgacgcgccatatgaagaatcgaaatgatttttggcatcatgcatgaaatggtgaaggaaatggcgtaattattaaattttttaaatattcctcatgaaatgtatttcgactaaataagtaacagcccacttgaatcactttattgtagaaagaagctcaataaaagccatttgcagatgccagggggagaaatgtaaaaaagaaaggcttttaagcgtcgtgctggaaaattggaaagtacaaaaaaactaattttaattttatcacttatttttgcctaaagaagctaacgtgccaattttactcgacaggaattttaagggatgccgaaaaacttcagaatggcccgaccaaaacacaatacgaacatgtatgcatatgcattttaatttgtcaagggctgacgcgccatatgaagaatcgaaatgatttttggcatcatgcatgaaatggtgcaggaaatggcgtaattattaaattttttaaatattcctcatgaaatgtatttcgactaaataagtaacagcccacttgaatcactttattgtagaaagaagctca

SEQ ID NO: 56652 - DNA, 485 bp, Heterodera glycines
  Genomic contig location: Contig_ID=SeqID_25878; Location=541..1025; Strand=+
  SCN-specific regions: Sequence locations=1-485
atgaaaacgcaaaatgaggaaatgagaagcgatgaagccgagagacagacgaaggagagagagcaggtgaagaaactgttggacgaatataagcgaaaggtgaacaaagaaatggaaaagaatgtcaagaaaatggagaaggacgaaaagctaaaggaagtgctgagggaaatcgaagaagcgaaagcgaaacacccgggggagaagagaaaagcggcgaaatccatcacagagataaatgagaagcattgggacgaattgtaccagggggacattgtactgagtgtggaacaggcacagtatttgctggatactgtaacaaaaaatgagcaggaaaagtcaaatagttcaccagcgggaaacggagcggagaaaaggaaaaagcgcggaacggacgaaaatggcaaaaaagaaacatttcctattttgaaatggccacttctcaccatcccattctcattccacagcataatccgtaattgaaa

SEQ ID NO: 56653 - DNA, 1346 bp, Heterodera glycines
  Genomic contig location: Contig_ID=SeqID_25881; Location=127..1472; Strand=-
  SCN-specific regions: Sequence locations=1-294,325-654,676-684,707 -778,800-1064,1087-1346
atgttgccgctttacagattcgtgacgactacacgcgctacaaaagaagtgatgagcgggaggaactttttgctcgctgattcagggatttacagagaagcaggacgacagacaactgaacggtaaggaaacaaaacccattatccgtttataatttaaaaatttagaattctaattttcggaaaatagtcgaatggcagttgggcacagcaaatgcgaactgtgtacgttgatggcacttttacaatcgcaccaccgcttttttatcaggtgttcgcagttcttgcgaggtacattttaatttataaacaattattttttaatgattttaggcgtgaacaatgggttttcccagttttgtacgggctacttactacaaaaacaaaggagacctatgcccgcttttttcggatggttgtgtctttctggcctaattttcgtcctgactcaatttcggttgactttgaagcaggaatcatcggtgctgtaaaagaagtgttttcggattgtgaactgtcaggatgcttttttcatcttgtccgtaatttcaaaaagcgtcttgctactgaacaccttgttgaggtttttccttcaacgctgtgtcacttttaatttccattccaatttagcgctacaattctgacccggtctttcaaatgtatgccaaaatgattacatcattggcttttttaccaattgaacatttgacgcttggaatcatggcacttgaaagagaacttcctctcgaacttcagccagtttttgactggtaaaaattcaattttgaaagttgcttaaatgttaaatacaggttcatcaacaattacactggccgaccgcgttttgacggaactcgaaaccctgcactgtttgatccggtgatctggagtgttcatctgcgaaccatccaaaaacgagacaggacgaataattacgcagaagccgcacaccgatcacttcaacgcgcatttggctgtgaccatccgtcaatttggacatttatcgacagactccgaaagtgtcagaaaattatcgacgccgattttgcaaaattttcgataggtaattcaaaaataaatcaaaatttttaaagctgactttataggcgaacaaccttcaaagaagcggaagcagtacagagacgccgatcgccgaattcttactcttgttgaacgatacgcccaagaaatgggagtccaaaatccgttagtgcccattcattacgatccccaatactttgcaaatcccggcccaaattttaattatgtgattgaatttcttcagggaatatcccacaattatgagatgaacccatgatttgttatttatgttttacaattaataaa

SEQ ID NO: 56654 - DNA, 1216 bp, Heterodera glycines; identical to SEQ ID NO: 25882
  Genomic contig location: Contig_ID=SeqID_25882; Location=1..1216; Strand=+
  SCN-specific regions: Sequence locations=1-197,219-301,345-418,441 -695,719-728,750-1193
  Gene Ontology: Mol. function=potassium channel activity; Cellular component=membrane fraction; Biological process=synaptic transmission

SEQ ID NO: 56655 - DNA, 808 bp, Heterodera glycines
  Genomic contig location: Contig_ID=SeqID_25883; Location=825..1632; Strand=+
  SCN-specific regions: Sequence locations=1-132,154-378,471-479,503 -613,636-685,707-808
cgccaattggaaatcctgcttgttggattgtgtacaacagaagtcgaattgacatgggaggagggtgtccatcattgttttctggatcaaggggaatctcgaacaattcaacaaacgttggaactttaagtggtacaactttgtttctgaaaaacgaaagcattgacatgatcagaagtgaaattgatcattattgtgactacttgcttgttttacgaacggcttgaaaatcaattctcgtcgactttatcatggatgatttggtgaaattaatcagaaagtgtaattaggcattaaaaatttagttaaaagcaattaccgattaccgtcctgccaaactttgttcggtttacttcaaactttgtttaccagaccaggatcattttcttcatcgactaaatgatcagcagattcgccatgaacatgaacaccgtcatcgccatcatcatcagcatcgtgagcagcatcattgtaaacagtgttgtgccaaagagaaacaaaattttcaaaactttactgcgccgcgatcaaggatcagcattttggtcgaaaatgatggagctgtcatgcctgcgggttcgcttgctgtgatggatgaaatgagttatgatacattggttagccaatttcttggcaccgatgatcatgaaggtgtgattttccactttttggaaatcttttataattataggaatggaaaaaacaatgaaatttctcgcaagatatgaattgattgctaacatgcttctctgtcctgaatgccaggagaaacaagcatcattggtcaaatataaacagtttcctgaag

SEQ ID NO: 56656 - DNA, 746 bp, Heterodera glycines
  Genomic contig location: Contig_ID=SeqID_25886; Location=333..1078; Strand=+
  SCN-specific regions: Sequence locations=1-443,465-642,669-746
atgatcagaatcaccgagaatgatcaggatttattgattttgatatcagaaagagtgagcgggcttttttcccggatggtttcgtatttttttaaattttttcagagcgagcctctgttggttttagttgaaatgtccacattattcgggattaattgcaattctcatatcaatttcatgatcattatttgatcagccttttgtttacccgcaatcgccgatcacttttcgtctcccttttccgcgactgcctaatcggttgttgataatgtttttgttgatgtgcagcacataaccacgggttggtggtgctgataaatggtcctacaataagggtttattagggatttaaataatttcgaagtgctggcattatgtcacaagggataaaaaaaatgttccgttgttcacacacaaaaagaaaacaaacaaaaattctaccagtttaaagtataaaagaaaattcttatagttttattgtaacaaattatccatgaaattttggctcaattacactttatgaagccaatagaacctggaattttgaaaaaaaacggaatcggatttggaattggaattaggccaggaaaggattagcgggattgaaatcccggttttgtagaattttaagctcgaccccatggtttaaatcccattttccccccggattccccgatgggcggcggcacttgcagccggaatcgggatcccgggaaaaccaggcgggatctttgaagaagttttga

SEQ ID NO: 56657 - DNA, 68 bp, Heterodera glycines
  Genomic contig location: Contig_ID=SeqID_25887; Location=688..755; Strand=-
  SCN-specific regions: Sequence locations=1-12,35-68
attcagcgatgcgggatcagtacatgcgcacgggtgagggctttctgctggtcttcgcgctgaacgag

SEQ ID NO: 56658 - DNA, 607 bp, Heterodera glycines
  Genomic contig location: Contig_ID=SeqID_5034; Location=134..740; Strand=-
  SCN-specific regions: Sequence locations=1-523,559-570,592-607
atgatttcaaacaaattttcaaaaccaaaatcagctaaaaaaggtccgatagcgttcattgagctccttcaagcacacgtcacgctgatcaacaatttccgcctccgcgtcattacggcctcgcccgtgggccgatttgacgtgcattatggcagccgagctgctcaacgattcaaaggcacgtttttgaaattaatgaaactaagttttatggggtttttgaggtcgctgatctacaggatgcataaaattcgaaaaattgtatggatggtatcctatggttagtcccaaaaaaagtcttaaaatggatcgtgggttcaatttcaactgaacagggacaattgcgctcatcagaaagttaatcgacgacaaactcaaccaagaacccgtccaattcgttggaaggttggtaaaagtaaacaacaaatgtgtagatttaagataacgatccattatcccaaatcaaaatgtatcggtcaattcgaactctttttgtgcatattttccatcgcatgtaacaaacaattttaaaaaatatatgtaaaaaaatcattaaatgcagattttagtttcaacataattatttaataaccttttctgaaataaa

SEQ ID NO: 56659 - DNA, 879 bp, Heterodera glycines
  Genomic contig location: Contig_ID=SeqID_5034; Location=2098..2976; Strand=-
  SCN-specific regions: Sequence locations=1-70,92-520,542-766,788-879
atgcaacacaattgcccgctgtgtactgtgagtgccgttttggaaaagaaggcgaagaaaagtcaaatgcgaatttttatgaaaaatatttcaagggccgaatacaaggtgtgatttgattgatatctacaattgatcaaatccccctttcaattgggtacattaattagtcagataatacatcaattagttttggtgggataaagtttttgtaggcatttgggggcaaaacgacatttagggatttatgacttgggacccaacaattggacatcccgaaacttggagactccgatccgacatagggactccaacatctcggcatttgggggcaaaacgagatttggaaactcggcatttgggggcaaaacgagatttggaaactcggcatttgggggcaaaacgagatttaggaactcggcatttgggggccaaatgaaatttgggaggatttgtaacgtggggatccgacatttgtaatgggtgaagctgataagattgctcataatgtgggatgcagaggaattgatgataagaaacaataatttttttatgccaaacactagagatgcgccgtgaatcacggtcacggttaccgtgaatttcacgggttttttcactcacggtcacggtcacgattcacggtaccaattcacgtttattccgtgaaaaatttacactggataaaattgaaatttacgaattacatattgtttcataaagaaatttggtccttttttgggaaatttttgctaagaaacagagcaaaattttcaaaaatttccccggcggcgcctatcggcaccgccggcccaatctctattcctgaaactttttgaacaaaatcaacatttctttaaaaaactcgctcgaaataaa

SEQ ID NO: 56660 - DNA, 87 bp, Heterodera glycines
  Genomic contig location: Contig_ID=SeqID_5034; Location=3066..3152; Strand=+
  SCN-specific regions: Sequence locations=1-29,53-87
atgtctcggaaaatgatcaaaatacgtacaatttcttggggttttcttaggctcccggacaatccgtcagtggacaataatccgtca

SEQ ID NO: 56661 - DNA, 319 bp, Heterodera glycines
  misc_feature (291)..(291): n is a, c, g, or t
  misc_feature (316)..(316): n is a, c, g, or t
  Genomic contig location: Contig_ID=SeqID_5035; Location=5..323; Strand=-
  SCN-specific regions: Sequence locations=1-3,25-70,100-319
atgaatttcttcaccgtccttcttttcctcgccaactctgtgctttcaacgtaagactaagtgaaaaatcaaaaattaaaataaaattaataaaaaattctgtacatacttttaccgtatgaaaaaaaaaacattttcaattttttgtaaaattttagtggcgctttcagttgcggagagtttttggaaacaaattcgatgaagttcaaacagacgttggaccctgacaacatccgtcaccctagtgtgaatcttggaaattattgcggtgctccagacatgaccatgtgnttatgcataggatgcagctcaccgnatg

SEQ ID NO: 56662 - DNA, 673 bp, Heterodera glycines
  Genomic contig location: Contig_ID=SeqID_5035; Location=715..1387; Strand=-
  SCN-specific regions: Sequence locations=1-566,594-640,670-673
atgttcacctgtctcgcgaccacgttcaactcgaaaaagattggaacgtttgaggtcgaattcctttacagcatagttaggtaccgtattttctctaattatatgcccgtctccattaatctcctcgtctccaattatctccccctttctacggaggttgaaaagataatcactccgtcttaatctactcgtctgcaatcatctccccctttctgaggaggtttaaaaataatatacccgggcatataattagaaaaaatacggtaatttattttttttcatcagtacgaaaaaacttttagattttggtctacacctacatcagctgcacagctgtagctacagccttagctttctacaatattgatgaagtggcttgttactgtaccgttccttataccgtatggaccggattatactttctgctcgcgagttatttccgccatacacagattcacaacatagaggaataatctttttgcacacggaaattgaatgacaaaaacaggatcttgtatttgaaaaaaaaagaattttttttttaagtttaacaattaaaagagacgattttatttatttatttatttttaaatgaatcggattcaagccgatctttcagtaaaaaaatatacgaaaaattatttttgaaacaaaataattttttatcaataaa

SEQ ID NO: 56663 - DNA, 1369 bp, Heterodera glycines
  Genomic contig location: Contig_ID=SeqID_5036; Location=285..1653; Strand=-
  SCN-specific regions: Sequence locations=1-315,356-386,408-505,527 -1216,1238-1369
atgtctttcttctggaatacaaccaacgcaattgtttcctcacttttgccagtcttaccggcttttgtcatgtcatccagccatcgacgcgatcttgaggcctttagcagtaaggtgagattactgtatacgaaacgcccgttttggtacggactttttgtcgcggaggcccgccctttcatggacagtaaaaaaaatcgccaaaaaatcattgacttaattaacaaaatgccaatgcattccaaaacaaaaacaaaatgtcttaactgtgatcaatagagatctaaattttagataagaaaaaccacgaaatagatatttagtataaaaaaatatacaaatttttattaaatatgtacaaaaatccctaattattggggaagtgcatctcttaagtggatggacccgcgcatcttcacagccattgatctaattcttgctgttccattcggttatgccgcccatcttgtctataaaaacggaggaggttaaagcaattaacgccctttttgatagtttttgtctaacatcataagatgtgccgacttttgcgccgtagaaacgattggccgacatttgcggcgctgacacatgcggcgcagacatttgcggcgcccagtcaaagcgacacttgcggccccgacatttgcggcgtgacacttgcggcgccgacacttgcggcgacgacacttgcggagccgacagatgcggcgcccagtcaaaaggacttttgcggcgccgacacttgcggcgcccagtcacaatgacatttgcggcgcagaattaaatgaccccaaaaattatttgaacaatttttttgatttaaaaacatttgtttaatcactcttttagtcctattcttcaaagcttttcatccctaggcggtactgcaatttgattaattattagagcccggcgggaccgggactccagcgggattttacgggattaccgttcgggactcccgtcccggaaaattttgaactcccgaacccgctcccgacaatttttttaccgggctctattaattatatcataatctttttgttttacttattgtcaaaatcgataactaatctacggatcgcttcatcatttcgcagatattttttaagcgaggcccttcagtaatcccacgagttgagtcaatcccataaggcctcaggcagttttgttggtgctcttcctctttttaaggcgataatgaaccttataaaaatatttttattacagtatccaatttatactctgaaaatgctgggtggggcgaagtgaatcgttttctgaatatgttacaacggcaaacgactcaacctttatctttgtgggtaggatgcaattgttaaattagtcattattaaaaaataaa

SEQ ID NO: 56664 - DNA, 860 bp, Heterodera glycines
  Genomic contig location: Contig_ID=SeqID_25890; Location=97..956; Strand=-
  SCN-specific regions: Sequence locations=1-508,530-860
atgtttgataaaatcgactggctcggccgcttcgtggcctcgcatcctttttttgctttttctccaatcgtcgggacacaacccaccagatttcaatcactagtactcaaatctcctgcatttcaatcactgggactcaacccaccagcatttcaatcactgggattcaaatctccggcatttcaatcactgggactcaacccaccagcacttcaatcaccggggctcaattctcttgcatttgaatcactgggactcaattctcctgcatttcaatcactgggattcaaatctccggcatttcaatcactgggactcaacccaccagcacttcaatcaccggggctcaattctcttgcatttgaatcactgggactcaaccctccagcatttcaatcactggaactcaatccaccagcattccagtcactgggactcaaatctccggcattccaatcactgggacctaacctcacctggtacttcggcatcgcaatcaccgggactcaattctgtgacattccaatcactggaactcaattcttaggctttccaatcactgggactcaacccaccaactttcaatgacattccaatcactgaaactcaacccaccagcattccaatctctgggactcaacccaccaacatttcaatcgccaacacttaaccctccagggactcaaccctccaacattccaatcaacgggacacaatccaccaacattccaatcactgggactcaacccaccaacattccaatcaacgggacacaatccaccaacattacaatcactggaactcaatccaccagcatttcaatcactgggactcaacccaccagcattcaatcactgtga

SEQ ID NO: 56665 - DNA, 619 bp, Heterodera glycines
  Genomic contig location: Contig_ID=SeqID_25891; Location=649..1267; Strand=+
  SCN-specific regions: Sequence locations=1-50,107-107,131-131,237 -480,502-619
atggaaacacttaaaaattttaaacttgatgctttattcaaagttttggctctaccagacaaagaattcgaagaatggctcagagaacttaagcttctacacaccactcgtttttgtgactgtggcaacgaaatgagctacaaatggattaaggaccggaatcaaccgctttggatatgcaattcaaagaagaaccacgacggaaaacgtccaactattggcttttacactggcactttttttgaaggagcccatttgtcgcctaaattttcaagtttttttaaaaggccaaatttacatgaatcaattttatattaaggtttttcaattttcttactactgggcccacaaatttggaaatgatcaaattatgtttcaggatcctgtcactggtcagcatacaaactcaattgaatcgacgtggcagaagttcaagcagcaacacaaagcgagatttggcagtcacagatcacttttttccacatacatttctgattttttgtggcgtaagcaatttggaggaccggacattttttataatttgtggacccaaatcgcggaattgtacccaataagcacgtaaatctccttttatttgttatttaaagcaattgcgaca

SEQ ID NO: 56666 - DNA, 428 bp, Heterodera glycines
  Genomic contig location: Contig_ID=SeqID_25893; Location=716..1143; Strand=-
  SCN-specific regions: Sequence locations=1-214,236-368,391-428
atgagtgagtggctcagaaagctcaaacgtcgcagttggctgctgcggcagcactctgttctttttccacattcattctagcacaattaaatcgcgcccggagaagcaaaggaagcgaagggcggggggagagatttgggtcaacgcccctcgggggatttcgaagggacgggaccgaactgcgaccattggagacaagccaaaaggataaagcaggacagagaaggagaaaaagtggacaatgggaacagcagcagattaactttaaaattaaattcatataggtaaaattgtattattaacagaaacagattgttatgagcaaaaatggacagttaaatgtgccattggaggattatgaagaaagctgaaggaaaagagtcggcagataaggatggacgaggacgaagaggacgggcaggaataaa

SEQ ID NO: 56667 - DNA, 368 bp, Heterodera glycines
  Genomic contig location: Contig_ID=SeqID_25896; Location=1258..1625; Strand=-
  SCN-specific regions: Sequence locations=1-368
atgctgatttccaagtacaatcttggaaatagtacaattaagatcttccaagcatagaagcacaaaaaaaattagcttcttggggtccaaaatcatcattttgaaaattttattacaatcaaaaaatccaaaaatgtttttttttgcggcgcgcttttcccaaaaaaaaaccttttggggtaagggtccggcggtgccggtaggcggtttaaaatcttatgcaatgagtgaacaggttttcatcaaaaatgacaaattttttagcttttgatccaattttttatgaaaaaatgtttcggggaactcggcggtgccgagaggcaccgccggcagaaaatttcgaaattttgactatttcacaacactaa

SEQ ID NO: 56668 - DNA, 2228 bp, Heterodera glycines
  Genomic contig location: Contig_ID=SeqID_581; Location=99..2326; Strand=-
  SCN-specific regions: Sequence locations=1-312,334-1411,1439-2228
atgagcggaaaaaagatttatgttcaactcgctcaacaatttttctggccaaacatgtacgcagactgcgttaaaatggttcaaaaatgccggatttgtgcgcattcgcggaagccacgagcaaatgaaccgccaatgaaaatcgtccaaacgtcggaaccacttgaattagtgtgcattgatgtgctttcgattgggcttgcctattcgtcgaacaaatatatcttggttgcagttgaccactttactaaatatttggttgctgtcccaattcctaacaaaagtgcggacacaatcgccagcgaattcgtcaagaattttattttgatttttggaactccgaaaaagttacacagcgacaggggaaaagagtttgtaaacgaaactctgaacgaaattgtgaaaattttgaaagttgagagatcgctgacatccggatatgatccacaggcgaatggaatcacggaacgtgcaaatcagaccattttggcaatgttaaaacggtcgacggcatcgaactggacatgggacgaaagactcccatttgtcatttttgcgtacaatattactccatccgagacaactaaattctcgccttaccatttgatgtttggaaaaatcccaaattttccaactgagatatttttgccagttaacccgaactatacagttgatgtagacacttacattcaactttttcgcgaaaatattgcgcagctaatcaaattagcacaggaaaactcgaaaattgctcgcataaagatgaaaaatcactatgaaaaacaaccaaaagtgacagcagacaaattcaaaatcggcgagagagtaatggtcatatttccgggcgtaaatacccgcgcagcccaccgaaaacttctttggaatcagttcggtccatataaaattttggatctctctgattcgtcagcaaaattggttccagtcgataaaccgaattttgaacctataagtgttccaatcgagcggctagtgaaagttccggaaggtgtaccggatattagtactctccctcggggtaaaaatcccttcaaaaaccaattgaacgcattgctgagtgtagtttgtttggtgtatcgtgaaatggatattgagacgtgtgaagaaaatggacaatttacacaaacaaaaagtgttaaatttggaaatggaaccataaaaatggacgaatttcaaaaaacggaaaatatgggccagctttttattgggcaattgaggacaattgcaaattcagctgacggcgaggtgagagcgaaggacaacgctgaccatcctttggtctgggagatgcaatgtggcggactcggcacggaacatcgaaattgtgtccaattaacggctgccgacctcgacccagtgcttgagagggccggcctaggccttaaagtgattggaagacaagaaaagatggaaaatgttgagggaaaagttggttttaaggtgatcggcacgccaatgaaggctctcctcagtaatttcttgctgaaatcgggcgcagtttcatcagtcgccggcggccaaaagttgacgcagcttgtgatcagtgcacccgttggcttcgagctgatcgcatacagtggcggacgcgaagaccttgtgaagaatggctttttcccgacggaaaatgacattgagagtgcctttacggcatgggtcgaacgatgtgcggtcacacgagagaagctgatgaagacgggctacgcgccaattgaagtgccactgccgaacgttgtcgccgaattgcccgaatcggagaagatgggatggcacgaaatgctgaaaagggccaacttcgttctcgaaaaagtgcgtgccacaatcatccaccggaaacagctgttggtcgagacggcgactgtgatcatcggcgattcctcagctaaacaactggtcaaactttggcccaaatcgcaatttatcggtgccgaaaatggaacaatcaccgaagtgatcagggcgtttgacggcgccattctctcctccaaagtgaaagttgccattgtgatggttgggcgggactcgataagaggagatgagacgattgaaaacgtgatggagcgagtggggagacttgagcagctgctgaagcggttcagtcatgtgccggttttttggctgccaccaccattcatcaagcagaagatggtcgaacatgaagaattggtggtcaaaatgaaggaacatttcggagcgatgcaaggaaatgttaa

SEQ ID NO: 56669 - DNA, 4250 bp, Heterodera glycines
  Genomic contig location: Contig_ID=SeqID_582; Location=144..4393; Strand=-
  SCN-specific regions: Sequence locations=1-1423,1445-1482,1512 -1968,1990-2235,2257-3081,3103-3562,3586-4250
atgaatgtgcagcaacgccaaaacgccgattatcaaccgcggctaacgcatcaacaaaattatgcgcaatttgaagaacgcgcttaccgtcaacaaaacccgggaaatttgttcgtgagaaaccaacccgcgcgttacgaaaatgcgaacccaaattttgggtatggaacttcgggaaatgttatggtgaatcagcaaggaggggcacaacccccgatcagcaatttggagtacgtgctcattctcgatcgacttcccgaactaaaagggaatgaaggcgctgacaaagtgcgctatttcttcaaaaaatttgtgtcagcaacggaggggtggcccgacaacaagcggatttcatcgcttgaatccaaaatctcgggaagagccgagcgcgcattcaatgccgcattggccaatcagccttatcggtttgatgcaatccgacgagctgtacaagcacaattggaggaaaccgattgtagagaaatgggggcttttgacgaacttatgaatggtctgaagcggaaaccgaacgagaaactcgacgaactcgccgatcgggttcagaatgtcgttctgcgtgcctacccaggcctaacgcaaaacctggtcgatgaatatgcaacaaagcatttgattcgtgctttatcaaatccggatttgtctttgtcccttgaaatggcacgccgaccggggatgtgcttcgatgagtttgtcgcattggctgcccgtgcggagtcaattcaaaaggcaacaaaaaatgtgccaaacgaacggcgaaatattgaggaaagaacccgtcctatgcagcaaaacttttcaagatttgcgcaacaattccaaccccaacaaaagcaaaatttttcacaaagttttcaaccgcgtgaaaacactgtttgttacaattgtaatgaaccagggcacttttctcgcgaatgtcgacgaccaaagcaatactttgatggaagggctaaccaaagccatgcagtgccggccgctggggccaatagttttcagatgcggccaaatggtcctgaaaagcgagcacttccacagacttcgacaaaagagtctgatcaacgtcggtcacaaaactttttgaagcaaaattgcattgtcgtgcaagaagaagcaccaccggaagctttttgccgtggtgttcagctttcatcagaaatcgctgaatttttcgccaacgagttcaaagaaaggaaagacggaaacaatcagcgagaaatgagttccgacagagttggaaaaattttggtcatcaaaatcgaaacatttggtgcaaaaacggaagcgatgatcgatggtggagcgcaaatttcgttggttggcgcctcatttctgtatatgctgatcagagaaaaaggattggatttgcaaaaaacaaattttgcacgcacaaatgacagaattgccgacgtcaatgggaaggaactccgatgttttggcacactcacattgccaattctccgtaaaggctgtgaacaagtggccatacatttttacgtaaccagtgcaccgttcggattcgacatgcttttcggaacgaattcattgtcagcactcgggttctcgctttacgatgaacccaataatgaaatgatccatttcgaaaaagcgacaaaaagcgaagacaccgtccgcatgattttcaacatgaaattccaaccaaggactagcaaattcgtcgaaatggaggtcgatgaacaatggaatggccaggacgtgctaatatgtccagtgcctgctgaaaaagcagtcagaattgatcagtccattggaaaagtcgaaaatgggaaaattgtctgccaaatatcaaatttgagttcaaatgtggagcaaatcgatgggaacacagtgatcggaagagttgaagaggtagaattgtcttatgattctggcaattcgtttttgccgacaaaggactttctaattggagaaggtgaaaacgatatccaatttggagatgaaatgtctctgaaagttggacacattccaaatgaagcgaaagccaaactaatggccttgttgaatgattttacccaaatttttgccttttccgatgaggaattgagccaaacggacttggtgagccatcaaattgccacgggaaattcggcaccgatacgttcaaggatacgacccgtcccctatgcctacagggaaaaagttgcggaaatgatccaaaactatctggggcgtggcatcatccgaccttcttcgtctccgtgggcttcaccgattgtgattgtgccaaaaaaggatggcacgctccgtttttgtgtggactacaggggactgaattcagtcactgtaaaggatgcatatcctttgccgaatattgacaacatattattggcactgggaggcaagaaaattttttcgaccctcgactttatttccggttattggcaaattaaaatgtcaccggaatcgatcgacaaaacggcttttgccacagaatttgggcttcatgaattcgtcgttttgccgtttggactttgcaacgccgttgcaacttttcaacgatttatgtcacagcttttcgaaggattaatcaacgattttgtcttcatctatattgatgatatcttaattgcctccgagtcgtgggaaaagcatcaagagcacttaaaaatagtgttcgaacgaattcgggaagcaggactaaaattaaaaatcagcaagtgccatttttcggcaaacgaactaccgtttcttgggcacattctcactactgaaggaataaaaatggatgtaaacaaagtacgtccaattatggaattgccaattccaacatcaaaaaaggcacttcaatcactgcttggatttttggcatactaccgaaaatttatttttggttttggagccattgccgcgcctttgtacggactgttgaagaaagatgcggaatttgctttcggcaaattggaaaaagaggcaataaaggccttaaagcaaaaaatttttgacgacgtaattttgcactttccaaacttcgaagcggccaaaaatgaaccaagacgtcagttcataatgatgactgatgccagtaaaattggaatcgcggcaattctttgtcaaccggacgaaaacgcaaatgttaggccaatttacttcgcctcgagaaagtgtaactcttacgagagcaaatattgtccaacggaattagaagcgcttgctgttcgcttcggagccaaaaaattttcacagtttatcaccatgccaccaacaagagtctttaccgaccatcgggcacttgtccacatgttcaaaagtaaaactgagaccggaaacagccgtgtcgataaatggctgatgcagctgaattcgagattcatactgaaggttgaatatcagcctgggaagaagaatgtgatcgccgatctcttgtcacgctcaccagcgctaaaatgtcccgatccaccggctgaaatcgaaatttcaagaatcgcgcacataaaaatgtgccaaattcaaacggaattggacgaggtcaaaaatcgacaggaatggattgaaaagaccaaagaaagcgaattggacttcatctacgactttttgaacaaaagaattgtgccacaggacccaaaaaataagcaaaagcttatttcgcttcttccaactttcacaattttggatgaactcctctacaagtgcgaaaacgacggaaaagtacgcctctttgtgccattcatctttcgcgacgcattgatcagagagcgccattcaggaagttgcgcgggacacatgagcggaaaaaagatttatgttcaactcgctcaacaatttttctggccaaacatgtacgcagactgcgttaaaatggttcaaaaatgccggatttgtgcgcattcgcggaagccgcgagcaaatgaaccgccaatgaaaatcgtccaaacgtcggaaccgcttgaattggtgtgcattgatgtgctttcgattgggcctgcctattcgtcgaacaaatatatcttggttgcagttgaccacttttctaaatatttggttgctgtcccaattcctaacaaaagcgcggacacaatcgccagcgaattcgtcaagaattttattttgattcttggaactccgaaaaagttacacagcgacaggggaaaagagtttgtaaacgaaactctgaacgaaattgtgaaaattttgaaagtcgagagatcactgacacccggatatgatccacaggcgaatggaatcacggaacgtgcaaatcagaccattttggcaat

SEQ ID NO: 56670 - DNA, 1800 bp, Heterodera glycines
  Genomic contig location: Contig_ID=SeqID_582; Location=4501..6300; Strand=+
  SCN-specific regions: Sequence locations=1-58,81-97,119-677,699 -738,760-1385,1439-1479,1501-1550,1584-1714,1768-1800
atgccagttgacgatttatcgccaaattctcttcttgctgacgaatacgtgccgccgcaacatttggggtcgaggtaagatgagggttgaactcccaattatctaccagatccaaatgggcgattcgctggtccaaatttatccccaaattttgttgctggatgtttcgaccattttctcgacccaaattttgttcttgggagttttcgtgaaacaccgaattaccatggctgtccaggagagcactttcatccaattcgcctcgattttgcgcgtccattccgtttcgtggtctcggaatttccaaaagtcgctgatgaattgcttcgggtcctaaaacagacgaaactgatgaaactcgactttggcgatgttggttttcgcgcaatggagcattttcaactacgaagtgctgttgctgaactcgctgttctccttgcgtatctcctatgccttcatttcgcacttgtatgccaaggtttagcgccctttgtcgcgttaacggcgggcttcgcattaccggcaccattggtgtgtgagaatttgttttctcgttttatggttcaaagctttttgacttagttgtctgcttttccttcactttcgtagggatttgtttccccgtttttgcaaattttcaattcacacgatttcggcgagtggtgataagatgaaaaggatttgtttcctttttaacaaattcggcgatttctcttccactgtctttacgggatttgtttccctcttaaacaaattcggagattctttcttccacgtttgactttagggatttgtttccccgttttacattcaagcactcgtaggatttgtttcccgttttttttttgttgctccttttcgcgctttacaaatttcgaaattgccgttgatctcacctcttttagcaggagcgccacgtcgtacaaagtggagcacgtagtagagcacacacacaattaggaacggggaattgtatcccaaaatccaaacacaatccaaacaaaaatccttttacaatcaaaagtccaaacagcgaagaaaattcacaaacatttaaaattaaccaaaaacgagcgaatatccaatctgaatgcaagtgaccaggaaaaaaaaagtcggcagcggaaaacaatcgataatgaaaaggcgggagattcaaaattgagaacgaaaggacaaaaataaatgagagggaaatacaattaattaattaagtcaaaaattgggaataaaagaaattaacaatcttatcacattctacaccgcgtctgaaaccttcaaatctgtaagtaaaatattttccaaaaagtgctaatttttccgtttctgttgaatccattatcaaatgctttttttatcagagcattaataaatttcgatttatcatttatataactaaaatatttttaatgattaaaataatattaatttatttatagattctgcacgcgaattaacaccatttttttcaataaaccaccttttcattatccattttctattaagatcacatgaacttcactatttccttaatttttatcgcgtaaatcttataaaagatttaaataatattaattttttaagattctacaccgcgtctgaaaccttcaaatctgtaagtaaatattttccaaaaagtgctaatttttccgtttctgttgaatccattatcaaatgctttttttatcagagcattaataaatttcgatttatcatttatataactaaaatatttttaatgattaaaataatattaatttatttatagattctgcacgcgaattaacaccatttttttca

SEQ ID NO: 56671 - DNA, 390 bp, Heterodera glycines
  Genomic contig location: Contig_ID=SeqID_5037; Location=128..517; Strand=-
  SCN-specific regions: Sequence locations=1-104,182-207,253-390
atggcagaggaccaggaggaattggacatgacgagcacaaacccaatgccaaccacaacgatgacaaagacaacgacgatagagatggaagaggtggaggatgaagagggagggggagaggcacaggaagaggaagaggaggtgaaagagcagggcgagcgagagggcgacggggaggaagggacggaaaacatcacgcctgggacggagacagagagagagacagagacggatggagagagggagagagaggacggcgagggaaaaggggacacgggcggagcagcagccgaacaatccgcagaatgggccgaggtgaataaaggcgaatttgccgggagtgggaagggaacgtattggggaaatgaaagatgggcgaaattgggttga

SEQ ID NO: 56672 - DNA, 405 bp, Heterodera glycines
  Genomic contig location: Contig_ID=SeqID_5038; Location=961..1365; Strand=-
  SCN-specific regions: Sequence locations=1-55,77-405
  Gene Ontology: Mol. function=structural constituent of cuticle; Cellular component=basement membrane; Biological process=cuticle biosynthesis (sensu Nematoda)
atgcctggaagaccgggaacagccgggaagccgggatcccctggcctatctccaaaccaaacgtgtcccatgcaagtgaagcgggacccgcccccgtgccggccgtgtcccaagggaccgcccggcatcaaagggtggcccggttttccgggtgacgttggcccagtcggtgcgccgggcgaaaagggccgagacggagacgacggagcaccgggtgggcatttcaactaatgaaaaaatttattttgctcttcttcaggtgaatcaggaccccaaggcccgccgggattccgaggagcccccggggcacccggagacaaaggcgaaactccgaaaggtggggaaattaattggagagggaatggggcgattctaaacaattcaaagtcaaatgggcagctttaa

SEQ ID NO: 56673 - DNA, 1820 bp, Heterodera glycines; identical to SEQ ID NO: 25901
  Genomic contig location: Contig_ID=SeqID_25901; Location=1..1820; Strand=+
  SCN-specific regions: Sequence locations=1-73,99-478,500-578,600 -787,809-974,996-1006,1028-1444,1466-1820
  Gene Ontology: Mol. function=poly(ADP-ribose) glycohydrolase activity; Cellular component=cytoplasm

SEQ ID NO: 56674 - DNA, 523 bp, Heterodera glycines
  misc_feature (473)..(473): n is a, c, g, or t
  Genomic contig location: Contig_ID=SeqID_25908; Location=148..670; Strand=-
  SCN-specific regions: Sequence locations=1-237,261-338,517-523
gctttgtgcacggaatcggttctggtcgcaatgcgtgagtgctttccacacatgtacatcagttcggaaaagttggaattggacccagcaaaaattcgcatcaaaaaagcgcatttctccgatgctttgcattccgtgaagccatccgccaagcgtggtatactgttgttgttattctatttaggggttcactaggtctctctccacatcgacaattttttaaattttttgggagtttcccattaaaaaagtaactgaaatttttttttatagttttctctaacattttgaaattgtaaagatctgttaaaaattcaaaagaaatttgttttttcaacttttttaatttaaaaaaacaaaccttttttaaaaaaaagtttttaaaatttttgtttttttgtaaaacgaatatatttgattctttaagtagttttttgtaattaaaaaattctgttttttttaacttttactanaaaatctaattgtaaaaaattaaaaaaaaattttcaattatttcaataaa

SEQ ID NO: 56675 - DNA, 1144 bp, Heterodera glycines
  Genomic contig location: Contig_ID=SeqID_5039; Location=273..1416; Strand=+
  SCN-specific regions: Sequence locations=1-226,248-254,279-646,668 -697,719-1144
atgtcaaattttaccacatttattatcaaacaatcaaaatggaatttatttgatcacataaagtacgacacagttatttgtttagcatttttccttgcataaaatgattccttttttggtcaacaatcgctgcgattgcagtgcttctggacgatgaaaaacggtgaggtcaatcagtggggcatcgttctgaagagaagaaaaaatgacaatggtaaaggtgcgaactttttacacatttatttataaatcactgataaaaataataacactgaaattttcgcatggaaaataaatcccattattagtaaaatttataatttgccaaatggacgcgacttcgtctcggagtgtgtccagcagttccttcaatccgctgtcccctcctcccactaattttgcgcatcgactcgcgtcatccctcgcccttcctttcagtcccattctgttcaatgccaaggctcgcctgaacaatgctttgctgttgttcgcttctcgcttcaacgctccacaggcgtccatgtacgctttttcaggtcttaataattaatctaaaagttaaactagcgtttatattccatttaaaaaagatacggtacacataggtttgtttagactatgtgggagaatttctatagcgaaagcgtttttaagtttaatcatttttggttacaaatggcagaaaataatgttattgtttaatttttgttattttaaggacatttaaagtcaggcatgtgaagagtacccccaaaaaagtttaatcaacaattgtcaatccttcccccccccccctaaaacctcccacctgtgcaaattgaggtaagcttgagcccgatttgaccatagaacagaactgctggggtcaatctcaatggcacgcgtataaagtaaaacggctttattgaaaagttttcgtcgaaaacattcgtttgcctcctctttaagacggcaagcgtcaatttgtcgctgattatcagtggacattaatctttatgcagggaaattaatggaggctattgtttcgctttatgtaatattggatagtcaaatccatttacatgacaaaaaaaaccaactcgaaaatatttattgaattaaaccattgtcagaaatcaaaaataatgtgaaagatcagacccga

SEQ ID NO: 56676 - DNA, 89 bp, Heterodera glycines
  Genomic contig location: Contig_ID=SeqID_5039; Location=67..155; Strand=-
  SCN-specific regions: Sequence locations=1-89
atggtttccgttggacttgcaaatgctcagcgacttgttgcgattgtgactggcggtgcttcggggcttggctgtgcgactgttcgtcg

SEQ ID NO: 56677 - DNA, 910 bp, Heterodera glycines
  Genomic contig location: Contig_ID=SeqID_5039; Location=2817..3726; Strand=+
  SCN-specific regions: Sequence locations=1-5,28-298,324-458,481 -708,732-910
  Gene Ontology: Mol. function=protein transporter activity; Cellular component=endosome; Biological process=two-component signal transduction system (phosphorelay)
gttcccttcaaggaatttcctacttcaactttcccaatgtatcattaccaatatcgcatcatagtaattggtgattcgactgtcggaaaaagcagcttacttcgttatttcactgaaggcaaaaatgctgaaataagtgatccgacagtacggattcaaagatttttttttgcattgaattacttttttaggttggagttgatttttacgctcgaatgattgagatcaaaccaaattatcgcatcaaattgcaactatggtgatatctttttcttttctttatttttggtattttacagggacacagccgggcaggaaaagtttcgttcgataacaaggtaatataaagttaaacgaaaacggtactaaaactggaaacaccaataaggtcgtattatcgaaattccgtcggagttattgtcgtctacgatatcacgaacagacgcacttttgagcatgttgttgattggatgactgaagcagaggcaaatttaggagggcctgaccctgcgcaattggcaagtgtaacatccttagtggccagtgaaatctgctattattcttaggtttttttactggtcggacacaaagcagacttagaggagcagcgcgaggttctctacgaggagggcgaatactttgcaaagcacagacgaattaaattcattgaaacatcggctctgacgggagaaaatgttaatgtaatagacaaatcaaaaacaacaaacaaaacgccagtatttaggaggcatttttgattgtatcgcgggagatcaacgccagattcgaaactggtgcactgcgcatatgcgacggttgggatggaatcaaaagtggactgttgcggacgcaatccatcactctatcagacattcaagagacaacgaaagaaaattctcagtgttattgc

SEQ ID NO: 56678 - DNA, 1614 bp, Heterodera glycines
  Genomic contig location: Contig_ID=SeqID_5039; Location=6056..7669; Strand=+
  SCN-specific regions: Sequence locations=1-204,226-610,633-1232,1274 -1477,1499-1614
atggaatatgtgcagtcatcagcagcagaaacagatgagagtaaactgtttttaaatttaaatgaatcagagaattgcgagctcaacgaaatttatgaaacggaaagtgaaacggaaagaaaggaaatcgaagcggcggagcaagtgataaacgcacttttatattacaaaaaatacgcattgagcaaactgaggaagcaggcgaatgccattctgtgagcaattaattggacattagcgaaaatggaggaaattttgcaggaaattatcggaggaagaccggaaaatgctaatcgtgccgagtttggaccactttcgaagggttcgcgaatgtgttgcagaaaaccaaaggcgagtcacaaaaataaaatcttatttttttattagagtaaaattagttaaacgaaaagaaactattttagacgctttttaggctttttaatatgatggccgaatgtggcgcccatatgctcggcgggacaatccaacaggcttttgaaattacccaactccgaccggcctcagagcattacatgacgaaggtgaaaagcgtactcaagcaaattttgcgcgattggagtgccgaaggtgagtgattttgatttggctaattttgttttattccacaaaatattcgttggaaaggcgccgatgaaagggcgtcatgttaccagaaggtcaaggaggagatggtgaagcagttcccggacccaaattcgcgacatgccgtcaaaattctagtcaccggtgcggggttggcccgattggcctgggaattgctcggcttgggcttttccgtgacgggcaatgagttctccatcttcatgttgcttgcttccaacttcatcctcaacacttgccgcaaggtgtcctcgtcgtgtcgtccttctctttttgaccttttccttcagtgccatgagtttaccatttacccgtgggcgcttgacttctccaacgcgtggagttggcaagaccaactgaggcccgtctcttttccggatgtcaatccctcaactgtctccaattctcaggtcccatcggctggtgttgttgtttaatctttcgccctttgatattgtttcagcgtctcaataccttttcaatgtgtgccggcgattttctccaggcttattccgatgagcaaaatcactttgattcggtcatttccgttttctttctcgacactgccgcaaatcccctccaatacatccgacttatccataaaattctcaagtgatttatattttttattttgttcctttcttcacctttttcttgcttaggcccggcggagtttggcagaatttcggtccgctgacttatcaccacgaagactctgacgacatttgttccattgaacttccgtttgaccaaattgtgcgtttggttgagaattgtggctttcgaattgaccaacttctcgcgaaggaccaacttccgttgtcaaggcaagggaaggcatttctccaaaaaattattttatttgacttgtttttaggtatacttggaacccgaactcaatgcttcagtacagctatcactgtggttattttcgctgtacgaaaatggttgaagattaaattctgtgatagcaattttattttatttgtctaa

SEQ ID NO: 56679 - DNA, 2323 bp, Heterodera glycines
  Genomic contig location: Contig_ID=SeqID_5039; Location=4650..6972; Strand=-
  SCN-specific regions: Sequence locations=1-285,308-692,714-1060,1104 -1170,1195-1465,1490-1577,1604-1793,1817-2034,2058-2323
atggcactgaaggaaaaggtcaaaaagagaaggacgacacgacgaggacaccttgcggcaagtgttgaggatgaagttggaagcaagcaacatgaagatggagaactcattgcccgtcacggaaaagcccaagccgagcaattcccaggccaatcgggccaaccccgcaccggtgactagaattttgacggcatgtcgcgaatttgggtccgggaactgcttcaccatctcctccttgaccttctggtaacatgacgccctttcatcggcgcctttccaacgaatattttgtggaataaaacaaaattagccaaatcaaaatcactcaccttcggcactccaatcgcgcaaaatttgcttgagtacgcttttcaccttcgtcatgtaatgctctgaggccggtcggagttgggtaatttcaaaagcctgttggattgtcccgccgagcatatgggcgccacattcggccatcatattaaaaagcctaaaaagcgtctaaaatagtttcttttcgtttaactaattttactctaataaaaaaataagattttatttttgtgactcgcctttggttttctgcaacacattcgcgaacccttcgaaagtggtccaaactcggcacgattagcattttccggtcttcctccgataatttcctgcaaaatttcctccattttcgctaatgtccaattaattgctcacagaatggcattcgcctgcttcctcagtttgctcaatgcgtattttttgtaatataaaagtgcgtttatcacttgctccgccgcttcgatttcctttctttccgtttcactttccgtttcataaatttcgttgagctcgcaattctctgattcatttaaatttaaaaacagtttactctcatctgtttctgctgctgatgactgcacatattccattgttatttttccgatgaaaatctgttaatttataaatacacttacaaaattaccacacaaatctatatacagccgaaaagtttgccaattacatatgtttaagttggattgaaagataattaaaaaagtttcaattaactaacttaaaatttttaataaagttgttcaattttattattttattttcttttggttactttatggcagcagtgatcaaccaaaacccttctgttactatgaccagcagtttgggtgaaaatgcaagaatgggtaaccattttgtaccattccttttctgttgatcactgatcagattgttgttactttttacccacagaattggcccagaaaatcgaaggtcagctcacgggacgcatcgccggcattcatttgttggagcgggaggacggactgctcgttgtaaatgaggacagaacgctaagagtgctgctcagacgcgagtcgggaatgttttggccttcaattatccatgacttgccgcacatccccacaaaactcagctgcagtgaacagaaaaacacgtgaagaaattttttataatttatttttaacaaactcattaaaggatttttgtcggttttgcaaatggacagatccacgaatattcaattgaaaacgatttcaacaggtatatttagcgcttacaaaaaataaattattgtcccatagcatttcattcaaacggcaatggaattcgcacaccaagtgggacgcttaattgttaaatggaataattatttgttcagttccatcagtggactcggcttttcagaacgattagaacaaatggtcagttgctcaaaggacaaaacggtggtttggcattgcacgtcgaccactcgcaaaatcggtgtcaattaattatttataattttttactggagtttttcagcaagttactgtacgggttcgccttgtaccacacttcaattcgatggcgatgcttccttcgtttttgtgggcgattattccggaaatatttcagtgcttcggctggtggttgggacgcaacagcaaccgcaattaatcagcaaattatctgctcataccggtgctaatttgtttgcttttaaatttattgtgaaaattgccaacttatttcattttcccatttgttaaaagtgaattgacttggcttttatcttattgttatttcaggggcaatcactgatctttgctgggatttgagccatcagcttcttttttcggcaagcactgattcgctggtcattgtttgggacatcggaggcaaacgcggcaactgttatgagctcaagttgtgtcttttgtcttcgctctccatttttatggttaagtggtcacaatgccaagttgactcgtcttgcgttgggtgccgactcgcgtcgcttattctccgccgatga

SEQ ID NO: 56680 - DNA, 1003 bp, Heterodera glycines
  Genomic contig location: Contig_ID=SeqID_25911; Location=88..1090; Strand=-
  SCN-specific regions: Sequence locations=1-127,149-229,253-545,569 -628,650-688,711-1003
  Gene Ontology: Mol. function=general RNA polymerase II transcription factor activity; Cellular component=transcription factor TFIID complex; Biological process=negative regulation of FGF receptor signaling pathway
aaatttaaatcaaataaatactttctttttttctaaattttagggaaaaacaaaacctttttcgaataccttctcaaccccacgcgttactcgtcgcctttgaacacttcggccgacctttcaaatggtataacttttgtcattttgtgttgggtttccctattttttctccattttggcacttttcagattcgcgtttgccaatcgacccgcaacattcgctgttcccttttgaaaattacgaattggagaacactcagtgggaggacgacatcatttgggacagtgcgaatatgccggcaattccaagtgattttttaatattttttttctatgagaacttcaacaaaaaaaattgaaagttttctaaaatttttttgaaattttttgtctggaagataggggtgggggtgagaaaatgatagtaaaaacgagctgaatcccatatgtattgcctgccatagaaccgcgggtgttgaccttggactacgaggacgacccgagggcattcggaatgccggaggacgcggcacaagtggaggaagttctgcagcaacaacagcagcaagtcggtgctcgcgcactcggaaaggtttttctgccattttgaattattttaatcaaaaatcattttgcttttgctgtttttctccaggaacagggcgtcatgaagaagtccaagctgatcctggcccaagtgctgaagcggcagcgacaggaagtggaggagcaaatcgaaacgcaaattgcgcaaatagcggacaaagacccgttcaatttgtccaacgacgaatattacgcgccgaagagtagcggagcaaataccaagacgcaacggtcgttggccaatttgaccatccaacattcactgcccgcccaaaatttgcacccggcactgttcccactgctacagcacaatgtcgtggcacagctgcgccatttccatcgcccaccgctcagccgacggacggcgcagggaatgaccgggcgaacggtgccaatc

SEQ ID NO: 56681 - DNA, 690 bp, Heterodera glycines
  Genomic contig location: Contig_ID=SeqID_25912; Location=877..1566; Strand=+
  SCN-specific regions: Sequence locations=1-285,307-350,372-374,422 -660,686-690
atggcaaatgaatataaacaaaaaggaaaaaaatattcaaccaaagaatggcgacaaaattatgccgaaatttgcaagaaaattggagttagccattacgtaattatgaaatggaagaaacaatttggaatgagtaaatttataacggagaaagaaaaaatggaaaaaatgaaaatttattggcaaataaaaaaagaaaatccaaaaatgagtgaacgggcaattgcaaaaatgatgaaaattgatagaacgaacatttcaaaatggaagaaactgtttggataaaagaatcattgaagattgaaaggatgattataagaaaaattggataaatttgccgaaaaaattatcagaaaaactatgacaatttctagttttttttcaaattttttgtatttgtattaaaaaattattttaaataccctaagttttgaaatttttcttagtgaaaataagtgaaaacagtcaattcaaggattgggagggtatcattaaaactgaacaatgttggaactgggctcccagtatgcgtaaatttttgattttagaggccctgtaaaactccttggggttttgctagggtgaaaaaatggaataattgtaaaatggaagagaaaatttggcatttgtattagccggaaacgattaacagagcaagaaaaaatagagaaaatgaaaatttattggcaa

SEQ ID NO: 56682 - DNA, 372 bp, Heterodera glycines
  Genomic contig location: Contig_ID=SeqID_25913; Location=45..416; Strand=-
  SCN-specific regions: Sequence locations=1-372
atgacaacagcaaaacatcaacggacaccggacgacgaggaggagaagaatttgaggcgtaaggcaaaggtggcgcttgacttagtggaagctggtctagcggcagacgcaatgatgcaggatgggacgcgctggaagaaagccaaaaacgcgatcaatgtgctggccaatttgcttttggcggaatcattaacagatgtctcgccaacttttgatcaacaacaacaacaacagctattgtcaaaagaggaggagagggagggatgcataaacagcagcagtgctgcagcaacaactgaatctgctcccgatggtgatgtaatggaagatttcgtcaatagcattcaagcggtgacaagcaatatgcaatag

SEQ ID NO: 56683 - DNA, 1158 bp, Heterodera glycines
  Genomic contig location: Contig_ID=SeqID_25913; Location=578..1735; Strand=-
  SCN-specific regions: Sequence locations=1-186,209-603,642-782,812 -874,897-911,933-1092,1114-1158
atgcagtggattaaatttaactgcacgctttgtccgatcggtctgcattgtttttatccgcgcaagtacgcaaagcctgtgctttgtgcgcatcccagcgtccgtaacatcacggactttttgagcaccggtcagcttgacgaagctgcaacgacaacaacaacaacaaccgcacttccgacaactgcggaggtgtcggcggcggcggcagaatgcgcacctccgcccgcgcatttgaccgcgtggatcgcggtgtgcacagcgctggtggcgcttttggtgattgcggaggtctgttattaattttggtcatttatccgctaaacccctattcctcaattaagcttgtgcgcgccggattcaaagtgcgcaaatttttgaaagaccgcgccttcaaaaaggggatgctgcgccgacatcgccagcgtgagtttctcgctattacattttagcaaattgtaattaacaatttgtacaggaatgagcgccgctagtcgcaaccgccagccggcaagcgcgccgactccgctgattttgccggctatattggccggcgtttctctgcgcccgacgggcgtcaatttgacggcggaccgggtgggcaattttaattaaattaaaatctttatatattttaatttctcactcattaaaattacaatttaaatttaaaggcagcggggcagagccgcgcggatggtgcaattgaggagggcgaagagcccgtgtacgatgaggtgccgcttgacagcgacatcgtggtcgagatgcgcgatgaagataatggggaggaggaggaggaagaagattacagcgatttttagtgattcggcaagcgatcactcaccatttaatcaatcgatcgatttttcactttaaaataaaatttaaaaaatgtttgaaaataggataactaaaataggaatttataaaaagctaaaaataggtacaacgaaggcatcagataaaattttaaatgaggatttagaagcatttgaaaaatgtgggtgggcgctcgcgctatataaataagtgcacgtgtcccaatcggcccatttaatcttttcaaacatttgaccgtcagtttttttgtcagcatcatgtcggataaaaaagcattgttcaagcgagttatcgcagaggtggacctcactataa

SEQ ID NO: 56684 - DNA, 697 bp, Heterodera glycines
  Genomic contig location: Contig_ID=SeqID_25915; Location=266..962; Strand=-
  SCN-specific regions: Sequence locations=1-147,169-178,200-221,246 -467,516-634,656-697
atgaagaattcactgctccacctgtacattttgggcatttggttgctcagtgcgctgatggcgtcgcccaatttgtgggtgtaccggcaaattctgtacgatttgatcagcggacaacaggtgggagagagagagagaagccgattgttaaatatttgaatttgctaccatttctcaattgtttggcattttgttttgtcaacataacgcccgagatttctttatttaaaataaaattcaaaatttcacgattttttcgttttttcttaacttgagattagagatcggtattttgataaaatacggttaagggtaagggttacgggcttgacaccaatacgggttacgggctagaaatccttaacccgtaaaaacccgtatcggccgaaaaaaatacgggttacgggcccgtaaaaacccgtatacgggtccggcccgtacccgaactctacttgagatattaagagtttattattgaaaatttttttaataaaaatgattttttttttttttttgtttataccactaaaaatgttttctttaaaaaagagatatgtatcaaaaataaaagccaaacttaacatttcttgatataattcgattttttttagttattttaacttcacgaaaaaagggataaatatttattttcattggcatttgaaaaatttaatatgttttaaattgattaaataaa

SEQ ID NO: 56685 - DNA, 356 bp, Heterodera glycines
  Genomic contig location: Contig_ID=SeqID_25919; Location=509..864; Strand=+
  SCN-specific regions: Sequence locations=1-286,311-356
atgccgcgttatttatttgcattttacggtggacgagcagtagccgaaccaaagggcacagagcgaagctcaactcggaaaaacgcactgctgcaacccgcagaggcccacaacgatgttgaggacgaagaacggagtccaaccgatgaaaaaggaagagaacacgacgatgagcacctcaaaggggccgactcattgccagcctaattaccccctaatactcaccctcgtcgccttttgttccgatgccaattccgccgtccgttttgccctcccccggcggactctgcgccggcggcgctgccgcgcgttcgccgtttgcgaatcgccgctgatacttccggttgattttcgca

SEQ ID NO: 56686 - DNA, 920 bp, Heterodera glycines
  Genomic contig location: Contig_ID=SeqID_5040; Location=196..1115; Strand=-
  SCN-specific regions: Sequence locations=1-100,122-391,413-695,717-920
atgccgcttccgctggtcaaagtgccgacaaagcgcacgctcaaagtagggatgggattttccgaggcaatattataggggaagtgtggacgaaaatggcaattattaaatatttttttatccaacagaaacgaccaatttgttaatttttgttaaaacgaaatttgttaaaaattttattgttatttctctaatctttcattcttttaaggtaccccaacattacccggaggcattccccgcaattcccaagctcaaattgacgttgtccggaaatcgacgtcggcacgtggcaaaaaaaattcggtgagtaaatcagggttttaaacaggggtcttgactgaaaattttcaagatcagcattttggcttaaaaatcagcatttcaaaattttattacaaaaatcaacaaaaatgttttttttgcggcgcacttctaaaaaatatatttttttttgtggaatttggagggggaggtgccgatagagactatacataccgtatttgctctaattatcccacatgggggattatttttcaacctcctcgtagactgggggattaagatagagggattattcttcaaacccctcctagactgggggataattggagattgggggattaatggagattgggggataattagagcaaatacggtatatggcaatttttgaggattttcaaaaaatcagcgaattttgaaaaatttttgcttggattttggtagaaattttacataaaaatgacgatttttgaggttttttaaaatctttacaggtgaacgcggagggcgaggcggacaaagcgattgtggccaaaaacaaggccggtccaggacaatcaagtgacccgtcagacatgatcatgctgccttcaacatcggatgcaccaagaaggtctcgtcggatcgcggcaaat

SEQ ID NO: 56687 - DNA, 1548 bp, Heterodera glycines
  Genomic contig location: Contig_ID=SeqID_5041; Location=195..1742; Strand=-
  SCN-specific regions: Sequence locations=1-172,195-365,387-406,428 -494,516-545,567-571,593-782,834-973,1016-1043,1065-1146,1171 -1211,1248-1548
tccgaggacaacacgttggtagaatggcacaatgaaatagacgcgcaaaggtcccgctcgttgtccgcccgacgtgacaaaaggccggaggccccaccaaaacctctggtgggtcaattataatttttggtttttaatgtgcgaaatatgtaacaacatttcatacctttttgaaattttaattacaaataaaacaagtttgatcatcaaaaattctgattttaaaactttctttgaaccaacaaattaagtgatcttgctatccctaattattttctaatttcactgcataatttcattatttaaaaaaagttattttgagcaattaaaaaactatcagcaccatattagatttccagaaaccttcatgatttttctctccctaaaattgggtttatggcgtttgttcattttttgtgattatttttgcgtcacaaaaattgagctgatcgatttgggtccactttctcgatgaaatacagtaacttttggaccatatgttagtaaagaaatgtcatgaagacaagcggtcttttttgtacttatttgttagaaagttttagatataagcttttttcaaaaacgttccaaaacattttaagaataatttgatgatcaagtcatgcattttgcccaacgatttttcgatcaatgtaaaaatcgtgacttaaccaaattaattccaggaatggagatgcacaaaatgtagtcacgagcctttttatacgcctcgtggactttctacgcacatgcgaatacacaagtagattagcagtaatcacttttaattgattataaatttttaattttacataaaaaataataattaatttcgaatagtggtgcaacacattcccccgtccgtcgtccatcgattcgcaccaccattgactttacggcggcatcacctgaaccagaagaggtgggtcatgatgccgtataaaaatatattgtcttgactcaaattaatccgaaaaaattgaaatttttttgattttttaattatttttttttaggtttttgaaagtttgatcacttttttctgatcagtttgttggtgagggccaaaaaaaggtcgagaatttatgatagaatacctccacaaaataaaagtggtttaaaagtgatttgaatatttactgtcagaaatgtttccttgttagaaataaattgattaaatgtttgctcaaaaaagttttgcaaataagtccaaaaaataaaattttaattttatcaatttttaaaaaggctcaatcatttagcgatatgcccccccccccctccctccttgggatagttgcggtcttatcttggagtcaaaatttaagaattagagtcttttttatgctttacaacaaaaaaaaaatgcaatttttagtaaaaaaacaaaaaaatattttacactttttcagcccaaagcagccgagccgcccaccgaagtgcctcaagaacgatgggtggacccattgccagaaaagttgcaatttcagcagcaggagaacaaatttgccgagctcaaatgcaaatactcgcgcgccaatgccaaag

SEQ ID NO: 56688 - DNA, 1268 bp, Heterodera glycines
  Genomic contig location: Contig_ID=SeqID_5041; Location=1944..3211; Strand=-
  SCN-specific regions: Sequence locations=1-194,283-547,587-604,635 -694,760-1058,1080-1268
atgcgatttttaggtaagaaaaatcccagaataggtacttaaataggtaaaaaaaaatctcaaaataggtattaaataggtacaaaaattccaaaataggtaccaaaataggtaaataaaattttttattaacgatttttagtggaaaaaagcaaacaaaaggggaaaattttggttctatttctttgtaaacgaataatttaaatatttttaatatgttcttagaaaatattgacattttaaattaaaaattttgttacataaaaaaacaaataaatttttgggaaaaattttccaattcttaggggtgtattttttgattttattgcatttttgttaaggaattttctgaaaatccttaaataggtataataggtagaaaaactccaaaataggtaaaaataggtattataaaagtcatcgtagacacccaaaaccaagtggaaaatgcttttttcgtgcttatctgtgcgtattaaatgcgcaaaattttaggtatttaactaaaaatcgcatccctaaattaatgcacaactaaattttattctcctttcctttcctttcttttcctttcctttccttccctattagtgaatcgattaggaataaaatttatattaaaatttattttttagcttttatttgttctgcaatatttgcttccttcaatggacaacaaaacacttactgtgggtataataattaaattttaatttaattgctttttttaatttatttaaatttttttaaaatttttttcttcatgctagcctgaccaacaacgggcaaagtggagaaaagaatatgcacacagaagtacgggccaccttttctgggaggtaactttttttaaagaattaataaattttatgaggatttaacaaattacttgatgaatttttttagggagcaaaacaccgaaaacgtaaccaaataacttaattttgggtcggggtcggtttagtacgggccgttttagtacgagcgcaactttttggctataacttttttctttgccaatcaaatccaacatttttagtatcgttcgatagctctaagtgtgctctattagcctgcaaaatttcgaaaaatctcgttaaggttcaaataagttatggccagaagaattaaaaaaaccagattatccaacttttttggctcgaactttttttaaacttaacaaaatttttcgaaattttgcaggctaatagagcatccgaagggctctcgaatgatatcaagaaagttggatttggataataaataaa

SEQ ID NO: 56689 - DNA, 270 bp, Heterodera glycines
  Genomic contig location: Contig_ID=SeqID_25920; Location=81..350; Strand=-
  SCN-specific regions: Sequence locations=1-270
atggacatggatgaggaagcggtggcagcggttgctgatgaggaggaggatctaacactgttgccagcactgacactaccagcagcagtgcgtgggaggagcacacatcgcccgttccagcgccgatggcatttggtgtcgtcgcggcggacgccgtcgcaagcgatgaacgccgtttgatcaacgcggccagccgctcgtcaagtgacagtggtgagcatttgatgggcgatgggggtaacgcagatgacgagttggaggagctcggcc

SEQ ID NO: 56690 - DNA, 861 bp, Heterodera glycines
  Genomic contig location: Contig_ID=SeqID_25920; Location=376..1236; Strand=+
  SCN-specific regions: Sequence locations=1-316,344-380,420-664,780-861
atggtggcgcccgcggaaacttcggcaaccgaagcgtcggaagcggccaaagcggcgctggaagtggcatggaaagaagacgaacaacaactgctgcagcgacggcacgctgacgacagtgcattgttgctgccagcaactggcggcggcggcgccgcaacaccaccactggtcggcttcggcacaggtatgccgtcatcagacgctgtggcgagtgcatatcaaacggcaacgacgactgaagtcgtggtgccaaagtcgtcgttggcggcggcaagaagtagtagggcaccgttgacgcagtttggtgggagacacaacaacaacagcaataacaacaacagaggctggccaacggcgtggaaccacagcggcgccgatggtggtggtgccgttggtggtggtggtggtggtcgtgggcgctatcaccattatcatccgcaacagaaacggttgtggaagaacaacaatagttggcaacggaataatcaacatcgcaacagcaacgaccagttcaatcagcagcagtcgcaaagttttggtggtggtggccaaaaccgtccatggttcaacaacaaccacaaccagcagcacggccagcaacacaaccggcatcagacgctgtcgttctcgtcaagtggtgcaacgccaacaacaagttactgtagcggcaacatgaacaacaccaccagcggctacggtagcggttttggcggcgtcaacagcagcagatacagaggagggcgacaacagcagcaacatgaacatccgctgcaacaatcacaaattgactacacccagcaacagcataaccaacgagccacatccagcagcacaacaacaaccatggacacaaaaatg

SEQ ID NO: 56691 - DNA, 666 bp, Heterodera glycines
  Genomic contig location: Contig_ID=SeqID_25921; Location=446..1111; Strand=+
  SCN-specific regions: Sequence locations=1-5,27-312,368-409,431 -584,606-666
atggctaataaatttttgcttgttccacaagaaatttaccgagggctaacctcagcgtcagatacgggagtcattaatttggatgcggtaaggtatgacctggaccgtgccaggcgtgaacggactaatccaacaacaaaaaatgtccggtacaatcaacagcttaggcgttatctgcaaatgagaagggagcttgccgatagacctacaaaagttgagttaaccaagggcttgagtgttttgctcaagcgagatgggggtgttgatgatgacgacggcgaagtcgtcaacactcagccacggcctcccgctccaccaccacctccaccaccacctcatcacccatctcaacaacaccaccgtcgccctcccagccttcccgatcagcaatcttcctcatctgacgatagtcatccgcctcatcctcctcgtccaccacgtcctcagagaacaaagaaaaaccatcaatcttctctgaaacatgatcgtttgaaccaatggcagcaaaggcgtcgtgacttacaacaacaacaacaaccggtagtacgtgatctcctcgctgaagcagcagctgctccgttacctgaaagtgacgatgacgatgaacaaatgttggaaggcgggtatctgctgccaacaccgtcacaaaattatggagacatacca

SEQ ID NO: 56692 - DNA, 555 bp, Heterodera glycines
  Genomic contig location: Contig_ID=SeqID_25922; Location=503..1057; Strand=-
  SCN-specific regions: Sequence locations=1-120,150-155,178-246,284-555
atggagaagatttgcttagttggttgtgctggtgagcatcactcattttgcgtttcacttcaatttcaacttaactcatacatattatatatttaacgcaaaaaaggaatactttttagcattaattaaataatgtatatttttttaaagttgacatttttctttaaacaatttttacaaattatgaaaagttattttccttatcatttcttaattgtaagaatgacttgcaaatctaaaaaagtgaatttttataaatttattaaatcacataaatatttttgacgttgaactcaaaaaaatatctaaaattcagcgatcatcggtttattaccatttaaaagttacgaaaatcgttataaaagaaaagaaaaattataaactaaatttctactttaagttcttaaattttttgtttaactgccagataccgcttatctgaaagaaataatttttattcatcctttccgtagaaatttttccatgtgaaaaatatgtaacagcaatataaagcttttcattagtatcgctcgttggttaatgtatggaaataaa

SEQ ID NO: 56693 - DNA, 894 bp, Heterodera glycines
  Genomic contig location: Contig_ID=SeqID_25923; Location=304..1197; Strand=+
  SCN-specific regions: Sequence locations=1-207,229-894
  Gene Ontology: Mol. function=ATP binding; Cellular component =cytoplasm; Biological process=protein kinase cascade
atgcgattagacgagcagatccctccggcgattatgagcttctgcagagagtcggtagtggtaagtgcacgttgtgataataaataaatacttcaatttttggttatttcgaatcacttacactttggctaaatttgattggttttacattatcaggttcctatggggaagtgttcaaagcccgtgatgtccggtaataaaggtcaattttataaaacattttcagtttcttacaattagctcgggagaatttgctgccataaaaatcgtcaaattggagacgggcgacaacttcgcagacattcagcaagaaattctcgtgctcaaagaatgcgtacatccaaacatcatttcgtattatggcagctatttgaagcgcgacagactttggattgtgatggaatattgcagtggcggctctctgcaggacatttacgaaagtcagcaatcaaaaactgactgtcaacacaccgtccccttccctttaagtgatcggacctttggcagaactgcaaatcgctttcatttgccgagagacattgcacggccttaaggtacggactcaactgcttgtcagtcgtccattataacatggtacaaattcagtatttgcaccaaagagggaagatccatcgcgacgttaaaggggcgaacatccttttgacgcacaatggcgacgtcaaattggcagactttggaatcgcggcacaaattactgcaacgattgggaaacggaagtcgttcatcggttcaccctattggatggcgccggaggttgcaaacgtcgaacgcagcggtggctacggctcggagtgcgacgtttgggctgtgggaattacggcgattgaactcgccgagctgaagccgccttattactatctcagtccgctccaa

SEQ ID NO: 56694 - DNA, 755 bp, Heterodera glycines
  Genomic contig location: Contig_ID=SeqID_25928; Location=1377..2131; Strand=+
  SCN-specific regions: Sequence locations=1-8,32-438,462-755
atggcgaaaaaagaagaaaaccaccaaaaacaaccaaatcattggggaggggagaaaagggcccgaaatggacgaacatttgcgagtaattgaccattgtgcggcaattgcggagcgagaagaataccaggcaggcagcaattgccgtaaattcggcatttttaattgcatttccatagagaggccattttggccatgtgcagcgacgacggcgacaacggcgcggggcccgccccgcacttccgcgtccgcgcgaaatggacgacaaaagtgcactgaagacattgacgcgaatgctgaaaaagcggaagaacaaagcactgtcctctgctgaccattggacaaatatcggcgtaaatccgttaattaattacgatcccgactttcccagccccgccgaagaatgacgtgcaatcctgatcattttctgatgtagcataaattctatgtttaattagtttatttttagttgattcgttggggacgacgcacaattcgcggcattcgaagacccgcaagtaattgtaattaatattagtgatttgcaattgctcctcgaatgatatgccccataaaaacgaaaattttatcttcagaaatcatactttcggacattcctacgaaaaacctaaatattcttattgtaacattttcagtacatggaaaaatattaagccttaaaaaaacaccgacaaaaagcaaaaaatggaaaagtcagcagaaaaaaagggagtaaaaacatacgacgacgaaga

SEQ ID NO: 56695 - DNA, 49 bp, Heterodera glycines
  Genomic contig location: Contig_ID=SeqID_25931; Location=196..244; Strand=-
  SCN-specific regions: Sequence locations=1-49
ggaagctattcccgaaggattcggtctccccataaatctgtgcgcatcg

SEQ ID NO: 56696 - DNA, 1208 bp, Heterodera glycines
  misc_feature (765)..(765): n is a, c, g, or t
  Genomic contig location: Contig_ID=SeqID_25932; Location=179..1386; Strand=-
  SCN-specific regions: Sequence locations=1-30,52-625,647-1208
atgcgtcgtgtgatgcaaaaccgggaaattgacccggtgttggagcatcatgttgggagtgacgaggaacaaacggacggagaggggcaggccgaacaaagtcagtccccatcaaaccgcctttttatctttgcgaatcaattgttagacgaagatttcgttgcaccaaatggtgaagttcaaaacgacgaagtgattgatgattttgacgatccgatggacgaattggttgcggaagagataattaactgtgcgttaaagcattttattcgggataattttgttatcagtaccgcaagatgaggtttgggacgacgaatttgagcagagtgagcatcagaatttgggtgaccttctcgaggtggaggatttggagaattcgatcggccgcatgcagaatttatatgctggttttgatgtaaaaaaacagtggaagcgtctctagattgattatgcaattttacagcatttaaacaccgttcaaaggaaacgggcaaaatccctcgccacaaaggtcattcattctttatttaattatgcatttaataattcaattggtcgttcgtagaacaatttttacgatgacacatttttcgcggaaggtaactaaacgcggatgatttgcctcctcgtccaatctcccaaatggactacgacgaaatcatcgccttccatcttcgcaagtcacgttggcaatgccttcctttaatttgactttttattttaaggtattggactgcctctgagcaagcaacttccacgttncagtgagcaccttcagaagtgggagatgaggatgacggaggtgctggaacaggaacatttgcaccgtgacttttgcactggcgcatatggagacgaactgctggagcgctttgggggggaaattggttctgaattggatttcactaaggtggattggaaaggattcattgtcagtgaaaggacaatgagaagacagttttcagatgttatcggaactgcccaatgattacgaccgaagtcgctttttgcttgtggctttgatattggccaatatgggcaacgtgcacattctcacggaagcgaatgatagcgagaaccaactcgtccgtttacaattactaactcttaagaggagagaattttctttctaatgaattctgtaacctgatttttttgatattaactgaggtaaacttatgtctttctttctttcgacgaataaa

SEQ ID NO: 56697 - DNA, 1026 bp, Heterodera glycines
  Genomic contig location: Contig_ID=SeqID_25934; Location=325..1350; Strand=+
  SCN-specific regions: Sequence locations=1-656,680-1026
atgttggatgcttttggcctcatggacgacgtcagaaagaaagtggccatgacattgaatgtgaataatgtcaaaaaggaagagtctgttgttgatgaaacactgagcagactcagggcgaagttccctaatgtcttttcgacaaatttgggccactgtaaaaaggcaaaagcgcgcctttccttaatggctgacgcaaagccagtgtattgcaggccacgtccggttccttacaacaccaagttggttgttgaagctgaattggaccgtcttttggctgcaaatgtcatccgtcctgttgaccacactcggtgggcagcaccaatcgtggttgtcaaaaaggcagctggttcggcacgtgtatgtgctgatttttcaacgggtcttaacaatgttttgctgtcgaatcagcacccgttgccagtgcctgaggacatttttgcgacactaaacggaggacatgttttctctcagatcgatttccgtgatgcgtatcatcaaatcgaattggaagaaggatcaaaagagttgtgtacgatcgcaacgcaccgtggtaattttgagtaccagcggttgccattcggagtgaagtccgctcctggcatttttcaatccattatggattcgatgttggcagattgtccatttgccattgcttatttagatgatgtcattattgtgagccggactcggaaggaacattggactcatttggcagaagttttcaaaagaattgacaattttggcttttggatcaagccagagaagtgttccttcggcaaggaacgaatcaaattcctcggattcatcattgataaggatggccgaaggcccgactcaaccaaaattgaggcaatccgaaggatgcccattccaaccaatgtgtccactctccgatcatttttgggaatggttaaccactaccaacaattcgtaaagaatttgcggttcattcgccacgttggacgaccttttgaagcaggacacggtctggaattggtccagcgaatgtcagaaagcctttga

SEQ ID NO: 56698 - DNA, 656 bp, Heterodera glycines; identical to SEQ ID NO: 53175
  Genomic contig location: Contig_ID=SeqID_25935; Location=125..780; Strand=+
  SCN-specific regions: Sequence locations=1-313,344-533,571-656

SEQ ID NO: 56699 - DNA, 195 bp, Heterodera glycines
  Genomic contig location: Contig_ID=SeqID_25935; Location=118..312; Strand=-
  SCN-specific regions: Sequence locations=1-195
aatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgactttc

SEQ ID NO: 56700 - DNA, 560 bp, Heterodera glycines
  Genomic contig location: Contig_ID=SeqID_5045; Location=442..1001; Strand=-
  SCN-specific regions: Sequence locations=1-560
atggtcatcacacgcagtccgattttgacacggcaacgagcgttgaatttggagattgccgttgacagaaatggacatcagattaatgtcggtggaaatcagcagaactcgctgcaacgccaaaatcacagtgctggagaaagttttccccaaaatcagcaaattgaaaactcgccaatctcacccactgaactcgcgggctttaatggggaaaatggtgatgacagttctcttgttttagaaccaaatatgaccgaagaggaattgcgcagacgcttgttggtggtcagcattgaacgtagccagccgccagccaacggaaatgccggaaatggagaaaacgccgaaggtttgcgaaacgcaatcagggaaaatgatggacgaccgaattttggagtaaatggtcaaacatttgcccaccaaaggaggccgcatgacactttcttatcaaatttgatgaataatggaataggaaactttcctcaaaatttggtccatgtaccgcgcacttctaccccaactcgaaatgttgaatttgaacagcaaataggaccattccc

SEQ ID NO: 56701 - DNA, 1272 bp, Heterodera glycines
  Genomic contig location: Contig_ID=SeqID_5045; Location=3921..5192; Strand=+
  SCN-specific regions: Sequence locations=1-116,158-217,240-395,461 -828,850-1182,1254-1272
atgtctgctctttcctataggacagaaattgatcggctgtcacttgcggttaacggtgcaaaaaattccgattagcatagcataagaagggtgacagaacttatacaaccccccccataaaaaaaatgaagattaatttatttaatattatttataagttctcctttattcgtacacaatcctaaaataagagattttaaattcaatttactacattaataattacatcaaaaataaataatttgttaagtgcatcatatacccctaataattgaaaatttttttcacaaaaactgtcccaaaagttatttatttatctttgagaaaaatttttgtgtccttattcgaaaaatcttcaaaaatttggaaaaattgaaattttcttggagtaattcatttaatttattgttgaaattattaattatttttttaattcattaatattttaaaaattaattttgttcattttttcttgtattaatgagtattctcgcaagatattcacatgcacagagtcatcaaatagtaacatgttttcttaattttttatagtattatttgttcagattctcacataaaagcaaattttcagaaattcgtgttttcgacctattgttcgaatttgggttcggggatcggaatatgcccaaataatttatgatcagcgaccttgaaaacccccggtgcataaaattgaaatcattgtatggaaattggtgataattaaaaaaaaaatttcaagaaaatcaacacattgaacttatatttgaaggaggcctattcataattttctcgcatatggtccaatgaaaaccaaaatgatcaagatttgatcaatcattacgtgcacttcaatatggaattgacatgaaaggcttcgaaaaaggaattaataatgaatatctatcaattcttattctataaagcacataaatttattttaatcagagcgcaaatgtctattttcgctgtacgacgcaaatgtcgcggcgcaaatgtcgtttttgttaggcggcgcaagtgtcgcggcgcaaatggcacggcgcaaatgtccgcggcgcaagagtcttttttgctgagcggcgcaagtgtcgcggcgcaaatggcgcggcgcaaatgtctgcggcgcaaaagtcggctaaccgaagccaatagtgactaatcatatggaataagacaacgaaaaatttttatatagtttttattgattatggatatttattaagataatttaaattgattatatatattttcacatatttagacaaaata

SEQ ID NO: 56702 - DNA, 63 bp, Heterodera glycines
  Genomic contig location: Contig_ID=SeqID_25941; Location=1169..1231; Strand=+
  SCN-specific regions: Sequence locations=1-63
atgcttgtcctggtgggttgcctgcacttggcccatgcattggagggcgctgtgccgcaccag

SEQ ID NO: 56703 - DNA, 126 bp, Heterodera glycines
  Genomic contig location: Contig_ID=SeqID_25943; Location=115..240; Strand=+
  SCN-specific regions: Sequence locations=1-126
gcccgacttcgtcccgcgtgacattccgccccgaatatgtccctccgccaccgtttggtccgctgaacgcgttcgacgcgattacaccgaacatttgcattatttgcgcgttcggttgcgccaaat

SEQ ID NO: 56704 - DNA, 1428 bp, Heterodera glycines
  Genomic contig location: Contig_ID=SeqID_25946; Location=322..1749; Strand=+
  SCN-specific regions: Sequence locations=1-239,262-1252,1288 -1320,1346-1428
ccaatcttttgaacatgtccctctccacggaccatctccgttttgcgcagtattcatccgtctctcaaaagagtccatcttcgatcgaacttcttcaacgtgccctggaggcttttgcggtagccaatcagtccaaatttgccaacagttcggcccattcggcaccgtccattgtcggcagccctttgatccctccgcctcttgcgcacagccaatcgcaacaattggccactaatggcgcaacagcagcagcaaccacaatgagcagtgtggagcaacagctggtcagaaaagggagggcattcattcagtaatcacagggggcaaatggcacattaggccagaagcagccaattagtgatgatttcgccttgagcatcgtcctccctgccccccgagggggctgctcagtaaatttgacaccggaaaaattggtttttaaaaattccatgaaatattttccgaatgaaaattataataatcagtcattcgtcggtgccaatcgaaccacgcgaagaaatttctgtttcggtgaccattccggagttgctctcctccctcaattcggcttttgccaaatgacttttgaagttcaattgccggggcggggaatgcttccgatttggccattcatctgcattttttagctgtctctgctcaacttttcccagctgagcagcaaaaatggcaacactttgtgctcctttgctcctcacaatttgctttcttccgatggcttttgcctttcctccgcgacgataacggcgacaacgacaacggcaccaacaatagtttctgaagcgacgcagcaaaataatgccatcgtcgacaaagtcaacgaacaaacggacgaagcattggcaaactccgcctccgcagctgctgacccatcggtgccgattgatctttcctccaaccaacagcagtcgcttctcctctcatccgcccccaatttggcaccgccctccgtccctcgggggcgcaaaagttgcgacattcgccgttcggcttcctccgtttcgtacaaaggaaacgcggatgtgcatgaacatttccaagtctgtggctgcttttggctgtttgcccccaatggactctaatttcagaggacattcagtggaaaatggccgcgtcgacagccatcgctgcgggcgcatttgcaggcgagcggaagggcatcggttgggaagaaggaagcggcactttgcattggagaaaatgaggcggagggaagcggaacagtgcggacggaagagccaatggaagaggaggaggaggagggcgaaagcgccgcacggaacggcgcggaacggacgaacgccgggggaaaaacgggggaaaagggacggcccaagagccggcagcaggtgaagagcgtgtacacagcagtgatccgcaagttgttcaccagcaacgaagtgaaccaag

SEQ ID NO: 56705 - DNA, 553 bp, Heterodera glycines
  Genomic contig location: Contig_ID=SeqID_25952; Location=413..965; Strand=-
  SCN-specific regions: Sequence locations=1-278,303-427,450-459,481-553
atggcgtcggatggccaagctttggccaaatggctgttcactgcccatccggacaatgtgccaaaggttttcgaatgctcgtggggcaggaataataaggacgacggggattggccgttcaaaattgctgacttcaaagcggtaaacttatcattaattaatgatgtcactcaacgaaatttcgtcactttctttaatcgtgcgaggatttttaagggcgaaaaagtccaaaataagggcgaaaataaggacgaaaagctttcaaatttaggggtatacttttttaaattgttctttttattatgaaaataatttcagattaaggcaggcaattttattcactgattgcagttacaaataagaaattttataattttcatgagtaaaagacaacacgactatcggccaaaaaattctggtgattgaattttaaagaaaatttttcatttcttaagggtcttttcctgaaaatgttttgttcgattcttaagggtatatttttcgaaattttttgggtcgcttcttacgtttttattgcatttttgttaataaa

SEQ ID NO: 56706 - DNA, 705 bp, Heterodera glycines
  Genomic contig location: Contig_ID=SeqID_25954; Location=607..1311; Strand=-
  SCN-specific regions: Sequence locations=1-75,107-136,169-317,340-705
atgtgtcaaagcgaagaaagaaactcaattggactgaagagcgaggaaatgtttccttccattgagaaggcacccgaagttgaacagaaactgaaggagcaggaggaaatcagcagacgggcgaagttggaagagcggaaacagcaggaggaaagggagagggaagagaagacgaaacggtgcttcgacgaacatattttgttaccaacaaaactattcagggaaaacgcttacaaagcgccgcggcgtacgatagatggagagagttcgcgaaagcaaatggacaaggagcgtaaacaattgcaggacacggagttgggccaattccgtttaatttttcaaaaacaaaaagttaaggccaacagaatcggacacgacttcaaattggagagacatgcaacgggccgtaccgaaagaagaaaaggataagtaagccatttgactctattcagaataaaacaataaattttaggccgcttaggggagttagcgccgctcatcaaacgaatgccaccaagtaagtaccgatttcaagtgtctgatagtaaataatctgcaacaaatttcaggtctaatgaaggggattcaaattggagaaccaaaccgactggaatgtaattgaaaattcgcgaatcattaaaagaagatccattatttaagcactagcacagcggattcccagaacagttggcgaaccatgtcaaa

SEQ ID NO: 56707 - DNA, 612 bp, Heterodera glycines
  Genomic contig location: Contig_ID=SeqID_25954; Location=1422..2033; Strand=-
  SCN-specific regions: Sequence locations=1-37,59-282,309-589
atgaccgatttggatgcgtttttcgcgaagaaggctagcaaaggaaaaaagaaaggagtgatcaaattggaggaaataagtgtgcaattggagcggagagcgatggtattttttaaaccctttatttcgaaattatcgcaaaataagagaaggtataaaataaacgatttcgaatatatcttcgaggctttttatcggttttcgttttcgccaacaaaacggaacatttttgaattcacctcgaagagagttcttaactctgaatcgtgattgcatttttcgttttaaaaattataaattttaatattcatttaggtcgaatatgcttgatgtttaatttttaattgttccaggaacaaagagatgagactcgatgataatgaaaataaatcgtcagttgaggacattagcaaaagccgacccgcgaacgagcacaacgaagactctgaacggttggcatttgacgacaagccgaacgtacctgtggtgataaaagagatggccgactcgtacgtcgaacgcgaagaagaggagaaaagagcgagcgccgaaccggcgaggacttggaaaacgaacagcgaagttggttttggaataagcaattttaaataa

SEQ ID NO: 56708 - DNA, 415 bp, Heterodera glycines
  Genomic contig location: Contig_ID=SeqID_25956; Location=853..1267; Strand=+
  SCN-specific regions: Sequence locations=1-61,83-415
atggggttggagacaaaccaaggtattaccaaaaggtgaggcgctccttcaacatcaattaattttctttcaaagtaaattccttcataaacaaatttttgtttcttgtaaattttgaagcttctccaaattttcaattcgggttgacaatcaaaatgcgtgtcaccaaaacatcgaaacggggcgaaatcagtgccaatttgaagccgagttgaggacgacgaaagaatggcaaaatatccatccaaatgtcgttgcaaatccatttaaaacatggcacttaatggtaggtaatatatagtgccaatggtaccccccccctttttttttgaaaaaatttttctctcgaaataatgatttttagggggttcgcagggccggagactccgattctggcatccattttgaagcataa

SEQ ID NO: 56709 - DNA, 219 bp, Heterodera glycines
  misc_feature (216)..(216): n is a, c, g, or t
  Genomic contig location: Contig_ID=SeqID_25957; Location=1621..1839; Strand=+
  SCN-specific regions: Sequence locations=1-94,116-219
atggacccatcaaatgaatgtggcaattcagctaatttagtaacgcctcgtttcttattcaattgttcgaattatgtttacatattaaggtctgttgcttttgcaacaaatccacgtctggtgctcaccattgtcgaaaatgctccaggccttgtcacgccattccaccatgctcactctcaagcgatggtgaagaaggatacggatcgaaggtcntct

SEQ ID NO: 56710 - DNA, 107 bp, Heterodera glycines
  Genomic contig location: Contig_ID=SeqID_25957; Location=1..107; Strand=-
  SCN-specific regions: Sequence locations=1-107
ataggtttttaataaattccatgtcgacgatttcttccgatcagttggacaaattggaaaatgtatttgaaatccgaaaacatttgaatgcttctgaacaaggacgt

SEQ ID NO: 56711 - DNA, 623 bp, Heterodera glycines
  Genomic contig location: Contig_ID=SeqID_25958; Location=629..1251; Strand=+
  SCN-specific regions: Sequence locations=1-71,93-169,199-266,289-623
atgtctgccaatgctgaattacagttcgtccgaatcaaaacaaaagcagggtcaacggaggctgaagtgacaattggaaatggacaacccctttcgattctggaggcgattgaacttctgcaaaaaaatttcaccgcatttgaaggcatctcgattaggtaaaaattggacagaaatgaattatgaaaatgaaaatattaagccatttcgatggtgatgtcctcactttgctccatcaccttcattcaaaacttgattgtcaccatgtaaatttggcaatagaaacttataacaccgatttttctgaacaaatattggacaccattttgccgttaatccaaggagttctaaaatctatcaaaatggatgccaaacatattgagaatttgacacaattggccccatcactgctatgtgaatgtcccctgcttcattcaatcgccacgaataaattttcgttggaatttacggccaaagacggtgccccgattgaaggacaagcattggcaaaatggctacacatagcgaacccggaaggactgcccaaaatgatcgacttttgctacaacgctaacggcctttggaccatcaacaagagtgaagaaatgaaagacgtgggttaa

SEQ ID NO: 56712 - DNA, 521 bp, Heterodera glycines
  Genomic contig location: Contig_ID=SeqID_25959; Location=2..522; Strand=+
  SCN-specific regions: Sequence locations=1-401,447-521
atgtggggcgtggcaaatcgatggatggataatgaagcaggttagtgccatgccgtcgatgaatgaatggccatgcaatgccaaaattgggcggggaaaggcgaatttgtggccaaattaaaatgtggggctgtggcaaaatcgatggatgataatgtgatcgctacagtgaggcagattagtgccatgtcgtggatgaatgaatggccacaatgccaaaattgggcgggaaaggcgaatttgtggccaaatccaacaattgagaggccaaatcgatggatggataatgtgactggcctccaaagtgaatttgtcatccccaattagaaattttgcaattgtacgttttttttctaataatcacagttaatctaggtatttctaaaattcgctgaattttgaaaaattaaatatcattattattattaatcaattttaaaattattcgcctcgggggattcaaattcaatgcatggccttttcaaaccgcagaaccaattcaatgataaaaacatttttta

SEQ ID NO: 56713 - DNA, 194 bp, Heterodera glycines
  Genomic contig location: Contig_ID=SeqID_25959; Location=994..1187; Strand=-
  SCN-specific regions: Sequence locations=1-56,84-94,124-194
gaagaagcgggacaaagcagcgacaacgaggcatcttctgaaaatgagtgacggacacaagaacaacgacaacaacaacaacagtgatcgccagaagaaatgaattaattaattaagaaatgatcgatcattatgtacattttaagtgatcaaatgtattttatgaggaacaattgcaaatacatatgtataga

SEQ ID NO: 56714 - DNA, 137 bp, Heterodera glycines
  Genomic contig location: Contig_ID=SeqID_25961; Location=1633..1769; Strand=-
  SCN-specific regions: Sequence locations=1-42,64-137
aaggggtatataaaaggagtggaaggaccatttgattggtacattgtatcaaaaatgcaaaaaccgataatcgtaaatataattgctctcgctaatctcggtaccggaattaaactaaactctctgacgatcaccga

SEQ ID NO: 56715 - DNA, 426 bp, Heterodera glycines
  Genomic contig location: Contig_ID=SeqID_5049; Location=6..431; Strand=-
  SCN-specific regions: Sequence locations=1-426
atggacaaaactctcgccgatattttggaaaaactcacccaggcaataaagcaacaaaatgcgccctccacaacacaaacagcacagaacatcacattacctgacattcagacattttctccaaacagtgctgaagaattcgaggagtggctggaacgtttccaatttgctttggattgtgctgcctcaaatttggacgatgaacagaaggtcaaattgttgatgaccaaattgtctccgacggcgttcagcgagtacaagcgcttttgtctaccggacgaaatcacgaaattcaattttgcggacacaaaatcccgactgctaaaattattctcgcatccgccatcattggcaatcgaccgatacgaatgtcttaaggcatgcagagagggaggcgaagaatttggcgcgtttgtgaaccgttaa
